United States Patent 7,745,391 (HUMAN THROMBOSPONDIN POLYPEPTIDE) - sequence listing, part 59

SEQ ID NO: 192888 - DNA, 378 bp, Homo sapiens
gagttctaggtgaaaggtcgcaggagcagctccagagtttaaagagttttcacttgttcctgacgctcaattctagagtaataatggagtgtttaaaaaatgatttccaaattagaaactaaaccgatcttaaaacatgggtatctttgggggatttttttttcaccttaaaaaattgtgttaaaatacgtacaaaatctgccatcttaaccgttttttaagtgtacacttcagtagtgttaagtagattcatatcgttgtgcagtcaatctccagaacttttttcatctgcaagctgaaactctatccatgaaacaactcctcttccccacctccgctcgtacattggcaaccaccattctactttctggtttatgt

SEQ ID NO: 192889 - DNA, 471 bp, Homo sapiens
cccaggagctccaggctgccgtgtgtaacagtcgtgcctgtgaatagccactgcattccagcctgggcaatgccagcaagaccccatctctaaaaaacaaaaacaatgtttgctgaaagaatgtttgcttgtcggagagatacagtaactacttgttctaactttggagaaaggacacttcgggtttcatgtcaggaaggagtgagtcagactgtggtctggaagggaacccaaaagcaggagttgaagaaaatgtgttggccaggaagccgcggcctggagatactcctctgctacttgtgggtgttgtgaactcagctgggagcctcgggtctcacatctgtgaagtgggtatcaaagcgttgtgaggctaacatgagattttgtgtgagccttctgtaaactgtaaagtaaggtgcccacccaagaaattttcctggaaggcagaataaaatgaaaagtgtgatataa

SEQ ID NO: 192890 - DNA, 394 bp, Homo sapiens
tggccccctgagaggaaggactaggaaagattctggtgcacaggcattcacagcagcaccagtcacaatggccaaaaggtaggaacagcccaagtgcccatcaggagatgacaaataacacgaggggcgcctccatgcaggggatattgttgagccgtgaagaggaatgccactcctgtgaactcaacttgctctgaaaagtaaagtctattcaaaatgaaagtgcggcgggaaggaaggaaattctgactcaggctctaacgtaaatgaactttgaagacacgatgctaagtgaaagtagccagatgcatgattccggttaaataaagtgcctagagcaggcggattcacagagacagacagtacgttagcgcttaccaggggctgggggacg

SEQ ID NO: 192891 - DNA, 575 bp, Homo sapiens
cagaaagcaggatcctatccaagagagctccatgctcctggaggtgagattctgtatgctccttcagtagaaggccacagactgaataatcaattgagaatcgcatatcttttagtttcccaaaaaagaaaaatttttaaagtatttttatccatgttaagagtaacagctactcaggaggctgaggcaggagaatcgcttcaacccaggaggtggaggttacagtgagtggagattgcaccactgccctccagcctgggcaacagagcgagactccatctcaaaaagtaaacaaaaatggctgggtgcggtggctcacccctgtaatcccagcattttgggaggctgaggcgggcggatgatctgaggtcgggagtttgagaccagcatgaccaacacggagaaaccccgtctctactaaaaatagaaaattaggcgggcgtggtggcgcatgcctgtaatcccagctacttgtgaggctgaggcaggagaatcgcttgaacctgggaggtggaggttacggtgagccgagatcgcgccattgcattccagcctgggcaacaagagtgaaaaac

SEQ ID NO: 192892 - DNA, 302 bp, Homo sapiens
tatatgtgtggaaagggcctgaggtgttgctgtgcacaggtaggacattgctgatagatgagtactatatctttatatcatagtggtagtcctcaattttcactatgtcccaaaaggtatgtggtccccaatgtcctgtctttttatgtagccagtaagccacatcttttgtgggcacttccttgaggaggagaatgtaggctaggcttgtctacctgttgatttccaggtggtgtagatgcaatgtgggcatccacatggtagactgttacatgcatcctctggatgcatggagaacgtca

SEQ ID NO: 192893 - DNA, 784 bp, Homo sapiens
attgatctccggtgttggaagtggggctaactgggaagtgtttgggtcatgggggcagatcccttatgactggcttggtgctgtcctaggtaatgagtgaattcttgctctatcggttcccagggagatctggttgttcaaaaagaatctgggatatccctcctctctttcttgctccttctgttgccatgtgacacactggctccccttccccttgtgccgtgattgaaagcttcctgaggccctcatcggaagcagatgctggtgccatgtttcttatatggcctgcagaaccatgagccaaataaaattcttttctttataaattagccagtttgaggtattcctttatagcaacgcaaaatggactaatacactaatatctcacacattttctgtccttacaactttttggatggttaatcaagataatgtgcataaagaactacataatgctatgtagtaggcactaaaagacactggcttcttctatcttacctaagaacaaacttgagattataaaaaaatgaaaagttaaaatctctttcttgcaagtttcatttttcctttaaaaaattttaaaagtatatctaaatgccacctcctgtctgctttctcatctctggaagatgggaaatcttccagagatgagaaatgtccatgatactcctcctttgcactcatagtaccttggaacattcttctttcaagcagctcatcattcagtattttaattgtgcagtacaatgcctggcacataattgatcctcaataaatatttgtt

SEQ ID NO: 192894 - DNA, 354 bp, Homo sapiens
aaattgagcttcagagaagtttgttatcttaccagcagtcatacagcaaggaagtgctgaatgaagctgggacctagctggatttgagaatacatatgcatgccaggaaaatcttggaggaagtacgctggaactatgtcttaataaagggaaggatattccaagaaagggaacagattttaaaacgttcagaggcaaaacaacacacatagcaagtagcaagtagcttgcagtggtggagtaagaagaaatagggagaaaatgagaagagacaagcagataaataccttattaaagtacagatctgatcgtatcactgtcttgttccctctcacctaccaaataaactgtaac

SEQ ID NO: 192895 - DNA, 371 bp, Homo sapiens
taattttcccgttccacccagacccctctggggcgcgaggaaggtccccaggctgcgggtcccgcgccggcccggccgcgcttctaaggcaggactgccgcgtgtcggtcacggtgtcgcgtattctccgcgggacggacgtgtcttcaggtccaacccgcccggtgggaagcgcagacactgattttccagaaaaagtcctccttccgtttcccgcactggtaggaaagctggggagagagaaggagtctcaccgtcctggaccagtcggaaccacagaggccgctccgggtccgggggcgacttccgagtgggggaaggaggccggagggcgcgcggccgagcccagacccagcagagcgcgcggccgc

SEQ ID NO: 192896 - DNA, 595 bp, Homo sapiens
gtgtcaaagaaaataaaacagaaatacctgtaaataaagatgagtatctatcaattataccatgataaagctgggtgggagggagattattactgtaaaacttgtttgaaggggaaaaaattaaccaaagcattatcaataaacgactaaaaagctgaaacgtaaggatcactttgggaaatgaagcaaaatcaaacaccaggaaacaaggcatgaaaagaaaaggattaagggaacagatgagttgatgacaaaaaagttacaaagaccaggaggaaaaagaaatatgagaattaccgattgtaataaagaaaaagaaaaagactgacaagcataggaaaaaaaatgacgtttttatggctgcttgatgatagttcagtccattgtcaacctaactagaatcaatcagaaagccgatcctcagaagcaaatgagtgaagaggcctctgggtaaaggctgagagtactggttgatgggcatcactgttaccactgttctcacctaacttgagaagattgtgatactagctccccaaatgctcctgttaatggcatgtaccctactcttagcaggtctcacattctgtgcaaaaac

SEQ ID NO: 192897 - DNA, 295 bp, Homo sapiens
gtattttaaaatcatctgaaatgattcttctctgattggggaaaccaggaggtggctaatctttacttaaaggccagatcacctaggtaaaaaatgagatatcctcttgaaagcaacaaggacaaagttgttcagcatgcgtaaacctgagtgtcatgattggtttgtctggtctggtcaggatacacatgcactccgcatcccccttgccatctcaggtccaggccaacattgtctctcacctgacaactgtcacagcttccaaaatggtctccctgctcccactctaccctgt

SEQ ID NO: 192898 - DNA, 520 bp, Homo sapiens
taagggtctgtgactgtttttttccctcatagccatgacacatggtgactggcacatagcatatgctcagaaattaaatgccaactgaagtaaaatgatgaagatttaagatgaaatgaaaatttaattttatcattttcatatctgtgcgcacatgctctttagctcctcaattccttcaaattcttatacaattcactcaggaaaacattctttttatcttcattctttcttcaacacatccataaacttcatttttttttttttttttttttttttgagacagtctcgctctgtcacccaggtgcatctcaaaaaagaaaaaaaagaaaaatacatatatctatctatagatatagatatctgtctcgttcttacatctcttttgatgtagcaacagctttacaaatgaaacttcatgattccccaagtaatctacaaagttatttcaaaagctgcattcactgattctttggccatcgctactacaattttagaattgctgggactcaggtgtgtg

SEQ ID NO: 192899 - DNA, 441 bp, Homo sapiens
cttattccctccggtgtcatcccctctggagaatgtaacacgcaaggtgccattttggaagcaggagcagccgtcattagacacagaatttgctagtgccttgatcttggacttcccagcctccagaactatgagaataaattgctgttatttataaactatccagtcttacaattggtgtctctagaccattcacatttaatatgattctttctctgccttctgttaattattagaaaggtgaaggggagtatttactggcacagcgctcttcattctctccattttcattacaaaagcaggccttgcaatattgatttcattatatgcattatttgccaaattttaaatgtgtcctaattacataataacatgtactgctgttagtcttccccatagatgtcattcttcttgcgcttcatttcctcaaagtcaaactct

SEQ ID NO: 192900 - DNA, 448 bp, Homo sapiens
acgacacccaactaattttttaattttttgtagagatggggtcttgccatgttgcccaggctggtctcaaaactcctgggtcaagcagtccaccttccccagactcccaaagtgctgggattacaagtatgagccactgcacctggcccaagggtcttgctttttaaatccagtcttacaattggtgtctctagaccattcacatttaatatgattctttctctgccttctgttaattattagaaaggtgaaggggagtatttactggcacagcgctcttcattctctccattttcattacaaaagcaggccttgcaatattgatttcattatatgcattatttgccaaattttaaatgtgtcctaattacataataacatgtactgctgttagtcttccccatagatgtcattcttcttgcgcttcatttcctcaaagtcaaactct

SEQ ID NO: 192901 - DNA, 409 bp, Homo sapiens
gtaagatgtggcactacagaagaaaagattaaggatcttgaagacatagcaatagcaattgttcaaaatgaaacacctagagggaaaaaaagactggaaaaacaagcagtgtcactgtgagctgtgagacaactttagatgatcaaatatataaagactacggatggggcagggagacagaaaaaatatttgaagacataagggctgaaatttttccaaatttgataataactgtaaacccacaaatccaaaaagctcaacaaaccaaaagcagaagaaacactgaaaagctacaccaaggaacataatcaaattgcataagatcagtaataaagaaaaaaaacttaaagtagctaggtttctaaaaacaacaacaacaacaacaaaaatgcattacatacagtgaaat

SEQ ID NO: 192902 - DNA, 440 bp, Homo sapiens
tgagaaggagtctcgttcttttgcccaggctggagtgcaatggcgtgatctcggctcactgcaacctctgcctcccgggttcaagtgattctcctgcctcagcctccccagtagctgggactacaggtgcctgccaccatgtccggctaatttttttatttttagtagagatggggtttcaccatgttggccaagctggttttgagagcgaccactcctcatattgtcttacacttaatttcttgtttgctgaaaaagtggaggttgaaagaatgggcagaagtgaaaatcacgctcagacaactgggtgccacatttcgggcctggttgttaaaattcaaccgctgacctcaccgattgtgctgtctataaattccagacattgtataaaaaagcattatgaaattcccttttctgtcctgtttcattctgattaccag

SEQ ID NO: 192903 - DNA, 514 bp, Homo sapiens
tagtgtggtagcagcctggttcacatgaataggactttcacggagtagctccgtttccaggtgtgacttcggagcccagcatgcctagtttcatgccacagtgacccaagtgagtcaccccgtctgctccagtcccctgtccccaattccctgtcatctcagccacccattttcattttgaaaatcaatctcatggaagtttctatttgcttttattgctttctttgttttcttgtctatttcctagtactcatacgtgccattaaaaaggtgactggaaaaacagctcttaaaactgcaagagaaatagtatatagggttttgtgtaataaaaaatactgcaactttccaatactgataaatgtggacccttggtaggattgtatagttttttcatgtgaaatatgaaattcaggatttctcataaatttaggattgctttgtaaaaatccttcactgttggtaggaagtagtttatattaataagtaaaaaaaacaaaaagtcaataagaaa

SEQ ID NO: 192904 - DNA, 583 bp, Homo sapiens
tgctgggattacaggcgtgagccaccgcacctggcccttggtgaatttttctaaggtgggctctgtaacaatatcattgggttaggaggtggggcttagacactggaccaaattgaagactagctaaaacagggcctggagagaagcagctttctataaaacatgcccaccagtgtgccacatcagtttaccattgccttggcaacacccaggagttaccacccctttccacagcaatgatctcacagcccaaaaggtactacccattctctagaaatttctgtataaactgcctcttaatctgagtacagattatgagtacaaaatatgagtacaaaactgtcctcagctgctactggcagcacacggcctatggggcagtcctacctcacgagaccagtcacagagctgtaacgctgccacctccataaagctgccttcttcagccctaccaccagctcgcctttgaattccctcctggctgaagcccagagcccttgccagctaagccctcctttggggctcgcctgccctgcagcatcatgaaggcctctgaggaatgccattaagctgacttcattca

SEQ ID NO: 192905 - DNA, 359 bp, Homo sapiens
ggctgtgtgacgtgttaactaacctgtgatggtcagtttgacgtgttttggctgtgtgacgtgtaaactaacctgtgatcgtcagtttgacgtgttaacttggctgtgtgacacgttaactaacctgtgatggtcagtttgacgtgttttggctgtgtgacgtgttaactaacctgtgatggtcagtttgacgtgttaacttggctgtgtgacgtgttaactaacctgtgacggtcagtttgacgtgttaacttggctgtgtgacgtgttaacttggctgtgtgacgtgttaactaacctgtgacggtcagtttgacgtgttaacttacttggctgtgtgacgtgttaactaacctgtg

SEQ ID NO: 192906 - DNA, 194 bp, Homo sapiens
gccttgatccacatgttcttctttgatgggtatttagcatcccctgccttgatccacgtgttcttctttgaagggtatttgatggatatttagcatccagtaccttgatccacgtgttcttctttgaagggtatttgatgggtatttagcatccagtaccttgatccacatgttcttctttgatgggtatttga

SEQ ID NO: 192907 - DNA, 439 bp, Homo sapiens
gtgttggcttagattagcagggcctttgatggaggggcatgtatgtgtttgggtttgctgtgccaggcaggggagcagtggaatttgtctgaattgagctcacacattgaagttattgagcgacttacatgcaaggccatgacctggactcccagccgagaggcccacgtggcggggcttgagctgggggagccgaggacagcttacatctgctcatctgcttacgtaaccctgcctcccagcttccagagccaagaaaacacacaagccagcccagcggggccgagagcctgtggtagcacacgccatgcgccgcacagcaagggcgccttggctcggcttgaggcctgtcatgaagccctcagccctctgcctcctcccagagcttctccccaccaccccaggcagtggctctgaaacctggtcgcaggtctgcatg

SEQ ID NO: 192908 - DNA, 220 bp, Homo sapiens
agacatgaagaaaactatgtggggttctgtagtggacccacacagctcagaagtaggacgccagtccaaaccaagacattaaagacttgttgcaaattattgaattttgcataatcatcttatgtaatttgcctaatggtccttagcaagcccattagtcttttaaccataaatttcacgtctgttttaatttccagatttccattggtagtacttagaa

SEQ ID NO: 192909 - DNA, 251 bp, Homo sapiens
aggtaacgggaacagagtttgagttttgcaaaatgaacaaatttccctatgaatgtggatgatggttgtagaacaatgtgagtatgattaattcctctgtcctgcacttttaaaaattgttaaaatggttaattttatgtatattttaccacaatgtaaaaaaggacttttttaaatgaacaaactgtagatatctgtaacagcataaatatcacaaatataatattgcattaaaaattgatgtaaaagta

SEQ ID NO: 192910 - DNA, 365 bp, Homo sapiens
cacaacacccggacaagatactaacttttctgcagtggtttgggaccaaacccacaatatatccagtgtatgtctgtacttcaaataggccgagagttaactgtctacagtctgctaagtagtcacgtaagcatgtgtgccttggaagatacgggttagtgaatgctgaagcccttattcttacaaggaatgcagagcattttcaaactaaatagttctcaccctggcccactatttacttttttagtcatatccccaggttccttcccagttcgtaacctatgcttcagtcagactgaacaattggttgttttccaaacacatcacagtatttcctaccttgatactcattgtccggggttgtt

SEQ ID NO: 192911 - DNA, 597 bp, Homo sapiens
tccctcccaagtccgcgtgcctgcccagccccatctaaacgcggggtacggagctcgcaggtctctcttaatctgaaacctgttcctatgaagtgtaagatgaaggaaaatggaacctatcagatgggtctgaaatgatcccactaaaaatcccttaaatacagaatccgctcatttcttctattccgtgctccagtcacagtacacctacaacctgaaggaaactgtactattaacacaaggaaaaaacgacccagtctacacaccagctttgtccaaaaccctctacaacagctaataaaatacacacgcagccaggcgggcctacacctggggccagacagtcccgggagccatgggcagggagtccctgagcctggggcgcaggagtgccctggggtcagcgggcaggacactgcctccagtgcctgtggctagtgcagggatgtaactttacagcgatgtctcagacatggacagaggaaaaaagtgaggctggcactgggtggcaaagctcacaatttcagccgcagcagcagcaacaatacattgcctctaactaaggcagtgtcgatcctgaaaaaaaaaaaaaatcca

SEQ ID NO: 192912 - DNA, 443 bp, Homo sapiens
ggatttggaagattacctcattactcatcctttggctgtggattctgggcctttacgggatttgattgaatttcctccagatgatattgaagttgtttatagtcctcgggactgcagaactcttgtttcagctgtacctgaagaaagtgaaatggatccacatgttagagactgtataagaagttatacagaagactgggcaattgtcatcagaaaatatcataaattgggaacaggatttaatcccaatacattagataaacagaaagaaaggcaaaaaggtttgccaaaacaagtttttgaatctgatgaagctccagatggcaacagctaccaggatgatcaagatgaccttaaaagacgttcaatgtcaatagatgataccccaaggggtagctgggcctgtagtatctttgacttgaaaaattcacttcctgatgctt

SEQ ID NO: 192913 - DNA, 605 bp, Homo sapiens
tgattataacccggatcacggctttacgggcagaagaatgcaacaagagatgaagctttgtcgtaataagccactgtagttgggctatctattatcacaagaaaatggataacagcactttggcagatcacaaattcaggagatctagaccatcctggctaatatggtgaaacccagtctctactaaaaatacaaaaaaattagctgggcgtggtggcatgcgcacgtagtcccagctacttaggaggctgaggcaggagaattgcttgaacctgggaggcagaggttgcagtgagccaagatcctgccactgcactccagcctggccaatgtggtgaaaccctgtctctactaaaaatacaggcatctactaatcagagaagcagggtggggtctcctgaaaagagcatggcctttgggatttaaaaggcctggattcaatcactcttctacttactggttgtgtgactttgacaaaccacttcacctctctgtgccacagtttctatcttctctgtaaattgaggataaccaggccaacctcgggcatggtggcacatgcctgtaattccagctactccagaagctgaggcatgagaatctct

SEQ ID NO: 192914 - DNA, 145 bp, Homo sapiens
tgagaagggacaatacagtagattataaccttccccaaatggcttaacattgttcggacaaaagactatcttgtcttttttttgcacctaaataggcataggatttacacgtgtgtgtgtgtgtgtgtgtgtgtgtgtgtgtaaa

SEQ ID NO: 192915 - DNA, 350 bp, Homo sapiens
tcaacccacaatcctatattcagttaattaattgtgaatgaagaacatgctagtttagaatgtatggtatcacattttccatttactcaccctttcacagaaagctacagcagaatatgttcaagcaaaacgaaggtgtaaattaagaaagaggaagacaagaaatctaaaccaagacagaagcaactgtgcagaagggcaactgaacagcaagtccagaatggagtgggagcatggagggctccagagagatgacttcatgaaaaaaaatggaattgatataattttatttgtgttaccgagtggaaagtggtatcatgagatgtttttacagggctgttggaggggag

SEQ ID NO: 192916 - DNA, 208 bp, Homo sapiens
cccatttttgacagcaagatgagtaccaaaactgtagattcatttaaaataattttcttaatttgtctttagtatccctttgttttacaaagcacatacttttaaaaattagcaagataagtcttgttgccaagatgtagaattttgccagaaaaattattttgattaaaattaattattttgaaaatttcttgcttaataaggaaca

SEQ ID NO: 192917 - DNA, 649 bp, Homo sapiens
aggagactgatcctactgttatatcatagatggaaaaatccattagccactcaggatgtgtctgatactccttttttttgggtttcaagagtaaagtcaagaaaagctgcttttggaaagtcaaagaatcacagtagtggttatttcttagtgcttactatttgctacatgcttcacatacgtggtctcatttaatcttcccaaacaatttggccataatattattacaaccatgttgaatctgccaataataataataataataataatttgtttcttaaatatagtctgctgcataagcgtcccctggaacactttaagtaactctgacacccagatcatatctcagttcaattctctttggggtgggctgatgaatcagtattttaataaactctacatgaaatttttatgaaggctgaagtttcaaagccagttgtagcaataaatgcaagggaagcacagaaaaagagttgaggaacataaatacagctaagaaccacgtgggggcagaagataaggaattgaaccatttctaactggagttactgatgagagacagagaaggagcctaggcaatcactgcaaaatatagtggctgtagatttttcattttgaaggaaaatataaacagattgaagagagataa

SEQ ID NO: 192918 - DNA, 767 bp, Homo sapiens
aattgtggtagatacgtatggctattggagttgtcattgctcataggcttcctcagtgaacagagcagaaaaatacagctagatggataaatatacaaacatacatgcttatattcatccatatttctatattagaatatactgaaaaccatgagttcttcctggtgattctaattccagttgaatcacacatggctcattttagtttttttttccctttcagtactcttgacctttgaacaatgtggaagttagaggggctgaaccccacacagccgaaaatttgcctaaattttgacttccctgtaatgtaactgctgactgacctgattaactattgttgaccagaaaccttacccataacaaagttgattaatatatatgctgtatattctatgtattatacactatattcttataaaagtaagctagaattgccttagctattccagctgttttggggttcgatataaattttaaaatagtttatcctaattctgtgaagaatgtcattggtggtttggtagctgacttcaaactatactacaaacctgcagtaacagaaatagcatggtactgttacaacagcagacacatataccaatggaacagaatagagagctaagaaataatgcagcacacctacaaccatccaaccttcaacaactccacttaaaaaaagcaatggggaaagcaatgggactgctggatcaaatggcaattctaagttctttgagaaatcgccaaactgctttccacaatgacta

SEQ ID NO: 192919 - DNA, 557 bp, Homo sapiens
tgttcaagcaattctcctgcctcagcctcccaagtagctgggactacaggtgtgcgccaccacgtacctggctaatttttgtatttttagtagagatgggcatgagcctgtaatcctggaaggttctattatgatccccactttatggatgacaaaacaggcacaaagaggttgtttgtcctttccttttatctccgcctgtcgttcatctccatgcttcctttagtttatccaaactcttaaaactacaattaaaaaaaaagacagtatgcccttcagtttggtttaaggaaccccattaaaaaacacaaaccaagactaatttatgaaaagcttatattcccagaaatacaaaataaaattttcaaactagaatcaggtttattatgctacatgatacaatgttggcactggcaggggtcttaaaaatcatcaattccggtcatatttactaatctgaaaggggaagtgatctgccaaaaatcccattattaactaatgggaactccggaactccttactttttttcttctttttttttgagatggagtctcgct

SEQ ID NO: 192920 - DNA, 552 bp, Homo sapiens
attttctcaaaggagagaatatttgaaaagaacgtacagtactcccttggtatccataggggaatgattccaggacctccctcagatatcgaaatcctcaagtccttgatataaaatggtgcagtatttgcatataacccatgcacaccctcctgtgtactttaaatcatctctgggttacttataataccgattacaacatagaagctatgtaaatagttgttatactgtattgttcaggaaataatggcaggaaaaaattctgttcatgttcagtacacatgcaatttttccccccaatatttttgatttgcaattggttgaaacaacaaattcaaaacctatggacatggagggccgactgtataacatttcatctaagagaaaaatgtacccaggatgaagttatccatggattcatcaacaaacataagcaagacccagaggtgttgaaaatgcaagggcttgagtgataaaggcggctttcataaaggtggctgagtcacacagaagagcctgggggcgggaggcaaaggtgagcaggaagggcca

SEQ ID NO: 192921 - DNA, 403 bp, Homo sapiens
cagggttcccattgattccacattatgatgagttgtataattatatcattatatattacaatgtaataatagaaataaagtgcagaataaacataatgcgtttgaatcatcctgaaaccatccccccacccccaggctgtggaaacattgtcttccacaaaactggtccctggtgccaaaaaggttgaggaccgctgtcctactgcactacagtcatcatcttgggtagatacttatctcctgattcacagggcctgacactgagtaggtacttggtacctgtttgttattgccagctataaataaaatagctttcccttccattgacatatgaccagagttttaaaaggtaatgatttcaaataactatatgttagattccgtttttcattcataagggaaa

SEQ ID NO: 192922 - DNA, 470 bp, Homo sapiens
gtacttatgaaaacaaaacaagctaaatataacaaggcatcgtattaatggtattattactgcatcagaaaattgtggaacaaacttatttggtcaaattcatatcttaactatagaaatttaattccaagtaaggcctgaaaaagtgaaatggacatttcttaccttatcctactcttctgttcactatagaccagtaagatttacatttctaaaaaagcattgcatttcaagagataaagccatggagttacaggaccatccaaaagctttacaccctgagataagttacaaaaaagagaaatctcatggtttgatttttttaaatccaagaaagaaatatgcagttttaaaaatcaaagtttattaaactgcatccaatcagaaatactgaccgtgggctgggcgcagtggcttacatgtataagcccagcactttggggggccaaggtgggaggatcgcttgagct

SEQ ID NO: 192923 - DNA, 416 bp, Homo sapiens
ataaagcaataatgtccctttctccccaccactaccccaggctaagaagagacagtatgttctgtggtttagataaatatcacagagattaaagagaacagagtcttttcagaagtgatacaagtaacagaaatgtgatcagattggtgctactgaggcccttggcctagacaggagacagacatttccgccaaagaccattgccgagtatggctccacaagaaccccttttcagtagagaagtgcctgcattttcagcttttcaactaccatgttagtccggctcttgcgtgcttgttagtctaggtgtgtgtgtacgggatgtttgagtcagtaacttgtcacaaatttatttatgataaaataagaaagcaaaaatgcaaacaagtttggctatttttaaaatcagctggaaa

SEQ ID NO: 192924 - DNA, 236 bp, Homo sapiens
gagcactattgtgtgccagccctggctgtagtgatgacctctgctattcctcactccaatcctgagtttggcacttggatcagccctgttctgcagatgcaaaaactgaggcccagggtcacatggttaagaagaggtggagctggcattcaagagtaggctgcttgacccagaatccaggctcttaccattccccagccacccctctgtccatccacggtgctgtgcggccaaag

SEQ ID NO: 192925 - DNA, 346 bp, Homo sapiens
ttataggggagaaggtaggtatacactgtcatatcaacctaacttgtcctgaggcctccttatggtattaacacagagagagagaagagccttgaaatactgagacattcttttagagtgtgagtgattttgttattgttatttaaatcttgatatcacctcctatagtttttgaaagacatcactcttcaagttgtcttcaatggcacaaactatacctgtgcattttctgaaacaagtttgaccataccagcaaaggcaatgaaaatgctttgtctttcagcatgaaatgtgaagtctacattattagtgggtatatatggcccaagggaagaaaatgttgaag

SEQ ID NO: 192926 - DNA, 300 bp, Homo sapiens
gatccttcctttcccctcccagcttcttgtagccacgggtgttctgtgactgtggcagcatcattccagtctctgtctccattgtcccatggccgtcttccttctgtgtctgtgtctaaattttcttcttcttgtaaggacatattggattaaggtcatattggattaaggacacaccctactccagtgtgaccttatcttaactttaattacatctgcaacgaccccattcccaatgacctcatgttctgaggtaccaggggttaggacttcagcatgtattttgagggaacacagttc

SEQ ID NO: 192927 - DNA, 232 bp, Homo sapiens
tacagtcccagctattcaggaggctgaggcaagaggatcacgtgggcctaagagttcaaagctacagtgagccagtgagctatgattgtactactgtaccccaacttagaagacagaacaagaccccatctctaatcacagattaccataacatatggtaatcatggaaaagtttattagcacagggagacacaaagtgagcacatgctgttggaaaaatggctcctataga

SEQ ID NO: 192928 - DNA, 308 bp, Homo sapiens
ccatctcagcctctcaagaagctgggactataggtacacatcatcacaactggctaatttttgtatttttgtagagatggggtctccctttgttgcccaggctggtctacaactcctggcctcaagagatcctcctctgcctcagcctctcaaagtgcagggcttacaggtgtgagccaggtgtgtttcttatcgtctctctctccctcctggcagcacaggaactgtgtcctgctcactaacctattcctaattggagaatggcaactgtctggcaccttgtgagaattcgataaatatgtgttgaa

SEQ ID NO: 192929 - DNA, 630 bp, Homo sapiens
cagttccttcatttaggcaatcagaaaccaaaccaaatataattagtagaaacaaactgaaaaagaaacactcatgcaaaaactggcaaattggcagatgtccttaacatacagcacgtgcaagcaaatcagtaagaacccagagaaaccaaagaacaggcaggtcagagacgcccaaaacactcacacgcgatgacaaggaccatttcactggtcatcaacgtttttgtttttcgtccatcaaaatcagcatgccttaacaacactggagaaggtgtggggtgaagggtcattaagggcacgcagtagccataatgccacaccctttgtgccagccactgcgcttctggaaacctaccccacagcggtcaaccaaaagacagcaaaggcttctggcactaagctggtcacaaacgcattactaattattgtgcacatgtggaacctaccatctaagcctcctttctaaggcgaaaattcccactactacatcttgccacccttctttaacttacacactttaggaaaaggatgatttttcagaaactagcactgctcattcaaagtaacttcatacttcaatgaaaaataagcctccaatgccagtggcctccaacagggcttccctgc

SEQ ID NO: 192930 - DNA, 751 bp, Homo sapiens
gtggtgggctcggtgggtgggaagatcttcaggcccctgggcatcagaaattgcttgattaatggcagtagcagtggtaggacaaccctctgactcccagggagtccacactggtgctggtggtggctgtgacaggatgaacagatcagtactcaggcctgcaggtggcatgtacaggtggtgccagctgtagtagtaacagcaggttggatgggcttgttctcaggcccctgtgagggatgccaacaatggtggatggggcagggtgatccccaggcatgcttgtgcatggatgatgcagggccagcctgtgtgggtctatcctcaggctccatgtgatgtgtgcaggcactggctagggtagacagggatagggtaattcccaggaccccagatgaatgcttgggtgggggcagcagtggttgtgctgcagtcctactactgaggagggcaaagttgttttcagtggcagcaaccataaacaggcagctggggaatgaacacattggtctcagttggtggcttcgggcaggatagcatctcatggcacttgtagatgtgtggtgtccccactactggggattgtggggtcactgacagtggctcatgattcacgcctggtggcagcagccagaagtggcacctggctgtgggcaagggatgtcaattgggcttcagaaatgtggagatgaagaggctgttggaccccagggtaggatgcagtctggtaggggctgggctctcaaagtgg

SEQ ID NO: 192931 - DNA, 520 bp, Homo sapiens
tggagtgttgctctgtcacccaggctggagtgcagtggtgcaatctcacctcactgctacctccttctcccaggttccagcgattctccttgcctcagcctcccaagtagctgggattacaggcataagcgactgtgcctggcccattttctgaattttatttatcaaatgtactctcttccttccacctcagggcccccctactcacccccaactctcactcagcttaggttgtcactttagagagactgtccttgctcctccccaccccagctccaactagatcagccccatggcacacggtgagtattcagaacgattcgccaagtgtgtaagccaaaggccacacagatggtaacagaggtagccttcagacccaggagtgacccagagcccatatttggcaggtgcagggcagggaggctcacacagtgcccaacgtgaagcgggcacaatggccatcaatgcctctcccagctttatcactgctctgcgttctcacatgggtgcagagtagcat

SEQ ID NO: 192932 - DNA, 617 bp, Homo sapiens
gtttttaggtaccacaacaatactgtatgttatgtgagagaaaaaagtcataagttggactttgttaaaattgaaaactgctctgaaaaatacactattaagagaatgaagaaactagccacagattaggagaaaatatttgcataatgcatatctgatagacttgtatctaaaatatacaaagagctcataaaactcaaacataacaaacaacccaattaaaaatgggcaaagatctgaatagacaccttaccgaagaagacacacagacagaaaaaagcatataaagagatgctcaacctcatttgtcattagtaagttgcaaattaaaacagcagtgagatgccattacatacctattagaaatggctaaaatccaaaaagctgataatattaattgctactgagaatgttgagcaaaggaactctcattctttgttggttagaatgcaaaatggtactgcctctttagagcactgttcggcagtttcttacaaagtgaaacatagtttaaccataggactcagcagttgcaatcctacttggtatttacccaattaatttgaaaacttaggtccacataaaaacctacactgaaataaaaaggattacaaagg

SEQ ID NO: 192933 - DNA, 227 bp, Homo sapiens
ccaaaaaaaaacaggttttggaaaagacaggaattagctcctgtagctagttcccaagcattttaaacataatcaccaggttcatctcaacttttttgaggcatgattcacattcaatgaagtgcaggtgtaatcacccaatgggttcttcttgctcgctgcctagactgagccaatttatcaaggcaagggaattgcaatagagaaagagtttcattcacacagcg

SEQ ID NO: 192934 - DNA, 115 bp, Homo sapiens
taagagcatgggaagaagagggttttgccagaagaaagggccagagaggaggctatggtgacatggaaacgaggaaggacacatttgaaggggaaattggtccatggtgttggct

SEQ ID NO: 192935 - DNA, 622 bp, Homo sapiens
gcacacgtacagacatgcgcagacatgcacacacacagacgcacacacactcagacacactaatacacccgtacatcacacacagacgtgcacacacactgatgcacacgtacacacacacaaagacaggcatacacagacaccctgagtacatcgcacatacactcacagacacacacagatacacaggtacacacacagtacacacagacatgcacacacactcacagatatgtacatcacacagacatgtacagacatactgataacacacgtacatcacagacatgtacacacagacacactgatacatcatacacagagacatgtacacacactgataacgaacatcacacatacagacatgtacagacacactgatacaaatacatcacacatactcacagacgcacacacatactgatacacacgtaacgtatacacagacacgtacacatagacatgcacacacacactcagacacactgatacacatgtacatcacacgcagacatgtacagacatactgataacacgtacatcacagacatgtacacacagatacatcatacacagacatgtacacacactgatacgtacatcacgcatactcacagacgta

SEQ ID NO: 192936 - DNA, 646 bp, Homo sapiens
tgcaagctaagccgggggagtttcgatcaaggttaggagtttctgtactcattgttactacacttaaaacctaaacatgccagcttctgggatgagccaacacaatcatgattatcacgccctgtcctctatgcagctgcaggcctaaggtacgatggatggtaacagcagaaagccacaagggagattagcaacgacttgaaacacagacagggatttagaacacactccagtaaacgccaccattccaaagttcttcacttctagattccaaaatttctttcctaaaccttcagtcctgacacagacccaaactttaggcgctcctaactaaccatcaactttaattatttatccttaattcaagcctccacaacataggcacaactttcttttctggactcatgatacacaactcccagtgaattatgtcacaatatttgttcgtaacacttggaacttgcctgtaacacatactgatgtaataaattctatgagaacaggtgaaacctccctactttaaatcacctgggacactaatttttttcctctgtgaatggtaattgatacaaaggcacaggtgaggacatggactgaataactgacatttcccttctcctagaatgtaatattagaatgcattcta

SEQ ID NO: 192937 - DNA, 466 bp, Homo sapiens
agaggcagagcaggggcccccgtgcctctggacttaacattcctgtccggaatggtctccttctcttctgcctccctgtcccacctttcctcacaccccaagaccaaaaacaattcatgtgaggagtcacatgcaatttgaggtggctttatagtctcccagatagagtccatcggctcctcttccgccgtacccctactgcccactgtatgggtaccgttctcgacttttcatgacatagtccctgcttgtgggcctgtgcacccctctctaggttgtaaagtcactaagaaagggaccatgtcttaaaaccaggcacaggcctgatcaacaaaactcaaggtgaatggcatgcaagcccacccttcacatgtctgaaggaccaccgtctatcaacagtttacagagggcttaatggcaactccagtggcaacacagatctcttctggtggcgcagatgccaaga

SEQ ID NO: 192938 - DNA, 987 bp, Homo sapiens
gtgtctgcagacagccagaggcgcagacagacgcgcttatggtctgaacagtcagcaccacagagaccaagggcaggatgaaaagcccatcatcaggcccagagagcagcacggctgaggggccaacaggagcactcatgccgccacgcgagctccataaaaagactccaggtggccttgcaggctgcgtcaccacggttctgagaacagcaaaactgtcagagtcatcagatttacagagaatggcaacctctccagctttagaggaacagaaaaaaatatcataaaggaaaaagccaagtaaatgaaaacgtgaaacttccaagtaattgtaaaggctaaagatgaagaggcccctccccgcagggcacgcattctggtaccagatgctgtaaagccacggcccccaaccttttggcaccagggaccagttttgtagaagacaatttttccatggacagtgggggcagggggcttttcgggatgaacctgctccaactctgatgggcaggtgttaaagagtctcacaaggtgcacacagcctgggcctccgtgggtgcagccacaacagggttctgctcctatgagcgtctaagctactcccctcctgctgtccctgctgcagagccatggactcaccagagaaacggcatagcttttgcaaaaccaaggccctcaacagagcagaagtgggcagtgcaaccacggcacgtcctgctagcttatcggcttcctgggcctccccccgcctctgctcaccaccatcctcgggtccagtttcccagtagcagcagtgagcaggccccgggcagctgtgcccgtgatgtgggtttctcacttgggcctctggctgagggacctcccaccgaaggttccaaccacagccccacctgacaggccacatggacctgatgcaggttcctacagagcctccgatgaggttgtttgctgcagactgttcacacagaaacgcacactgcggccccc

SEQ ID NO: 192939 - DNA, 788 bp, Homo sapiens
acaggcatgtgccacgaagcccggctgaattttgtaattttagtagagacggggttttgccatgttcaccaggctggtctcgaactccttgacctcaggtgatcctcccgcctcggcctcccaaagtgctgggattacagggatgagccactgcccagcctgcccctgcttctcttaacacactgggaagctcctgctgtagcaaaatcctcaataaataggtgttgattagatgaactgatacgaataaaacctatgtgggggtgggagagtttttaaattactcagatttttaaggaggatttcaatagtcctttttatctttgtgaaaattttatttgaaagttcttattttaaaatatcaaacctgtcagaacagctacacttttaaatgctcctttaatatgaaaagatactcagtcatgcataaaaagagagatgcaaatgaaaactacatttagctatcatatcttgtctatcggagtggcaaaaaataaagtttgacaacatgtcttattgaaaaggttgtagggggaagatactgtgcttacatacatagctggtgggaacgcaaaatactatgactgtattaggagaatttgacaatatgtagcaaaataacatttgcatttaccctttggtcagccaggctcacttctagaaatctatctccctaggaatctaactcttttgagacagagtctcactctgttgcccaggctggagtgcagtgacgtggcctcagctcactgcaacctctgcctcctgggttcaagtgattctcctgc

SEQ ID NO: 192940 - DNA, 809 bp, Homo sapiens
cccaatccattccagcgtagtccagcccagcccagcacaggtcagcccagcttagcttagcccaggtcagtccagctcggctcagtccacttaagctcacccaggtcagctccgtccagctcagcccagcctagcccagcttagcccagcccagcccaacacaggtcagcccagctcagcctgcccctgcttctcttaacacactgggaagctcctgctgtagcaaaatcctcaataaataggtgttgattagatgaactgatacgaataaaacctatgtgggggtgggagagtttttaaattactcagatttttaaggaggatttcaatagtcctttttatctttgtgaaaattttatttgaaagttcttattttaaaatatcaaacctgtcagaacagctacacttttaaatgctcctttaatatgaaaagatactcagtcatgcataaaaagagagatgcaaatgaaaactacatttagctatcatatcttgtctatcggagtggcaaaaaataaagtttgacaacatgtcttattgaaaaggttgtagggggaagatactgtgcttacatacatagctggtgggaacgcaaaatactatgactgtattaggagaatttgacaatatgtagcaaaataacatttgcatttaccctttggtcagccaggctcacttctagaaatctatctccctaggaatctaactcttttgagacagagtctcactctgttgcccaggctggagtgcagtgacgtggcctcagctcactgcaacctctgcctcctgggttcaagtgattctcctgc

SEQ ID NO: 192941 - DNA, 508 bp, Homo sapiens
  misc_feature (8)..(8): n is a, c, g, or t
agccgctntagaggatccactcgccttttgataggaactctacaagatgaggtgccccttaggtttagccatgtggaggtcatgattcaccaaagggagagagggtcagagacagtgggaggtgaagaaatagaggttgggccaagagtgctgagttttctagtaaagtctgtctcgtggtgatggagaataaatgggatcagcagtttcccctgcaccatgatggaccaagagtcggggtgtgcagaggagacgagaagaggcttagagctgtggagaagcagacctcagccaggtggctgtctcccctctgagggagatagcggtgtgggaccccagggacaggcatgcccattgtaaattgggaacagcagtgtctgatgtgagcaacgtgggcaccaacaatggaaacaaaatgtccttggaatcagtacacacagggaatgtttcgtgttctttccgacattctacaccgattgttctgacctatcaaaagacgatgctctct

SEQ ID NO: 192942 - DNA, 437 bp, Homo sapiens
cagaactaaattccatattggtgatagtcggggcagaattgacaccacagaaaatcaaattaatgtcttaaagaactgattaaagaagctttcccagtatgcaggaaaataaaggtcaaattatcaaaagaatgagagaaaacatggcaagcatggtgggcagagagtggagattttttttttttttggtaaagctactatttgataacataatagggtatctgtagccaataataactttattatacattttaaaataaagaatataattagattgtttgtaacttgaagcgtaaatgcttgaggggatggataccccattctccatgatgtgcttatttcacactgcatgcctgtatcacagtatctcatgttctctgtaaatatataatcctactatgcacccacataaactttaaaaaaaaaagataaatcta

SEQ ID NO: 192943 - DNA, 480 bp, Homo sapiens
cttcagggatggagagagagattggctactggccttcaaaatgtcatcatgccatagctgcttaggtcatgaaggaggagatacacaatgtgggctcttactctggggcaacgaaactacttaaacttctggcaactctccaaaatagattctgggcctgtgaggactgggagactctcttgtagcaagaactgctggcatctgtgatggctatggaaaccgctggaagtcttttgcatgccattttcctgtaggaagaagccaccctgactcccagtcatttctggtaggagagacagtgtggcagaggcatcttgcatcttgttcaatgttctcctattcttgacaaatcttgagctacatctgtttttcttaggtctagttcttagttatgaagaactaagaaagtagaaatagaaccaagaaagtagaagaagtaagtagaaataatattagtctgtcaacttgttttgttttcac

SEQ ID NO: 192944 - DNA, 353 bp, Homo sapiens
tcaaaatactcactggcattctactcttatcttgtttctgattttaacagctatttatttgatgatagatttttttctaaccatgttaaagaaatttttttgcattcctaatatgctgagaatttttaaaattaaaaaaatgggttttggaatactataaaatgccttttggatgattttggtaaattatcatccatgaggagaatataatatggaagccagagtatgggatttatggccagacagagctggagtcaaattatacctcctcctcttagaattgtgtaacattaagcaatttatttattcccttccaatttcagtctcttactctgtaatatgaagataatcat

SEQ ID NO: 192945 - DNA, 393 bp, Homo sapiens
cgtagcaagctcggtaccccaccactcctatagatcagtcatcacaaacatcaagatgtgaagtagatgctattagaattgttaaagaacaagcatcaagcatacgctactcaccccctactcccctgaaaggcaccaccttacttcacagaggtcttttgagtggctgagagtaagtgtaccgatctaaaggtcagcagacactaagttctggctttaccatttaataactgattagccacatgatcataaaaaaatctctctctcaaactcactttcttgaaccagaaaatgggagtaacgctctacctgcttcaatcttgttacataaattaaaaacttttgtcaacggcggtctgttcactgatctataggagtggtgggggatcctct

SEQ ID NO: 192946 - DNA, 431 bp, Homo sapiens
cctagtctctgacaatcacctcttaccttctgggatcactccttcaagtgcttcaatccatcagttcccacaccctccaggagcctctgatctatcatcttccgtagtctcctctttagagaaaaccctcttgaaagagtttataatcttgtcctacacttcttgtcctctagttctaacttagactctctccaatcagggtttccaagcaggggaaggagggaggagcgtaaaggagaaaggaaaagtcgtgaagaagggaggggagaagaaaggaaagagaaagggaggggaaacataggtggaggagatgaagaggagaggagaggagaagaggaagagcagggtgaggggaaggggaagtcagagcaggaaaggagtaggggtaggggaaagaataaatagggaaaagaaagaggaagatggggaag

SEQ ID NO: 192947 - DNA, 466 bp, Homo sapiens
acctcctaccccacgacctcttaccccacgggctgtcacacgcatctctagctcatcacactcaccagaccatttctttccccattctttgtgtcgtgtcattcgttttacttctacatatggtattaatgccaacatatattatttttgctttcaacagttgtttttaaagaaaataatgattgtgtagctaatttgtgtgagtgtctacccaaatgcttgcaagtgcgggcgctccccaggccttcggcagaccctggcttctatctggctttgctttccagcagctgaagctccttcctcctgcacttctcctactagaggtctctgtctgaaaaggcatactttgcctccattcagaaatgtatgttcactgaatacagacttcccagctgacagtgtttgcttcagctcttcactaatgtttctgaagataagccacttagatttgtatggaactgggttt

SEQ ID NO: 192948 - DNA, 404 bp, Homo sapiens
ccatgcccggctaattttttgtatttgtagtagagacagggtttcaccatgttggccaggctggttttgaactcctggcctcaggtgatctacctgcctcagcctcccaaagtgctgggattacaggcatgagccaccgtgcccggccagagcattttgagaatacatggtctcataaacttttttggcttgcaggatcaaaaataaagatatgtgttgattttactcagataatatgacttgtaaagctggagtgcagtggcgcgatctcggctcactgcaagctccgcctcccaggctgaggaagagaattgcttgaacccgggaggcagaggttgcagtgagctgagatcacaccgctacactccagcctgggcaaaagagcgagactctgtctcaaaaaa

SEQ ID NO: 192949 - DNA, 271 bp, Homo sapiens
gagctgtcggggcagggagccaggaggttcaagaaagagcaagggcaactctctccctccgagagtttacagtcttatcgcatgtatgcaagtagctctactgtaagacacaaaataatcccagtgcaggaggaaggaaagactctagctacctggatgaacccaggaaggcctcctggaagagaaggcagaggatcaggtctagaaaaaaggtagaatttggagaaagggtattcaggtagaggaaacagagcaaagactcggaggcaag

SEQ ID NO: 192950 - DNA, 589 bp, Homo sapiens
ctttggcccatatttctctctcctgaacattctacctggatgtttccactatcattcaaacaaaaccaaaaccctagagttaaatacttcatctctaaattgccctccttgttatattttactatattccccccaaatctctgcaaaattgtatctaaagttggagttttagatgttatttcttcatcatagctactgactcaatgttgagatttaactgtatcaaaacattttattccctatttatttgcttaactccgttgttcactcaccaattctttcattaatcaaataaatatttattgagtgcctacaatacaccaagcacttatgttaggtattggggaagagctggtaagcaaaacagacacagtccctgctctagtaaggaagatcaataataatcaaataattgcaaatatatataattaaaaacagtgataaatgccagaaaatagtgactatggcatattcttaatcaccttttaacacttaaatgtttacagtttctaaaaattaccacaaaaagagaattaaaccaaactaaatcctcaagcttacagaacttataatgtgttatgagaactgg

SEQ ID NO: 192951 - DNA, 609 bp, Homo sapiens
catgcccagctaattgcaggtgatttctaatgggatttagtatttctgggtttaaggatgagatctgaggtaatgactttgtttccagatgtgaaataatttgctcttgggttgtgagccctttgggtgggctcccaaggatcctgctctcttccaggagcccaggctctggggtcagactgcctgggtccttgactccctgttttctgattgtacaactttggtgagtggcctaattcctctgtgccttggctaccttggttactatttctaaaacaactggtgttgtagtagtactgcttagagtactttcaagggttaaatgaattaatccatgtaaaacgcttaaaatagtgcctgccacaaccatcaatttagtgtgaaaatctgctcacctgcttggccagcccctttcactttattaaaccaagggtcgtgctgggttttccagaagtctaagttgcggtctaatctttgtgcagaagctgaaatagcagccataacgttctccctagatgatttcgtggagcttctttgaactgtatctatctccagtcatttttgtggaagaaattttcttctgtactttttagggatgagaattacctg

SEQ ID NO: 192952 - DNA, 299 bp, Homo sapiens
atagcacacacaggaaatgacagtatctgtacagctctctgggtacgcaggcctttggatttagaggcagctcctgccctgtgggtatcagtatcatgacaacccacctgaaatccatgtgagtcccttactgaggcccataagctggggagttctgtctagtccagctctaaagaagagcaaggaagagccattatcagaatattcttggcttggagtcacttttaagctccaagaagtaactcatctgtctgcccactatctctatttcattaggattccaaggtagcacccactct

SEQ ID NO: 192953 - DNA, 324 bp, Homo sapiens
aggtgtccctattaaatggcgagatacccagaaacattaccctgttgactccagtatgctggcaacgaggctttatagtctttgggaaggagactggaagattcttctctgggaaaaatgtacacatactgacctttgaaggacccccagtaatcagccaggtcttacctgatcatcctatagtgaagccccccgacacagtatttccattcatagtttagctcttaaatgtgaattagctatccagcaatcaccagacacttgaggaaagcctccagaaaacaaattggaaaaaggggcaagtcataggaaacagacaaaaca

SEQ ID NO: 192954 - DNA, 556 bp, Homo sapiens
ctcatgcttgtaatcccaatactctgggaggcagaggagggaggatcaattgaggccaggagttcaagaccagcctgggcaacatagcctatagcccaggagcccatcgctcctctctacaaaaaataaaaaaacaaaccaatgagcctggtgtggtggcctgtgcttgtaatcctagttccctgggaggctgaggcaggaggatcgcctgagcccgggaattcaaggctgtgatgagctatgatgatgccactgcattccagcctgggcaacagagtgagaccttgtctctaaataaataaataaatcggcacccaggatatcatcctcagggagttgttgtagaataaaaaatgcagcaggaaccactgctccagattgctgcttcccacacgggctgggctgaaaccttttcctcctgccctctgttgtccctgtcagtaggtcctgtggagtacttgctgcctgggggaggcccttcctcagggagtgtccagcagagggaagagcagaccacgctctggaaggtccaagccgatcatgcacgagtcaacag

SEQ ID NO: 192955 - DNA, 606 bp, Homo sapiens
atgaatgaatggatgaaagtgactgcaggtattacaggtgtaattgagaaatacctagataatatccgcattgcatggaagtgaggttattgttgtcttccctaaattagagaagtgaggcaggcaagatggccagcagtgccttatctctgtacctcgttcttggaccctaccacctgagtatctaggtgttggcatagatgggtttggggttgtcacttttcccgtgagagcgcacatatagctggctcacaggcttttgaatactgtgaagacaagctttgtgaggcagtggtcaccctcacgtgagaaattgtctgttttgacagtaggttagagccacaaagctattagtagttaatcatataaaacttagctgtttggaaaagaactttggaaaattttgctgctttagcaaaaacttgataaaagtgaggcatttgaaaaaaaggcatttgttgctgtggaactcacattgttaatcatcagtagttttatatgtaaaaacttggaatggtcttgaaattctcaaaatgttataggaattatttttataaatgttttattttcttacatgctgttttgggttttctaccttactctttg

SEQ ID NO: 192956 - DNA, 160 bp, Homo sapiens
tgtgtattttaccataaatatataaaagctattattaatcttataatttttaaaataaatgattgtcttagatttttctaaaatatctatttgtttaaaaaaaaatgcaggaatacaaaatggcaagaaaactgtaccaacactttgggaggctaggagg

SEQ ID NO: 192957 - DNA, 468 bp, Homo sapiens
tttgtttaggtaaaaacttccactttgtagccactaaaattctaaattgcttttggtaagatttgcccattcttttagaagagcttaggttctgagatgctattatgagaagcacttgagactataacatccttctccccacacccccaaactgggaaggagctgggagaccaaagaataacttggataaatctagcttgacggctagatgagcttgttaggacttaacttcaggacactcctggatggtggctggacagctctagagatccacaccacctcccatttctaagctgcttttaagttaattttctggccctttgtcaattttgtgtggttttccttgatatgtccccagctatgccccaggatgtttaggttctcagggacacgtggtccttggctgggcgcagtggccttggttcactgcctagcttttggggttcaagcaatacacatacactctta

SEQ ID NO: 192958 - DNA, 294 bp, Homo sapiens
ccagcaaaactgaatttcaaatataatgatacaaacaataagcacaataacgttttataaaatctgtaagttttagaagtacgtaaataagttgtaataaaaactccaggaataatgttcccatgaacgcttcccgaggaatcttaactagagaatgagcttcaattaaaaaaatgactagagacttataaggactggtgctgaacactgaatataccgtttcttgcaaaaactatacatggtttaaagagagggtataatatgtaacatctgcacatgcttacaacatatagt

SEQ ID NO: 192959 - DNA, 213 bp, Homo sapiens
gattcccttctgcccccccagccccctggggtgaaaagcactgcttttcctgtgtaaagaaaaaacgttcacacccagaccagtgaaatgtttttgtggccacgttgtgaacgcactgagtgtttgttgtggcccaactaagacaactttatagattaatgaagagtgatgtatcctttcttccgaacagaacatttagttctcactcggccc

SEQ ID NO: 192960 - DNA, 210 bp, Homo sapiens
gaattatttaatttgttggttttaaggcaactatgtaatgtgctagagaggaagatgaagatagccagtcatattttccttcaggcaattgaaactaaaagtatctgaagtcagcactctggacacattatgtctctggagcccattgacagttgatgtggtaacttgtagatctctgtcagagtcagagatgagttatttacgcttaag

SEQ ID NO: 192961 - DNA, 596 bp, Homo sapiens
tggctctttgtaaccatggtacggagtggagagcacgttctggtaaccttgagcatgaggtggggcctgggcagtcagggcaccgtccctgagagggtgagagcaaaagccagcctctgccctatgtgatgaaacccagcagccctaggtgacctgggccaggccaggcccctggggtggctttgcatgacatttaaaaaagaagtcaaaccctatccagctcccatggcccctcaagctctgggactcatctctcagctgctgccctgtccttccgtccgtgcaaggaactccaactttcatccagtccctgaaccatgccgagctgggtcctgcctcagggcctttgcacaggctgctcctcctgcttggaaccctcttccctcagaccttcctgccctgcctcctttgcaccgtttaggtcttgttcatgggctacccctcagggagctgtctacagccaccctggctatggcactgtcctcactcccagccaccttaccatgcacacagttggcattcagggagaggattaaacctcacacacacaggcacatgtgcgtgcacacacacacacacacccactcccgtaccag

SEQ ID NO: 192962 - DNA, 684 bp, Homo sapiens
tactacatggatacttaagcagtgcacttaccgtggcattttggtcaactaaaatttttaatgaaatttaggtgagttgattacacattatcgcacaaattattagcagcattaatagaaaaaatatatcagaaaataatcaggtcaggcatggtggctcacgcctgtaattctagcactttggaaggccaaggcaggaggcttgcttgagcccaggagttcaggaccagcctggccaacatagcaagaccgcgtctctacaaaaaaattgaaaaggtaactgagcatgtctgagaaaaaataaataaaaagaaaataatcaccctagtcttggccgactgaagaaagagttccttagaacacaaaagtaaaatcacttctagattaaaaaagagagagagagagaaatagagtgagtacatgtaagtttattgcacaagagcagattttaccagctcttacattaatccttgttaagtttcatctccttcctttgggcagatattccagtctttcatgatctgtgatgaattatgacataagatttaatcccttttaagcctatgtcatttgaaaagtcatatctttgttcaagttgtgatataaccaccttcttccagattgaacctatacattttttgggtactgttgtttagaagtcatctattttattaagtctatatt

SEQ ID NO: 192963 - DNA, 472 bp, Homo sapiens
tatcacttcttgactcagaacaaaggcaacacaaaacgcttctgcccagagttgacagcagagctttgcactgttttgttgcctggatccaccttgtataggctctctttgctcatctgctaatagctgctttgtttcctatatttcttgttcttcttaataaaagagctgctatactaactgaattaatggttaggatagaaacttttctttggaactctcatatgaaagttttagaattaatactgttcagaatgatagaatatttctaaactagaaccaccaataaccaaaatattggtataattgcaaaattcagctaggaagctaagttgcttgatattgcaataatattgctttctttgaatttagagaaaaatctcattacatgaccagttcagaactgtttcccataattctgaaatacacacatagattaggctggcttatttctaaaccagcataatagcag

SEQ ID NO: 192964 - DNA, 674 bp, Homo sapiens
tctgacagcatatacatctctattctttctaataagaatcaccaaatgttacacaaacataaaatagtttagagcacgtacaaaaaagttggtggtagaagtctacctggtgtccttgaaaccaatatacctaagaagggttcatagaggatgagacatgtatttttttttctttttgagacagagtttcactctgtcatccaggctggagtgcagtggcgcagtcttggctcactgcaacctctgcctccctggttcaagtgattctcctgctttagcctcccgagaagctgggattacaggtgtgcgccaccatgcccggataatttttgtattttttgtagaaatggggtttcgccatgttgctggccatgaactcccggcctcaagcgatccgccaacctcagtctcccaaagtgctgggattacaggcatgagccaccgcgccccctcagggcttattcttattcatatttccttgccccaacacagtgccttggaatgaataaatgaatgaatgaatgaatgaatgaatgacaacatgagataactgaatatatttctactctggactccagcactcatctatactctgttaatttcagtcaatttatttctcttaactaagtgtgagttcttacccttgtaaatcaagaagttatcaggttccttca

SEQ ID NO: 192965 - DNA, 213 bp, Homo sapiens
atctatctatccaaccatctccttccaacaaatcaaccatcgatttattccctttcaaccaaccatccatccattatcttctacccatccatccaattctcttacaactgataattcgtttttcagaaacagatctattttccatctgctatataccaccccttccaaccactctctcacttatctgcccaccccatcatacccttcccagca

SEQ ID NO: 192966 - DNA, 296 bp, Homo sapiens
gtcgatctgccggatcttactatacaccatggttgaccgttgcaggattgatcaaataaggaataagtgaaagacaatgaaagcaggtttcttagtgtcacagaaaggagttaggaatgtgggaagggagaaaactagaatgaaacttgtggtgttagattggaattagaggaattagtgtgaactcatggtgttcaatatatttagatatagaaataatatagaaatatagacgtgtgtgtttgtgtgtgtgtgcatgcatgtatgcatgtgtgttatgcaggagaaggaatcag

SEQ ID NO: 192967 - DNA, 448 bp, Homo sapiens
caatggaatagaacagagtcctcagaaataacgtctttaatccatgttgagttaatttttgtgtaaggtgtaaggaaggggtcgagtttcagttttctgcatatggccagctagctttcccaacaccatttattaaatagggaattatttccccattgctttttttttcagttttgtcaaagatcagatggtaattttcacatttcaatgaatttgtcaattttgtctaagttgtcatgtttattcacataaattttatattattaccatgtatttttaagtatctgtagaatcttaaagaatgtcacattaactcattttcaaacttggtaatttgtagtttttgttttcaagagctagtttggctagatagacttttgcttttattgatcctctcaaagtgtttggtgttgttcaagttttctatcatttttgcgttttattcgtt

SEQ ID NO: 192968 - DNA, 456 bp, Homo sapiens
gactcgagccccttggaggcggggcctcgggctgcaggggcggggccccgagccgcctgggggtggggcctcaggctctttgggggcggggcctcaagctgtctggggacggagcctccggccggctgggggcggggcctcatgcctaagggcggggcctcgagctttctgggggtggggtctcaagcttcagggtcggggcctggagccgcctggggacggggcgatctgttggggaggaggttctcgaactgctgaggaggatcgcagtgcttttgcttcctctaggagaccagctgcacaggctggaacatgccatctctatgcctgttttcccgtcgataaatccagagacattactctcatcatttcttcctctgtacacaatattcatatatgtaaccccttggtaaagcagttgtaagaattaaacaagaggaattgctctttcattca

SEQ ID NO: 192969 - DNA, 465 bp, Homo sapiens
aggaaatatcatatgtaacttctcataattatctcatcacttccaatagcaatttggaaaaggatgctattgaactatactgtcaaatatggtagccactatcaacctgtagctacttgtttatgtttaaattaattcaaatttaaaatagttctccagtcacactagccacatgtgaaatatgcagtagtcacaggtgattaatggctactgtactggacactgcagatacagaacatttccatcatcacagaaaaaaattctattggatagcactgctctagaatggcaggggtgggaggagctatgtgtttttataattaaaattttaatcagaacacagccatatccatgtgtctgtggccataaaagcactaaaaggtcagagatgagtagttgtgacaaaaactatttggcccacaaagactaaattatttacttctgtaaggacagcttcaatctcaa

SEQ ID NO: 192970 - DNA, 425 bp, Homo sapiens
tagtgtggagaaatgcagacatgctccttacactgttttcccattccttggtatttctaactgcatacccatcatccccagtgttgacttagcctcccaggagaaggcagcaaggaacagcaactattaatagaaggtgtagaggccgggcagtggctcatgcctgtaatctcagctctttgggaggctgatgcgggtggatcacctgcggtcaggagttcgagaccagcttgacaaatatggtgaaaccccatctctactaaaaatacaaaaacaagctgggcgtggtggcaggagcttgtagtcccagctactcgggaggctgtgacaggagaactgcttgaacccgggaggcaaatgttgcagtgagccaagatcgcaccactgcactccagcctgggcaacagagtgagactctgtctcaa

SEQ ID NO: 192971 - DNA, 475 bp, Homo sapiens
ttctccccctctccctcctcagcatcctctactcacaacaccttctgaaggagcctcagtcctgccatgactggcagaacctatcacgagcatcgccggcatccatgccaacagctcacctgcaaggctttcaactctgctgaccttcagagtgtcagagcagtgccgaagcccaggacatggctgtcatcccttattcctcctagctcaaatcaccctcaatatcctgataggaaccaaataccaggccatcccgccatttcagtctctgtcccaaggactcctcattaaattccatcatcatccttcagctaacaaccaaaagccttcctgaaacacagcctcatgcaaataggtactgagaaaacttcctagcccctagttctgcaaacactcacctacgcagtttagaatcagctaggttacgtgcctgtgcatttatatatgcagataaataatacagcagctatactac

SEQ ID NO: 192972 - DNA, 615 bp, Homo sapiens
cataaaacaaatattacagctaaagagagagataggccttaacacattaatagatggaggcttcaacactccactttcagcattggacagatcagatcatccagacaaaattaacgaagaaacatcaaacttaatctgcactgtagaccaaatggatttagtagatatttctagaacatttcatctgatggctgcagaatttacattgttctctttagcacatggatcgtcctcaaggttagaccgtatgttaggccacaaaataagtcattaaaaattcaaaccttgatactaaaagcagacaaagacacatcaaagaaagaatactacaggccaatgtctctgatgaatattgatgcaaatatcctcaacaaaatactagcaaaccaaattcagcaatacgttagaaagatcgttcattgtgaccaagtggggtttatccctggggtacaaggatggttcaacatatgcaaatcaattgatgtgatacatcatgtcaacagaaggataaaaaccatgtgattatttcaatcgatgctgaaaaggcatttgataaaattcaacatcctttcatgataaaatctcttaaaactggttatggaagaaacatacctc

SEQ ID NO: 192973 - DNA, 648 bp, Homo sapiens
gtagagtggatgatttgcaaaagacaggaagatcctcgttatatttagggtatcttttctttccacattctgaatttggcctttaagaatattcgggccaacacaaaaggcccaagttgctgctgttaccccagcaagctgtgcgttagggtcttgggggaaggaagatgataattagaagaaatttggatcaggcagctcatcaaaaaatagagaaatgaaagccttccttcttctctctcaagttagtagcaagtaactgactgtactttatcctttgtgtgacctggcaggggcagaactaacgttttattttcttgaagtctcagaggagccttttctggaagctgcatggttatttcaaagttggaaaaaataataggttcctgtggaaatttatgaaaacattttttcttgacttccttctcaaaaccttgggtgattgatagagggagcatggtttaggaaccatattttgaaagcaaagtggcaagagatgaggggtagagccttcaggccttctgtgaaattgagattgcgttctaagtgcagtatgcagccactgaggcttttggcaggcactgatgaacacttctgtaaaccacagtgtttgcaagtctgccaccaatttccttgctacaaagcctg

SEQ ID NO: 192974 - DNA, 497 bp, Homo sapiens
acccttcacacagctgttgtgctgagcagtagtgctttcaggaaagatttaagagagttctaaccagaagcgcctgtgacttaattaccctctccagctcagctcctcattgtataatggcagttagggttaatatctactcacaggggcattgagagcaatcagtgagcgcacacatccagactgagacggcacttagctgaagtgtgctcccagccagcagaagcaactcagcatgcaaggctgcctggattgcagtctacctatcttctagatataggagaatttattgccaattaattacagaacgtgtcagtcaagttctaaggagcattttgagacccattaaagaacagtataaaaatgtgtacaccttccttactcagacttcttcagtaaaccaagaaagtggtaattctttcagggctacggcaatgattagtcatgttaataagtgagttaacacttactaagagtttgttgtggggaagtcattc

SEQ ID NO: 192975 - DNA, 363 bp, Homo sapiens
aaaacttttttttttaagttttgtttttatttttatatcagggtagttgaaacaatttaaaaattaaaaaaaattttttgcagagacagggtctcactctgtcacccaggctggagtgcagtggtgccatcatagctcactgcagccttcaaatcctgggctcaagcaatacccccatctcagctcccaccaaagtcttgggattataggcatgagccactgtatctggccatataactattgataattacttttaatgactacataatactatctctagagaggcaccatgttttcctcatcatttctctaatattaataagttaggttatcttgaaattttttgccattataaataattcc

SEQ ID NO: 192976 - DNA, 355 bp, Homo sapiens
atgcccacatggagagggcctgcctcacagtgaagacagtaggaaggaaagcagaggtaagagttgaaaagtccaaatccatatatgaacactgcgattccgccattcccgaagctagttaccctccagacttttcagttccaggaggcaatgaaaccccttttctgcttatgcccgttaggtttggattttctgtcacttgctactaagacagccctcactgaccaagtgaagctcagagatgggacccaacacacccaaggtcacatagctacgaaagcagtggaacagaaactcccatgaaagtctgggcttttttttttttttttgagacagtcttgctctgtgtccaagg

SEQ ID NO: 192977 - DNA, 312 bp, Homo sapiens
agtttagatgatgtcttagtttattttatgttgctataatagaataccacaaattgggtaatgaaataaatttatttcttacagttctagaggctgagaagtccaaggtcaagggccccacatttggccagggcctttttgctacatcctcttattgcagaaggctgaaggaaaagagaccaagagaggaccaaatttgcttttataacaacccactctcaccataacaacattaatccagtcaggaaagtggagccttaatggcctaatccctctccatcgtcccatctcttaatattgccacagtgactg

SEQ ID NO: 192978 - DNA, 325 bp, Homo sapiens
tctcagctaacctacaggctgctcaaagtcagacagtgtggcttctgctgagctcttctgtccacagccacccagtgggaggctggtgtccccagtacctcatcacagcctaatgccagggaccccagggacagcaccgtgagcagccccgccgtgagaagggatggtcatggctggatgccagggatgctgccagtgtcccaggtgacagatgcccctccagggcctggactgagccgctaggatgcagaaagagccacattcaaagccttcactttgtcagtcaggggcagcacaccggggccccagatgtatttgggttggt

SEQ ID NO: 192979 - DNA, 486 bp, Homo sapiens
tttacagttaggcaacaggagtactagacataatgattgacttcccgaggtcacaaggcttagtaattggttaaaacaagaagtagagtcaggttcatatcactccaaaggctgggtttcctctgcttcttcgtgctgagtagtacataataagcaattcattgaatgcttgagtacacatgtgcacatttagatgggtgagtagtggcacaggtggaggaaatctggtggagaaattgatgttagagagaaataatggaaaatgagtaacttcaccttgagggaactaaaaattttgaattcagtgagagcaagtatttaattatatttgtcatggtatttaaagcatgttagtcattatatactttttttttttttttggcctatgaaagattttaaacttggttccaaaatgtggtcaaatgccctgtgaggatgagaaaataatgtcaatactatgagttcactttaataaaggctaagagg

SEQ ID NO: 192980 - DNA, 186 bp, Homo sapiens
aaccatctacttgcaaaattaccactttatcctaaaaggatacaactcaggaacagccagatggaagagatgcattgggcagttatagggaaagaggcatggagcttccatttcctctccaggcccactgcccttccaagcacctccgtgtgttcaccaacctggaaactcatcatatcttcttgt

SEQ ID NO: 192981 - DNA, 379 bp, Homo sapiens
aatgagctttatggtgctgaaaaatcgcttagggcacagtctctctatatgtataacatgagaggtagggtgggaggaactcttctaagcccagactctcttgttcttgactatgtctccagtgtctagaacaatgccagacacatagtaggtactcacaaaatatttgagtaaatgaaaatttccccctactcctactgtgtacaatgggtatacaattgcactatcttgcaactgaatccgaagttggaattccaatagcagccccaagcttatagagcccagctgatctcagcctgtccttgttttattaggaagcttgggccagaacagccagtggcttccttgaccttaatgagctttgttctttccaacacac

SEQ ID NO: 192982 - DNA, 678 bp, Homo sapiens
  misc_feature (5)..(5): n is a, c, g, or t
  misc_feature (7)..(7): n is a, c, g, or t
  misc_feature (15)..(15): n is a, c, g, or t
tgagngnacacccgnagaggtacctcaactcgtcttgccaagtgcagtggtgtcatctcggctcattgcagccttggcctcccgggttcaagcgattcttctgcctcagcctcccaagtagctgggactgtaggcatgtaccaccacacccagctaatttttgtatttttagtagagacggggtttctccatgttggccagactacctgaagtgatctgcctgcctcagcctcccaaagtgctgggattataggcatgagccaccgctcctggccagtttatagttttcttattttttattttatttttatttacttatttttgagatggagtcttgctctgttgctcaggctggagtgcagtggcacaatcttggctcactgcaacctccacctcctgggtttaagcagttctccctgcctcaacctcccgggtttaagcagttctccctgcctcaacctcccgggtttaagcatttctccctgcctcaacctcccgggtttaagcagttctccctgcctcaacctcccgagtagctgggactacaggcacatgccagcatgcccagctaactttttttttttttttttttgggacagtctcactctatcgccaggctagagtgcagtgatctaggctcactgcaacctctgcctcctgggttcaagcgattctcct

SEQ ID NO: 192983 - DNA, 364 bp, Homo sapiens
gaaaaaacttcttgctcattttgttacaccaggatataggtgacaacctaaattcgtctgacaacacaacaaaaacaagataaatgaatggtggaccaacttaggcttctgtaagacaggtatgggtgaaaaagggaaagcttttcagatttttgtggccatatgaggatgaaaacccatgactgtccttgagttttcttaggcacaggagaaaggagttaggtggcaccaaagttatttgacaccagaaatctgaaagacagtaaacatagtttcattccaaatgctgagtcattcttatggggaagaagagaaacacttaagactctcacttccctgaggtcttggtcttcactagattgcc

SEQ ID NO: 192984 - DNA, 386 bp, Homo sapiens
aatcaaacaccttctacactccactctgcagtacagaaagagccaaccaatgatatactgctggttaaatccaggctccactataaagtttgaactttgtttcagaggaactctgctctagaaacaaaggctgagagtgtgttttgtgggttgcagtatacacagaggcagaggtggtatcgtggcatcatctgatttgggatctctgggtgattggcgtgactctcaattcttgattttttttccctcttcccaggaatggggtaaattactatcttttagatcttattagactgtctttccaacctacaagaataaaatagctaaggagaacacaaggctgtttataatgaacttggaccaagataattgagcaagcatcacat

SEQ ID NO: 192985 - DNA, 466 bp, Homo sapiens
gtgccacttgcacgtgcatgtgcaagagcatttgaggtctcagagaagatcccaaagaatagacagcgcccttgttagcacctgggctgacaggcttctttgggagagatgacaacgaatagccatgccgggaacttgccgtgtggcccctctccctttccccacctgtgatgtgcagggccactgaccccaggtgtcctccctgctccagtgatcatggacagcatggggtcatgggcgtacacacaggtgctgataccaggggtcagtatttaacatacttgctttacagatgggaacagggaggctcagggggacactctcaaaattacacagcttttaacaggtggcagaattggggttcagacccagatctgggttcaagtcactcatggtgtgattgcggcagttccttcccgcatctgggccttgccatctctctctccgagtggacatggagaggacg

SEQ ID NO: 192986 - DNA, 299 bp, Homo sapiens
aaagaggtgatactggagctaaaatgaaaatgatgggaaggatccgactaatgccatgatcctggggaagagagacagagggggacaggggcaggaacgagcttagagaagtcaaagaagagagagaaggcagagtgcctggagcacacattcattccacggtctctgctgggcaggcaaatccttcacgggccaggcatgtggagagaaagatgactatgattcagcccattggctcatataactgacaggctggtgaaggagccagcatggcaggctgcacttgaccactcttcatt

SEQ ID NO: 192987 - DNA, 444 bp, Homo sapiens
attctttcttaaattataagactaaatgtgaacccaaaattcgaattgaattctgttcactgttaaagacaaaatacagcagacgactgaagagtttttatttgggttgtgatcatggcgaggacattcattacaaagaaaaatctcaaaaggaaggagtttgggggctcctaaaggcaggtaaatcagtgcatggtctgtgaccctatgggagtgtgaggaaggtgggggcagggcttaacttgaacatgtgaggccagggtgggtttcggcaaacacaaaagactgatgttggagaaattattattttttctattaaatgagtacaaaaaatggaataaataacaaagtagatgcaattagtttaaattacagagatcagaaaattgcaagtagaaataagcaggaaacattttaaaacctgtcaacacccattaagacaaa

SEQ ID NO: 192988 - DNA, 469 bp, Homo sapiens
cattgctttatctgagctacttgttccttgttctaagtctgggggagagaaagggaacatctgcaggcaggatgggggaaggtggtatgaaatgaagggccacacacctatttgttggttggtatcagtacccacaggggcaaagcaacaaaaagaagtaccgtctgctttgaaaattgcctttctggccaggtgccatggctcacatctataatctcagtactttgggaggccaaggcgggcagaccacttaagctcaggagtttgagacatgtctgggcaacatagggagactccatctctacaaaaaatacaacaattagccaggcgtagtggcacatgcctgtagtcccagctacttgggaggctgaggtgggaggatcatctgagcctaggaggttgaggctgcagtgagccgtgatcatgccactgcactccgtcttggacactagagtaagaccctgtctca

SEQ ID NO: 192989 - DNA, 652 bp, Homo sapiens
gatgctgttaaacatcctgcaacaaataggacatccctcacgacagagttatccagcccagaatgtcactagtgctgaggttgagaaaccctactctgaagtgacccagccaggtatggcagcacacacctatagtcccagctactcaggaggctgaggcaggaggatggcttgagccaggagtttgaggccgcagtgagccgtgatcacaccactgcattccaacctgggtgacagagcaagaccccatctgtaaagtaaaataaaataaaaataaggagacccaaataggctgtgagcttctgcttaaaatctcctccaccaaatactatgcagccgtaaaaaagaagaagtcatgtcatttgcagcaacatggttggagctggaggccattaatctaagcaaactaatgcagcaacagaaaaccaaataccgcacgttctcacttataagtgagagctaaacactgaatactcatggacaacaaagggaacaacagacactggggcctacttgagggtggaggttagaaggagggtgaggatgaaaagactatctcttgggtacagtgcgtattacctgggtgatgaaataatctgtgcactaaacccccatgacatgcgatttacctatataacaaacctgcacatgt

SEQ ID NO: 192990 - DNA, 189 bp, Homo sapiens
cccaccttcaataaagggaatcctgtgggaagagaaaggaatgtgttaaagtgtagatcaagaagggacaggagaataaaaagaaatggaagcaggtgcacacacaggaaagatgatgagtgttctattgttgttaaagagttcatgctctaacaacacaaaccaaattaatcccagcctccccactta

SEQ ID NO: 192991 - DNA, 263 bp, Homo sapiens
ctgatgtagaactgcctcttagggatatagaatggagagcagtttgacactgtgaggtgctgaaaataaccaggtaactaacacccgttgattttgagtgctttggtttaagtgggagtgctgagaggaactactttagaaaaatcactatgtagttgacccgtgaaaaatatgagtttgaactctgcagcacttccacatggatttttttagccaaatgcaaatcaaaattacaatattctttgaaccggcggacctgtgta

SEQ ID NO: 192992 - DNA, 911 bp, Homo sapiens
gtcggtctcggggaggcgttgtagcctcaggagtgttctctgggtgtgactcacacctggccacatgtgtggtcgtccttggttctccaaggaaacctgtcaaacttaaaacagttttaagacattaatttgctcaacgatgttcaaatacttttgaaaaaattggtatgtatgcaaggtatgcatgatgaaactgactccagaagagagggagacactaaattgaccagttattaggaaaaaaattaaaaagattgatcgacttgtcaaagttgctgtcccaaaaaagctccagatgtaggtgtttccagagtggattctaccaaactgttgaggaacatccggccccagttccctttcaaccagccagcttatcagacagaaggaaaatgcagggatacggaggcccgacagaaggtggcaccgtgaaaacagctgtgcagttgtcttgctgttgcttgtgagtgaaaccatctcggcttaggacccaatagcaaataaactcgatccaatgtgttcatactagaaacgtaaggataagttcatgttccaaaaggttgagggatgtaattccctgttttcataagttaatagttcatcagtagaagaaaccttgttaggttatctcgatagatgctgaaaatgtatttgttaatattaaatgcctacttttgattgaaaaatgattattcttaataaaattaaaacatgtatttccataatataattttaaaacacagaatcaggcatttccactagtgtcagggacaagacaccccatgtaaccacagttgtgtaatatactttcagaagctctagctagtgaaattaacaatttaacaagagaaagaataatgtaaatattgaatactagaatggagagacgttacttgcaaatatgattgtgcatc

SEQ ID NO: 192993 - DNA, 718 bp, Homo sapiens
cccctccagcctctactctcatcacttccccgccccctcatactctagactcaggaaccatttgtaatttcccgataaactccactccgacacacttccacccacatgcctttgctgatgctgatccctctgtctggaatgcctatctggactctgtttaccttgtgaaagcccagtggtctttagggctgaaacatcaaaggcagccgagtgtcacaggtcccagtttggactctggagtcaggcagactggtcaccaaacccaacccaccatttactaggtgtgtgagcctggaggagttgcctaacctctttgaacctcagtttcttcatccataaaatgggtataataacagtcctgaccccttgggtgacttcaggatgaaacacagtgacgcctggctgggctgcatccttagctgcactgttcttctttgaagcataatttgccctccctgggcccccttttctacactgtactctggggaagtttgtatgatggttttgcacatacccttgcattgatctacttgtggcccctcctacctcacctgactgtgtgttctgaagctgaaggctgcaagccccggggcctggtgcccatgcctctgacaatggtgggtgctcaataaccaccactggtagatacaatcaaatcaagagtatcgcacacaattcagggtgtgtagtggctagagtgtggctgccctttgtcaac

SEQ ID NO: 192994 - DNA, 709 bp, Homo sapiens
gaaagacttcttagaaaggaaggaagtagaccgggcatggtggctcatgcctgtaatcccaacactttgggaagccgaggcaggtggatcacaaggtcaagagatcaagaccatcctggccaacgtggtgaaaacctgtctctactaaaaatacaaaaattagctggacatggtggcacatgcctgtagtcccaactactcgagaggctgaggcaggagagaaaaaaaagaaggaaataagagggagattgggagaaaagtaaggtgttatagctctgatctgtggtatctcctgttttccttgcggtatgactagtgtgagccaaggatagagaccaacaaactggggtaccaaagtggacaatgaagtactatgtaattagtgctaatgctaaattcattcctttgtttaaggcttaatatccttgcagaagccatcctgtgttacttgagcctggactagtattggggtgaagtcaagcatcagagtaaaacatttgtccccttaatgttaccccctcttaatttctaagaaccacaggcccattttgcccttccttgttaccatcattgagataaggaataagatgtagtaaccccaagttatctgataggtacaactgacctattctgtttggcagctttatcttagacctattctgtttggcagctttatcttagccccaaccaaatctcttcctttcacatg

SEQ ID NO: 192995 - DNA, 754 bp, Homo sapiens
ctgttgccctcaaaggaaatccaatgttatacccccacaccttagttaattatttcattaaaattttttgttatggcgggcatggtggctcatgcctgtaatcccaacactttgggaagccgaggcaggtggatcacaaggtcaagagatcaagaccatcctggccaacgtggtgaaaacctgtctctactaaaaatacaaaaattagctggacatggtggcacatgcctgtagtcccaactactcgagaggctgaggcaggagagaaaaaaaagaaggaaataagagggagattgggagaaaagtaaggtgttatagctctgatctgtggtatctcctgttttccttgcggtatgactagtgtgagccaaggatagagaccaacaaactggggtaccaaagtggacaatgaagtactatgtaattagtgctaatgctaaattcattcctttgtttaaggcttaatatccttgcagaagccatcctgtgttacttgagcctggactagtattggggtgaagtcaagcatcagagtaaaacatttgtccccttaatgttaccccctcttaatttctaagaaccacaggcccattttgcccttccttgttaccatcattgagataaggaataagatgtagtaaccccaagttatctgataggtacaactgacctattctgtttggcagctttatcttagacctattctgtttggcagctttatcttagccccaaccaaatctcttcctttcacatg

SEQ ID NO: 192996 - DNA, 646 bp, Homo sapiens
atccactactggctgacccactactgtgttctcaactacagacttcttaagaccaggcagccctgtgctgccagggaaagacaggctcctcccacccttatgttctggctaatttgtggagagccacagtggtgtctcttagtgcatttgtcatcacagctcttcctcgttcaaaattgtatccgtgaatgataccacgaacaaccacaactgcaagcagcaaataaacaactgccgaatgcacaaaaacaatggcaaattgctcctaaaataaaatgaacaaacttgttttaattggacagaagtggaacagaagtagaattgtttttctgggggtaactctaggccatttaaagctgcaaagagtgcctttgcctagctgctttcttcatgtcctgaggacaggacaaaatgcccgggaaggggcctcacatgtctactactcaggcagctgcccacagagaacatgaatcccttgccacgtcacacatgccaagcacacacaatgcatcatcaacaggctgggctccgcctggtccaggccactgggggacagcacttcccttctctctgctctatacaaaaaggtgccctaaaatgcaggccgacatttaagttcctctgccacaaatgacagagatttaca

SEQ ID NO: 192997 - DNA, 312 bp, Homo sapiens
gcatagtggttgtagtgatagtggtagtaaaataatcaaaacctaaactgagagagggtgaagagaggcaggtttccaagtgtgcactgttaatgcctacataatcaagactcagctgttcagcactgagtgggagggtatttctgggagacgggtggagcttttctcctccttgttggtgtcttcacaaattccagcaatcaaaatagtcattttccttccttgccaatgtcatcttaaaagaacctctctctaaacccaggtgcttaaattgtccagtgagtttctctcctctttaagaagaagttgagg

SEQ ID NO: 192998 - DNA, 395 bp, Homo sapiens
acaaggaggctgagttccaagtccagaccgaacctgcatcagggaggagggacatctggtttacatcagtgatgactctttttcattcatttattgagcacctactgtatacaggcagtgatggaggaacagggagcatacctattctaaatagataagtccacattgttgtgtgtgataaaatacacataacttaaaagttaccatcttaactacttttaagtgtacagttcagtggcattaaatacattcatattgttgtgcagccatccccgttgttcatctccagaactttctcatcttgcaaaactgaaactctacccattaaacaaaaactcccccttgctctccaccctcgcaaccaccattctgtttcctgtctccttgaatttgac

SEQ ID NO: 192999 - DNA, 271 bp, Homo sapiens
tgggctcagattcagcccctgcttgcggtcctcgcaccctctagtggccacggggagaaagaagtagctcagcggagattctggagctgggtccgggtggacactgcaccccacccggcaagcaggagagagaacccagaagaacggatgactccctcacacgcctctttctaaagcatgctggcgctgaataaccacaggggtccgtgatctttatcaattacatgtgtccggccttattagctcttaaaggaatcttgttttctctctc

SEQ ID NO: 193000 - DNA, 464 bp, Homo sapiens
cctgcctcagcctcccagagtgccactgcgcctggtctgatacacgcatctaaatcaataaagtaacatgtccatcttagttgatgaatttgtcagggagaagggactatgttagtgtgtaggatgagccatgtggccagatactattatgggtggaaggtcatataacatcagagcgtgttggataaagggtagacagaagggaagagtcagtgagagcactttataacataaaaaagtgaaaatttgctctccctattttttttttttaataaaaaagcactgtggccacatatatacacacatatctgttcatacttacttattgtattcaaaatccagggtactgagttattttttttcttgaatgacagaatgggagagatggtaacatatgtgagaggagaacggactgctcttggcagtcatttgtttcatccaggtggggagactgttattttttt

SEQ ID NO: 193001 - DNA, 325 bp, Homo sapiens
ttgggaggccaaggtggatggatcacctgaggtcaggagttcgagaccagcctggccaaaatggcaaaaccccatctctactaaaaatacaaaaattatcccggcatggtggcacatgcctgtaatcccagctactcaggaggctgaggcaggagaattgcctgaacccaggaggcggaggttacagtgagctgagatcatgccactgcacactccaccctgggcaaccctccgtctcaaaaaacaaaaacaacaacaacaaaaaaacatgatgaaattggcattaagtgttaataatgaatcgtatgagcttggttaaagggag

SEQ ID NO: 193002 - DNA, 400 bp, Homo sapiens
tttcaatgcagttacttatttttcatgccttcaatttggtataaatatttcttttgcccagaatcaaatgcataaaaggtttcctttcatctcaaggatgcaagttattttgttatcttctatgggaaattaataatggtggggtcaaggtgcggaaggaagttagcggatccctctaacttaatgactgcatattgtaatagaaataactcataacgatgcaattcctctcttcccttctgataaacaagaccatggcttagtggtcattctttttcttttctatttctcacttactcctgtcctagttattcaaatacctagccaatgacttctaaaggtgccaccacctgaggtcagctacgctttccagaattagacataagggtagagatggatg

SEQ ID NO: 193003 - DNA, 588 bp, Homo sapiens
tgacctgatcaccaagcaagggccccaccgtccaataccatcaccttgggggttaggatttcaatacataaattttgaggagacataacatttagacaattgcattaatatttaacaaatatttactaaccaacgcattttaagaagagttatcactttcaaagtccatttttgaggaaaggaatttattttaaaaatgattgcgtttcttaggagttttcttcttgcctttggaggcaatttcaaaatatagtttcttggaaacaacttaactgtccatcttgaggggaatagtgaattaaataatggtacacccaggcattggtgtactcttagctacaaatacgagaatgaagaatactaatatggtaggatctctgggatgctatgagatgagaaaaaagtaaggtgcagaacaatgtatactatatttgaacaatgcgtatagtatgctacatttgccaaagaggaggaaataaaaatgtatatccatatgtgctttgttttaaggaaatgctgaatgatgtacaagaagctaatacaagctgcacctgtgggacagggaatatggtggatggagagagggtg

SEQ ID NO: 193004 - DNA, 438 bp, Homo sapiens
  misc_feature (3)..(3): n is a, c, g, or t
ggnccactctagagtatcccccgtcttttgataggtaaactgatcaaagtaaccaagtaagtaccaatactgagctttaaatgcaagcagtccagattcaagttgatgtttttaaccactacactctagcctctcactcttcaataagatcatagaccaatttaaataatcttaattctaaactctagaagcctagttacagaaagggtcccatatgcctgaaaacatacatctatgcccctgttaagaaataagcctagttaagaaatattcaatttagcagcataacagttgcttctattttaaatatctatggcagaactattgtgagtagacctgagtatgcaaattagaaagcattctaaggagctgattatactagctcccaaaattcttctgaaaagacgaaaactcctatcaaaagacgagggtaccgag

SEQ ID NO: 193005 - DNA, 1181 bp, Homo sapiens
agtagaaacggggtttcaccatgttagccaagctgctctcgaactcctgaccttaggtgattcacccgcctcggcctcctaaagtgctgttattacaggcgtgagccaccgcacctggcccacaaactattctttgaaaatgcttcttgcaactgtggggagagatcgggccagcagacccgttccgaggggaggatcggctggtgtatagagcagggttgcacgctggccccaaaactctcctcagatgctccagctctggggcggaactggcctgaaactgatagtgagttcctggactagtgttcccagcctggcacgtggtgcctggttagaactgactcatcatggtaatatttcctggaaagttctggaagaattgtgagattgtagagtcatgggtttcccaaacattggttttggtttcttttcttggctttccctgcgtagtctctcacctcagctccgattttgtgttctagcacccaaccctaatggtaaagacatcgaatttatccactccagtaagtctgtttctttgctaatgactttatgatcttcctgtctatccagtgttccagctaatccactctgggtcgtaaggctgttcccctaggcacagtgggcacattttggttttaattcatgagagaatggcatttttgacccactgggagtgttccattccaaagtctcatgccaaagttctgggcatcttaattttgagactaaagccacagcccttgtaaagaattggcagtcagcagggctttctccctgataagtggtgtagacgttctttacagcccattgtatttcttgtgacagtttaagtttctaatttcctgacactgtagggggggttgggttccagtgtagaaggctggaaattttccattttttcccaacataatctacattccaacattgtaagacacagcttaattctttccagttgtgttactattctttctctttcatatttttcagtctttctcattcatggggtattctctcctatactggaaagaggggcctttgaccttcagttatgaaagtcacatccagcccatggttggaatagagcacacagcagagcatgttgagtagaatcagttggattaggttaattaggaagaagcttcctgaaaatagcaagctgagcctcagcttctttcata

SEQ ID NO: 193006 - DNA, 540 bp, Homo sapiens
tttccagctatagaggcagcctctgctagtaaagggtacctatgctatattacaatgaaatgttttaaatttcaaactggtttatgtttttaaaagaagacaataggaaaagctaaatacacagcaacaacaacaactatattgaaacgtccgttgtgccgataagttcctttaaactaccatcttggaaatatcctgttgagtgggtgttggtgtgggtaacaataatgttgttttcataatatgtgctggcagattagcacacttctctacagtgttaacagttgtaattaaggaataaacagcacagggtgtcagtccgatgacaatttcatctatagtgtcacaatacaaaatgtcacaaaatattagaactgttatataactataaaaagtatcagcttaaaagctaaaagcctttgaaaaaagaagacagaggaaggaagaaaaaagaaaactggcatagcaaccagaacaattttataccttctcaagaatgttctgtcatgaaaataaattgataatttttttctgttaaaa

SEQ ID NO: 193007 - DNA, 353 bp, Homo sapiens
ttttctcaaggagtatgagtacttgaagggctccattcacataattttaaattgctttctataaatattatatcaatttataataccgctaatgaggcatgagagttttacatctgtattagtctgttctcatgctgctaataaagacctacctgagactgggtaacttattaaaaaaaaaaaaaaggtttaatggactcacagctccatgtggctggggaggcctcacaatcatagcacaagacaaagtaggagcaaagtcatgtctcacatggcagcagacgatacagagagcatgtgcaggggaattcccctttgtaaaaccaattagatttcttgagacttaatcatta

SEQ ID NO: 193008 - DNA, 629 bp, Homo sapiens
tgcactcataaccagtggtatgctggtaatgttgaaccaccagctttctgtgtttgcggggagagcaccctgatttgtaatgtttgccaattactgtggtgtcaatatttccatcacagctgatgtcaagctgccaatgtgacatcactgaaagcagcattgggaagagatgtacacagcctgggctcctgagctagtgcaagtcactgggaactggctccccaataccactaacttcatcatccaattgagtgcataagatacacagaaggaacatttccagcagaaaagaattgaacagctatagtatggcagagggaggaaaatcactgaaacaaatactgaccatgcccttttgagtactattcaggagagaggaaggcttgacaatctgaactttaaatatttcgaaatccaaagactacatccccagccctgtaaaataaattcataaggttattttagctcagtgccattaaacaataacttatctaatgccttattttccatccttttccagtcaaacaagcttctgctcatggcctggctttcttttttttttttttttttttattatactttaagttctagggtacatgtgcacaatgtgcaggtttgatacataggtg

SEQ ID NO: 193009 - DNA, 392 bp, Homo sapiens
ggccagctgcttccaatgtctgctgtcactgcctctgctcccatcattcaaggccgggggaactccagtggcaaaagccccacacccccaatctacatgtgggttacattattttgttcaccactggtcagtgcaaaatttgcataggtaattctcaagtgctggtattcctggcagatgtgacactgggccaccccatagtgatggtgggcctgccaatgactgtccaggatggcctggggctataagtaggaaaggagaagttttagagaaacaaggaactgaggcagagtagagagaagccccttcaacataggcagagttgtgaagttagtacccaccccgcccagtcacacggggccttgaacccaagagttgttttttttttgttt

SEQ ID NO: 193010 - DNA, 259 bp, Homo sapiens
aggcatattggcttattttgaatgagaggtttttatcctctccttctttcgcatctgtttcagcctgctaattttgcattgtcttagctgtccactggatccttagcccaggagcaggcattacagtgtgccttctctattgttatgacactgaagataggagattcagacattgaccccatgaatggcatagctcagttcttggtcatgaggccacatatttgatttttggttcccaaattccatagcttcttttaaa

SEQ ID NO: 193011 - DNA, 565 bp, Homo sapiens
attagctaagttcatatattttatttgatgataccaaatttttatcctgagctactcagtctaaatatattccctttttcttctcaagcatcagatcgaaccttaagatgattaaggaatattcttttcccttaatatttagaaaacagtagtgggcccacagtgacttactaagtgtacatgaaacaaaaatagtcaaggagggagcaccatatttagcaatacaaattatgcctttttatgactgaaaaaataatctccctcaacaatgggcctaatactggaagacatgagcagaaaaaccttactaccctgggtcccagcccttagcaaggctgctctaaacacagggaaaaaggatgcattcaagagttatgacaaccctagcacattcaatatgagtaaatcaaagatgttaggtcaactgacactctggaacacacaatgctttcatcaaccaaattacagagatgtaaagagctgatgcaatcaagttagctgaaagccttgttgccttttcaggttccagaactcatccttcaaggtcccctttgcttccttcttt

SEQ ID NO: 193012 - DNA, 135 bp, Homo sapiens
gtggtgatgacgctgagacgtgtggtgatgacgctgggatgtgtggtgatgacgctgagatgtgtggtgatggcatcactgagatgtgtggtgatgacgctgggatgtgtggtgatgacgctgggatgtgtggtg

SEQ ID NO: 193013 - DNA, 511 bp, Homo sapiens
attgtcttttatctgccagtgtactgggttgaatactgtcccctcaaaattcatgtccactggaacctcagaatgtgatcttatttggaaataaggtttctgtacagttaagataaggttacggaccttaagagaaggttaggactcaccctaatccacagtgaccttatcttaacttgattcgggtgggtcccaatccaatgaccagtgccttataagaaatttggacatggacacacagagaggggtcgggtgcagtgactcacacctgtaatcccagcactttgggaggccaaggcaagcagatcacttgaggtcaggagttcaagaccagcctgaccaacatggtgaaactctatctctactaaaaatacaaaaattaagcgggtgtggtcgcgggcgcctgtaatcccaccttctcgggaggccgaggcacgagaattgtttgaacctaggggcagaggttgcaataagctgagactgcaccactgcactccagcctagatgacag

SEQ ID NO: 193014 - DNA, 499 bp, Homo sapiens
tgcttttctgacaagattaactagaacatctagcaaatctaattaaggaaaagtgagtggaaatccataaacatcactgatgagtaagaaaatggatagaaccacaaaagttataaaatttttttcagactttaacagaatactgtatatagatcttaccaaaaaaaaattaaaaatgataaacacagagcagacagaaacacagactgaaagagggatatgaaaggagaaagattggaagacagagagaggggtaggtgcaggcacactcaggttgccatactgttaaaatggtctaatggtataaaagtagaaacagctgcggcttttttttttaagccagcaaaatcttgatactttgagaagggaagactataactagaaaactgcagaacagtcttcagtttaacacagtaattaacatacagaagtgcttgaataaaaactgcccgataaaattggtaaacatttttaaaataatagtatttggatgttggtg

SEQ ID NO: 193015 - DNA, 236 bp, Homo sapiens
tctggattttctattatttctgcatttttgccgttttgattgttatgttgttttctctccagtattgtttgttgtcacagagttctgtctcacctggaaagtgagaatgaacagtgggttgcagctgtagaacctcttgccttggcaatgtgggctatggcaagaaggttcccgacccctaagcatcgtggttagggcaggcgctccggagacagacgactgtgggtttgaattgc

SEQ ID NO: 193016 - DNA, 476 bp, Homo sapiens
attactaactttaaaaaattggttgacataggctttttcagaaactcaactaatccccagccagggccacgaggataagaaacagacccagccctgatggagtgtgtctcatcacaggcaacagacaagtgggcagatgcaacgtgacaaatggcacttcacagctcacaaaagggcttctggaggagactcgagtctcctagaaagatggaccgtgtagagggagggacaggaacagtgaacacagcaacctggcaaaggccaggagtcaggagggaagctgacatcggaatgaggcctccacgctgcaccaagaaacttggatttggaggtaaagacaacagcaggaagcctgcgaaggacgtcctaggcagaggcaccatcactgcacaagtgacgaacatgctggaggggacaacatgagaggaagaccgctgttatctggagggagatgcaagcagctgaatgcaatgcag

SEQ ID NO: 193017 - DNA, 296 bp, Homo sapiens
gaaagaacagttgcagtggttagatgataactgtgttcaagaggactttcatcctcttgaagtcctgtttggctcgtaggccgcacacccccgttcctgtgttcacatctgtgacgatgttaatgctgttcactgcaccatgcctgaagtctcaactctgagcatgcctgtgctgtcctttgtggctcttccttggttaggtctccctcacagttcttctgagatatgcaacccacagactctggtgttttttcactgtcagatgcactgcatcctcacttctcttcccagtcata

SEQ ID NO: 193018 - DNA, 447 bp, Homo sapiens
actttgggaggccaagggagacagattgcttgggtccaggagtttgagaccagcctgggcaacatagcaaaatcccgtctttactaaaaatacaaaaaattagcagttgtggtggccggcgcctgtaaccccagctactcgggaggctgaggtgggagaatcacctgagcctgggaggcgaaggctatagtgagtcaagattgcaccactgcactccagcctgggtgtcagagggagatcctgtttcaatttaaaaaaattatatgccaacacttgtatgcatctgtatatacctatgtatgtatttatgggaagaggtaatagctttataaacaaaactcgaagaagttgtgagccctaagttaagatccactgctctacttccaatgctctcttctttttttttttcctttaaattgtggtaaaatatatataacataaaatttg

SEQ ID NO: 193019 - DNA, 462 bp, Homo sapiens
agctcaatctctcactgaattatggttatctgtcaccactgtatctgcctatcagtgattagggagagctctctctggagaaaaatgtcacctagagcatcaacaattttcatacacagtatccagcattcacttgaacgttaccaagcatacaaggaaacagaaacgagaaaaaagagacaacatatccacatatccacagtgacccagttactagttactgaagatgatctttaaaatagctgtaattcggccgggcgcagtggctcacgcctgtaatcccagcactttgggaggccgaggctgaggtcaggagttcgagaccagcctagccaacatggtgaaatcccgtctctaaaaatacaaaaattagctgggcgtggtggggcgtgcctgtaatcccagctacttgggaggctgaggcaggagaatcacttgaacctaggaagcagaggttgcagt

SEQ ID NO: 193020 - DNA, 674 bp, Homo sapiens
tgaaaaaacacaggtctcagacttactaaattaagatttcaaaacagctgtcttaaatatgcttaaagggctaaaggaaaacacagacaaggaaataaaggaaatcaagaaaacaatatataaacaaataagaatatcaacaaagagattggaattgtaaagagaaccaaatagaaattctggagctgaaaaatagagtaacctaacagaaaaattgactagaaggatacaaaagcagacttgaaaaggcagaagaaggaattagcaaacttgaagataagtccattgaaactatcgagttaaggagcaaaagataagagtgagaaaaagtaaacagagcctaaaagacaccatgcaccaaacacatatacattattgaaatctccagacaaaagaaagagaaaagggcagaaaaattatttgaagacgtagtggccaaaaacttcccaagttggaggaaagatgtaaatatacaaatccaaaaagttctgtgaatccatgttggttaaacccaaagttacccatagtacattcatgcataattatgtagcatttgaagataaaaaattttgaatgccttttataatagcatccaaatacatagggatacatttaacaaaagtgtgtaagaagactataatgaaaactaaaactttgcagagaaaaataaaact

SEQ ID NO: 193021 - DNA, 450 bp, Homo sapiens
atcaggtctcatctggagtgagcaggcatgatcctcccagcccccaaaaacccctggccgggcgcagtgtttattttccaacctagacaccagatggcagcagtacccggttcaaaatccaacaacaacacagtggggtacacgcagctcaactgacgacttttaatccagttccagtagtctacgcccgtccccacggtccaaccaactccagcagatgggacctacaccttcgatcacactgtctcatcctgccgggaaaccccactcccagtaggtcccacagtcccccacaaaaacaccaaccaaagtagcacctccacccccaggtgccaatggagggagcgccccaaacgtggcagctatgaaatcaaagggggacattttaaatgcaacgaggggctggagacagaacagagaaagagacgagggtcggtggacccctcgggg

SEQ ID NO: 193022 - DNA, 205 bp, Homo sapiens
gtgatctaacgtccccttagattttgagcatcaccatgcccggctaattttcgtgttttttgtagagacgggattttgccttgttgcccaggctggtctcgaactccggcactcaggtgatctgcccacccctgctccccaaataacgtattttaaaacatacagattataactgctttacaataggtgatgctcaatttttttg

SEQ ID NO: 193023 - DNA, 358 bp, Homo sapiens
tgaggatcccctctccacactgttatataacatcatgtatatacttaatgcctcagaatagtccacttaaaatggtcaaaatgataatatgttttatgacaataaaaatggatataaaaagaagggagcaattaaaagttattattggctacttcttctctggtgtttgtttcagttcataaattagttttctaacccaaattcatacttgtgtagtaaatttacaatttataataaaatatttagtaaaacttagttctcatattaggaatgggtatattgaattaagggcaataattcctttattgtaatgtctgtgagctcacaagtttccaaaattccagttatgccccaactg

SEQ ID NO: 193024 - DNA, 239 bp, Homo sapiens
tttttcattttgccggcaaatatctgtaactaatttttttaaagatagggtgggtgcttggatgctacttctttcatgattgaaaatatctttattttgccctagcatttgaatgctgctttaggtaggtaataaatttcttcatttacagtctttttcccttacaactctgaggagactatgtctttttttttttttttttttagccatttggtgttatagatgagaaatctgattct

SEQ ID NO: 193025 - DNA, 592 bp, Homo sapiens
  misc_feature (9)..(9): n is a, c, g, or t
  misc_feature (18)..(19): n is a, c, g, or t
  misc_feature (27)..(27): n is a, c, g, or t
  misc_feature (36)..(36): n is a, c, g, or t
tatagctgnctctagagnntacaaccncgagacgancttaatgaaaatgatactataggtctgcctttataagagccatattaagggagaaaagcgtacatatatttataaagtgataattttaatgttatcttaaatattgacttaatatcaattttacatataaaaaacatgcatgtattcatgaaacaagtctttaggatagatactaatgtgttaacagaggtcatttctttatggtggggttgtggtatttagatctgtctttatggctttgttttatgttttggtttgttttgtaatgaataagacatctataattagagtaaatacaataaagtgttaaaagggtaagaaggtaccattggtcttgtacatatattttgtacttattgattgctgtgtcttaaaaattattgtgaaaattttcaaacttatagaaaatttcaatttcagtaatacaatgaacaacgaacaacacacttgttcacctagcttcacccattgttgcagacattgttacacttatccctaaatacttgagcatgtatctcctaaaaactaggacattttcttatgtaagtacaatata

SEQ ID NO: 193026 - DNA, 617 bp, Homo sapiens
catcaaataaactgaccaatatatctcatggcgtgctttatctgtataaacgtacctaacattttccaaatgtgcttttcacatctaatattcatttatttgcatggtggaaaaatgggttgtttgaatcaggtatctatttttatagaattagattagggtgaagtacacttaacatttaaagcacatttaaattttaaaatgcctgagaattgtcatgaggagtcttggaattattagacttttcttgatgggtttgttgttacttattggtaatgagagagacatattctgattgaggttctagtacagctgctacaatcagtttcttctctttgccttcagtagcataattgtggaggtgaaaaatcagaaggggtagttcaaaaagtagttttcatgttaaacagccattttaaattggagtcacgtaattttccagtgtcttatgattatagctatctagattggctgaccctcagaaactgtgatgaggttaatattagtggttttaggccactagattttgaggtaatctcttatgcagcaatagataactaatacaatgttgatacaattggggctgtatttttggttgatggtaaaatattttgagt

SEQ ID NO: 193027 - DNA, 409 bp, Homo sapiens
cacgtatataccacttcaatttgatgatgcagtgctgctggtgcatgacccacttgatggctagatgggtcagaaagtacccagttcatgatacgcagttcaggtcgcatcgtgacttgatgacccatggtcaaatgttcagtttccaccaaagcccagtaacaagccaagagctgtctctcaaaaggagagtagttacctgcagattatggcagggccttgctccaaaatcctagatgcctccactgtgattcacctatgggggcctgccaaaggctccaaacagcatccccgtctgccactgacacctcaaataccattgaatctgctaggtcatatggaccaagtggcagagcagcttgtacagcagcctggacctgtgtccgttctggaccccactcaaaactgg

SEQ ID NO: 193028 - DNA, 185 bp, Homo sapiens
ataaaattcctagcctaggccctatttatctttgcatcccaaagatctgtaatcttacatatcttaattaaaaagtggttaaaaaaaaaaaaaagacccagcatattaacaatgtatgagtatctacaacaatgtagaatctaattagaagtatgaccttatatatttcctgaaataattgtgct

SEQ ID NO: 193029 - DNA, 299 bp, Homo sapiens
tctagtggggacaccgaccactaaataccaaaatggtcttctacgtctcttatgtgcctattgtttcctatcttatgattatttacattcattctattgccttctcagagggtgtaatgtaagttctctgagagcagggaacaattcactgtaatattcactagtaccaggcacacactatgggcttaaatcgtagaagaatcagtccaagttaaaaggacctttttgtataagcttcagtcatcatagctataagctgaaatcctctagatagttatcacaaaatctcactttacatt

SEQ ID NO: 193030 - DNA, 275 bp, Homo sapiens
tgtatccgagcactttgggaggcagaggcgagaggatcacttgagcccagaagttggaggctgcagtgagctatgataacaccactgcactccagcctgggcaatagagcaagacccccttctccgaaaaaagacagagagagagagaaagagaaacctgaaggagataagagaacactcaccgtgtatacctgagggaagagaaatccctgaagaaggaagagccagtgcaaaggccctgaggctggattgtgctgggtggccgatttggctgc

SEQ ID NO: 193031 - DNA, 210 bp, Homo sapiens
aactgctggctacatggatggagagcccctctccagctctaatactctctgtgttccatgcctctgggttatcagcaagaagcccagctgctcggcccataactcagatcagttagcatataaactccagaaaataattgccctcttaattgctactgataccatgtcttgaaccaggctttgttcaaggtgggatacaggtgggacaca

SEQ ID NO: 193032 - DNA, 404 bp, Homo sapiens
ccctccttttaacagcaatgagattcagggttaccatggccttactcatcttcccattgtaaatatatcacaatgtcacaagagcctctgtgtccaaacacactaaactgggtttacaagcattagaatctttcactcatattgtgaatctcaattctgccagtcacctagtctgtgtatctgttcccaaactggaaaaaataattcttgagagaataattttcagaataatggaggtggaaagaaatgaacagttaagcaatttttcaacatagacaaaaccactggaccattgatagccctcaagctctgattcttcctcctgactaagtttcttttctttggggggctttcaacatctgaattttccagatgattgcggaaccatcgtcactaaaccaaag

SEQ ID NO: 193033 - DNA, 308 bp, Homo sapiens
gaggactggcttctctgccgcctccccgacagacggttctgttgccaagattctggagttttgccagctggatgggaaatcagtggagctcattaaggctcagtttacattttctcttattctgagtgaagctgagcctctttccttatgtttaagagctatttatattttcttcctgtgatacaatctctgttcatatcacttgcttactattgttgcactttctagaactactgaccttttctcttactgattttttttttttttttgaggctgagtctttctctgttgtacaggctgcagtgtag

SEQ ID NO: 193034 - DNA, 129 bp, Homo sapiens
gacagaaggaaaatggggaagcagcggaagaaagaaaaaaacgcacaaacaggcactagatagatacagcaaagcccagaatgtactaaaaaccacttgttaacagctgacatgcactcacaagctgtg

SEQ ID NO: 193035 - DNA, 349 bp, Homo sapiens
tggtggaggatataagtataaaataattacctaagtacaaaaataaaggtacatgaaattgttgtaggatcatggcacaaggaatcagagcctgtattctacatatattcattagatgtatatgtgccaggaactgttctgggctttaagagataaagaaaataaagtttctgctctacattccaactgagagagaaaaatgctgaggaagaaataagtaatatgagaaatggtgacaactgcaatggagaacaataagcagagtgagaaggaaaggaagagggaaaggcagggctgtttttctgaagtggtcagggaaggcctctctaacaggtgacatgtgcacagc

SEQ ID NO: 193036 - DNA, 554 bp, Homo sapiens
taatatttcttcctcaaatatttgaaagaattcctgggcctggcgttttctttgtgcaaagtattttaacatgaatttaatttctttaatacagattttctatttcttctttattggttttggcacactgctttttcagtaatttgtccattcatctaaatttttaaatttattgatataaagttgctcataagatagtcttactctttaaataaatgtctttaggttttttgatattcataatttgtacttccttttcttttttgctttatcagtcttaagtactttatcaacagtatttggcattttaaggaaattaagtttggctttatcattaataattttctgtattgtgtgtttgttttctgttccattaatttacgttctttatatttacttctactttcttttgggatttgctgttttttaaatctttcttatttcctgagctatatacttttctgatatatacatgtaaagttacacatttccttgtaagcatggccctagctgcattttacatttttctcttttatcacattttcaattacatt

SEQ ID NO: 193037 - DNA, 484 bp, Homo sapiens
gccacgctgacaacgttgattgctgcctgctgagaccctgagcagagaacccagagagcccacccagactcttgaactccatcactaggacagagtaaacgggcgttggtttaagctgctaagtgtgtggcagttcatcacacagcaacagaaaactaaattggcaagcagtttatcttgtgctgcgttctgactcctcagaataacttcctctaagagaaaatccccacaggctgggcttctggcccagcagcgtggctggtttgactcactgcagcgtcctctgtggacacatggcaggagtccttcggtccatgagagggagctaaacaagaggctgcccttccagaggtggaagctgcagggcgttcagccacaaagggttagaaagttcctctctctctcaggctggagatccatttgatggtgccacaaagcaagagtccaccaaaataaggaggcctaacatgtcctggccagaggc

SEQ ID NO: 193038 - DNA, 350 bp, Homo sapiens
aggaatggcaagtacaaaggctctggggcaggagagtgcctggtatattggaagcacagcaaggaggccagtgtgtttagagcaaaaggtacaggcagagatgagatgagattagataagtaacaggataccagaccattggtttagtacttttcaatactgtcagccctatcacctacattttcactacaaacatgctacagtattccttatactatctgaaatgaaatgcatacatagtataacctacctatgcttacataattaagtatataaagaagaaataacaaattttagatgaaattatatccagtacgtaaatggccctaacaatactagaagacctaaag

SEQ ID NO: 193039 - DNA, 447 bp, Homo sapiens
gtacatgcacacagctttctggatgacatgagtgtaatcttagtagggtctactttacctatcactttccctgaatctccctgataaatttctggctggtctgccattttgttgctttctgcaacactagctttgccagactgttagcaaatgagacctctatcattttaaacaatatgcctgggcatggattttttttttcccaagccctgcttttaataaagtcagctctctttgacaggacaacagatctaccagtgctcatggcttaccctgcccgcccagggaagaacctgagggaccacagagctggggaatgggagcagctcctgactaaaatgacacagactgtcactgatcttactgagattcaatagcttccatgaggccttaaatgggtgttgttcgttgttgttgttgtttttgagacagagttttgttctgttg

SEQ ID NO: 193040 - DNA, 442 bp, Homo sapiens
ttgtggaacatattttagagtataaaagctgttagacaggtcacatacacagacacagtccatgccagaatacagagaatatagcataatgaatgacacgtatatacttttaaagttatcttctcacatacaatgtaagcagtttatgaagcaaaggtgagctttaatgccaaatagtagcataatgctagctgaaggagtaggaggaatatacagtcatgcattgcttaacagtggggatgcattctgagagatacgttattaggccatttcatcattgtgcaaacatcagagtatcatcaaaactaggtagtatagcttactacacacctagcctacatggtacaacctgttacttataggctacaaacctgtacagtgtattatggtactgaatactgtaggcagttgtaacacaatggtgtaagtgtaactaagctgc

SEQ ID NO: 193041 - DNA, 571 bp, Homo sapiens
cctttgtctcttcgatactcactttacagtacaagtgaatcgacgtggaaagcttcataatgccagtgagggcataacctcgtgtcacagaggtggacatattagagattaggacactttctaaaatatccaacacttcatcctctgttacctgaataggctcttcctcttcacactggccagatactagaagatcaccatattcacctatacaccatgcagccacttgtaccagaggttgttgagaataatcaccaagaattgctatgttgcgactttggaatgcagtggctatgcacaggtgtgattgtggctcactgaagccccaaactcctgggctcaattatcttttttttttttagacggagtctcgcgctactggcaggctggagtgcagtggcacaatctcggctcactgcaacctccacctcccggattcaagcagttctcctgcctcagcctcccgagtagctgggactacaggtgcgtgccaccacagcagctaatttttgtatttttagtagaggcagggtttcaccatgttggccaggatggtcttgatctcttgact

SEQ ID NO: 193042 - DNA, 388 bp, Homo sapiens
gctcaggaggggagagcaagaccagcctgcagcttcatgaatcaggtcagctgggccatctggagcagacaggtgtgggtcgtgcccccgaatctcatttctctagacaggatttgctgcctcgatgctgatcttgagcatttaaaacatgtctctgcacccacgtttccgtcctgcaagggatgattgggttgtggtagagcttaaatgaggtaatgcatgcacggaccccagctctgagccacaccactcggatggctccatcagtgtgggtgccctgccctggtgggatgaactgggaggcccttctaactttatcccatcctagattcccaaagaccaccccatgcctcagtcttgggcagcatttccatttcccccccctacg

SEQ ID NO: 193043 - DNA, 375 bp, Homo sapiens
ctgcaaaactatcttgaagagaaaacatggcaacatctaatacagcagaagatgtggatcatcccctataatccaacaattccattcctagataaatactctagagaaaatactgcacgtgtgcagacagaaaagtgcatattcactttaatgtgtattagaaatctaccaaaatgtatcctgatggcagaatggattacggtaaatcttcaaactggataaatatataagcagtgaaattaaaaaacttacagttacctttcacaatacaacatcaaaaaaggagaaacaggcaagcaagaagaagacaggcagggcacggtggctctcgcctgtaatcccagcactttgcaaggccgaggcaggtggatcact

SEQ ID NO: 193044 - DNA, 718 bp, Homo sapiens
cctcaggttgtccagctaaaaggggagtaatctgcaggtgctaatataagtgcaatgctcctataggagctcctgtagtatctttgcaaagatgtagggaccaactgtgtacagtccatcttctagttcacaataaagcattggtctttccaagtgaccttgaatcttaatctgtgcactatcctggcttagagatgtggatatcccagtgataccaggttcttatagtttttcttgtcttttcttcttttttgagacagagtcttgctctgtcggccaggctggagtgcagtggcatgctcttggcttgctgcaacctccgcctcctgggctcaagcaattctccttactcagcctcccaagtagctgagattacagatgtgtgccaccacgcccagctaatttttgaatttttcgtagagacagggtttcaccatgttggtcatgctggtcttgaactcctaacctcaggtaatccgcccgcctaggcctcccatcctatagtttttcaacactaaacctctgtgtatagtcttagaaaagtccagatattctcacatgtcctgagagaaatctacagccacatccctgaatttcactgatccagggtcaatcttcctcagtgttttcttctggaaaaacacagtctactttgatttttaggtgtgcaacaattcttctttcacaagataattcttttggggaggggcagaaagca

SEQ ID NO: 193045 - DNA, 591 bp, Homo sapiens
atagcaatgcacagttacaggaaacgctaaagtagaaagtgtgagagctgttggagcatgtctgtgaggattaagttcctgggatgagcacagtggtgtcactgggcctcacaaagagaacaaactgtagctttgaaaagtgctgaaccatgaaatatattttagatttaaatttggaataacaggaatagtaaaagaataggttcaccacttggacatgatggtgtgataggatagatatggagaaaagaaagaccaattcacatcttcatttacttctatttttttctttctagaagagctaataatcttcaaattgggacagggaggacaagacatatgaatatgaacaactaattaattcctaaggtagatgaggagaaaatagaaggtctaggcactgtcactgccccagacacagatgtagaacttcttaggtattaaagaatgtgaagatttggccctggaaatggtggagttctgcaggcacttatggagcttaagaagaatctgaggatggagaggtattgagattttcaacaaaggtacaaagatttttggaagttcagaacaacagtattgatgttagga

SEQ ID NO: 193046 - DNA, 603 bp, Homo sapiens
aagctgaccatagaggaccccgatgtgcgtgcatgtttatcatgtcacttctgaaaatccttcactgaccatccccatctaaacagaattctctacttgacatttctgcattttctgctccctcagaatagaagctccagaaccgtatgtatcgccaacacttaaaacaccaccttccagagtatcactcaataaaatatttgttgaatcaatgaatactgttagtctccaatgtttgaaatttgccaaccctacccatcagatcaaagggtatactgacaagagtaaaaatggcgttcagtggtgggtctgtcctttagagaaaaagaaaccaaagttaggtatgtacgaccctccaagagaaatggcagagaaccaacccagccaggaaggaaaaactaaaggaaaaacatttgctgggaagattaaatgagaacacgaaacacccagcacaggcttcacgtacaaaaatattcaataaattacatgttgtatagagctgttcaaatcttggtcatctatgattagaaagaatctaacaggaggaaacaattaatttaaaaaaaaaatctgagaaactatcgaagtaaagaccagcttctt

SEQ ID NO: 193047 - DNA, 447 bp, Homo sapiens
atgggctcttttttggttccacatgaattttagaattatttttttaattctgtgaagaataatggtggtattttgatggggattgcattgaatctgtagattgcttttggcagtatggtcattctcgcaatatcaactctacccatccatgagtatgggatgtgtttcgcagtatcagctctacccatccatgagcatgggatgtgtttccatttgttcatgttgtctatgatttctttctttctatctttctttctttttctctcttttttttttctttttgatgtagtctcactcttgttgctcaggctgcagtgcaatggtgcgatctcggctcactgcaacttccgcctcccaggttcaagcgattctcctgcctcggcctcccaagtatctgggactacaggtgcacatcaccatgcccagctaatttttgtatttttagta

SEQ ID NO: 193048 - DNA, 306 bp, Homo sapiens
cgtacctgtattccctgatctgacaattcacagtttcagctactactggaaaatgactcaaagaattaaagtgttgaaatagatgcccctaactcctttgctagaataaacaaggattgtgggtagaatgtaaattattaaaatgcattaactttctcctggacaagtctggtgctaatcacctttgccgcgaggaaagataaatgggttgtgcgtgttgcaggctgaactggcacctgacgaaatcgtgaagtagcaaagtttgtcttgatgattcctgttccagaacatctcctattccctttc

SEQ ID NO: 193049 - DNA, 494 bp, Homo sapiens
tgaggtcatgagtgagggtcaggatgtgaagtgctcttataagaaaaagagaaaccagagctctcgctctctccaccacatgcggactcagcaagaaggcggccatctgtaagccaggaagagagtccccaccagtgaatcaaaactactggcaccttgatgttggacttcccaatctctagaactgtgagaactaaatttctgttgttcaagccacctagtctatagttgttttttaaaatagcagcttgagctacgacaaggggcaactaggatcagaggtgatgaaagaataaaaatgagccagctgagagccctggagggtcactcactaactttttctaagtaatagagaaagcattggcaaatgttaactgcaaactgtctcttcacagctggcctgagagcctgcatttctgttctgccctgggggccaagaaggatgttcctctgtaggagggaggccctaaattgtttccactttcacatgtgtc

SEQ ID NO: 193050 - DNA, 262 bp, Homo sapiens
attttacatattaacaaacataaaagtagacattaaaacttatgattaattaataagattaataattaagatttagtcttcagtttatagatacactatctgaaaatgagcatttcaaagttccaagaaaagacccacccctcctttttttttttgtttttgagacaaagcctcactgtcatccaggctggagtgcaatggtgcaatcatgtctcactgaagcctcaaccttccaggctcaggtgatcctcccaccttagcc

SEQ ID NO: 193051 - DNA, 360 bp, Homo sapiens
cgatcaatgttcactgttctgcaattttgaaaattcctctcctgccaaccttttcaacataggtttcacaattgttctgcatcttgttttggccactttcccgttccttgtgacaacacaaatattatctaccctagttatgtgatcacatttacttaccaattgtcccattgcccccagaatataaattgtctgtatttaaagataactatagtgcgttcttagtttcacttttttgttttttaatctcaggttttagccctctcctaatcacatgtgtactacctttcactgtttatgatcattttccttgatagagaagcagaaacaaaataggattcaagatgttctgctgtttac

SEQ ID NO: 193052 - DNA, 344 bp, Homo sapiens
ttcgtgcgaggcactgagtcaggtacagagacaagcaatgcagttcctcttcaagtatgatggaagaggaatacattataaggacacagaagtggaatattaaggcacactgaggagttaggaaagacttataattcctaaatttattcttgagttttgaaagagataggcagaaaaagtttccatgtaggtacagagacatgaaatcacatgtagattaagggaaggagtatgagacagggaaatggccaaatcaagaaggcttttatgtaccaagtaaatagtttgaactatatttcaaaattaggagtaccgttgaaagattataaacagggacatataat

SEQ ID NO: 193053 - DNA, 704 bp, Homo sapiens
gtaaataacacattttcaaggcagagtttagaggattgaatactgggtagcaagaccagaagtggagataatgatatcagatcattattacatacaaccagacagtctgtctcttatataatttatttgcctatgacgttgtagataaagaacattatcctgtacatatcctaattttttcatttttgaatccttaaaacagttctgagaaataagttagttattctactaaacctaaattactcaagaagatattgagactcacgaaagatgcatactttgaggaagtttagcttggactcaatgtgttgtaagttcggggctgccgggcgcaatggctcacacatgtaatcccagcagtttgggaggccgaggcgagcagatcacctgaggtcaggagttcaagaccagcctggccaacctggtgaaataccgtctctactaaaaatacagaaaattagcagggtgtggtggcaggtacccgtagtcccagctactcgggatgctgaggcaggagaatcgcttcaacctgggaggcggaggttgcagtgagtggaaatcacgccattgcactccagcctgggcaacaagagcgaaactctgtctcaaaacaacaacaacaacaacaacaacaacaaaaatctttggggtcaaggttctaatcatcatggtatgctgttcctcacaatataaaattatgtgcc

SEQ ID NO: 193054 - DNA, 344 bp, Homo sapiens
cagatataggctcagtctttcatcagctcctgagtggtagaaagggataggagtctgagggcagtctccatctccacatgcattttcttgttatgttttcaaatcaccctcccagaggccagcttcagcaagtaggaagaataagcagtcccagtagagaaatgccgcacccctaattctaaaatgcttccctgctttgaggggaactgtccatgcttttggaaagttagcttagaaaaagtccctgggggcccatggactattggataatgtcacaggtatttagtttctagcccggatgctattgctgttcttagtccaagacccacagctatgaaaaggct

SEQ ID NO: 193055 - DNA, 251 bp, Homo sapiens
ttaaaattcacaggctgacaatggaataaacagaacaaatccatgaaagtttttttctcttagaaaaaacaaagaagtcactgtaggattctgctgatgtgtttaagctttgtgagtgggttttaaataatattaaatttacacaggatgtgttactttctaggatcctaacaattagaaaaggaaaagtggtatatttcagctagaatgtatattgctagcatagaataaggactcagtaaatgtttgca

SEQ ID NO: 193056 - DNA, 308 bp, Homo sapiens
ttcagatgtagcattcaaaaatctgtggcggagaaatttgtcctcgtttttataagctataccctgtaaatgaattgtagaaaaccagatagtgaaatcatctgactgggtgaaataagcccaaccaatcaggataatgaatctgctttcttcactaggatataaagaaattagaatttggtataaactctatgaaagggatatgatggaccaaacaaaaaacaaaaaacaaaaaacaaaaaacaaaaaaacactctaaatgcaatatagtgggtaaaaaaaaacccctcaaaaacaaaaaaacaaaa

SEQ ID NO: 193057 - DNA, 592 bp, Homo sapiens
taaatatcaacaacagtattttggcacaaagtaggtgcctaataaatggaatcattagtattagccccttttggtgttattttatattaatatgtcctttattttagtggtttttcaaactgcaggtatcaaatcatgagtggattgtgaaactaatgtacacaactttgagatacaactagaattttttagtgataaagaatagagtagaattgaatttatccaagtatttcacagaagtgtttttatgcgaaacttctcttcagtatataatatctaggcagacagagtgtatatactggatgacaatgtaaaataacctcttaactatgggttgtatccaaaaactcctccaaaaaacaggattatattggatacttgtctcatagtttccaagtcttttgatactatagtggctaagacaccttggttcaaatcccaactccattaattactactatatgactttaactgcctggcttttactgtataacctcctatgacttactttcctcacctatgaaatgggtgataattattaacgagaataatatgaaatattatatgctttaatatgtgtaaaccacttagc

SEQ ID NO: 193058 - DNA, 377 bp, Homo sapiens
aaatgttcaccatggcattgaagtacctcaatctatcccttttcatgttcccattcacacatcttatgttgcagtcaaattctataatttgctcttccacaaacatgagataagctttccaatcctcgtgctctgctcatgctgttcccacttcctgggatgatattgcctggtctccaattgtccaaaccatactcattttcttaagttccatttcaacttctaaatgaaatcttccatatctctgccagaagtcagtattcttcttctaaattcatacattactctgttctcaacaatcagctactagattctgcatatatgtatatgtctgatctccctattatatgacaagctttcttatggtaggaacgaca

SEQ ID NO: 193059 - DNA, 678 bp, Homo sapiens
gattaagggagtttagtcaacaatgtgttgaagccacttataacgactataccttgagctgtgtgaactaatgtaaatatagtataggctgaaggacaaggtggacaacagtcctgcctagctctgcaatggtcaggctacccgtggagattggagaaagtcaaagccacattatgtgagtcacattgggacaactggagatgtttttcctgaaaaagagaagacttgggaaacatgacccatcttgaaatatatgaatggctgtcacatgaaggagggattaatagacttgttctggatggaagctaatggaagatacatttttgctaacctgaagtttacgtaaagcttaaaccctgagcttatgaaacaagctaattctagaggtaataaacttcccatcactaagttcaaatggagtctgtgtaactccttgacactagggtgttctgcaggggattcagcattgtaaaaggggttgcacaagatgacttttagagctccttttagacctgagattctattattcactgatacagatataaatcactggagctctcatttaagcagtttcttttgctgccccataactaggtgatggggtagatttaattcaataaacatttactgaaacttaaccaggtaccagatcttacactagatattggaagaatagat

SEQ ID NO: 193060 - DNA, 339 bp, Homo sapiens
agacattttagcagtcctggaacagataacataaaaacttgacaagaaagttgggtggctaggaggatgtggggcttatgaggtacagataggaattgtgagatactaaaattcatctagtcttatctggtcttcttctttcaacagcatctgttttgaaaagctattcctttgtgctaaaatctgtcgctgtaatttctaccccatagcacacttaggagtaaatttaatctcaaagatggttactattctccttactgctcttcccccacaaaatttttcttctgggaggctaaaaatgtgtgatgcctttaaaacaatatgtgtatagtatagtgc

SEQ ID NO: 193061 - DNA, 341 bp, Homo sapiens
caggatgtatctgctcaatctgtctgtggtgatgttttggtgcacgctgatgcctatttcctttcactgcggagcttgtacactacacacttagcaggaagttcagacctaagacgctgcatcctggacattctgccccctgaagatattggtttgtttcttatcttctgtcgactgtgtgtgtgtgtgtgtgtgtgtgtgtgagtgaaagagagacctttttattgttgccaagaaaaatctctcattagtgtaaaacaaagttgcgtggctgtttttttcttccttataattttagtttgagtagaaaaccatgttgcactgacatctgcaactctgag

SEQ ID NO: 193062 - DNA, 660 bp, Homo sapiens
ccaaccctatagcacaagtactatcactttaaaaaataaactgaggctcagaaaggtttaataatttacctacccccagaagttcaagaacaggtaaaagtaattgaaggtggcaggagtcagaataatagttatgtggggtagacactaacaaggaatggccatgagggtgtctcctaggcaggagtgttttaaatcttgatcttgacctgggtaagttacatagcggcatgtctgggtaaaaattcatcaagctgtgcatttaagactctggactttatgcatcccaatctatactaaaggagaaacaaaacaaaacaaataaataagaaaaacaaacaaacaaacaaaattcccaaaaactaaaaataaaggaaaaacaggctgggtatggtggctcaagcctgtaattccagcactttgggaggccaaggtgggcagatcacttgaggttaagagttcaagaccagcctggccaacatggcaaaaccctgtctctacttaaaataaacaaattagctgggcatcgtggtgctcacctgtaatcccagctactcgggaggctgaggcaggaaaattgcttgaacccgggaggcagaggttgcagtgagctgagattgtgtcactgcactccagcctggatgacaagagtgagactgt

SEQ ID NO: 193063 - DNA, 366 bp, Homo sapiens
tcctcgtggatctgtgtataaacagctactcacatttcacagctacacacttcccagctgtgatcggggacaggggagagatggagtttgagtcttctgagcacccctcagggtaccccattctcctattccatagcagctgcacaccagaaaagctaggcagcttgtcaggggggggtggaaaagtcacaattcacctcccgccaggagtggggaaagagagtgacagtaccaagaagagtgacaggtgaaaagaaaaatataactcctgtcttgcagaatcgctgggctaagactacaccaacaccagtccttcatcccacatcctattaaataaatctgaatttaggtggttatgataccgcg

SEQ ID NO: 193064 - DNA, 380 bp, Homo sapiens
tgggcaccaggagaccaaactgctgcagaatcagagatatgtctgagatcacagcagaaagagaggaagtagaaacgggattccgctgtgggccttctgccccagctgactgaatttccacacactccatatatgaaaatttcttttcctaaagcatggtagaatgaatgctgctgggccccaccctatcccctttaccatctgagtgttggctgataacactcacagctgtctgctctctctggagaactggactgtaaccacccacctcctccacagcagacctgggtcaatgactaactggcagaggggtatgaagagctggtgcctttgccttgaggtgggactaatgttggtgcagtttatgctacagagcttct

SEQ ID NO: 193065 - DNA, 199 bp, Homo sapiens
aagccacctgaccttacctcccattagctgtccctgtaccatctaactaaaatgtacagatacatacttgtggccaggcacggtggctcacgcctgtaatcacagcactttgggaggccaaggcaggcggatcacctgaggtcaggagtttcagactagtctggccaacatggagaaaccccgtttctactaaaaatgc

SEQ ID NO: 193066 - DNA, 333 bp, Homo sapiens
tccaggcatttttaacagaagcaaagtgacacttttatagaggtataatatagtgacacagctcttttccaatactattaaaaatcaaatgtaaccaaaataattcctaaagtaggtgatccctaccctcttatggagtcaagatccctttgagaatctgatgtaagcaataaactctcagcaaaatgcacatatacataatttagcacatgattttaggagttcttggatccctgccgtccatctgtggactctaggggttcaaggatcccaggcctgctctagaatgtgaagaaatgggctttaagctgttggctgaagttcttcgagatg

SEQ ID NO: 193067 - DNA, 433 bp, Homo sapiens
tgtatgaatccccctctttactaaaaatacaaaaaaaattacctggacgtggtagtgtgtgcctgtagtcccagctaatttttggtgtttttagtagagatggggtttcaccatgttggccaggctggtctccaactcctgacctcaggtgatccgcctgccttggtctcccaaagtgctaggattacaggcgtgagccactacgtttggctgcttatcagctttttaccactttgtcgccactacattttggaattttcctttgagaattaggcaaaatgcccagactcccccccggcccccgctttagagggagaggggagcaattagactattcctttgtttccctatagaaggtggggctgagattactgctttgatatctggaatgtaatttagggaagaaaatttaggtcttggcctttctttggaa

SEQ ID NO: 193068 - DNA, 301 bp, Homo sapiens
gaggcaggtttcatcatgttgccccaggctagaacttcttaaaagtttatgtaactatccattcagataactaataaagttccaggtctgaacaatatactgtagaaaaatcacagttaaaatcagcagaactggcccacatctgcaatgttaggtaaaatatgtcctcttgcatgaattctgtgtttatcttggagtttcacacatggtggtcaggtaaagaagcttctgatgcaggctgggtgtgggggctcatgcctgtaatcccaacactttgggaagctgaggcgggcagagcact

SEQ ID NO: 193069 - DNA, 458 bp, Homo sapiens
gggactgagggcgtgagggtgggcgagaataagggtcaggggactggaagcgaggggtaacgggtgatgggcaaaaagcttcagcagacagaggccggggtgtcagtggagactgggagctggactgggactgaggactggcaggcactcgggagaaagggtcggagggcagtgagcgagggggcagagcacagcagctctcagggggcggaggttggggccgaggagtcaatgggggctgagcatatgggtcagtgtaggagccagggcgaaagatgtctgggtgacttggaggagaaggtgccaaagcctgggcagggggtggctcctggggccttaggcccaagcccgggctctggggctctacctgagatgcccgaggggtcaggggggctttgaagacatcaggtgtctttaactccaggccacccaggtgggtgcctgaggagggtgagtca

SEQ ID NO: 193070 - DNA, 203 bp, Homo sapiens
tctagtagaggagacgggaaataaaattaacaagtaagcatagtgtgtggtcaggtggtcataagtgctatggaggacagtaaatctctacctgtctacagaggtagagagtggaccactgcatataggatggccagaaaagccctcaccaataaggggatgtttgaggagatgcaaggggagagagggaaggagtcatgagg

SEQ ID NO: 193071 - DNA, 236 bp, Homo sapiens
tcaggctaaatatgatgaatgagacattgtatttcagtaattcatgcaacaagtggttttatgttttgttgtttttaaaactttgtatcaaacactttcaaatatctatggaaatagaaagaatagtctaaggagcacaaaaaaagaaagaatagtctaaggagcatgcagccccacacttatcaattcatggcccatccccatcctttttcatctaaatttccactcatgcttca

SEQ ID NO: 193072 - DNA, 156 bp, Homo sapiens
tggtgggctgagcagagatagatgaccagacagcaaaatgacacaaaaagttggcaatgaaaagaacaagaggttaagactgagactgagtgttggggaggaggctaataggtctcaggattttatttttttgaaacacattctcgctgtatcacc

SEQ ID NO: 193073 - DNA, 371 bp, Homo sapiens
ctttaaagaagattattttcaaaaagaaagaaacttaccaatatctggagaggggcagaaagcacgtgttgcttgccctaagtctccatcctacaaataccaggagagtttgtcctgattttgaaaggatttaggaggtaacatcctgcttttgtcaacgcatggtgtttgctttgacttttgtttggcatcttatttcacctacaagatcagtgggagctaaaatttattgagcgcacctgctaagtatcaggtcctgtgctataaacatcactctgtctcacagccaggaaagatagaattattcacttagaaataaaaagtcagagttctgttttgttagagaaatcttagtgtaattgcataaatat

SEQ ID NO: 193074 - DNA, 249 bp, Homo sapiens
acctgaatgctctttcaggtttggttggagaaagcaagctgacgagaggctgggagaacaagagctttatataacctcctggagagggagcaggcctgttagtagtccttggagttccagggagtaggatggggatgaggggaacacagagtctcctgaaggccacattagctctcctgaggcagagcagtagatgcagccctgtgagtggccatctaccctcagggcccagaggaggccagcactgca

SEQ ID NO: 193075 - DNA, 507 bp, Homo sapiens
agatggagacgatggagacggtgcagacggtgcagacgctgccccagcgcattcggagcggagccccagggaacggctgagggaacaggaagcagagaaaacgggagcgtgcgcagccgcaaggacgaccgcacccgaacacagggtgcaagccaggctgacggctgactgcaggagcgaatcaaatccccgccgtcctgcagggggaatcccagcctcgtcgtcactaaaacccaaaccagaatcacacacacttcatgctcctgcagggctggatccgcgtcttggagggcctgaaatttctacgttttgcaaagacgctcttttaatacaaaagaaaaaagaaataatacaaaagtagaaagtgaaaaaagaaaaatgcaggtaaaaggtccttcgtccacctctctgccctgggatccgcggctgcaggtggcgcggcgcgggcggtgctgggaccggggacccgcccaggaccggctgcctctggcgccacctggcggccgc

SEQ ID NO: 193076 - DNA, 487 bp, Homo sapiens
tctggcttccagaattgtgagataatgaatttctgttgttttaagtcaccaagtttgaggtaatttgttacagcggccccaggaaacaagtacagtgtccaaacctaaccttgatccagcagcacaagggagcttgttagaaatgagattctggggccttaccagattcagtcagtctggagtggcacgaagaaatgaaatcgcagtaagggtctgcaggtggttctgatgcaccagcatccattgttcatgctccccttttagccctattttcttttcatccaatttacttcaacttgggcaaaatgcatgctcacgtttgcaaccacctcccatatgtcattgcactgtacatctgaatcttcaccccagctccctttcagcactgaagtccattttggatgtctgttgattgagggagccacctgcattttcctcaggcttctcagagggagcacagacttcacaaccttcattatccacctcc

SEQ ID NO: 193077 - DNA, 458 bp, Homo sapiens
ccttttcaaagtctcctttgcctgaagaacctcctctgcatggggctggaccatgcctctccctgcctgcccttcactggttctgctctgccttcagcacaacccacatccggccttaaagggagttattaattccctcctgccccagaagtgccgggcgggaaagctctggacgcagtatttctgaagcagattggacagaaatctgcaggcctgcaaactgcagtcaacaaaacgccattgagcagagagaatggagcatttggcacaaatcagctgcttgccctctggccctggaggaggcagccagggtcaaggctgccctgggaagccctgatgctggtcgcttgttgagccctcagcccggttactggcttccctccttgacatggtctcaactggacatgagcctttgtccccagctctgtcctatgggccagcatctctttggctctgca

SEQ ID NO: 193078 - DNA, 515 bp, Homo sapiens
taatgagtgttaataaaatgaaagatgaagaaatgtaaagacaatcaatattaaaataaatgtgtccactataggaatattgtcagcaaagattgactaaataaatagtgaggatcatggaatgtgaagaccagaagtacataaaaataattagttttgaacttaagagaaatcttcaaatgtatcagggaagaatgcttgtactgtttggatgaagaaaaaatactgatcataaaatatcctgatatattttgaagaccatggatgactattatatactacatacactggcaaaatttaagtgacaaacagaatgaagtaaagctgtctgtggagtggagaagaaatttacataagaattgtaatcgattatttaaaatagtttaatttaaatgtgcattttaattacaaaataatatgagataaagtttgtcttacaaaatatttttatatctatttccacctatttagaattattgcacttctaacaaggggctaaaatggggcaagctttt

SEQ ID NO: 193079 - DNA, 1011 bp, Homo sapiens
agcgggagtttgtgagagtccttggtggaggaggttggaaagcgttctccctcccacaaaacccggtgcagagggagggagagccaggtccgtagcgtgggtccaagaaactatggatcctggaagtgagcacacttttgtgtcttaaaaagtttggtgtctcgttttgaggtgaaaaatgaatgagataagtgctttttaaaaagaagtcttctattgttcaacagttatgaacaaggactatcaaaaattttggtcatcaccttcagatcctgtacattttgaagtggatacttctcatgaaaaagtagaaagcatgtcagaatcggataccatgaatgtcagcaatctttctcaaggtgtaatgctttcacattctccaatctgtatggaaaccaccggcaccacttgtgacttgcctcagaacgaaataaagaattttgaaagggaaaatgagtatgaatccacactttgtgaagatgcttatggcacactagacaatttgttaaatgactgcagttccttcaaaagaaatacagaattatggggagattcctgagatgtcagtcagttatgaaaaggaagtcacagcagagggtgtggagaggccagaaattgtctcaacttggtcttcggcaggcatttcctggaggagtgaagcatgtcgggagaactgtgagatgcctgactgggagcaaagtgctgaaagcttacaacctgttcaagaggacatggctttaaatgaagtcttgcagaaattaaaacatactaacagaaagcaggaagtgcgaatccaagaactccagtgtagtaacctgtatttagagaagagggttaaagaactacagatgaagattaccaaacagcaagtgttcattgatgtcatcaataagctaaaggagaatgttgaagaattaattgaagacaaatacaaaataatcctagagaagaatgatactaaaaagacattgcagaatttggaagaggttttagctaacacgcaaaaacatc

SEQ ID NO: 193080 - DNA, 1415 bp, Homo sapiens
agcgggagtttgtgagagtccttggtggaggaggttggaaagcgttctccctcccacaaaacccggtgcagagggagggagagccaggtccgtagcgtgggtccaagaaactatggatcctggaagtgagcacacttttgtgtcttaaaaagtttggtgtctcgttttgaggtgaaaaatgaatgagataagtgctttttaaaaagaagtcttctattgttcaacagttatgaacaaggactatcaaaaattttggtcatcaccttcagatcctgtacattttgaagtggatacttctcatgaaaaagtagaaagcatgtcagaatcggataccatgaatgtcagcaatctttctcaaggtgtaatgctttcacattctccaatctgtatggaaaccaccggcaccacttgtgacttgcctcagaacgaaataaagaattttgaaagggaaaatgagtatgaatccacactttgtgaagatgcttatggcacactagacaatttgttaaatgataacaacattgaaaattactcaacgaatgcactaattcagccagttgacaccatcagcatatcttccttgagacaatttgaaaccgtttgcaaatttcactgggtagaagcatttgatgatgaaatgacagagaagccagaatttcaaagtcaagtgtataattatgcaaaagacaacaatataaagcaagactcatttaaggaagaaaatccaatggaaactagtgtttctgcaaatacagaccaacttggtaacgagtattttagacagcctcctcctagaagcccgcctctaatccactgcagtggagagatgctgaaatttacagaaaagtcactggctaaaagtattgccaaggaatctgccctcaaccctagccaacctccaagcttcttatgtaagactgcagttccttcaaaagaaatacagaattatggggagattcctgagatgtcagtcagttatgaaaaggaagtcacagcagagggtgtggagaggccagaaattgtctcaacttggtcttcggcaggcatttcctggaggagtgaagcatgtcgggagaactgtgagatgcctgactgggagcaaagtgctgaaagcttacaacctgttcaagaggacatggctttaaatgaagtcttgcagaaattaaaacatactaacagaaagcaggaagtgcgaatccaagaactccagtgtagtaacctgtatttagagaagagggttaaagaactacagatgaagattaccaaacagcaagtgttcattgatgtcatcaataagctaaaggagaatgttgaagaattaattgaagacaaatacaaaataatcctagagaagaatgatactaaaaagacattgcagaatttggaagaggttttagctaacacgcaaaaacatc

SEQ ID NO: 193081 - DNA, 1394 bp, Homo sapiens
agcgggagtttgtgagagtccttggtggaggaggttggaaagcgttctccctcccacaaaacccggtgcagagggagggagagccaggtccgtagcgtgggtccaagaaactatggatcctggaagtgagcacacttttgtgtcttaaaaagtttggtgtctcgttttgaggtgaaaaatgaatgagataagtgctttttaaaaagttatgaacaaggactatcaaaaattttggtcatcaccttcagatcctgtacattttgaagtggatacttctcatgaaaaagtagaaagcatgtcagaatcggataccatgaatgtcagcaatctttctcaaggtgtaatgctttcacattctccaatctgtatggaaaccaccggcaccacttgtgacttgcctcagaacgaaataaagaattttgaaagggaaaatgagtatgaatccacactttgtgaagatgcttatggcacactagacaatttgttaaatgataacaacattgaaaattactcaacgaatgcactaattcagccagttgacaccatcagcatatcttccttgagacaatttgaaaccgtttgcaaatttcactgggtagaagcatttgatgatgaaatgacagagaagccagaatttcaaagtcaagtgtataattatgcaaaagacaacaatataaagcaagactcatttaaggaagaaaatccaatggaaactagtgtttctgcaaatacagaccaacttggtaacgagtattttagacagcctcctcctagaagcccgcctctaatccactgcagtggagagatgctgaaatttacagaaaagtcactggctaaaagtattgccaaggaatctgccctcaaccctagccaacctccaagcttcttatgtaagactgcagttccttcaaaagaaatacagaattatggggagattcctgagatgtcagtcagttatgaaaaggaagtcacagcagagggtgtggagaggccagaaattgtctcaacttggtcttcggcaggcatttcctggaggagtgaagcatgtcgggagaactgtgagatgcctgactgggagcaaagtgctgaaagcttacaacctgttcaagaggacatggctttaaatgaagtcttgcagaaattaaaacatactaacagaaagcaggaagtgcgaatccaagaactccagtgtagtaacctgtatttagagaagagggttaaagaactacagatgaagattaccaaacagcaagtgttcattgatgtcatcaataagctaaaggagaatgttgaagaattaattgaagacaaatacaaaataatcctagagaagaatgatactaaaaagacattgcagaatttggaagaggttttagctaacacgcaaaaacatc

SEQ ID NO: 193082 - DNA, 647 bp, Homo sapiens
attaatggcctcttggtatccaagtcctttgttgtatgacccatccattctcccctgactcccaaggtgtcaggacatgcttgactggctcctgaatttgctctctgcgcatgggcagtacagtcaagcctcacagtgaacccaggtcagctttcaggacaaagaaagtggcctggctgactaggcacagtaaagccagggctgggtaggtacatacttgtgctgatcacgtatgtcttatatctctgtgagagtgcagtcccaacaggaaggtttaatcactggggactgcccaatgctgtgacagggcacagagctctgggttgctgtgggggtgactgcattgaccactgttagtggtttgctgtgttgacactctgtgctgtgtgaccatggctcctgccatcaagaagtagagtctgtttctccacctctgaatccaggctggtcctgtgacttgctttgtcctgtagacaagtgtagtgcaacttcctgtgagccagtttgaagcataggccttggaagcaaaactttacctccacctgtcttaggttttcagctggggctctgctgtgatttgattgtgtctcccaaagttggaaccttgatccccagtgttgtgaggtgaggcttgatggaaagtaaat

SEQ ID NO: 193083 - DNA, 653 bp, Homo sapiens
gtgtatacacttcagatcaaaacgacatgttgagtagaatttacctctcacattttaatgtgttcaatgaactgaagattttgttaatgcagattatttttacagaaaatctggaataaagtctgagttgctgaatttctaacaagctcaccagtaatgccaatgtttttgatccaaaaagaatattttgtcaaacattcagtaaatgaaggaagctgtgtttttcccagtttttttgtcctgtaaacaaagatgagagctttcattttccaaagacagatatatgcaaagaaaacctaaggaagaagggcagctgccagattaaatgtgatggcatcagctgcataaagatagttaataataaagaaaaaataatcaactctatagtaaaacagtctgtcagagagttctttaaccaagtgaatcattaacatcaactgcactaggacaaatttttatgatgtgctggtgcatacagaaagacatagcctcactgatgtgatcttgctacctaaaagtagattacagtctgaatttaaccataaagaaacatcagttttattcaaagtttaaggtactgatgactcatgggttctgtaattttttttttctttttaaagagacggagtctcaatctgtcccccaggctggag

SEQ ID NO: 193084 - DNA, 317 bp, Homo sapiens
ctgccctttcccctcaattctggcctgaagtgggacttgtgcggggtggtgggacaggccagaccacagccccatcctcaggctagcacagttatcaatggacaaatgagatgttcaataaacgtttttataatctgaactcagatgcatagctgcacacacacacgcacacacaaatacagattcgtgttaacacatttgctgagcgcattctatgccaggtcctgcaaggccctgaagactcaaagtagagttagattgctgccctcaaggggcccaggatctggtgaggagtgtgtacagaggaggcagataca

SEQ ID NO: 193085 - DNA, 167 bp, Homo sapiens
tgtgacttctttttttgctcctgaaattattgatcaaggggatttctgaatgattttgtgttggatttagctaaaaagagttttattttcctcctgctgctgaaatgatctcacataccttcatcttagcaagtcctttagatttcatttgggaattaagatatgaa

SEQ ID NO: 193086 - DNA, 618 bp, Homo sapiens
aataaaagcaaaatgagatactactacatacgcactagaatggccaaaatccagatcactgacaacaccaaattctggtgaagatgttgaacaacaggagttattgtccattggtgatggtaatacagaatggcacagccactttgaaagacagtttgacagtttcttataaaattaaacatactcttaccatatgattcagccatccagttccttggcatttacaaaatgagttcaaaacatatatctgttcaaaaacctgcacactgatatttatagcagctttattcataatttcccaaacttggaagcaaccaacatatccttcagtaggtgaaagaataaattatggcgcacctagacaatggaatattattcagcactgtaaagaaatgagctatcaatacatgaaaggacatggaggaaactgaaatgcatatttctaagtgaaagaagccaatcatatgattccaactatatgacattctggaaaaggcaaaactatggagacataaaaagatcagtggttgtcaggggttgagggtaaggagggataaataggcagagtgcagaggatttttaagacagtgaaactattctgtaggagacagaagggtg

SEQ ID NO: 193087 - DNA, 544 bp, Homo sapiens
atacaataaaaccggtgaattgcacacttttaagtgcttaaagtgaacattatgttatgcaaatttaatcccacctccaaaaaaaattcacctccaagatttactaagcctaagcttgtgtgtgtgtggaggacttagagatgggcctggcgcccagacccctaactcctcaggttccagatctttgtacaagtcagcaacctctcgaatggattcctgggtatgtgtataaagcactagaacacacagtgggcctcaggagcaccggaatcagcgcgaaaacgcagaatgcaaaccgtactttgcaccattatttgcaacttgacagtgaccgccgccgtcactgcatgtttaagggaacccggagctgtttccaacccaggtctgacgtccttcacagtgctttgtgtgaactggcagggggagaaacgacggctggggaacgaacggggttattcgtcccatcaatggcctcagaagcatccttatcacctgcttccagagctcccgacccaaatttcctcctcaagaccgacgcggccgc

SEQ ID NO: 193088 - DNA, 364 bp, Homo sapiens
cctggctaatttttgtatttttagtagagatgagagttcgctgtgttggccaggctggtctcgaactcctgacctcagttgatcctctcacctcagcctcccaagtagctgggactacaggcatgcaccaccacactcagctaatttttttggaaattttttggtggaaacaagatctcactgtgttgcccaggctgctctcaaactcctaggcttaaatgatcttcctgtctcagcctccccagtcaccctgtcccttcattgagactctctttcctcgtgtattaaatggagaaaggaatctcatcatgttcaacggcaggagaaccacctggaagtttcacatgaggaatttttcctggca

SEQ ID NO: 193089 - DNA, 288 bp, Homo sapiens
agacccgtcgccaaaggcatttctgtaaagcatctaagtgacacgcgcaagccagacctggggtcacagcagccattgttagagttgctgagataaaaggcagttctgtttgctatttttgaaaaaattacacttaatggctgggtgcagtggctcaatccggtaattccaacactttgggaggttgaggcaggaagatcacttcagcccaggaggtcaagaccagccaggacggccgggcgcggtggctagcgcctgtgatcccaacactttgggaggctgaggcgg

SEQ ID NO: 193090 - DNA, 538 bp, Homo sapiens
tttttagtgacaggatgagagagcccttcatgttcagagggaccgagttggcgagaagcgccggagagttggagagtctgtgggtcagaacatccggcttctactgatggaaggccacgactccccagtggaatgagggcctaggcaaagaaaatgagagagccctcggggtagtgacactgtcttgggaacatggagtgctaggaaacgaaaactggaagactaggatgaactctgcaagtaaaaaaatgacactacttacacatccttctcatcccatcctcgttttttcgagaccttaaagagatctccttggttagggaccttcggttttggaaaggcactgtttttcctttttgtcaaacactcagctttcaggccacacttttttgagacagagtcttgctttctcaaagaccaacccaggctgggcttgaactgctgagctcaagcgatcctcgtgccttggcctcccaaagtgctgggattacaggtataagccaccgctcccggcctcaggtcacacattttaaagcct

SEQ ID NO: 193091 - DNA, 582 bp, Homo sapiens
gcttgttccagaggaacccatgcgcgacgcttccatcaacagcactaataatctggaatctaatgatctataatctttctctccagtttctgtccatacgctcttggtctcctcccctagggcatatgaagaaccgaatgcatagtgagtccataaaacaaatggtgtgtagatattaatatcagggtgtcaacttgtttatgcttttacctgaaagctgaagtaatctgcaactggacattaacaatagataaattaccatcttttctttctcatttcttattttatgttattatgcattcttttaaattcccacatttactggaagtgtagaagcgctttaataatgagcttttcactgatgatcttattacataaactcaggaaggaaaaatacacataaatcttgggaggacagttcatgaagactcatcatgcagacttgttaacaagagttggaatttccaaaaaaaattaatgccagatggtatcatagttttggggtttttttgttggggcagtgttcttgttttgtttatgccctgtattatcaagaaggaaaagtacaatgttgatggaagc

SEQ ID NO: 193092 - DNA, 339 bp, Homo sapiens
tctcatggacagtggtttaatatcctgttaccaaatatctcacttatttaatataaaaatttggtaaagtcattattacaatgtatttgatggtgggattggttctagaaagggaactgattcttgcttaatccatacccaacattgtattagtgtcacctggggagcttttaaaaaattattcctggatccccaaccccaggcattccagcggcatgaagctggtgttgaacctaggaatcgtaatttttaacaagctacctacttaatttttaggcagccagtctggctgcagtttagaaccattgaagtgtgtgtcttttatttcaaatttatgaa

SEQ ID NO: 193093 - DNA, 244 bp, Homo sapiens
aagcgccagctctccatcttccagcaatccatattgatttaactgtattcgtaaaattatgaatgaggacattcctctacggccataccaccctgactgtgcctgatcttgtctgatcttggaagctaagcagggtcaggcctggttagtacttggatgggaggacattcgtggtaagaaggcacaaccctcctctctctcattaagtggttctttggtcaaaaagattaaaaagattttcatt

SEQ ID NO: 193094 - DNA, 286 bp, Homo sapiens
ttttcttatgtgctagaaattacactgcttcttggcatagtcaccgataggtcatagaaaaaaatgccatatttagctaaagaagagaaggaaacttcagaaatagtctttccagattaataaaagaaaaaagtttcttatttcaataaaatattcatctttactaaacttgcaggtttctatgtaccacaaggttgaataaccgagctgcaaaatgtttgagaacattgcatattcccagccacatcgactctcttgattagtgactgcaggcaatgtctatact

SEQ ID NO: 193095 - DNA, 1022 bp, Homo sapiens
tgtaagcccaggacagtcttgaccacttataaaatggagcaatatcagagttagtgggaatataaatgaggtaagtattggaatattttaatcgcagaatagtacattatgcacccataaaatattcactattattattgtaaagtgtataatgatatattctgcagccatcaaattcagtttaaaattaaatggaatgctgaattttttattaatatgtggataaatgtttaaaatcagataaacaacaattatagtatgatctcattttgtacaagtaatcatgtatttttaatgtataaacacattgtaatttaggatttagctcaaactttttttattcatcagtacaattcactaataaaaaagtaaagtgaagtgaataatatcaaagaaattaagttttaatttctgcaatggtagaaatagatgtgattttaaatttttaattaatttattcttttatatattgtttttcaacacactttatcaagtacctacacttttttgtggccctgtttcagatgctggggatgctatggtcaataagatggctaagttctctcccctgctggggctttcatggaggtatatagtcaacaggtaaatgaattaacgtggaagatcatttccataggactagtgctatagaaacacaaacagaataatgacatagcaagtgattgggtaggggcaagaggagggatgcagaagttcctgtatgtgaagatggtcagggaagatctgaggagctaataaataaaccataatcaggatgatgtcactgaaacaaagctgtgaagagcaatttgctcaaaggcctgagatgaaaacaggctctatccatctaacaatggaaaggtgacctgatcagagtgcaggcacctggaagggtagggagagtttgcaacagcacatcccccttttcgcaaaaaagcatcagcaagcacaaacaaagaacaacaacacacaaccagacaacagagaaaacagggacgatcactggacatccacggacacca

SEQ ID NO: 193096 - DNA, 843 bp, Homo sapiens
aaaaaagaaaaaaacttgttactaagtacactgatgctataaaataaaaggagtcctttaaggaactagagacaaaagaaaaaaattaattcattgacccattacactggtgaattttggctccaaaggtgttcaggttggtaatcaatctatgacttataaagaaaaagaccttgagacattatcaaattactcttattgagagtccaagagactgtagtttagtgaaaagcaacagatttacagtcagatagacttaaaagctaagtttgaatttgagttatggcctggataacttattaaaactgataagccacaatctcttcatttgttattgtaatgagtcaaccagggaaaatatataaggctgggcacggtggctcacgcttgtagacccagcactttgggaggccaaaggagggcggatcacttgaggtcaggagttcaagaccatcctggccaacatggcaaaaatccatttctactaaaaatacaaaaattagccgggcatggtggcaggcgcctgtaatcccagctacttgggaggctgaggcaggagaatctcctgaacccaggaggtggaggttgcagtgagccaagatcacgccactgcactccagcctgggtaacagagagatactctgtctcaaaaaaaaaaaaaagaaaaatacataagcatatgccaagaggtcaaaaaattagttaccatttaaaaatgttgggccctatatagcagaccaaaactaaaaactctacagccaaagtcctctcaatgagaagtagaaaaagaaaagctacctatggagttgtgcccctacgcaggcttggccgtgccatatgcag

SEQ ID NO: 193097 - DNA, 682 bp, Homo sapiens
ctgactatatcaagcagctaccaagatggcgcagtgaaggtgatgcgcagtggagactgttcccctcgccgctccctggttcctgcagagagtcctgttggcagctcgttggaacaatggttttcccctggagtttgaggagcttgtcttgggtgtggtgcatccctacaccatgtgtacagtttccagactgctatgattttatctctcagcaatgcgccaagaggttttagtgaaaatttaaaaaccgccaaatcgcctatcaaaccgagtttgaaaagagacctcttgggaaaggacaagctaactattctaagtggtctacgatccaaagcatttcctgggctgagtgtttatcaaagctgagctttacttccaaactaagcttgggaaggatctgggagtgtttcccagctgactgggggcggggagaagaggaggatgcgagtgttaaagaacagagaaaatatcactctcttttcttttacacagttatctgctgaaatctgtctatagatatggcttgcaaactaggtgttgttttggaggagagagaggataggtctgctaagtgttaatttagaaattatatacaatatcttaattttattttgggaatggaacattgggtaagattagcttttaaatggatcagctttactcttcaaggttagaaaaatgc

SEQ ID NO: 193098 - DNA, 573 bp, Homo sapiens
attatcttggtagtcctggacacaaaaagtcctcaaaatctctgagtagtaagtgaataaatctgactggtctgcaaaccatgagagaggaatatcaggagatgaggctgcatcagaagagtagtgaataaatgaagggctttgggtgccacgaggatgataagaaggcagagaagggttttattcaagagccaaagaggaacattatcagatttcataaaggttactctgttggcagagtagaggatagattagagacaacaacccacaggaaagaagagaagttcagcagctattgtgagagtttagaaaagagaacacggtctaaaccaaaggagtgaaacagaagataaattagtgattgacaggatatgagtcccaggtgttctgcactttaacttctataggatctaaaatttcatactggagcaacactgaatgctggaatatgagagagtaaattctagcttgagcaaacttttaatggctcaaaaacagaagattcagtcttaactgtgaggttatccgctaggttgttcaccacactctttgagaaaacctcccaaatactct

SEQ ID NO: 193099 - DNA, 284 bp, Homo sapiens
ggggttctcccgtatcatttctggcagcaaatttaatgatggctattcatagagcattggtatgtatcagtttgcagttgtagctatacaggttgggcaataagacttggcactgaaagagtggcaagccctcacttagtgtcagcctccactgtgcctcaagggccactcaccatgagactagccccagatccagccccacaccttccagagcactgcatcctgagaggcacctccacagacttgatgcacacctctgtcccctcaggcacattccaaaaggc

SEQ ID NO: 193100 - DNA, 427 bp, Homo sapiens
tatggcatgggcaatggcagtagcagtgatgggacaaccatttgctcccatacaggctatgctgatgttggaagtagtttgatgggctgggagggccagtccccaggcctataggtagcacatgtgggtgggtgccagctgtggttgtagcagcaggttggattggcccaaccttagactttggaaggattgctcaggtgtgaatggtggtagactgtgttgtatgagccccactttacagtttgccttttctagactgtcatgtaattggaatcatataggccgtggccttcttagactggcttctttcacttggcaatatgtttttaaggttcctttgtgtctttgcatggcttaatagctcatttctttttgctgctgaataatattcttttgtacagatgtaccctagtttgtttattcattt

SEQ ID NO: 193101 - DNA, 194 bp, Homo sapiens
cttgacacaacttcagggttaaaattacaagcaatctatgtaagaatctttaaatgttaatgagaatttcaaattttcacatgaatgcaaacacaaataattaccagcaaataaaaagttaaggttgccaggcatgggaggccaaggcaggtggatcacttgaggccagaagttccagaccagcctggccaata

SEQ ID NO: 193102 - DNA, 478 bp, Homo sapiens
taagatgccccatggttcttcatggtgtgctttcttcctcactgcaacgaaccaagaaacccaacttgttcaactacaagtgtgttcctttggccaaaaggcactgacacaaggaagcttttcctgtctgccccaggctggctgaggactgccaccttctctgttccaaagatgtcctgtaccttacagcactgcattatgcaggctatattgtattgaaattctgtccatccatgtctgtctccctctggagaccttgggccccacaggaaccatgttttatttttttcctcttattcatttttaagtcctcagctgacaaagaacctaggtcatagtaaagtttcaaaaaaaaatgtttaaagaatgaatgagtagatgctgcacatttcttgggtccaagatttaaagatgcagcttcacgtaacacatcattttacaacactgtcaactataacgtcatgtgctttaagaatgc

SEQ ID NO: 193103 - DNA, 574 bp, Homo sapiens
ccaagggagtcatctttgcatttgcacagaggagatgggaaaatcacaaagcccttaaggtccagaagaaatgagtgtcactacgttgggctcccaggctgtgcaacaagctgtggacggagatgtccgggcagggagcccggtccagctccccacccatcgcatcatggagtcagccgtctcctctggggactgcaccctctgggtgctgagaaatccaaatggctctttctcatgcagccgccccaagtgggcaggatggcccttctcttgatttgtttcctgcttactttgtgagagtcaaagtgcatccttcaggaccaaagtggccaaggggccagcatgttatttagagtgatcaaaatggaccattttcaacttggccctatttcagctccagagctgtggtttccacttgcttttacttatctgtattttctaacatttctttagcaaatttgtattactttggcaattagaaaaaatgaccagtaatttttataaaaggatttgtgtttgatttcctttcagaaaggcactttcatttattaaaagatcacaatgagaagtgaaa

SEQ ID NO: 193104 - DNA, 546 bp, Homo sapiens
aatgtaaatattgaatctgcaaacccaactctatgaagtcatgtctttttgctgaatatgaatcttttaaaggccacagaagaaaaccttgctcaagactacctgttcctctgttagtcagagtcattatcactaagttcttagaaccagcaagttttagaaccattgtcagtttcttttgctgttgttgaaagcaacatttattaaatagctacatggtcacaaggtttgatatccattctgtcatttgattgtatttctgcaactctgagtactcctgttttggcacattactgctagctttgtgaaatgtcaggtcttgttttctgaaactaccataggtggagatccaggctctcctgccttgttagatccctgaatactgcccaaactggagctgtttacctttgactttcctgtgggcctcttggatttgttctgttctggcgtctagcaatcagatattttctacttaggatgttgtcctttcagcctcactgctgaatgagaagcaatttcagagctgccattccatacatctaactt

SEQ ID NO: 193105 - DNA, 384 bp, Homo sapiens
tcgatcaaacccaaaattagtagaagaggccagcaatttgagaggctgaggccggctagattgcttgagcccagtaatttgagaccagccttggcaatcatggcaaaacctcatcgctataaaaaatacaaaacttagccaggcgtggtggtgcacacctgtagtcccagctactcaggagtctgaggtaggaaaagatttcttaaacacaatgaaaaaaactgacaaactggactaaattaaaggtagggccaggtgcagtgttcacatctgtaaccccaacactttgggaggccaaggcaggaggttcacttgagcccaggagtagttcaggactaagctggccaacatagggagcttctgtttctagaagaaaaaaaaatt

SEQ ID NO: 193106 - DNA, 296 bp, Homo sapiens
acagggataggaagtaaatgattatattgttatatactggctggattcattttatattggatgatttttttcatcttatatgcccctaccataccaaaagtacctattctagtacttaggccacaaacttggaatgtagtggagcatagtatcatggtaaaacccaggccgaatttgggccaggtgaacaagagcacaaaggattgagggtgtttatgaaaagttggatcatgaaacctagatcatgcatctaggctgatttaaggaaggaagtggcagaagagggcttttagtaa

SEQ ID NO: 193107 - DNA, 180 bp, Homo sapiens
ttaggcacaattccactcttcgctattctaagccaaattcatcctagacagagcaacagtagccacgggttcttctccactcctatgaaatatcccaagtgaggtaaatattttcacattccagctgcttgtaaaggtgtgaaacaggacgcaattaaggtcccagaacattttacttaa

SEQ ID NO: 193108 - DNA, 203 bp, Homo sapiens
acagtaatgtcagtgggatctttgagccagggcagaacactagcatttaagtgtcctaaagtaaattagaataaatgctttcttaataccaactgcttctctttcgctgggtgagttagagaacgttcaagtttggcatctgtctcaggtagaaggcaactgagaatacagctctgagtcagatatctgtgcacttgacacat

SEQ ID NO: 193109 - DNA, 454 bp, Homo sapiens
cacttgggttttacactttttcatagtgtatgtcttggcattaatgaatcaccttatattaaacagaattgggagcgataataggactgcgctcataagacagaagactgaaagcaatttgatgaggatcttatccttctttcctttttatggaattccagaaaaaacctctatcactggattatagttgatttcaaaagtttcttttacagtcattttccttatatccatggccaattaccaaactaaaaatggctccctctgttctatatgaaagtttcataattccaaagttcaatattcatcactaagtcctcaacgagggaagatttgaatacttgttttaagaaagttttttttttttttaaatcctcaaggtaaaagtattttcaaagtaatcaaacctgggcttactcagtggaaaagtggtaattagtatggtctcttttgtgaa

SEQ ID NO: 193110 - DNA, 230 bp, Homo sapiens
cctgacctcgtgatccacctgcctcggcctcccaaagtgctgggattacaggcgcgagccactgcgcctggccaagaatttactcttataattaacaatcctatatttagcatggttttagaagaaaaaaaataaagattagcccacttaaaagctatttagttatttaaatgcaaaaataaaacattctcttgtgttccagctgtggatgagaggggtaccggagctct

SEQ ID NO: 193111 - DNA, 304 bp, Homo sapiens
cagttggaaagcgaagagttgccactaaattgccggatataaagatgaaagatatcttgataaaacagggaaacgatgcaggagtgtgttatctaagctttagtgccttgatcctgtgcattcaatttttgtttcttcaagacatttaagctatgaggtgcaaagaaagtattagtgaatatctattatgtgtcaggcagttgctgaagtaaatcaatggacagtatttctcctaaccttcaaaaagtagttttctttctccttctctactccttaccagctgttctttcttctgtgctcctga

SEQ ID NO: 193112 - DNA, 219 bp, Homo sapiens
  misc_feature (25)..(26): n is a, c, g, or t
attacgaacttcgagtctcgtaccnnaacattcgtgtcagtgcatgcttggatacaaatattaatgaaacaccgtccctgtcttccaggaccttatagtagtggaggaggccaacttaaagtattatagcaagggacagtaatgggagacaggaggaggacaggggctcagggcagcaaggatagggggcagggctggtgaggaggacacgaatgttca

SEQ ID NO: 193113 - DNA, 385 bp, Homo sapiens
tcatatgggtgccattcaccaagatagagtgccaaagtcaaagctactttagaaaacactgggatgggtttggtcctgcacttaatgaatctgagatgcctgaaagacagctatgagctgaggtgtctataaggggactgaatgtaagggtctgagctcatgagagaggtctaggaatgggtggagagctaatgataaaatatattacacaccagctccaagagctttggaaagacagaagtggaaccattaactctctggaagcctgggaaggattctcaaagaagatgacatcggattggagtctggaaggagaaaggagggacctccagggaacaggtgagatgggatgaggagggagagaggagcattcctagcacaggga

SEQ ID NO: 193114 - DNA, 662 bp, Homo sapiens
ttcctccaagagtgtttcctttgcattcacaacttggctagttgtttagctcaagaggcctagcttttggcctgtctcaacttcctcactaagcttaatcatttctagcttttgatttaaagtaagtcgtttccttttatttgaacacctaggggccattttagagttataattagcccaatttctatatcattttgtctcagggaatagaagcgtgagggagggagagagttgggggaatggctggttggtagagtggtcagaatacacacaacatttataaataaagttagccatctaatatggttgtgattcgtggtacctcacaatgattatgatagtaacataaaagctcactgaccacaggtcaccgtaacagatataataataatgatctttgaaatattgtgagaattaccaacatgtgacacagagacatgaagtaaacatatcctcttggaaaaatggcaccaatagacttgttcaatgtaggattgctacagacgtgcaatttgtaaaagcacaatatctatgaagctcagtaaaagtgaagtgcagtaaaacgagatacgcctgtactttgatcctaacttagctgtattcatcactcatgctgtgcaacattttccaagttgatttctaccaaacgttgtttccaggtg

SEQ ID NO: 193115 - DNA, 508 bp, Homo sapiens
ttataattaaactcttatttcaaaagagaggctttaaaagtcaatgaaccaaacagaaataagccctcacatcttcaatatcatactctcttgatgatggacttgtaagacacaaagccccatgtctaacagtgtaaggagagtaaaaggactacttaaatattaagccatgttataagatggtgttgctgtgattgatgtattatcttttatttatggtaatggcattttgagatcaagttctgctccttgaattttcatgtaataagagtctgtggtgaagatgcagcaacagagaagctgctacttgcatcaaatttatttttagttcttttcaacttggttaagaatgattagactcacgcttttattctattcttgaccaaagtgtgggtaatcccagcactttgggaggctgcggcaggcagatcacgaggtcaggagatcgagaccatcctggctaacatggtgaaaccccatctctactaaaaatacaaaaaaattagcc

SEQ ID NO: 193116 - DNA, 429 bp, Homo sapiens
tgcctcagcctcctgagtagctgggattacatgtgtgcaccaccatgcccagctaatttttgcatttttagtagagatggggtttctccatgttaaccaggccggtctaaaactcctgacctcaggtgatccgcccgccttggcctcccaaagtgctgggattacaggtgtgagccactgcgcccggcctgtctactggaattttgagtgggcattcctccatctccctaactagatggataagcttcttgagtcaggaatctttttgtattcacatctctcaatagagtacaggatcttgcacatagttggcccttggtaaatgaaaggtcattattttctttttctgctgtcctatggttgactctttaggccacagcaacatcctggacttgaatctgcagagaagtattccctggtgcttgtctg

SEQ ID NO: 193117 - DNA, 423 bp, Homo sapiens
  misc_feature (3)..(3): n is a, c, g, or t
  misc_feature (33)..(33): n is a, c, g, or t
ggnccccccccccccaaaaaggggtttttcccnccaaaaggggtttttattagcggccagcacccgaaaagaaagtagagaagttctccatattttatttagcctaagtttagtcttttgtatcatgacagatcctagaaagataaagctgaatgaggctgaattgaaatccccactccagaatcctcaccacaaactcctggcattattcacctagggcccttcacaagcataccactttgatcttcaaaagacacagggatataactttgaagtcttttgacatcctagtaatctacttcacacagatttatgagtgtgtacctctggttaccagcatcatctgtcgcattccctgttcttacatcttttctagctctgtacttgattcacttttcccttacttaaaagaaaaaaaaagcg

SEQ ID NO: 193118 - DNA, 188 bp, Homo sapiens
ttgaagaaatagtgattatcaaataacctggcaacagaggaaacaaatcacaaatgcctaatcatttgtttctttgattcaaaccaataacctgtcttcttaaccttgatattttttagaaggaaatttgcaaatcaaagtctatagtcacacacatacaggaatctctatctccacattcagaaaat

SEQ ID NO: 193119 - DNA, 424 bp, Homo sapiens
tgatgttatcgcccaacacaaggagactcaatcaaatgaccattcccagcataagaaatgagtacgctctttagagagccagtcgcttctactacactcccaactttcaaccctcactttccgtcatcacaaacagataaaaagacatcagtggaggatatgatgttcaaatctttcccagtctcttacatcgaagtatgtcaggagctctgttacacaacaatgtaactgcaaatagttgaccaccactcccggagtaagtcaatgcatttttgctaatcaaatgtttacaaaggaacaagatgcacaaaactccgtctaactctcacaaggagtcagccaggagttctaaaaattcatgtgcagttatgcacttcacccgcatcgtcacttggtgttggggataagagatcctctaggcaaa

SEQ ID NO: 193120 - DNA, 297 bp, Homo sapiens
ccaatttgtacaaaatttctaagatacacaatttgcgagatttttcaaattgttccaaatcttcaaaaacctttctaatatatatgtatatttttaaatttgcatataagtggacccacacagttcaaacccatattgtttagggttacctatttgttctattagttactgaaagtagtatggaaaccttcaacttgtaactatatgtttttctgtttcttctttagcctatcgattttgtttcattcaaagttttgaaactgtttttagatgcatgtatgtatgggtagtcacaga

SEQ ID NO: 193121 - DNA, 652 bp, Homo sapiens
tttcaaatattattatttcactcagcctcttccttgagtttcaaagaagaaactgggatgcagggtaggaatgtgcaaggaagtgaatccgctgttagcttgatggagtttgttttgtaggtgacctgccctttctctgtagctaactttaaaattctttctttcattttgaccttagaaaatctgatgatgatgtgtgttggcaatggtctcctgtagaatcttgctagggttctctgtatttcctgaatttgactgttgacctctctagcagggttggggaagttttaatggatatcctgaaatatgctttccaagttgtttactttctcctcctcccttttatggatgccagtgattcataggtttggcctttttacataatcccatacctcatagaggttttgttcattcatcttcattcctttttctttatttttgtctgactgtattatttcagagaaccagtgaatttatttctcagcttggtctattttgctgttaatcttgtgattacatgtgaaattcttgtattgtgtttttcagctctgtcagatctgttagcttcctttttataccagctatttcattcttcagctcctttatcattttattatcattcttagttgccttggattaggtttttccatgc

SEQ ID NO: 193122 - DNA, 292 bp, Homo sapiens
ctttgggttcttaacatccaaagagtccatctgaaaccaagttaaagcggcctgcagattgaatctttgttctccatcctcttaaagtgatacgccccacctccactatagcacattccaacataacactgttcacaggtatgctcgcttccccaactggagctagctcctcaaaggtggggtttgttctttcttcgagtctccaggatctagcagaatgtctaacatatatacagtatgtttgtggtaaatgtttgttaaaagagtgaatgaattaagatgaatttatatt

SEQ ID NO: 193123 - DNA, 414 bp, Homo sapiens
ggcaggataatctcttgaaccgggggggtgggggttgcagcgagccgagatcgcaccactgtactccagcctgggcaacaagagcaaaacttaaaaagaaattcaagtgaattgaatccagaaaagtgtgtgtatgcatatattatatattatatatatagcatatatataaaatatatgtagtatgtatataaaatacattgggaccaagcaaggtttattgcaggtacacagggctagttcaatgtcagaaaatctaccaataaaattcaccaccttcatgcaagacaaaccaaaacaaaacaaaacaaaacccaacatcttaacaaatgttgtaggatgaatgcagaaaaagcatttattagtccatgataacaatttttatcaaataagaaaataaaagtgaacttctta

SEQ ID NO: 193124 - DNA, 172 bp, Homo sapiens
ttctgccacccagagggtttctcttattgtagggctagcgttctccaaggatgaaggtgaggggccatagggcatctgtgatgcctgcaaggtaccctaggagctgggcttggtgtcctggtaacttgagaagacaccaagctcatggcagctacctgggcctatgggtgat

SEQ ID NO: 193125 - DNA, 317 bp, Homo sapiens
aaatgtgcaaatccagcctctctgttgcttttccttttggaatatttctaatgcaccaaatgcggatggtgaagctctagattcattttccccaggaaaacatgttttctttgcttgcttaagtgaagctcagtggcaaaagttttggctgactaggagagttgatgttggcaaatgtgggtagagctgatgaatgccatgatcctcaccaatagtttgtacaccctaagaaattactaataacactgatgacaataatagatgctaccatttaattagtatatactgggtgcaaggcattacgctaagcacttgac

SEQ ID NO: 193126 - DNA, 489 bp, Homo sapiens
tttcactcactcattcatttgttccatcatacactcacaggtttttgtttcatgtgccaagctagtgaggaacagagacaaggcacccatacaaggaaaggaaccattacattacagaatagaaaattcccttttctcgaaactgtggtctcctgaaggcagtccccttcacctggatacagtgtggcacttcttagatacttatgaaatagtagttgaattaatgaaggcaacaggctcagagaaggtaaataaattgctcaatggaaactgctgattagtttacagcagagctaggcctgaattcaggggctcttctaccacactgagctatccttcttctgttacgaagacactgagtaacgggacttgcctaattggataaccaatttggaattggggacttcctgagttcttcattgctgagcaatgtctggaaagtggctggatctccagggttacctgaattattaaaaggtaagaaaactc

SEQ ID NO: 193127 - DNA, 461 bp, Homo sapiens
gcagacagcagactctgcagcttcagaggctggcagtgcagtgagctgggctctaaaaggcagaaaggttctgggacaagggacagcatgggaaaaagccgaggcgtgtgttgggagcagtggggttttgggtgggttgtctcctggagagggagtggggagaactgggagatggagccgggggcaggcttgatccagactgggaggtgcaggaatgccggggtgtgaagagcgtggtctttattctgggggctggggagccacagcacaatcttgagcagggcagaggtcctttgggagggtaagctcacaaaaactcagggaggcagcttggatgcatgcacgctccggccttgaccttgactgtggtctgttgtatccacagcacctgcatactgttttttcccgtttaaatgagctcacttcataagaaataaaactacagtgaaaacaacactgga

SEQ ID NO: 193128 - DNA, 377 bp, Homo sapiens
tcgatctcggcacccgtcagacgctgaactatgtgaattagaattgtaattactagatactagtttaaatcttttgacattaacattaaactgtttttcacctacaaagatgacaatttcatatggttcttctactgaatagatcacaagggaaagaattaacgtctttctgatatctactcgtgaacatgatgtatctctccatttacttaggtttcttcaatatctttattaaagttgtaactccatgcaggtattcaatatatgttgtaagatttactcctagatatcttgcttttttttttttttttttttgggcgggggaaaagggaactttttcctaataataaaccttcaagttggggggaatgcccaac

SEQ ID NO: 193129 - DNA, 537 bp, Homo sapiens
tcgatctcggcacccgtcagacgctgaactatgtgaattagaattgtaattactagatactagtttaaatcttttgacattaacattaaactgtttttcacctacaaagatgacaatttcatatggttcttctactgaatagatcacaagggaaagaattaacgtctttctgatatctactcgtgaacatgatgtatctctccatttacttaggtttcttcaatatctttattaaagttgtaactccatgcaggtattcaatatacgctgaactatgtgtgcttttttttttttttttttcccaaaaatgaatttttgcctctgtggccaagcttgagtaaaaagggggcgatctggtttaattgaaacttcggcctcggggttcaaggaaattctttggcctaaaactctggagaggttgggattacgggggggcacaaccacccggggttaattttggctttttaagaaaagtgggcttttcgcattgtggcccaggcgggtctaaaactcttgtcctaaggggattaaccccct

SEQ ID NO: 193130 - DNA, 211 bp, Homo sapiens
atcaatgtggacttaattttccattttaaactgttatcctttttcctgttgtcttctcccattcatgaaacagtaacgccaaaaacacagtctaaccattagctttttacatgtagaagctgttggcacagtttgtgagtgagcaaataaaaggtgtggatggaaaagaaatggaatttggcaaagttggtattgatgcaagtggttcctt

SEQ ID NO: 193131 - DNA, 159 bp, Homo sapiens
aaactgtgacaggcagagaagttttcagatggaggaaaaagcacctgaaagacgacaggtttattttttgagcatttcaaatatggaggtacctgagatatccaggtggagattgtcaggtttgtagtctgagacatgggagcaaattgtaaactagaa

SEQ ID NO: 193132 - DNA, 332 bp, Homo sapiens
ctttacataaaatcagttaactatacacatttgtgcctatttcaggattctcttctgttacgtggatctaaatgtgtctccttacaacaatgctaaactgtcgttactacgagagctttatagtcagtcttaagaccaggtagtgtgagtttctcagcttcattctttttcaaaattgtttccaatattctaggctccctgtatttccacataaacgttagaagtagcttgtcagtgtctaaaaagagcctgctggggttttgatgattacaatgaatcttacaacaatttgggaagagatgacatcttaacaatattgagtcttccaatac

SEQ ID NO: 193133 - DNA, 216 bp, Homo sapiens
gcctgttgaactctaacctgttcagtatacatttgaacttcttatgtttctcctttgttgtgtctgtccttgattaaatcacctgactttctttaattcagcagaaatttactgtcttttctgtgctagacattcttgtaagtactggggaaacagccatgaacaaaaacagttaaaaaattttttcagctaatatttcttgattgggtgcggaga

SEQ ID NO: 193134 - DNA, 643 bp, Homo sapiens
ctcccagttttgtgtcatctgcaaatctgataaacaaaagctttcattttcatctatgccgaaaaatatgtaggatgagaatgggctaaataacactagtgctctcctggcaggtaggtaattaactcaatctttggctacagttgcttcaatcagctataaatccatgcaacaaggaagtcgggcgcagtggcagaagctggaagactgcctagttgccaagtatctgatgtgctcttgctattggaaatacaacaaggaatgacacagacaacgttcttgtccaatggcacttgcttacactgtaaacaagtaaaaaaagaaaacaagattaggctgggtgtggtggctcatgtctataatcccagaactttgggaggctgagatgggcggatcacttgaggtcaggagtttagtccaggctgggtgacagcgagccctcgtcacttaaagccaacctaagagaagagcttatccttttggaaaaacaatagaagacaattctgaaaaccaaattctgaacataggctagtatagcaagcaagcagggatagcatagagccatttgctcaacttccagaaagagtactctgttcatctctcaaaaatctgaaaagggccggtgcgtggtggtcgcgctgta

SEQ ID NO: 193135 - DNA, 577 bp, Homo sapiens
ttgtatattcatgcatgcattggtagcattgtaaatgctctttactacttcagctacttaccctgagaaggtcttacacacccctcatttttactttatcgtttaaggctctcagatctaactcaaatgtgtcaccatctttttcctgtagctcgtactaataacatttgaacccctcccttatcccaacttctgtagcattactttactcatttttattcctatagcatttcctcaactctaatatgtctattttttacattttaacctctgaaattagggtacttcttacaattcatgggatcttagttttgattaaacaaggtacttccattctggtggagaattgagattctgtgcttgccttgcttctggaactttcattcttgggtccatatctctaattcctcttccagcacgacaactaataatttgtgctcaaatgttgctaaatggaattaaaatactgtgtctggcttttactatattcaggggaatttcaagggcatgatttgttctgaaatctatcaataataacaataatgattagcatttagagagtctttattttgtgcta

SEQ ID NO: 193136 - DNA, 581 bp, Homo sapiens
tcatgtgcatgtatcaaatcagctgaggatattattaaatggagattcagattcaatagttctggggtggcctctgggattatcagtttctaacaagctcttaggtgttatcaattctcctggtccccagaccatagttagagtaaaagagtatagactgcatttagcttccagattttctctttcaaggaaaggagacagaactgtcattgtaattcttcctgtggtccaggcactctaacgttcatcgtctcttctaatgctcttacaaatcctgtgaggttggtgataatagaagttacctcctgaagacgacattcacaagcaggaccgaccgtgtagaccagttttctcaaactgaataatgtacttcactttttaataaggaaaaaaatctcttagctcctcagtttttgcttaatttatatttattataatgttatctaaatatatataaacataaaactaggtataaatgctttatgtttatatgtcttgcacaagtataaaaccaaaacaagtttatgggttaacacaagcaaaactataaaactaataaaatttaaaatagtattaaatag

SEQ ID NO: 193137 - DNA, 554 bp, Homo sapiens
gccggttatataaatgatgtcaaatccaccaatggactaacacgcagctaagataaaggatgggacaactccatgtgtgactcattctatttgaattatggcatatttacatattacatttttaaaactttcaatgtcaaagaaagcaaagaaagaagaaacaaattacaaattttaggagtaaacactaactcaaatgtaaatagtatggtactaactgaacatgtgtcagctcaattttgagtctctacaagtcagtctaaatatgctgcgcagacaccaaaaagatcagtagtaaaattatttattagtcctccacctccagaaattgtttttgcctttgcatgacctgtgctttattactgcaacatagtcatatttgatagcttaaagaagagacattaccacttaggagttgcttcatatatttcctggtcagatttgaccaaagaggatgctattgccatgagacaacaaaataaataaataaatgtgttctattataatgggaagctgactctgaagactatagatactatacaaatgtttcaact

SEQ ID NO: 193138 - DNA, 387 bp, Homo sapiens
tttgctatcatgacgggtgtgctcttatagctgtcttaggtagctcgtctggtttcgggggtcttagctttggctctccttgcaaagttatttctagttaattcattatgcagaaggtataggggttagtccttgctatattatgcttggttataatttttcatctttcccttgcggtactatatctattgcgccaggtttcaatttctatcgcctatactttatttgggtaaatggtttggctaaggttgtctgatggtagaaccgactagtcggttctaccatatgaggacagatgcaatgagggctgtgtgcctaaatgaatacttttactcttgactaaattagtctggcataaacacaagactgctagctttcagtacaatt

SEQ ID NO: 193139 - DNA, 197 bp, Homo sapiens
ctagtatattagattagatcgatggaaaaaatgcaaacaacaacgctttgatttccttggaaatttcatttgttgaactaagaaaaagtatccctaaaaaatttacatgagcacaaagtagagtgaagggttttgtgtatatgactatgtatcttaatactctaaggtgtttgccaacagtttcttaataccgaggt

SEQ ID NO: 193140 - DNA, 197 bp, Homo sapiens
tcaaggttctacaattttcaaaggcacagctttaacaggctactgaatacctacctgtctagtgctgtggtcaaagacagtttgcacacaggggtcagcactgaactttttttttgttttttgagacaccgtcttagtcacccaggctggattcatcgcaaaataaataaataaaataaaataaaaggaggttggct

SEQ ID NO: 193141 - DNA, 118 bp, Homo sapiens
aacaatgatatccgtctttgaacaaagagagttgaaagactggcaaagaaaaaaaaagaagcaaagtgtaaatacccgtttaaccacaactggccagactttgtgaagttactgttag

SEQ ID NO: 193142 - DNA, 311 bp, Homo sapiens
agaatcaggggactagagtggatttcatctactctaagtggaagtagaaatgtggatgtagacatccatttaaagccaagttttcaaatacaagtcacctttgctgcttggtgacactagacagtgctacagatgtcttattcatctttgtgcttttagcatggtgcccagcacctggagctcactcaggtaatatttgtgttattgccatgagtaacatgtagaccaataatgaatcaacagatcattttctgcagattatcatcatttgtggccttctgtttctcattttcttagttgggtagtcacag

SEQ ID NO: 193143 - DNA, 209 bp, Homo sapiens
gccagctgggaaggaagacaacctaacaaatttggtcttctttccctttgttttgctttttacccctaacagccttttgcttatccaaaggatatggacaccactggaatgtctctctttgtcctgacacgaaaataaaaattaatcgggtaattttaatacagtacattcttcaagaaggtgccaggtcgccgctgtttccccaaacg

SEQ ID NO: 193144 - DNA, 335 bp, Homo sapiens
ctaagggtgtggcctggttcaattactattgagttctgccaggaagaccaggattctttttatcaaaggcaaatagcttgccagaggcattttgatttgataagaacataccaaaatatagcattagctgtccctgacacattactccactgtttgttcaagagtggtgacatttaaacagcagtaagtgtagaggaaagaaaggcagcctgagaaaaggtgtgagtttcctgtgtcctggtagcatcaatttcagccatgatacacttggcaaggactgttatcaaaacactgacacagatggtgtcaaagtgaaggagggggacctcgttgtc

SEQ ID NO: 193145 - DNA, 200 bp, Homo sapiens
gcactttgggaagccaaggcctgaggtcaggagttcaagaccagcctcaaactgtcttcaaggagaaaccagacctctactaggagaaaccccatctctattaaaaatacaaaattagccgggcgtggtggcacatgtcaataatctcagctactcgggaggcggaggtaggagaattcgcttgaacccaggaggcggag

SEQ ID NO: 193146 - DNA, 340 bp, Homo sapiens
tcctcagccaatcaaatgtgaaattctgtcaattcagcttctgaaaactgataacttgcatttgtttctccacttcttccttaatttgaatgttcaccctctaacctggactaatgcagagtcattaacagctctccctctctttggtttactctgttccttccagtccatcctaaatgcacgcgtgtcctaaacctgacttgtcactccgtgcataaaggcattttaagttcctctactgttcaaagaatttggaccatccttttaatacaattcatatagagagactcatggtttctgcatgggtcttctcatatccaggcactgcagaaaataactg

SEQ ID NO: 193147 - DNA, 354 bp, Homo sapiens
tttgatggatgtagtctattctaatataatgtctttcaagtgtttgaaagttactacttattcaaaactcaactgtctggcagcttttcttatcctgaactctgtgaagaacttcggggacaggaggtaaaatgtctttgaagagtaagaaatccaaaacttcatgtatttacatgttctggtcttgtctcataggattcttctttctccttacataccctcctttaaatccgtacctcccccggtcttctccatcttgcaaatggcaccaatgtccatcctagacattgatcatcccagaagtctaggagttgattcttctcatttcttcagttctgttgtgcaagtcttcaa

SEQ ID NO: 193148 - DNA, 235 bp, Homo sapiens
  misc_feature (1)..(1): n is a, c, g, or t
ntattatcccaacaccccaggttcctctttatctatgatcctccgtggtacttctacaaccacctgtacctactctatccgtgttgggcgtgatgttatcgcccaacacgccccaacacaggcagagctaggattcaaatctatcttacctagttccaaagctcatccatgctcttctctctatacctcaccatctctgaacaagagttcaggctgggtgtagtggctcacatct

SEQ ID NO: 193149 - DNA, 335 bp, Homo sapiens
ctgggcatccagcaagactccgtctcaaaaaaaataataatatgttttaacataaataaacatttatataataaaactcattgctgtcacaaggccaacatacaatccattatatgaaaaatttgagggactgaataatttattgaggatctttttgtgtgccaagccctcaggtgggtagtgtgatttttcattttacagacagaaaactgaggtccagagacgttaagtaactttcccaggatcacacagctggcaagtggtggtgagttctttagactgtagagcctatgttcttttttcttatatcagaatttcctaaactgtgttccact

SEQ ID NO: 193150 - DNA, 300 bp, Homo sapiens
agctgttcagaggatccccgaggaggcgaggtgctctggaaggcgtgtgcatgtgacccaggccatgtcactgccaccatctccatccaggctgtgggtactgggagcccggaagcgccaaagcttccaactttgccatgcgcttgtgcctttaattgggggatttcaaagctgtgagtggaaatccattcagatctgagctgtttgctgaatccgagatttctgtccagggggattgggcgaacgtaatgtcttatgcattctaggtgatgctcaaagatcttgggggtaccgagctcg

SEQ ID NO: 193151 - DNA, 395 bp, Homo sapiens
ccaactcctttcaccattctgacttacagtttggaaacactggtttaatctgttcccttccatggtatagatctagaaaaaatgacagtaattaaaatcatgcccaaacaaaacacacttgattaatgaccaagtcatgactagaatccacattcatgataaagggcctctttgcactgaacactctgaggcaggagttgaactgccttttcctttcctcttctttcctcttctcctccattcgctgaatcccacaatgtgtcagataaaagtagtgaccagaagacaagatccaatccatggaaaagtggagaagtggagaatcagagaaatctgtggtcacagacatgacacaggacggagtgactgcaaacacgtgggcagagtgaaaggaa

SEQ ID NO: 193152 - DNA, 455 bp, Homo sapiens
tgaaaccctgtgtctttaaaaaatccatttttaaaaagaactcttattcacatactttaagtaaaatgctcaaatgtaaaggaaaaatgaaaacaatatgtgataatatgcctttcaagatacagatgcttaggaagttatttaaagaagtaatgaagaagtcagatactctataaatgtgatggcttcaaatgcaagtccataacagacatgttgtattgaagttcagataccacaagcagtattgccgtcaatgttgtttctttttgaacagctcatagtttcaagttccaagcaattgtattactggtgatttcagtgtgtatgttaaaatcatgcaaaagtacttagtacctatataaaaattgatttagcttctacactcaagtaattataaacaggtttttcttttgggacatttgacagttatgtgaaaggtgagtcttcgttgtgta

SEQ ID NO: 193153 - DNA, 434 bp, Homo sapiens
aaaggcaagacttccgcttccagaaaaggtgaagtaacgagagcaatatttatcctcatacctgaaacaactaagaaactggatgaaatatataaaacagtttttaagatactggccacaggcagcatgggacagtgatgtgatccctgagacacggcaaatgaagaaggtggcctatgactggcctagcttgctgcctagggaaagtttcccagtcacagaacagggagggaaacccagggggaactcagaggaatacctttacttgaggagccagagctagattctgaaaaggccaaggaatcagaatttgcagcatacagtagtaccaagagagaaaagagctgcacagagaaagaactccagagatctgtaggagaccctctgagtattcagctgagttcaaaaacagcacgtttatgtgagaaaactgc

SEQ ID NO: 193154 - DNA, 552 bp, Homo sapiens
ttcagagaattttaagaaatcagagcttctctgggctcccatgatatgctgcctttccccatcatggcacttgccttgctataatcacacctgtccacttgtctgggtctctaatacctgagggtagcaactcaatttcccactggtagcactgggcttagcacagaatgtaagagcccaggactcctgtgataagattacccaggctctggtgagtaactgagtattcttatataagtcactcaacttcttggggtctcagtttcttcatctaaaaaataagagtcttggctgggtgcagtggcttatgcctgtaatcccggcagtttgggaggctgaggcgagcggatcacaaggtcaggagatcgagaccatcctggctaacaaggtgaaaccccgtctctactaaaaatataaaaaattagccaggcgtggtggcaggcgcctgtagtcccagctactcaggaggctgaggcaggagaattgcttgaacccaggaggcagaggctgcagtgagtcgagatggtgccactgcactccagcctggtgaca

SEQ ID NO: 193155 - DNA, 259 bp, Homo sapiens
tttatgaagcagtacaccatcatagatactatgagctgaaagttcaccaaactctctatcccaaaataacaataaggtatttatgaagtgattcgttccaactatttgaggcaaaaattgtccagcaagtgagagagaacagaaggaatagttggcaaaatagggaatttgaagtctgaggttatgcataaggaatgtgttatgggcctatagtagaaatctcaaatcagggattagggaatgtttactcagttctgtt

SEQ ID NO: 193156 - DNA, 619 bp, Homo sapiens
ataaaaaatttttgctgaaagcactgttttgagagaccaactctgtatcatctagggatgtactcttattatagtgtctgacctgatccagaggtgaagaagtacctctatgcagtcctttaatgttacttctcattaaatgtcacttctcattaaatgtcacttctcagttgggctattactggtagtatgacaggtgatatcttgagattgtctccttttcagaggacctggaattccctatgctttaaaaaccatgcaggtataacaggaaattttttttatttttgttgtcttgttatgaaacatatgtaatttaaaatgaggatcatatttgcttttttctttttagataaggtgttgcaatgacaaataagtagcatattgcaaatacaaacagtattttgttttggaaaatagtttaccagttgtcccagtgccttcgttgagtaatactttttgtcctaagttttgatgccatctctattaatattttgtgtatacaactgcttttcccagttcacttatttatgatagtacctatattttaatattggaaggaacagtccatctttactctttaaataggtttttggcttttcttaattacattcatttt

SEQ ID NO: 193157 - DNA, 411 bp, Homo sapiens
caaaacgttggggttcatgttacctcttttgtccagtggtttgtgtgttcccttctcactgaattggatttgacattcaatttgaattgacagtgaacttcggggtaattcctttcagaaacctgaatcattttaggatctgggaagcattactctgtggcaggggctcttaaccaaaaagcccatcgctagaattctagggtctctgaatttggatgggaggaaaaacaaaacaaaacaaaacaaaaccctttattttcactgtgccctagctgaaatttagcatttccttcaattatgaatatagacagcaaataatggttgtatttgaaatgtgaaattgtacttgtgaaacatgctactggcccctagattttatgctagtagtcctattattcagtgttattaatg

SEQ ID NO: 193158 - DNA, 398 bp, Homo sapiens
caaattgaaggaagtgggtgagagagatgctgctaattacatctatgaataaagtgacacagtgcaccggctctgagcagagaccaacacaactcgagagagaaaatcagtctgtcatatttgtacaaatatgtgcacttcgatgataattaccatagtcattgtttactattgctgcattatattaattatctattcagtgatattaaatacataactctaaacatcatccccgaacaaattaccttttatcaattgaaacaaaccaattaaaaatttcaaaatgcaaccatgtaatcaacggcttactacacgataattatgaccaaaatgccaattaatgtgttaatatatgacctcaaatctacagaaacaaacaacaaaaaaaagcagcctca

SEQ ID NO: 193159 - DNA, 476 bp, Homo sapiens
tgattctcctgccttggcctcccaaagcgctgggattataggtgtgagccactgtgactggcctctttttccttaaaaaaataatttactactgtcagtgtaccatacctgttacctgttttcttatttctttctgatcttctgtgggcttgaagatcatataagcaagcttttatgtttgtagtttctaatctagaagtgaataggatcatatatgaggagaacataaatcacccagtaatttacctgtagttatacaaagtagttattaggttggtgcaaaagtaatggtggttttgcaattatgaatgacacctttttaaagttgaggagaaatctctttgggtatttaacttggaggtagaatttgaatagcaagatggattttattttttctaaggtttggaggatgtgtaccataactgatttgtatgtcatttttgttgttttgattcaccttttacaattcagaattt

SEQ ID NO: 193160 - DNA, 435 bp, Homo sapiens
gattttaggatcaatctgtcaatttctgcaaaaacatttaaaaacataaagaaaaaaaaaaagccagctaggatactgttaggagttggattaaatttgtgtgtcagtttggagagtgctgccatcttaacaatattaagtctttcaactcatgaacatgactttccacttatttagacctttcttttttttcaaaattcttttatagctttcattatgtaatttcatgctttaagcttattcctataattttctttttgatgagattataaatggaattgttatcctaattccattttgggatggtcactgctagaaatacaagtgacttttgtatgttcatcttgtatcctgcaaccctgctaattcattttgtttagttacaatgtttttgtgtgtagattccctaggttttcctataaacaagatcatgcc

SEQ ID NO: 193161 - DNA, 397 bp, Homo sapiens
aaatttgattttttccctacaataagctctatgctaaagctcattacatttgattttgacaatctgtttttataccacagttgcaaaaaattaatcacattctttacttcatgagacattatcattattgtttcctacaagtttctctggttttacttgtttcatttttttattccttatcccttgtcacagacaggcatgctaatgtgtttgatataggttctttactcttaaagaattcttacaagataagaaggttgttttctgagtgtgtgtatgtgtatatacgtgagtgtatacattttgcttaaagagtattgtgctataaatctaattttatttctaatttttttcacagagcataacatccttcatacattcccacattgctgtaggt

SEQ ID NO: 193162 - DNA, 287 bp, Homo sapiens
caatctctacagaagagttgggctaacaggcttcagcaaagagagctcccctgagataagcttttattgcgcagataagaataatctcattagtatgtcatttatttgattgtaaagaggaaggtggaacccttattgtacatttacttaaccgccttcctataatcttaatctcattctagtgaccccatgtgcccaaacaccctcttttcacgggacaaggaaagacatcgtaccaaatcctgggttatcccaacttcaaagtcacaatcttccaaataaacctt

SEQ ID NO: 193163 - DNA, 580 bp, Homo sapiens
gaggtaggactgatattcagcgggaggttaagaccacctgcgggaccgtgagggctgtacagagaggatttgttacaaagtgggcagctgagtggtaataatggtggtggggcggtaatggtggtgtggggtggacaggaaggaggtgatgtggtgctctgggaaacagcccagactttcgcctcagacccgggttcaaatctcagcttttccactgttttaccagcgagcatgtgatgttttcaacttttcatctttatctgtaaaatggggttaataaggggttaacaattacctcctgctttgggttgttgtgaaatagatacaaaggcataccttgttttattgcactctgcagatattatggagttatttttaacaaatggaaggtttgtggcaactctgaataagtctgtcagcaccatttttccaacagcatgtgcttacttcatgtctctgtgtcatattttggtaattttcacaatatttcaaacttcattattattacatctgttatggtgatctgtgatcagtgctatttaatgttattcttaaaattgtttcggaacaccatgagcca

SEQ ID NO: 193164 - DNA, 346 bp, Homo sapiens
ctgggagtggcgggcagggatctgcggggagcgttgctggttcaagctggggctttcctatggatgatgtcctgtgaagggtagatcctggagggacagacaggtgtctgatctttggcaggcagggatgtctcatttgtacattataggtattcagtatctcttgctggcttaggcttcataatgtctcatttgtacatcatagccttcagtacctcttgctgatttggttaacccagttgttataccacgatattgatttttcatgccattttctttaggaagattggaagatcattgaggatagggactgtgaccttttctttttttctaccccagtacccaa

SEQ ID NO: 193165 - DNA, 447 bp, Homo sapiens
tttaaaaataagcatcttggataaattcaggtgcaaacagacaccacacaagaggaagtaacaagatgacatgatgaagatgagtgcttttgaacaggggccagacgatcagaaagacaacatataagcagcaatgccagaaaacaaactaacattaaaaacttagaaattctggcagaaaggttccaattattcaagactgcttttgacttccttttatgacaggaacccttctatgatatctgccctgaaactaaagcaaatggttaaagtgtagaaacatttgtagagaaacgaaaaagcaaaaaagaagtcaggcagaaattgtatttctgtaaagctacgccaaatgttcctgccactccttctacctctgtcaccccctgagataagagtaacgattcttcttcttcctcctccttagcctactcaatgtgaagaagagga

SEQ ID NO: 193166 - DNA, 352 bp, Homo sapiens
cacagtctaactctggtcatccatttggcgaagggaatgtcctattaacaaaaaagccgtggaaagctgaaaatgtttatctggaaattccacctcgtgaataattaaacaacaagccctcatggtgaatgagtaatatgaaatacgaaggactatactatcaaactcctgtctccctagtctcttacaaccccataatgttcaataccaactacatgctatcgatgcccaaatacatatatttaaactttagtcttttctctctttttttttttgagacggagtctcgttctgtcgctcaggctggagtgcaggggcgagatcttggctcactgcaacctccgcctcccag

SEQ ID NO: 193167 - DNA, 138 bp, Homo sapiens
cagtatccttctaagacatgagtacagagcatgtctcttttctcaaaacttccagcatctacatctcacccagaggataaacaaagtcaatacaaaaactctaaggcccttgaagacctggcccctttacctttctga

SEQ ID NO: 193168 - DNA, 609 bp, Homo sapiens
gatgcatgtcggtcaaagtgtaacataagcaggctggtatgaaacttaaaagatcttggagtccatggatatctgaatcactccacagtaagatggtatttcagaggaggaagaaaattctttctttcatacacatactaaagggctttccatgtttttgtgaaggccacaaatggaaaaaactaccactggcagaaaaaacacaacactgtggtatcaagtacactgccaaagttccaattgaagcaattgaatgttggtgtattttttttaaatcacttgcaagcattttggcatctggagtaaaagaagttgttcctattagtttgtaatccaagtaagggtcttatttcctcaattaaatttgcataaatttatcctgaatacataattttccttatgatgaatactgtattttcatgcaaatatctacaattaatgtaaagttccaatttactttcttctttactagtgaccaaatactatatggcaccttcaacttgttgaaccctacatcatataacttagatgattactgactctatgcatatttttccaagcttttaaaagcaaaatgtggccaggtgcggtggctcacgcctgtaatcc

SEQ ID NO: 193169 - DNA, 147 bp, Homo sapiens
gctctgggccagccaagaatgataatctgttctgctaagacctctaaaacaggcagggccttcttttccattcctgcctaatgccttctggtgaccacttatgatctggtggtccattcacgctgtcgcttattgctacatgcatca

SEQ ID NO: 193170 - DNA, 467 bp, Homo sapiens
cattactagagagagaagtggaacaaagaatacaaaagaaaacaacagtttatatgattttagaatatatggacacacaacattttcttcccacacggaacacgctggttctctaagatacaattctagtcattcttctcactctaaatactctctttgaaggctgcacttacttctgtagtcttaattaccagttctacatgctgatggcgtgtgtgtgtgtgtcctcttaaatttccaacccgtatctccaactacctactgactatcaggatgttccacaggcccttcacattcaaaatgtcagaaactaaacatattctctttttcccttttctgcccccaactcctgcctcctctctgtaatccccaaattggtttagggtaataacatcgacccagccaactaagctcgagaataaaatggggctcctttctcttccccatgaccctcatccaaatggctg

SEQ ID NO: 193171 - DNA, 356 bp, Homo sapiens
ccccaggcttggtcggcgaatcacttaatccactcatcccttcgtcttttcatagaattaggaaagatatttagctcaggccctagaatcagactaatgctgactcgttcttgtctcgaagggctttctacaatttactgcattcagctccatactattaataataatgttgctgcttttcttaaaatccatgttggaaatgtaagaaaatgtaaagaaaattttatttcatatttcattttacatctccaaagcccccaccatctccagaaagagtacaatgatcattttctttgtctctttatatttgaacaatcatcacaacactaaaactacttcgccgttgtgctaagacc

SEQ ID NO: 193172 - DNA, 263 bp, Homo sapiens
gtaggtgcttcctaactgtcagtcccttcttttttctattcattcattcaacaaataatttttcctagatcagcagttaccagcataatctgggaaacctccccaacctcctctccagggaatctttgagatcaaaactattctcatagtaagatgtggcagacagaataatggctctccaaagatatccacgtcctaatccctagaacctgtgaatatgttatcttacatggcaagggagaattaaggttgcagatggatta

SEQ ID NO: 193173 - DNA, 389 bp, Homo sapiens
ggaattgggccccagtcatcaagaatgttatgacctgcccagatacaagcaactaactatataatactgtgtaaaatgtgaagtcctacacaactattttccagttaacatttcagcatttaaaaaaatatacatcagtttagtagtatatatacttttttttctttttttgggtaggggggcagtcttgctctgtcatctaggctggagtgcagtggcgtgatctcagctcactgcaacctccgcctcccaggctcaagcaattcttgtgcctcagcctctcgagtagatgggactacaggtgcataccaccatccccagctaagtttttgtattttttgtagaaacggggtttcaccatgttggccaggctggtctcaaactcctga

SEQ ID NO: 193174 - DNA, 352 bp, Homo sapiens
tctcagtttagagtctgtaatattttgatacatcaacaagggggacctagtccttaaatggaacttctctatattcagaagctctccaagcctttctttctaggatttagaaattcataatgtgagagatcagcatctcctaattttaaagtgttcctagtgtatgtaaccatcagtggcgggtatctactgaacagtgaggaagttttcaaaaattaaacactgtctgattttctgcagagtttttattcagaatgtgcttggacttcccagccccttctcagctttcttgtttttggcagatgcttcaagtaaagctttcttcttcaggtacctacgccatagggtcgtt

SEQ ID NO: 193175 - DNA, 508 bp, Homo sapiens
gcaggatcttgctatattacccagactgatctcgaactcctgggctcaagtgatcctcccaccttggcctcccaaagtggtgggattatagacatgagccactgcacctggccccaaggattccttcttacaaccacagtatgtgatcttcttttcttattgagaactttcaccttttcacttaagaaagcactttatggcttctctatggtgtatccaaattgccagtgccactcctcttgtgctttagggccatggaagtaaagtaagggtcacttgaccacaagcactgtgattccaagacagtgaatttgatcacagagatggctactaagtgacctgcaggcggggacgctggcaaagagaaaagtcgcatccagggcgggacagggtgggatggccccagatttcatcatgctacttggaagggcatgaaatttagaacttaggaattgtttctggaattttccattgaatatttttgaaccaacgttgaccaagggtaact

SEQ ID NO: 193176 - DNA, 391 bp, Homo sapiens
cttctgttagttgcattagttactacttgaaccatattttagaaactaattttctctgtttgaactaatctgtttagaaatgggtttaaaagtcctgcagtgaaagtcctgcgttcaggcttctgtgtatcgtttgttatagttaatgacatcccttgcattccttatactgctttaggtgttagtggcttcatcagttgtagcaggggaatcccagaaacctgaactcaaggcttggcaggtaggaaaacattccttgagaaatacactttcagtttatattttaatgtttattccccttgttaacaaagattacaaatgatcctcaggattagggactggagggaggagtgtttgtgggtatgtggatccattgccctggagttaaagc

SEQ ID NO: 193177 - DNA, 150 bp, Homo sapiens
acccgtaaatagccactacactcttagcctgagcaacagaacgaaaccctgtctcttatttttcaaagtttgaataaaggaatctaacagatgccaacttgtggacctaggttagatattggtttggtccaaatagctgtgaatgatatt

SEQ ID NO: 193178 - DNA, 401 bp, Homo sapiens
gggttgggtgtttcgtcttttgataggtttcggcctgcttctcagggatattccagtttctatcccacaaattttttcgataacaccagtttcagagcatctaagaaccactaaaggctttcaattttcaaagaatgttctgctaacaccacttgtataaataattccaggcatttgctttaaaaaagtcaacattttaagcaaggctcagtggtgaaatgatattacaccctggattcctcttctttagttggttttgtggtgtcacaaccagtaatctgaagccctgtggtgggaatctttggagaagaaaagattaatagtacttcaagaatacattttgaaacatacaaaaccagagtatttgcctatcaaaagacgaggggatactctagagacga

SEQ ID NO: 193179 - DNA, 199 bp, Homo sapiens
atgttaatctcctttggcaacaccctcaacagacacatccaggatcaatacttcatatccttcgatctaatcaagttgacactcagtattaaccagcatagctgggatggagagactatgcttagagggggtgtttttatttagaaatgttattctggcagggtgcaaacatcagcattttcatgccttgaggtaactt

SEQ ID NO: 193180 - DNA, 208 bp, Homo sapiens
tgatacatgcatataatcaaatcagggtacttgggaacccttaaatatttatctttatgctaagaacatgcaagttactctcttttagctattttgaaatgtacagtcaattagtgttaactaaagtcactctaagggttaaagttttagatgctaaattcagttttgggatttaagtgggtagttatttaaagtaggtagcatactg

SEQ ID NO: 193181 - DNA, 466 bp, Homo sapiens
tattcatactggagtcttgcattctcctaatctggactgttcgttctagagacctactgcataggtactatcctaggactacctttcatcgtcttcatggaatttatgttgttctctagtattggactctgtttcctggatcctgtgtggtgatagctgcctgaggaaggttccattggaagtaaatatttcataatcttccatgtctgaaaaatgccttcatattgtattgatagtttgtctggacatagtattctagatttgaaactattttcctcttagaatttagaaggcattatgttgtcttttaacttacagtgttgctgttaagacatctgacaccattctgagtctcagtccttttattacagcctttctctctatatctggaagcttttagaatgttttatttattcccaatgtcctgaaatgttatgattgttgactttgtgtgggtcattattta

SEQ ID NO: 193182 - DNA, 469 bp, Homo sapiens
gttccccactggcaatgccaatgctggatagagagcccttgtcaggtgccagagtaaagcagaaaagcttcctctcccctgctccctgcacaaatgccacagtgcctataggacttgaccaacaaaggcaggcaaggaaggtcaggagcaactagaagcatttaacatgtggaaaccaacaaccaagacaaatgctggctgtcctgaacctgttacctgccaaggtcatttcatttccctcctggaagttcaggcttcgctgctgcagtttacaaaataccacaagggtaaagagtttgccccccctccccgagtggtgctgctgctggagttggaacagggcttccctctgctggtgtgaaatgacttgagatgggatcaggtgtggcaaggggagtagcagatgctgaaggccgcatggcaggcttttcattcggaactgagaccagggaagagtcagctaggcaat

SEQ ID NO: 193183 - DNA, 372 bp, Homo sapiens
ccggacactgggttagactgatggctgcctcattcgactattcatacaacctgagcagctacttcatctctctgtgcttcagttttttgtatagggggacactggttcctattttgcaggtctgtctgtacgatacagtgagataatgtacagaaagccctttgtcacaaggcctgcacgcagtgaccgctacattctatcgccagtcctctgcatatctgtacacactgcctctgctcattttgtagtgcgtgcctgtgctttattcatgccaaacttcaccttcttgttctccaccatcaggtcacagatgtatttgactgacaggtatcgaagcagcttgatgtcatagcctctgaccttatcaaaaag

SEQ ID NO: 193184 - DNA, 278 bp, Homo sapiens
ataagaggagctgttatgattcccatttggtcggcagaggacagtggagactcagggaggctcgttacctgccatggtcacagctggaaagcaggctgccgacaggtttgggcatcattatccatgtattgaagtgactctccaagccacaaacaaaatttttaactgaaagagatgaactgtcctcctaagtctcacatggctggggggagtaagatgatgctgacacccaccaactcatcctattagacataaacgcatgctttcattaggcccgc

SEQ ID NO: 193185 - DNA, 214 bp, Homo sapiens
actttccagcactattaaacacttatcagttgaagacaaaatttaaaaaaattaaagtcaaaaatttaagacaaaattaaagtctctcatttcaaaccacaactctcattaatactaagagtaataaacaaaatagtcttagaaattctactctgctagcccaaagaacagaaaagtcttcaacaaactatcttcaattgtttagttcaacata

SEQ ID NO: 193186 - DNA, 402 bp, Homo sapiens
tggatgttgcaggttcgaatctagcaggatcccgcaactatgcctcgatgatcactctaacatactctagcctgggcgccagagtgagaccttctctctcttgaaaaaaaaaaaaaaattagaacaacaaacgaacttccctttcttttcagtatcccttagggagggtgtatcctcagaaattcttacagtatgagcattagggtgttttcatcccagctctttttgaaatgaagaatagtacaacagtggagcatcgttcaataatgtgtgcagggagtggatggaagccttcaacaatatttgataacacaaaaaggaaattgtgatccatgttaactaataaaggaaatgataactgcaatttaaaaaagcaaaaaacatcaatttaggaaaacttta

SEQ ID NO: 193187 - DNA, 142 bp, Homo sapiens
actccatatgggcccttggttgagtaggaaggcaagtgacactagagtgtcgatgggctgggagaatagcagggaatatgagattagagtgtgtaatggctgattcagcaagagtgaaggaaagggaaaaacgaatgtggag

SEQ ID NO: 193188 - DNA, 281 bp, Homo sapiens
taggtttcaagcaggaaatagaacacaaggcaaatcaaccgtcatataagggtgtcaacttatcttaaatacttttggaattaataagatatagaggcatacataaagataggccacagatcagtcagtggctgatttctatttctggctgtaaatggactagtttatttcaaactaaggcctacactgtgaataatgaaaaaaactggattagaaaaatatatatatctaaaggcattggagcactaccaagagctaaagatctaagaatgaaaggaaac

SEQ ID NO: 193189 - DNA, 256 bp, Homo sapiens
tccttgtcacagaaccatgctgtgctcattctcaccttcatgctgtttgactgtcctcactgttgtgctcatggactgcatttttcttccatactgagtccaatgcatttgttcattgagccattcttagtcattttatcaagctcttaccgacctctctgtaaactggatataccagcacactgttttcaccgtaagttggcaattaattatatttggtcttatgttaactgtttcatggattagttatctccct

SEQ ID NO: 193190 - DNA, 627 bp, Homo sapiens
tgcaggccagcccattcctttcttgcccttgacacatgcttctcataccccattcctttctcatattgatgtcttgattcatttctcttcctcttgctttggaaagtgtgtgtttcctattgctgctgtcatgagtttagtggcttaaaacaacagaaacttattctcttacagttctggaggtcagaagtctgaaaggagtcttgcagggctcaaatcaaggtgtgagcagggctggccccttctgaaggctccctggaagaattcattccttcctcttccagcttctaggggccgccacattccttggattgtagccacatcactccaatctttgcttccatcgtaggtgccatctcctcttctgtggtcacatgtccttctgcctccctcttacaaggaccctcaggactacattgagatcacccagataatccaggataatcttcttatctcaaggagcttaccttaatcacatttcccaggttccttttgccttataaggtaatattcacgatttcagggattaggacgtggatatctgtgcagacagttatccagcctaccactcatagtaacaaaatgtaattcaaagattgggagccttagagacagacagggagtccc

SEQ ID NO: 193191 - DNA, 296 bp, Homo sapiens
tatataaatgcagtcaatttttaaatatcaatttattctcatctaattcaacagaatttttgttattctgaatatttaaatttttttagtttttcacgtatataaattatcatttgcaaataaagataattttaacttttcctttctacattttctactttttccttctataattgtgttagtacttcagaaaaatgttagtaattgttgtggttgtagatatacttgtcttatccacactttaatgggacacttctatttgttttcccagtaagcataatgttggttttttgttg

SEQ ID NO: 193192 - DNA, 228 bp, Homo sapiens
ggagagcagtctgcgtgaggacgtaagcacaggtccttctctggaggcaggagaatgaaaatcatcccacgggtcggggccgggtcagtgaggaagggagggaaggagttctgagaatgtcaatctgcaggacaacttctagtttccaccttttgcatgagggatttccaagtgccccagggcctgggagtccccattcatcaaccctgggtgctaccagggacaggg

SEQ ID NO: 193193 - DNA, 532 bp, Homo sapiens
tcagcatatctgaagttatcaacctcagatacgatacttattatcttttatatggtttgttttccaattctgtcagttaacccaataccaccttttatggcttctgttcacctcagtgcagaaccaagtgtagaatcatgcattacatttacttgtcatatctttttagtctcctttaatttggcatagttcttcagccttcttctatatttatgaattgacattctaaaatataggtctttttaaaaatggaatgtccctcatgttatgtttatgtaatgtttcctcttgtttagttttaggttatgtgttcccagtgggaatgttatgtaactgatattgtgccctcagggtttcacatctggaggcacatggcgtccatctgcttctcagttttgatgctaattttgatcatctagtcaaggtgttagtcgatttctttatgctattttttccccttgctactgtgggcaatctgtggggagacattttaattccatacagatgccttgctcctcattaaaatatttcc

SEQ ID NO: 193194 - DNA, 424 bp, Homo sapiens
agtatcttgtctgggatgtagttatgggcacagctgcaaacccagaggagagcatctaagatcacccgttgattccttgaatgatgtgaatttcctctatatcatcttcaacaggagactgtctagtgagcctcttcttaagcaccttcgtggccaggggactcattacctcctcttgtgtcgagtggcttgatgaggcaagaggaggtagaggatcagggagagcggttccccctgagtccttgcttcagtggcatttcttttctgactacaagaaccaaagagtgagtagaggatgatgccattttgggatgcttactgccagatgtgattctgccttccctaaggcagtagtttaaagtaaataaaagcttgttgggctctgaagttggactgtgtggattcagatcccagccttaccaca

SEQ ID NO: 193195 - DNA, 612 bp, Homo sapiens
gtggttcctatagctattggcatggcccctcttgaaaaaagtcttccttactatgctttaacaagtgtcaaaaataatttttctgtgtgtattttaatatgttatttctcccttgggccaacataactaggaagaaaacttcaaataatgcttaagagaagtttatactaccttttggtctttaaaattttcatttctggataaacttagttttatctcagggaagtgctgtccttcctctagctctaggatcaaaattactgtagtaggctcaataaagtttttcaaagacatcaggtcctagtctctagaacccctaaatgttaaccgtatttggaaaaagggtctttgcagatgtgattaaagattttgagatagggaggttataaaagtaagccctaaatatgatcataaatgtcctaataagagggaaacaggagctttgccataggcagaggagaaggcagtatgaccatagaggcagagactgaagtgatgaagtcagaatgcctgcagccccaaggctggaaaaggcaaggaacagattctgaaggaagcacggctctgccaacactttgattttggtccggtgatactgattttgaatttctg

SEQ ID NO: 193196 - DNA, 414 bp, Homo sapiens
tagacactcatacaaatcatgcttacaggactggcttacttagaagagtcagtagtctttcaataccaaattacaaatacagattaaatgtcttcccttctgtctcctctggatttaacatgtttacagagagaaagcaagagaacacagttgtggtataatcatataaagatattttaaattccctagttcaccagaatcagaacatttgttcaggctgaaaactaggattcaacttgctttctgttaagttgcaattgaaatgtgatcctgtcagtgaaaatacagctttcttctttgaacctctcaagttaaatgactatgaaattccattatactatgaaatatattatcacctttttgagggggatttttatggctactggtagaaaatgttactaatagtcacagtca

SEQ ID NO: 193197 - DNA, 466 bp, Homo sapiens
aattctcctgcctcagcctcccgagtagctgggactacaggtatgagccaccgcacccagctagtttttgtatttttttagtagagatggggtttctccgtggtcgtcaggctggcctcgaactcctgacctcaactgatccacctatctcagcctcccaaagtgctgggattacaagcgtgagccaccacgcccggcatgtttccagatatttttactctctggtgtttattaaacttaacccaggcagactgagtctcagccatgttagagattttcctggattagctgccttgtagtacaatctagaatttttagtgttcaatttatttcttgaactaatcattcaagtagattgaaggaagagttactggaagggtaggaagaagcatggcttgtgatgaagggtgcattttgacaagtattcttctggctctttgccatcctctccttttcctgttactgc

SEQ ID NO: 193198 - DNA, 563 bp, Homo sapiens
gccaactttgagattaacacaaaacttgtaactaattattacaatgcttatgtgtgcttctatatatgtgcagatagatacatacataatgcatgtattttatagatttgcatgaagtagaaacaacattttccagaaggatgaaataaatgattaaatttaaagaattcagtgtaaagaatttagttttatgaagtgagggatgtcctgtattaagaattaattacaggctgggtatggtggctcacacccacaatcctaatactttgggaggccaaggcaggtggatcacctgaggtcagtagtttaagaccaggcctggccaacatgataaaaccccgccactgctaaaaatacaaaaattagccgggtgtggtggcacatgcctgtaatctcagctactcaggaagctgtggcaggagaatcgcttgaacctaggaggcagaggctgcagtgagccaagatcacgtcactgcactccagtctgagcaacagagtgaaaacccttactcaaaaaagggggggctaatatctaccatgtacaaggaaattacccaattgat

SEQ ID NO: 193199 - DNA, 729 bp, Homo sapiens
taggctatgaaatcctgagccaaggcatcatgtctgatgatgctcaacactactaacactacttgcaatcacaattacacatcagacattgttttatttggtaatccccaagtgatttttgttggccagggatcctatcttaaatttttgagtagaatacttagcacaatgctatgcatttattaaatgcataaaaaaactgaacattaatggaacagacatattttctgttctcaggagcaaacaatacaaacatatcattaatagcaaagacagctaaatatatgtaggcctcaacacttccttagagttcccattgtgtatacctatactcatcaaactttcttagaaaacaataagtaacatggaaatgtttttgaaagttcttataattcatctattaaattccaatagctttagcagtacacttctaaacttctcaggtcacaaggcaggaagggcaagaaataaggggagaatacatataaaataggaatttcaagcaaaacagtaacatttttggatgaaaattacttaagtattgactatataccacacactgttcttaattcatgccactggaggaaagtagaaatttggatatttcaacaacaaaaaaatctttttttgagacaggagtctcactcttgttgcccaggctggagtgcaatggtgcaatctcggctcactgcaacctctgccttctgggttcaagcgattctcctgcct

SEQ ID NO: 193200 - DNA, 408 bp, Homo sapiens
cttgatagtggataactgagtgacgcaggtagtttgtatgagaagtgcagtaaccacatggtgaatggaagatgatgctgtacacttgcctggagttcatagctgggacactgtggttaccaggacacagcttccagaatggctgactaaacctagaaaatgcagactccgctgggtctttgtgtttctgttttttaaacgggaaaataaattctgtcatttactttcaaagagttagtgggagtgacataaaattgttgataaaaatctttggaagtctcagtgaggggatctgctatattgaaataatgaaataattgatgaaattatttcattcgtaaacagtctaagggccaagggaagagaagagtgacacagactctcctttccttgagatcttagaatcac

SEQ ID NO: 193201 - DNA, 417 bp, Homo sapiens
ttaaggaacagagctgggatgaatatttgagtctaattccaaaacattctggaataactcaatatgtggttttccatttctcccaaaaacaggtacctgcttttttcagtggcttgtgttccagctgacagctccagggcctgtttgaataattcgaagacaatccttagttaggaaagcaagctttaattatcactggggaacagaaggccgcatcttcgaggaatttggcagacctcagcagggggcaaccacaggcctttggcaaaagatcacttttcaacaacattgtcaattccagtgacccccgaccttccacctgcaggtccctgaacagctgctgttctgtgggaagcagtggcagtctgtcttcctttaaaaggcacatgcacactctgtccctgctgcctgctgaga

SEQ ID NO: 193202 - DNA, 178 bp, Homo sapiens
agggtttcaccatgttggccaggatgagctcaatctcctgaccttgtgatccgcctgcctcagcctaaccaaagtgctgagattacaagcgtgagccaccgtgcctggcctgtgctggcttttaagatgttgagataccaggggttggtcacagccatggccaggggcctgattgctc

SEQ ID NO: 193203 - DNA, 225 bp, Homo sapiens
cctctcctcatccaagaatgaaatcattattcatcacccccaatagcctcctgaaatataaatcagaatatatgaaaattctgtgggggttggattacttccattaattacgcatgaaagactctcaacaaaattttaccttgaagagctattatcaggaggacagtatcctttcgctcttggtaatcagggtgtcttcacacccctctccagcttgtcaattgt

SEQ ID NO: 193204 - DNA, 710 bp, Homo sapiens
ctagtcccttaaggtgtaaagttagagtactggtttcagatctttcttcttttttaatgtaggtgtttacagctataaatttccccctgggcactgcattcactgtatcccataagttgttgtatgttgtattttcattctcattcatctaaaagcattttctaattcccctagtgatttcttctttgacactcattggttctttaagagtatgttcttaatttccacacatttgcaaaatctccagtttttctcattattgatttctagctttgttccatttgatcaaacatactttgtataattccagcattttaaaatgttttaaaataattgttttatggcctaatatatgctctaacctggagaatatcccatgtacacttaagaagaatgcgtattgtgctgttgtggggtatagtgttctgtatgtttattggatctagttggtttacagtgttgttgaacactatttccttactgatcttctgtctagttgttctatccattgtttaatgtggcatacagaggtctccaaatattgttgtagaactgtctactatttgtttttaattccatcagtgttcacttcatatattttggagctctgttgtttgatgcatacttgtttatcattgttatatcttctttatgaattaaccctttatcagtaaaaatttccttcttcatttttatgacaattttttact

SEQ ID NO: 193205 - DNA, 171 bp, Homo sapiens
ggctttcaaatctcttgtttaccatctcctaccatgagttcctatcacaaaagtttatcatggtgagcttaacagagacaacttaaggggaaaaaaacttttagagcacttactggcaactaacattcgctgttcttcatttgtttcactcacctgctatggtagaaatct

SEQ ID NO: 193206 - DNA, 131 bp, Homo sapiens
ccacctcagcctcccaaagtgctgggattacaggtgtgagccaccgtgcgcggcctccaccttctttaagattctcaggagttgcttcggtaaacccaaagaccacagatgagtgaaaaagaactcagcag

SEQ ID NO: 193207 - DNA, 279 bp, Homo sapiens
tccagcctgggcgccagattaagatgccatctcaaacaaacagacaaacaaaaacaaagaatacaatgcttttaaggtttctgttattcttctgtgggttcaaggaaagatggtattgggtctgggtctcttggggccaagtctagttttaatcactgtggctaccccctgttcctgttcagctgcctctggtgaggtggtggggatggcaggctgcccttccccaacctgtggcagacatccccaatcaacgatagcactttcccctgcatgacatca

SEQ ID NO: 193208 - DNA, 369 bp, Homo sapiens
agatggttggacgagactgcagttaaagggcagaagtccagtcctcaagcaggcaagggaggcggcacgcagagaccagaggcccgcaagcatacaggagcacacagctcgacagattgtcattttctaattgcagtgcagtacacagaggtcccagaatggacaggaagggctcgtaggtgggcctggaactaaccctgatgttctgagttcatggccatctgtttcattttatgcatacaaaaaaacttactccagcaaaaggaagaaaatgaaaaaaaaagtattattttaataaacggagttttaaaaggtcatacataagagtttgtaaagatacaagcacaccacagcgttgtgtaggtgaca

SEQ ID NO: 193209 - DNA, 147 bp, Homo sapiens
gtgactgctgcagttctagattttctacatagttggatacaaaagaaaggaacaattcctgcctctgtgccaaaacttccatattccttagggttttgacaagaatttggattaccttgacctagggaataggagtgaggataatca

SEQ ID NO: 193210 - DNA, 143 bp, Homo sapiens
ccagaagggccttatagccactatctgtgcaggtcctactgctctgatggctcatgagatcagttttggaagtaaagttacaacactcccgcttgctaaggacaaaatgatgaatggaagccattacacctactctgagaatc

SEQ ID NO: 193211 - DNA, 787 bp, Homo sapiens
aaaggtatgtctgctgtttactttgcgatcttaaaaatcattcaatcttttaacggaaacttcaaatagcaaagtattctgtttcgtgttttaaaaactgtatgaacgttgcctatgccccattgcaaggtcaaataccttgtcttcaagtccatttagaagtatcacactgaggtttagcagtcttggcgataatgactaaatcatgtaaactagggcaactgaaacggtctagcatatcaggtagcagtctttcttaaagacaagagtctccgctcagcagacaggctgctgtatctttcatggtccggctaaagacagcctgaccctgaatgcaattagtaatgctttgtctgcattcaggagcctctcagtcttctcaatgcactagttacctacaacttagccaggtctctaacatttttcggagtcctcatatgactataaaactctcaggctgtcgctcagagaaatgagggaaggcaaaaataaagagttagtgttcagtgttcttctgagatgctcataatctttaatttcccttttactaatcaagaaaagaaatgcactatttccattttagaaatggcataaagagattttcctccaaagccattctttgccaactacaccattcttccctaagggtgtgggagagagagcaggcaatcactgtattaaacaaagttcaaatgaatttatccccataaaagtaaaaacagtccatcaaagtgtctgtttcaaaaatatatggcctggccaggtgcagtggctcatgcctgtaatc

SEQ ID NO: 193212 - DNA, 468 bp, Homo sapiens
ggtgagcaggtggagaggaaatgaggctaagacagtaactgggagccaagtcatatgtgatcttgtgggccactctaagggctttggctttttccctgagagatatgtaaagccactgaacaattttgaacagaagagttatataatttggatttacgttttgaaaggatcactccggcttcctgtttagaataaactgtagacaggcaagggcaaaagcagggcaatcagttaggctattatctcaccaggcaagagacgatggtaacgtggatcagggtggtaggtgcagaggtaatgaaaagtatctgaatgttggatttgttttaaaggtagaaccgacaggatatgctgacagattccatgtaagtgaaacttgttaaatttaaaatgcctattagatatctaaaatgttaattaagaggttagatatgcaagtctaaaattcaggtacttttcattacctct

SEQ ID NO: 193213 - DNA, 309 bp, Homo sapiens
cacgaagaaaatataaagtaggctaacaggataatcccaaaagcaaagtccttgagcagatggggtagtaggggatccagaatataagtctctgaaaacatggaatgaaacagaaattaactaattccacatatttagattatgagttcatttaaatgatatggaacaccactaagtctgactacttaactgtggtacatttgtacttctgccatcttattgttttcagtttaccatcttgttttctttgcttttatttttatttcgcttttcctgccgtctccatctcttagattgaaaaagttttct

SEQ ID NO: 193214 - DNA, 455 bp, Homo sapiens
actggctacattcacttggcataaatgcctctgggattcattctgtcattgcgtgtgtcagtcgtttgttccttttattgctggagcacagtccttgtgtgatcctaccacagtttgtttgtctggtatattttctcttcatgatggatgttgaattaacatgaaaacctctggttgtaagagcgacagcatactctagaccaagtacactaaatcgcagtgatactccctgcacaaacagccattctgtttggtaatttacaggattacagtttggtaatttacaggaacctgcatgtcttagaatgtttaccaatgaattacaacttttaaaatgatatgcaagtaatggccgggcgccgtggctcacgcctataattccagcactttgggaggccgaggcaggtggctctcttgaggtcaggagttcgagaccagcctggccaacatggtga

SEQ ID NO: 193215 - DNA, 519 bp, Homo sapiens
cccgtccagttggctcgttttctaatcctacccatcttggaaaatggcaccctcaacagcccagttgctcaagctgtccatgatccttctcatcattgccactttcactccaccagtgaacctgctggatacccctccaaggacacgctgtattctgaattcattgcttctcttcatctcattagttagatctgatgagacggccctgccgtcctctcttggacactctcttgaacaaagcagtaacctcttagcttgttttcccgctttcactgcaccccttctagagatcatcctctgtacaggagccaagggatctttaaaaacatggatcccagccgggcatggtggctcacgtctgcaatcccagcactttgggaggccgaggagggcagatctcttaaggtcaggagttcgagaccagcctggccaatatggtgaaaccctgtctctactaaaaatacaaaaaaattagctgggtgcggtggtgggcacctgtagtcccagctactctggagg

SEQ ID NO: 193216 - DNA, 676 bp, Homo sapiens
accccgcacaaaagaaaacaaagtggtcacaaaacaactcctttccttctgaaggttttacgatgcattgttatcattaaccagtcttttactactaaacttaaatggccaattgaaacaaacagttctgagaccgttcttccaccactgattaagagtggggtggcaggtgttggggataacatgcccaacactagatatgaatccattaacactgacatacaattgaccagctgttatagagccattcttgtatccctgaaaggctgaaatgggggaaaagagagaaacagactggctagaatacacagctcctctagtggcattcctgttaaaacaacctcataggtcagagatcaacacagtaaattgcaagataaaaaccaaaatcttgaaactttttaagtcttcaaaagtgttggtgttggggataaataatgttatcgcccaacaccagccccacttctgggtcatgcactgaggtccacagacctactgcacggagttaaaatagcggtacaagttctggcaagagcagatactgtctttgtgctgaatacgctaagcctggaagccatcctgcccttctgacccagagcaaaacatcactcgcccagcacatattggatatctcagaaatgaatatggaagtcccaacatgcgggtttaggtggtc

SEQ ID NO: 193217 - DNA, 761 bp, Homo sapiens
ccagtgatttaggcctttaatcccagcacttagggaggccaaggcaggtggatcacttcaggtcaggagttcgagaccagcctggccaacatggtgaaaacctcatctctactgaaaaaaatataaaaattagccaggtgtggtggcaggcaccagtaatcccagctactcgggaggctgaggcaggagaatcgcttgaaactggaaggtggaggttgcagtgagccgagatcacatcaatgcactccagcctgggcaacagagccagatcctgtctcaaacaaataaatgaaagtttccagtgatttagtcatccttctcttcctggtacagaaaggaagacactcttacaaatgtagatattctttataaaataaatttctcttacaaaaatacaacttttactgttttcagagcttctcctgtgtctgtttcccaaaataatcagtttaaagtaatcctgtgccaaagaggcatatttggaatggcatatactggtgtcctacagacatattttggggtgtcatgtcctgaactctacagttggctccctccgccttatggaaatgtaaataaaatctttggagaccattggtttccactgagctccttcatcagctccaacagaccaaaccaagttagaggtccctcctgctaaagttcgacgtcaccaatctaagttatctgacctgagaaatcaggagaaagagaaacaaaagtcaaatccccaaacaggctagttttagctggcatgataaggg

SEQ ID NO: 193218 - DNA, 617 bp, Homo sapiens
  misc_feature (19)..(19): n is a, c, g, or t
  misc_feature (25)..(25): n is a, c, g, or t
  misc_feature (27)..(27): n is a, c, g, or t
  misc_feature (39)..(39): n is a, c, g, or t
atagtgatcgctgattctngaggananaacgagagacgncctttgagcatgccagtcttttagtaataaggatggaagaatagagcaaagggaaagactgtgagtacccacagggtggtatttgtggctgtggctggggttactgggagttactgttctaccatggagagccaggagcggaaggccatcgatgacttactggctcttctccacattcagcaacaggaaacccacaatgcagaacaccaggttgcgtgtcaaatgccctctgactcactccttagtatggaaaataatgataaataatgcaaatttctattttgtagtcttttagcattttttcaagagcatttgctttatttcactctatctccgtagtctttcatctctaatctgaagaaagcaggttagatgaaatttgcttagcatcaagttaatgattagcagaagaaccaggatttaacttcaaccttttctgatttcaaatctggaatttgtctttgtaacaagcatctttggtgattcttatgcacattgctttggttttctgtgtctacataaatcaataggtaattttagtgtccttgcagaggaagaaactctgcgataaaaattgg

SEQ ID NO: 193219 - DNA, 315 bp, Homo sapiens
gcagagaaacccctagtggagggtggagtggggaaggaaggtgtgaggtacagcagaaattgagaatgaaaaatacctggaaacagggctggcctaggagtaaaggctgtgacccaactccacttcagctgacaagggtgtgattgagcagctctgtcccttttctggggcctcagtttcctcatctgtataacaagggatcagctcactctggccaagaaggccccagtccatgcttggctggcagcttgctgcttctcctgttgactacaaactttggtgtacattaaaaaaattcttttccccagccaagat

SEQ ID NO: 193220 - DNA, 325 bp, Homo sapiens
tattacctcgtgtatttgttacaaatagaaaaacttcttgtttgttttgtttataaacagataaacttcttataaataaaagagtcagacatgaatgacaaatataattcatttcctatgttctaatcatgtaccttttactagtaataatgctaccaaaataagtagtctttgttgaacaaggtcaaataaccatccatcactataagcagaaagatgaattctaagatctagtcttattgtctagagcaatattcctcaattgagaaagttttttttggccaggcacagtggctcagcacttgtgggaggctgaggcaggtaa

SEQ ID NO: 193221 - DNA, 223 bp, Homo sapiens
tgtttgaaggcgctgtttcccgtgcgctgcgtccaccgtctgtctggccccagccagcttgggcggaggggaggggggcgaggggagcacccgcgtgtgcacagccacagggtggggtgcaggtggctgggcccaggcagcattcaggcccctggccccgcagtggcgggcactcatgtgaagcccacccctctgtggtcagtaaattctccagaaagcgcca

SEQ ID NO: 193222 - DNA, 401 bp, Homo sapiens
ggaggggcccctgcttgaacactaggttttatggagggatcctgaacaaaatagtagcttgttagtgaggaagaaggggacagtgtctggtggtcagtgttggcctcagttgcaaaacatccagtgactcaggccagaaactgcaccatcagccgtctttggcctcttctctcattccctgtgtttgatctgtcagtgggtcttgttggccaagcctcccaaaggtctcccaagtccctctgttccacctgcactgctgccactagtgcaagcctctgtcctctcatgcatggactgttgcaggagctcctcatggcctccctgtctctgttcctcctccacttcagtcccttttcactggcatcctgtccccatggaaaccagacctctcactccttgta

SEQ ID NO: 193223 - DNA, 542 bp, Homo sapiens
ccctgtcttttccctcaaagacaacatgaaaagattcagtgaagaaagctgggttgatcctcttaagaggttgcttattaggacactgatcctcagaactagtaaataaaccagggcagacccctgaggcttgacctgggagagctgttcagcataagaggtgggagatgcagagagggtaaggtggttccggtccctgctgaaagaagaaagactctgaagggtaaactcatcacagtagatggagaatttggtgcctgttcattcctctgggaaatgggtacttggctagatcctgaggatataatgatggacaccacaaagctctcctaggccctatggggacttcagcaaccaaaatgctttgtgatgtggtgatgtgtgccacatggtacaacggcggtgaagcatcaggagcaacagcagctttcaggaagtcacctggcatgactcagcctacagtcaagagagtaataacttggtagggtttcagccaggcagtatttgccccgaaaacttcagtggcttcattctacaacctc

SEQ ID NO: 193224 - DNA, 140 bp, Homo sapiens
attttttttagtaacctccatattgtttttcaaacagctgcaccatattgcattctcaccaacagtgtgcaaatgttccagtttctctatatcctcaccaacacttgttgcctttttatttttttttaattttatttttg

SEQ ID NO: 193225 - DNA, 366 bp, Homo sapiens
aaatcttgcgattcttctcctgctgtcccagccacaggtcatgtccttgagtttcacaagtagcctctttggctttctcacacgtggtgaagagtggcaaacagactttctgttctccaactcacttttttcttccctagcagaggagatcccactgcttatagctcaggaaatttaagcctcaactgcaacagtggctggaaaccttttctagtagcagaattttataactcacagaaagaatttggtcttaaggtccctgcaatcagtgtcaagcctgatttctgcagtgccactcacttcaatgccaggcatgtgggatcagacagcagggaatttgctatcaaaagagctgggtctgaatcc

SEQ ID NO: 193226 - DNA, 307 bp, Homo sapiens
tgaaaatacaaaaattagctgggtgtggtggcacgtgcctgtaatcccagctacttaggaggctgaggtaggagaatcacttgaacccaggaagcagaggttgcagtgagctgagatggcgccattgcactccagcgtaggcgacaagagtgaaattctgtctcaagaaaaaaacaaaaagaaaaagaaagaaagaaacaggaatggaactactactgcatgttgaagacaaagaattctgataggcctgatagacatccacttaagtatagagaataccgtaacttctttctgctccccccttttt

SEQ ID NO: 193227 - DNA, 481 bp, Homo sapiens
cagcttttccctcaaaaacagatggtaacaactttgacatctttattcctaacttcccttctctaaagataagggtttcctttacaatggaaatcatctaactatggagcaacagtgcagactacttgaaaacttggaaagcattaggttctgtgctttcattaccacttttagttccaaattatcccacatttatcatgtcaaagaacttttcaattcagcatattccttagtgcatatgcctgaataaaagtttccctttttacagcaatcatgtttaaatacccttttcatttgattttttttgagacggagtttcactcttgcccaggctggagtgcaatggcaacaccttggctcactgcaacctccatctcccaggttcaagcgattctcctgcctcagcctcccgagtagctgggattacaggaatgcgccaccacacccagctaattttttttgtatttttagtagagacggg

SEQ ID NO: 193228 - DNA, 234 bp, Homo sapiens
tagtggtgggaaagacatgcaatctggaaaaccaaaatagtacagagagcaagcacagaactgccaattgcttgccccaaagcattacaaatctctggtccagaaggagaagtatcagattcagcctagtatgtgcttaagaatgtttgtcgaatcagttaatgaaacgtattttatgaggttctaatgtagcgcagtattgcactcccggcagattgacttataataaatttg

SEQ ID NO: 193229 - DNA, 263 bp, Homo sapiens
aatttctcatagtatttctttaatttataacatatcttttattataaatgtgatctcaagtagtattttggttgatcacgtttggacatctcttctttaaaggcacatctcaatacctcatccattcaatttttcagtctcctcagctataaatcacttctcctttgagttcccttaatgttttatctatatatttctcatatgatgctaaccacttaataccttattattttagatttatgcacatatgaccttcctcactg

SEQ ID NO: 193230 - DNA, 495 bp, Homo sapiens
acgcactgagtcatacaagagtatttgaggagaattacatgttattaacatttgtcctagaacctgggggagagttcaggtaaagagaacagctggtatacttgtaataaagatttaaatagagagacagaaacacagagagagggagagacagagagagacagacagagacagacacaggtaatgagagatacctaggcgtcgagatcgatactcatacacatagctatatccagaggtgaaagtggagggagagagagagagagagggagagtggaggcagagagagacacacacacagagagacagagagacagacagacacacacacacacacagagacagacagacacacacagagacagagagagacagaaaaagacagagacagacacagagagacacagagacagagacaccgacaaacacagagagacagacagacacggagaaagagagagagagacagagagagacagagaaagagacagacag

SEQ ID NO: 193231 - DNA, 321 bp, Homo sapiens
gctctaaaactgtattctctccactatacatggctgcctctggccaatcatccagtaaggaaggtccttaaagccagaaagtgacttaaactctcccaaaaacatttgggatgtcattctgcagcttcttttctacgcatctcaccctaattcaaacatcagctcaacactgtccttatttttttaaaatgatgatgaaacccaccagaaaaagttcatcgtgacctttcaccttcactgaggttttgtcctcaggacagtacaaagggaagacagaatattttacattttatgttttaaaacatacatgaaaagtagttt

SEQ ID NO: 193232 - DNA, 904 bp, Homo sapiens
gtaatgttttcagaagaaagctgtcatataaattcagagcagtgaaaaaggtcttctttaaatataaagtataattaaaatgataatgaaatgttaaaccttcctcctgatactttatctgcacgtatatactataagtaatggttataagaatctgctgtggctgggtgcagtcactcatgcctgtaatcccagcactttgggagcctaagttgggaggatcacttgagcctaggagtttgagaccagcctgggcaacacagtgagacctcatctctataaaaaaattgtaaaattaggcaggtgtggtgcgtgcctcctgtactcccagctactggggaggctgaggtaggaggactggatcgtttgagcccgggaggtcaaggttacagtgagccataatcgtgtcactgcactacagcctgggtgacagagcaagatcttgtttaaaaaaaaaacaaaaaaagaatctgctgtgatatgtggatcagatatttaattaggctggtgttcttgtgtagcccgagacaaagaggtctggacaaaattatcttaagtctgatcataggctttattttttatcattaagattggatttatgtagaaataatcatatttatctgttgtgctgtatctttagttgtttcatatgtaattattttcagtaatgagcactcagtgagtagtttttttattagacttctagagccctcaccatatgtagtccttcctttctatagtagggccgtatgaaattttcactatttagatcctctcaagtttcatttcacttcaagatgttctgtttttgtttttagagaaaaccactccactcacttcagctttgaaattgtttaactttttggtccatgatttaaaaaattaaggtgctaaaggctcacaa

SEQ ID NO: 193233 - DNA, 111 bp, Homo sapiens
tctccacatcatctttctaaaattctacctaggcaataatcccctggactttcatcatttgccaatttgtgccattatttacttgtaatatatgtctccttagctaggttg

SEQ ID NO: 193234 - DNA, 711 bp, Homo sapiens
atggcctaccatgtcatgaggctactcagaaggacacgcaaattaaaacttaggaattatttctggaattttccatttaatatttttggactatggtggttaactgaaactgtggaaagcaaaaccacagataaggggatgggactactttatttcctaagctttcagtaagtattcactgtgaatggagatcaggaattgtgctggcaaatgcgtacttaaattagacaacttagtcatattagctctgcttgcaggtccctaactaaggtagagggtatagtaaggaagttagcttggctaaaacagagatatggtggaaaggagtaaaagatatggctgaataggttaaacacacacacacgcacgcacgcacctaatgcacacacacacaccctaaattatagtgagcattgaagaccaggcagaaaagtctattaaatatttatggcatctatgaatgaattgtttctcaggattgaggtaaaacctgagagtcaatagtgatgaatgacgcttattctgctctactgtggtagttgtgaatgccatgtagcaaattcttaactactcctgaataactaaatggtatgttctgtaatattatttctagtattaattgattttccaaagcatgtatttccatttttaatgtttggtggaagagcctccctcctttttagcagatgatctcacgccaaatagttatat

SEQ ID NO: 193235 - DNA, 255 bp, Homo sapiens
aggcgtgagtcattgcgcctggctgtgctctgtccgtttctttgatgagaagggagattgtctgctcaaatgtcccagataggttttaggacttttgcattggctgttttccatacttgaaatgttcttttccctgtatgagggagctccctcatacatggctaaaatggctgatgccctcttaattatcctctcagtagccaaccctgtttacctgattcaaaaatagtgcctgcccatcgcaccccccactac

SEQ ID NO: 193236 - DNA, 468 bp, Homo sapiens
gaattttgacaaatatatgcaagttgtgtaactaccttgtatggaatattttcagcaccctgtaaatttctcttatgcccctttgtgattagtcctctcctctttctccagcttctggcagccacaaacctgatttctgtccttacagttttgccttttccacagtgttataaatggaatcatacaatatgtaatcttttgagtctggcttctttcacttagtataatgcttttttgagatacaatttacataccataaagttcatctgtttaaggtgtacatttcaacagtttttagtatcttttcagagttgtgcaaccatcaagatatctaattttaaaacatttttatcaccccaaaataaaccttgtactcattagcagttattccccaattctgactcccctcccatagctccctatcctaggcaaacacctacttttcatctctccagatttgctattcta

SEQ ID NO: 193237 - DNA, 763 bp, Homo sapiens
gacaacgcatttgggcttgccatggatttgtcttgagaaacctgttgtaaagaaaggaggccaagttaagtttttggacttagactaaccctaaaaataatgtttttccttttccaatattgtgtacattttcagtttgtcagttttatagagtaattaagaaaagtatattagccatttatcacatttttaatgataagtttggctctaggtatgtaagatccttgaatatggatgtacgtagcatttcagaacagtgtcagcaattgctggattggaaaatagtactagtaaaatgattttaatttcatctactaatttaaactggttgccttgctttcttcaagcagtgtggtcttttttttaattgtgcaggctttcattaatgcaccagtgaggatgaaagaaaacaattcatttatgtaattgcaactagcctgtcatacccaacttgggaaagcagcaactcccacagcatgaggtccacattatgcaacccaggctggcatttagatgagttcctttttgttgaaaatatatgaacttctaattattttaaatgtataagtaatacatatgtaaatctacattatacgaatgtaaaatctgttttagttaagaagtaaatccacagtagcaatttagttgtccattttagacattgagaaagtgtaggcatcaataataaggaaatacttgaaagataacaaagtcacggaattatatatgattctggtctgtattagctatctgtttctatcca

SEQ ID NO: 193238 - DNA, 449 bp, Homo sapiens
attttatggcttttacaatgtccttgtgtgaagaatatttttatacctcttccagaacccagagagctcagctgaaaggagtttgggttcctgacattgtggtgccctataccagcccttgctcctttagggtttcattgttatttggtggttatcctaaatctcctgctttcatcagatgtctgagatggcaaaatttggaaggatcaagagaacagagagttaatccttcctaatgggaaaggtggacaatgccaaggttaaaataccacatacatctttgagttactactataccctcccaaatggaaatgcttcaactttaatctgaggctaggcgcagtggctcacgcctgtaatcccagcactctgggaggccaaggcaggcggatcacgaggtcaggagatcgagactatcctggctaacacagtgaaatcctgtctctact

SEQ ID NO: 193239 - DNA, 271 bp, Homo sapiens
tcatctgagaatgtttttatttcaccttcattcctgaagaatattcttgtatatggaactccaggttgacagtttttatgcctcttccttctggccctccatgatttctgatgagaaatcaggtcacttgaatcattcatcccttaccagtaatgtatcactttctctggctgcttttaagatttttttctttttctttagttttcagcaatttatgatatgtctaggcatggatttatttggatttatcctgtttgcagtttactcagct

SEQ ID NO: 193240 - DNA, 160 bp, Homo sapiens
tagctgatgttatcgcccaacacctttcccaaaggtagaatttgtgtgggttttacttcactgagtgactaatgcagatctttatgttttaatgatgggaagaaattcgtcagcctgggtactttttccatgtgttggggataacatcaggggatcctaa

SEQ ID NO: 193241 - DNA, 258 bp, Homo sapiens
tattgtttgctcagtgggattttgttgtttatcacaagagccacgagtaagcttggtggtatattaaaccatgattgagtaagcaatgacccaggaatatttattggtcctttccttagatatctgtgtatatttaggtaagtgttactatagtatgtgggtaaaggtagtatgatcccaaatgaaatactcagtgctaataaacagtttcagtctaattacctttcagttattgattcatttattttctaaatcttg

SEQ ID NO: 193242 - DNA, 675 bp, Homo sapiens
aggcagagggaggagcaaggtgatctggaaggtgacgaatccagtcccatctgtggctgcagttagtggctgcaactgccctggcacttgccctttggtgtcagttcccattggctgaagagctactgagcttcatacagtctggaggtggggcttgagtttctgccaggaaagctgggagagccagggagaagccaagaggcgggagaaagtgcttcaagccgaggacctgccgttgttaaaggcctggaagtgagaacgtgccaggccctttgagaggttactgtcaacagtgagatgggtgagtcatcagctggggccccacggctcttgtttgggctggcttggtggcttcctgctgggcatagagtgagcagtgttttagaaagagtcatctgatgtcagcaggagggatgcaggatgaatgtcctgtcacacctgtcctgaaatcctccagcaccttcccttcgcctatggggccccccttccctttgcacagctgtcaaggccttgtgtgacctgacccctggaccccctgcctacctctgtggcctcaggaccaactccgtgctagaattgtgaactctcacgagagagagattttgtcggttttgtaacaaaacttgctcattgcagtctctggtgccgagaactgtgcctggcacacagtaggtg

SEQ ID NO: 193243 - DNA, 382 bp, Homo sapiens
ttcctgcccaaccaaattaaggaagtaatttcaaaaattaaaagagaagagataatctagagtggcaggcagtactaaccaactccacattcaagaatagcatcctttcttaaccagcattgcgtgattttaaactcttcgtatccccagaatttagcacagtgccccacacatagtatatgttcaggaagaactgtggtaaatgataaagaattatgaacaaagtcctcttcaaaatgaagattgcaggagaatcaagcttcagtcagatctaagtgcacactactctagtgagataagccaatcagataagcaggatggggaaccaccattttggttttgttgttgttgtcattgttgtttttgagacagagtctcacct

SEQ ID NO: 193244 - DNA, 268 bp, Homo sapiens
cagcattactaatgcattgtagatttgttgtgatttctgcccttttgtacatcatcattataatgttgacctcttttgaagaaagaggtcttccacattttgtgagctaagaaatgaaaacaagcaaacaacaaaacaatgatatctctaagattgttgggagactacctttgctaaaggaaattagcattcttcaaaaggttctaatggtgcattgcatagtataattcccagtttcattgtggcagagagattataaggcagagat

SEQ ID NO: 193245 - DNA, 297 bp, Homo sapiens
tattggatcagggccaccctaatggcctcatgtcactgcagttacctctaaaggccgttaaagtccccagctccaagtataatcacattccaaggcactggggtcgggatttcaacttacgaactctgagcgggagatacaattcaggccatggcaggctaaagtataatactaaaatcacaaatgtagcagcctgcttttccgtagaatgttgctgtgtgtattttttgttttctgtggcaaaataaaagtgggtcactcttgtaaaatttggcagtttttaatggagaaagcaac

SEQ ID NO: 193246 - DNA, 448 bp, Homo sapiens
acagtttgataccagactacagcatagcaagaccctgtatttacaaactaaaactttttaaaattagccaagcatgctgacacacacctgtagtcccagctacgtgagacactgctgcttgggaggtgggaggataccttgagcccaagaggaggctgcagtgagctatcatcgcaccactgccctccggcctgagcaacagagcgagaatctgtctcttaaaaaaaaaaattaaaatgtgccatggatttgaataagcgttgcttcaaagcagatctacaaatacccagtaagcacacgaaagacactcaacatgattactcatcagggaaatgcaattcaaagccaccaggagataccactgcacacccaccaggacggttacagtaaaaaagatggacaatcacgagtactgttctgtgatgttggaagtctgcagccctcagac

SEQ ID NO: 193247 - DNA, 439 bp, Homo sapiens
cacctatcggctgccgagcacctggagcctctcgaagatccaaggactcttcctggcttgaggcagcgtagccatatctcagtatgcgtttctccctttggggaagtaacccattctgccatcttctctaatttggaaaacactgagatgctttcaagcaactttgggatgctcagcaccttctgcagcagctgctcagcctctccaggcctgctgtagaagccttcatggagaaaagaagcaggatgccatgggcccacatgtggcaattcacatgaggtgtttgctctcagaagcagagcctgaagtttctaagccaaatgtgcttgatcgacagcatcaccctagcatgttgatttcctaaaatacacacactctcacttacccacaatcccacagtcagcctgggctatttaggtacagggttttctgcaccgtg

SEQ ID NO: 193248 - DNA, 116 bp, Homo sapiens
gcatgccatcaaaattgaattcaacagcaatattcaattatcactattctcagagtaaacacaggggtaactcctgcaggcccatcttttgtgatgtttttaatatttactggtgg

SEQ ID NO: 193249 - DNA, 288 bp, Homo sapiens
cacccgcttcggactcccaaagtgctgggagtacaggtgtgagccactgcgcccggccagaaggagcttttaaagatgtgcatcaaatgataccactttctagcctataaaatgctccaggaaccctggcggctcccctcctcaccctgaggcccctggccacctctatgaccttatctccactctcttctccactctgtctgtgagcttcagccaccctggccttgttttcacttcctcacactccaggttcctgctaccccagggcctttacacctgctgctcttt

SEQ ID NO: 193250 - DNA, 313 bp, Homo sapiens
tatgaacatgggtgtacaaatactgtcttttgagtctctgctatttctggtgtatatactcagaagtgaaaatctggatcatatgttaatgctatgtttaattttttgaggaactgctgtaatgttttccatagaggctgcaacattgtaccttcccaccagcgatacacagaagttctgattcctccacatcctcaccagtgcttgtattctctctgtatgttttactgataatagccattgtggtgggtatgaagttcattcttattttttaagaaaaaaatatacaataaaaatatgtgataaaaagaga

SEQ ID NO: 193251 - DNA, 861 bp, Homo sapiens
tgagattttagtacaattgatgtcctagggtataaaggtgatacagaactatatacatatcaactgtgttttataattcaatgatgactaaagaaagataaggaccactcttctcactgaaactaaatttgatgtgggaccaagttcatgcttttatagatgtctaaagtgttatagaatgaagttgcttcaaagtaccaaatcctagaggagaaatataatgaccttgatattgaaatgattaagcaacatttggtataccaatctgcctttgtgaaaaggtttagcctgaataatacatgccattttcaaggacatattagaggataaaggggatactggatggagatgaccaccagcatctgatgttaattcaaagcaccaccaagtctttaatttaattaaactttggtcatgccaaatgctaattgaattgttgaagacacaagttataaaatattaatttattaatcatgcaaggcataatatgatttttaaaacaagtacacttcttgcttccacgtgtatttgggttcttaattcatctatatccaagtttcttgatagtgaaaattacctcttaaaaaaggttcagcctttattagactcgtgagggcaaatggtacatattttaaagacgttttctcctttaatgtatattatgtttcattggcggatgctttatatttcctttttctttttcttttttttttggagacagtcttactctgtcacccaagctggagtgcaatggtgtgatctcggctcactgcagcctcggcctcccaggtttaagtggttctcctgcctcagcctccctagtagctgggactacaggtgcctgccaccatgcctggctaa

SEQ ID NO: 193252 - DNA, 215 bp, Homo sapiens
agtgtgtgcttagcctagcagctgggtaagcctgccctgccctggaatggagccctcctctaattggatggttgggcgtaagggttcttggttaccatcaacagaaagatactggctgacttgggcaaatgacagtgaactggaaggaaattggggctcgtatgatttatgcaaagctagggctccatggtagggaattgacagcactctggagg

SEQ ID NO: 193253 - DNA, 647 bp, Homo sapiens
ccatcttgaattgccattaccaataaaatatttatatcaataggaatatttgatcatgcaagattttctagttgtttcttttatttatccgcattttattttattatagcttattttaaaaataatttcttcttctaaaataaagttattttatcagttatatccttactcatataaaacataattatcttaaattcttcatctgactataacattggttttaagtgaggaagtcgttcttctagtcagtttttttttcttttgactttcttacttggtatttgatgttttcatttgttttgaaatttggggttataggtgtatgttgtgtggagattatttttctctagttctctttctattctgtgctcgtctctcactcctagtggttttgcaactacctccactagttttcaagatccaggtctcataagtgcaagcatctgagaatcataatccaggtttaattttattcatttttaattaaacatagaacaaaatttcttgtttttggtatacagtgaagattctgacaaatgcatgtaatcctgaaattaccactataatcaagaaacaaaactgctctatcaacattcctcatcaacacatcatgtatgaaattcccctgtgctaccttttgtagtgac

SEQ ID NO: 193254 - DNA, 306 bp, Homo sapiens
tggagagtggcagttggggataggagagcatccagtgttcattatggagagtggcagttggggataggaaagcatccagtgttcattcagttcagctgcttggggcagggtgttccatctctaggaactgtgagatggtctagttctatacctcttctttaagagacttctttaaaaacagctgtaccataagctgcttattttaacagagctgccaggctggtgggccaggggtcggcagtagatatcatgggtgtttcaggcttttagtaagatatttggatgtctctaatgacatctatatga

SEQ ID NO: 193255 - DNA, 138 bp, Homo sapiens
gagttcgcatatgacccagcaattctataacattcttaggtataggcccaacataaaagcaagcatatgtctacacaaaaaattagacacaagagccaggcatagtggcttacgcctgtaatcccagcactttgggag

SEQ ID NO: 193256 - DNA, 264 bp, Homo sapiens
cgtaaacggcgtcccgggcaagctctagcttattataaccctggcatttcctaggggttcatttgccgggtagtttggggtccctttcttaactctcccaaatttataacttaaagtgaataacctgggccactccgatgcgtaggttcgttttcgctgtctgcccgttcctggaaagatacataatttgtttgctcggacattcagaaaagtccagcttgggtgttcggaaaatcagattgtgtgtccttcttttgccaaagt

SEQ ID NO: 193257 - DNA, 415 bp, Homo sapiens
gaggggatggggtgtggtagtgggggtacaggcatgtgctgtgggcagaggtccttacaccatccagatgcgagaagggagttcttactcttcatgggagggactggccacatctgcaggctcaaagagttcaagggaatctgggtaggaagatttttaagggaatctgggtagtcaagatttttaaggcgttctgggtagtcaagatttttaagggaatctgagtattcaagattttttttcccagttagtccttggctttctctgccttcactgtcatgggctgcatgagatgactgtgtctttctaagctcctgaggatgtcccctggcttagttctattttagttttacttagttcttaattggtgatttgtcctttaagctttttgcattttttttcaagtgcgagtgaa

SEQ ID NO: 193258 - DNA, 175 bp, Homo sapiens
caaagaaagcaaagcctaaaagttgactgacctgcaaaagatcatcattctgtgttctcttattgttataaattatttctcagtagaattttttttttttttttgggacagagtctcacactgtcacccaggctggattgcagtgacacaatcttggctcactgaaacctctacc

SEQ ID NO: 193259 - DNA, 357 bp, Homo sapiens
gtcaagaatggcatattcaggatagttcagacggctttctagtttcctgtagcgtctgagatgttggtattagtttagttttgtcgtgactgttaggaccctggcgtacaggactaggaagcagacaaggaaaggcaggagggagggatgacaaggagcatgaggaaactttggggatgatggatgtgttcattatcttcatcgtggtcacagcttcatggatgtatatatatgtcaaaacctatcaaatccagtatgtgtatgggtttttttttttttttgagacagggtcttgctattttggccaggctagtctcgaacccctggcctcaagcgatccgcctgcctcagcttccc

SEQ ID NO: 193260 - DNA, 473 bp, Homo sapiens
atttaaaataaactctgctgagtagtgttatcattttaatgggactaatttaaagaagttcatgcagacttttgaaaatggagctagaggttagagcgaattatatttattttttggtttactgcagcactttatttttccttatgtaaataacagtggaaaaccaaaatttgtggtcatctctttaaaaattgagaattatgtacaaaaaacttacataaattaaaagaatgaataaatttacaggtgtaaatgtaaaccgcttctagctcaagacttaacactaatagaccagcaagacagaaatgaaactggttcaggagctcttgccaggctctagaaaaatcctggaatggctgggcacagtgcatcacctaaggtcgggagtttgagactagcctgaccaacatggagaaaccctgtctctactaaaaatacaaaattagccgggtgtggtggcgcatgcccgtaat

SEQ ID NO: 193261 - DNA, 478 bp, Homo sapiens
gagcaaggcaaacaagttaaagttctacacttacggagagtcacgtataagaactgaaagaaacctaagagagtatttggtctaacccttccgtttgacagatggggaaactaaggcctacagtgatcaatggcttatgtaaggttttagaccctttgtaggggaatttactgaacatttatttattgaatgcttactatataccaaacattctaaggtactagagatgtggaggtacataacacacagtccctgttctcaagaaactgacaatcgagtcagggaatcagacccatacactcctgccaacagtgagttctagatgtgatgagtgctaaaggagaagtaactatatagggctatgggaggatgtgggagacactcactaattaaacggggagaaaaaggctgcatatgaagaatgagagaggaataaactgagaggttatttcaggcagagggagaagtatgcatgagc

SEQ ID NO: 193262 - DNA, 414 bp, Homo sapiens
gttatttttttgttcacaaactggaaagtacagccaacacataatggtcacagagtcattcttttcttaacagcctactttgaagatttacttgggttgataattctatctactgtttgcgtaattgttttctgaagtgcattagggaccttaggcctacatacacatacacaacactctcattgttaatgataccatgtaatttggatgattttggctttgctgtattcatatggaagtcatgacctgaattcctccactcacgcttgcaattagagctaatctggaggctattagaataggccagcaatgttagaatgagtcaggtgaacaaaagggtgaaaaatcctgccatttctgtgttgagacactattgtctaaagtttaaaaaataaaaaaacctgatttgcttta

SEQ ID NO: 193263 - DNA, 453 bp, Homo sapiens
caaacaccatttaatacacaaaaagctacctgctttccaacctgccacactgatggtctctatgatgctgtattacatattttgtcattaatatgtagctagagttaattaatgaccagctgtcaattcatgactcatgaaacttatataagatcatcaaagtttagaaacagcaagttggagatccaaacctcaataataaaagcagagaatgagaagacaaaatgatttaaaaaaaaaaaaaagaggggggaagggaggaaggaatttaaagaacatgcaggtcattgcccagaatggaagtatacctgtttgtgttatcaaagtttgtgatacagtgtttgttagcctacacacaggccaatgggttatttttcaagtagcttttatccatccagtgtggaaatactgaatatttagggctaggtcctgaaatttagacctcaagagtac

SEQ ID NO: 193264 - DNA, 485 bp, Homo sapiens
tataagaaaacctggctgggcatgatggcaggtgccttgtaatcccagctactcaggaggctgaggcaggagaatcacttgaacccaggaggtggaggttgcagtgagccaagaacacaaaaacctttgtagttcccagggatcctgggcctcctagaatcgtcagagtgtaaggaccaagtggcattcagctgtgctgttctggtggtagtccatttagccaagaactcaaatataattgtagttgtctattacaacttagccttaacaaaatctttagaaagtaatgaaatacaggcttacagtgtgggtttatatttcccgtgtgctggccacatggttcttgcaattaccgtccatgattaactgtccatgtgaagcacagaagtaggaattagaaacactttttgctatgtagaatgtactctgtgttcagagtaatgtttagtcatactctctttttagatccctgctaacctctctgc

SEQ ID NO: 193265 - DNA, 292 bp, Homo sapiens
tatgttcattcccccaaaaagcagaaaatacaagactataaagaaaaaaattaagtttatccttaattcagtaccacgtgaaatgactactgttaacttggtggggattctcattcatattctagcttgttttctccctctctctggggcagataagtaaatgagtatggggtcatgctgctctgtaacctgttggtgttttttttgtttttttttttttaattttaaattttaacatcttttcatgtgcatatagatctcaattttgtttttttttttttaaatatggagt

SEQ ID NO: 193266 - DNA, 576 bp, Homo sapiens
ctggcatggcaagacggtttctcactgtgacgaccactctgggagggccagcatcattcacggtcatcagaagagtgacaagttgccacagaggcgtggcccctgggtcccactgggtctcaatgggtcaggaggcgaggagcaactccagggcgacctgccacccacatgatttatacagggtggtgtctttggatagaggtttttgctgtgttttctcctctaacctggaagggatttgcctagagtactggatacactcgcctatgataccaaacactgctacccgccccacgcaagctgcaggaccaagcggggcctgttcccaaaagaaagggggtgtccacagatgctcccattgcataaaggctcgagcgtgcatctgcgagttctacactgtgagatgaggttccttcaaacacagaacccacaacataggccagtacctggggtcaaattctggatttcttttagggaaaaaacccaaagatacaaaccaaagatttataaggaggagtgagtaaacagtagttaatatcactggtgctattactgaattcctactgccaaaattcc

SEQ ID NO: 193267 - DNA, 124 bp, Homo sapiens
ctcctaccacaggtgccttggcaaagggactcagcacaggagcctttgcattctctaggtacttaagcaagtactacctccttggatgctctgggcatgggggagggaaagctctgccaggggg

SEQ ID NO: 193268 - DNA, 458 bp, Homo sapiens
gagacagagtcttgctcttttggccaggctagagtgcagtggcgcgatcttggctcactgcaacctctgtcgattctccttcctcggcctccgtagtagtcaggactacaggcatgcaccaccatagctggctaatttttgtatttttagttagacaccaggtttcaccatgttagccatgctggcctcgaactcctcacttcaggtgatctgactgccttggcctccgaaagtgctgggatgacaggcgtgagctgccttgcctagccaaataactccattatttaagaaaaattaaccagtatttattgaatacttactgggccctgtgctaagtgctttgcatgtgatttctaatttcctgaccattctatgaagtggctactataattatcctgatttcccaggcagagaaactgaggcttagagagttgaagtaatcaactgggtgttaaaaa

SEQ ID NO: 193269 - DNA, 356 bp, Homo sapiens
aaggcccagattttgggctcaaggaactttacaaactgaagcattagcatgttcgtggtaagaaatcttctgatttaaacaaatgatgtaaattttacattttttagtaagcactacttcaagtgtgctatctttaatgaagactttaattcttgtttttacacatatgtagaaaacagaagttgagttcttcaaacatttgttatcaaaaatataggatatataagcactgaattggaagattttttcccccttggataatctagaaaagaatatagctctattctgaaatcccttctcattcaagagttatccaagcaaatagtgttgaccaaggtgttgaatgcaccagtaat

SEQ ID NO: 193270 - DNA, 169 bp, Homo sapiens
ccagtgcgacccaacggcagccagaggccgccctgccccgccgggccagaagcggactcggtgcagacatgcagctctctccgtggaatgtgcatgtgcacggagtagagacgggatttcaccatgttagccaagatggtctccatctcctgaccttgtgatccgcccg

SEQ ID NO: 193271 - DNA, 611 bp, Homo sapiens
tgcttccccaggtcctcctggctgggacctctggggccaactgtgccagtcacataacactggaagaagaaatagccagaatgttggagctggactcagagtggaagatatgcaagagcacagagtgccagggaggttcagcaggattgggagccccaaaggaggtctatccggagctcaagttagggggctgtatgcttggggccaaaatgtaacttgaccttgagataagatgaagggaattacagtatacccctctccataaccccatttccccagtgaccagattgctatggcgtagggtaggaaggcaccatctgtagtggaaatgggagggagaggaaagtagggacccctctctagtctcatgagtccagatgctggccagtctacccaccagcctggggacctctgcattctctgagtctgcccttcaggactcaccccatcccaagcaactctgcttgcatgtcctctatctctacctagccttcagccttgaggtccaacttgctcatgtaggaggttcccagatgccaagcacctgacccacatgcccccctgttgaaactgcatctgctttggccctgagaagagtcccacccagtact

SEQ ID NO: 193272 - DNA, 335 bp, Homo sapiens
ctgatggtgaggacgagcgtggtggtggtggtggtggtggtgacagtgataatgatgatgatatctctgttttatattgcaagacccagaatgtcaattccttctttgagggaaagggccactgcttatagtggtcttgacaaacttcaaaacatatggcccaatgcttatttctggtggaagctttactgaccatattaatgctattgataatattttcatgttattggtattaatcacgttaccagggaaagagcattggattcaaagtcaaatgcagactttcagtcctgtttttccactttgggcctcagcttccttagctataaataaat

SEQ ID NO: 193273 - DNA, 169 bp, Homo sapiens
accaaatcctttaggaatcaatgaaagactatcacaactaataaagagtcagcaagttttcaggatacaagattaatgtattaaaatccattgtatttctacatattagcagtgaataaaccaaaaataaaattgtgaaaacaattatatgtaaactcaacatatgggc

SEQ ID NO: 193274 - DNA, 489 bp, Homo sapiens
cattttattcagtttcacagatgttaagtgataaagcccagttttatgtgattttttaaataatatgtaaggcatggtaagatgggcaaatgagatgaaatcactgttttataaaagtggatattacgacttcctacatcagaatcttgagtgttccttaaaaatgtaaaaatcctggtttagtctcataactgctaaaacagatacttgggcgggtgcggtggctcatgcctgtaatcccagcactttgggagaccgaggtgggtggatcatgaggtcaggagttcaagaccagcctggccaatatggtgaaaccccatctctactaaaaatgcaaaaattagccagatgtagtggcgtgtgcctgtagtctcagctactcaggaggctgaggcagaagaatcgcttgaacccggaaggcggaggttgcagtgagccaagatactgccactgccctccagcctgggtgacagagcgagactctgtctc

SEQ ID NO: 193275 - DNA, 424 bp, Homo sapiens
gagagcaatattttaagaataaaatatgttatttttaatcattagccattgttaactgcgatgtaatgcagttttgtcagccaggcacagtaaagcaaggctgaacagtgaaagactcatctacagaaaacaagaatcaaaatgagtaaaaatgagtaatttgaaagattcctacttaaagaaacctttactcttgaaagaaataacctaccgtgccttaatttaaaatagagaactagcaagcttaagcaggactaggctcaggaatgtatttaacccataattgccaaaacaaaagtaactaggtggcacctgtttatagagtaaatgatgatagcaaccattctcaaagtaagcactctgatgactaatggatgccaaggtgaagctttaatcacaacactcatcaggaagagttgaacaa

SEQ ID NO: 193276 - DNA, 344 bp, Homo sapiens
ggaaccttgtttgaaaaagctgtttggaggagtttaagatagtgctttgtttttctcacagtaagtttcctcctaattgcaatccaaggcctttaaaatcattcctttgacagtcctatcacacatttggaatgtgcacaaataagcagaactctgcttttcaggtgagctttgagattacccatctcttgcttctcttcattgaacttgaagattttcaagtttcccaggagcaaaaccttacttaggaaatcacataaagaacacccctatctgcctcataattggaaacaaatcccagcccttcagagtgaaaccaggtgttcagagttaaatctcataac

SEQ ID NO: 193277 - DNA, 416 bp, Homo sapiens
aattttacaactatataaccaccaagggctatgctactgagcagatgtacggcagcaacccaagcatctaggattactagaaaaacaataagaaaacagttaagtaccaatttaagactttcattaaccttgcctttcctataatgttgttttatcaaattagctcactctgaaaaaccaaaaatccatcatatacttgtaaagcttagaactcacctaccctctcattctataggtaagggaacaggtccaggagagtgttatttgattaaggttacatggctaattagtcacagagacatgaccaggacaccactctagactttgcattattgcacaattctcgaagaaagagcttgaaataccaggctccactgcccaaaccatttagatataccagagtttaaatcaagtcc

SEQ ID NO: 193278 - DNA, 361 bp, Homo sapiens
gacaaacactacactgatgtcagtgaatcagtatgacatgcacttggtcccctgctagattctggatgagggtgaggagaagacatggctcaagacagcatatcaaagaacacagtgccaagaaagggaggaggggtttgggaagctaggaggctgtttttcagtgggttctagccaaagggcagagagtcaaaggcttgggtttgaatcctagcaccattcttgtgccacgatctatagtaaatgtccctacagaccaagtcaaataaaatctgtgttgctgatgttagcaggtaactaaggcttgagaggatgatgagaaacatcatgtactaaggcttctctcaaatactttcgaagg

SEQ ID NO: 193279 - DNA, 132 bp, Homo sapiens
taagtaaatctctgttgatgctaatcactggagaagatgtggggcaatagaggatcatctattgctgggaagaatgaaaaaagataaagccacttcgggctggcacggtggctcacgcctataatcccagca

SEQ ID NO: 193280 - DNA, 208 bp, Homo sapiens
tgcaatcctcaacattttctgtgtatggcttctgtgtgactaactcaagctgtccagttgtagatatactcaatgtggatacaccatacctaagacttcccagaattgacagggtgggaacttattttctgagtaaccaaacgataagttgctcctggcagcagccaacagtcaaatacatattcaatacaggagccaatttgcctag

SEQ ID NO: 193281 - DNA, 360 bp, Homo sapiens
taactgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtg

SEQ ID NO: 193282 - DNA, 319 bp, Homo sapiens
tgctcagctgtgaatatatgcagggggctcaggaacttgagattctaatcgtgtcttaaacagaatataaacctgcctttgggtttttggtggggagtgggtttggtacctcctcaatccatgcttcctgtcgggggaactagtgcagccagtttctgagcctttgaggaattctaaagcataatttgggctgaatcttggatttctctatttgctggcttaggattcagctctcttgggtctgctaaaccagtttgctcacccatcatctgttcagcttctgaaagtccaatactgttttctcctctcctggtagctt

SEQ ID NO: 193283 - DNA, 493 bp, Homo sapiens
caccgagtctcccttctgctctgagccctccagggactcccaaccagtgcaaaggccggcgccctcccagtggctccaggctcaccatcggctccccacctcacttcaccgctggccctgtttcatcgtcctcgccccattcttccctcccttctgcgaccgtggccagtattagagcattcctgagaagagagatttattttaaggaactggctcatttgatgttcaggtgacaggcaactctgaaatccacagggcaggcaggttggcagcctggaaattcaggaagagttgatgttgcattttcaagcgcgaacgctggaaactcaagtcgaatttcgatgttgcggtctggaggcagaaatcctccttcctcgggagaccgtagtcattattcttaaggtcttcaaccgagtggcccgcccaccatatagagggtcatctgctttactcaaagtctactaattaaatgttaatcacattccaaagttaa

SEQ ID NO: 193284 - DNA, 230 bp, Homo sapiens
aagggagaaattttatttgtgccttgaccttattgataatgtgtaacttgtgatggccactatcaatagaactatcaacagattcgaagggcactgtttgttcctttaatatggagaaatatcgcaaataactgggaaataatttaatgactgaagccttcatttttaatcatatagctgagtgatattttaagtttgatgagaataaacatttgaacaaaaatagccaa

SEQ ID NO: 193285 - DNA, 642 bp, Homo sapiens
cacatgttgaatcatacaagatgtacaatacatgccgtacggtttggactctcactatccatttgagtccttcagatagcatcaagcacttgggttctgctgcctctgacgttggagtaatctacagtgctctgaaatctcaaaggtcttcacaatctcctcccagtcacggtatatcaaagctatagatgccttgatttctaacttgtgtgtaatgttcaaatgcctcatagtcgtgcattaatactaacaggctctattacctggcagacggtcttggtcaagtcttattcttgcaaaaccatcccgtataatgaaggaaacatgaaagatgttttccactgtacgggggacagaatgaggatcaaccacaaagtcaaagaaggacattggggtatcaggatcttctcgaaaatttgtctgcaacaatcccaagattctttctacttctttctctgttgcttcttgatgagattcttccattcttcttaactgggcaggcattgcctgctccccatttcacaggcggtaaaagctcaagtcctcatggtggcctttacagccctgcgtgttgtgacaatccctctccgcatgagttctctgacttcatctctactataatctccttgctggaacacattg

SEQ ID NO: 193286 - DNA, 441 bp, Homo sapiens
ttatatgttggaaacatttcgagtcctctcttccagctattttgaaatataaaatgcactgttgttaactacagtcaccccattctgctatcaaacagtagaacttattccttctatctaactatgtgtctgtacccattaaccaacctctctctatccctccctcaacacacacatacttcccagattcgggtatctatcattctatctacctccatgaggtcaactcaaaagagtagagcttaacatttatacctgagctgttaccatttgtgattggtggtggtggttgttgttgttgttgagacaaggtagtgctctgttgcctaggctgaaatccagtggcacaatcatgtctcactgcagccttgacctctcaggatcaagcaaacctcccgcctcagcctcccaagtagctgggactacaggtgtgcattacca

SEQ ID NO: 193287 - DNA, 450 bp, Homo sapiens
  misc_feature (52)..(52): n is a, c, g, or t
  misc_feature (71)..(71): n is a, c, g, or t
ctgactctagagcatccacacacgtcacgccttcctgcctaagctgtcatgntattcaagccttacaatgngctagtgacttattaaaaaaatcctaagttccttccatgtctcaatggtcagctttttaattcgtcctagctttctttccctcgttactttaaaaattatctacttcttcaaactccttccctacctcttcttctcagcataaaacttttgtttcctagagtatgcacatgcatatatgcacatacacacagtagaattaaccagattggaacccttttttttcctatcaccctgcttcaaaacttactctctcatccatccttgcctccttcctgcctaagctgtcatgttattcaagccttacaatgtgctagtgacttattaaaaaaatcctaagttccttcctcccttccaaagttaactctaagtcagctagga

SEQ ID NO: 193288 - DNA, 111 bp, Homo sapiens
ccttttgcactgtgctgtgtgtactatatgtactggctcttagcagacccgtttcttcaagtgaagcattgtgtgaaggcctatgaaaaacagcttttatttaaaaagaag

SEQ ID NO: 193289 - DNA, 271 bp, Homo sapiens
accagtctgaccaaattagatctattcttcaaagccaaggccatatgatccttcctcaagcaaatctttcccaatctctttaagacatctttttgtccttggagtttccaaagacaagaaacattccatttttgagagagaagactacacatgtagatttaatcccagaaccaaaatttaggtgtgtgccatttggctggtcactttacctttcttagaattttttttttaatttagaaaatgggaataagaacaccatcttgcttttttt

SEQ ID NO: 193290 - DNA, 438 bp, Homo sapiens
tgtcacaaaaggcccctcttcatctagttaatagttaactctgctcatcttcacaatctgcctgggttccaacaaagcaattttaaggtatctttcccagattctcccaccaccacaagcaccagatcaggtctccatttgaagttcttataatattctgcaccttaattaaaatcacaattatatttaactagagactttatttttcaataagtatttccccactagactttaagctccatgagggaaggatctgttgtatcttactgccttggaccctgtgttagaatacagcgagtatagatgaatgaaacccaaggagaggcatctgaaaatgtgaagtcgatgttaaatcttacagaaaactcaaggagaggacttagaaaaaggtagttaaatgtgttgattaggttatagttccttgtgaaggtgaaatcc

SEQ ID NO: 193291 - DNA, 216 bp, Homo sapiens
tgtcacaaaaggcccctcttcatctagttaatagttaactctgctcatcttcacaatctgcctgggttccaacaaagcaattttaaggtatctttcccagattctcccaccaccacaagcaccagatcaggtctccatttgaagttcttataatattctgcaccttaattaaaaggtaacccagttttcaaaactcaagcagaggtataggatgga

SEQ ID NO: 193292 - DNA, 1062 bp, Homo sapiens
aaactcctgagctcaagccattctcctgtctagacctcccagagtgctgggattacaggtgtgagctaccacttgtggcaaaagcattaattcaaaggaattctagaaggaaataaatgttaagtaatgttcatttgctgtatatgttgcaggtaccttgttgggtttaaaagggacagaaggaaacaggtaatgctgaggtcctttacattttatatctcatccttccaattggcaccctactgcatacagatcaggagaaacctacccgcttagtattaagagttactagcaattctctaatgtttgatcataactagagaatggttggtagtttcctgggatttttcttccctatgtctagactgaaatagcacctgtaataccctctctcttttctgccctcttttctctcttgttttgtgttttccctgccttccattccagctgtgaaacaggcatcttttctcactttgtggattggatggctgagtccttaactttgagccaagctggctggttcctgagcacacacacaaacccgcctttgattgtccaggaggacagctgccctagaggcagattgctaacataccactagaacaatccttcttctctgttcttatgctggctagcacaatctttactgcctctagttccttctgtttcccaccccatctctgatctttgcttttggcttagtgagatgtcacattaaaaatgagagtagggattggattttttttcttgtggtagggttgagggggtgatcagagaatgtgacatgtagccagctttctagagcaggcttgccagtggtaaggtaggtaatttttacagagtagtgcctcttttgttcttagcacctttcctcctgagtactaggttcttataaaagggaaggtaaatctgaagtaggctgcaagctactcttcccaaattgagtaaggttttgttctttaaagtgaagataagacccaaaagtctagctggctccattccaccttctcttgcctccttcccctctccgtaaaaaaaatgtcaactttgggttaacttctt

SEQ ID NO: 193293 - DNA, 652 bp, Homo sapiens
tcccatttcttccccagtccccaaagggtagtcacagctactacagaactgttaacagcacagctaaaagaaaaaaaaaaccaaactagctacacgacagaaagattgtaggtttttttaagagtcagtgggttttaaaaagggaaaggaattgaatcagaaaaataggaagacacatgtaagaaaacacaccagtccaatttcataccaggttatctcctgtggcagagaataatcttagcagtccaagcctaacccctgtcactgataaccttagaaaaccagaaaagtcagattaaccttagcagatcactcaatttcaattaacgctgtagttcctgactaacaggccagcgggaagtagagggccagagtagggaggtagcagtacagaggagcacagatggaaggtttcacttccagctaagatgtcattctaatgattaattaaaatgtttgaaaacaaaaaatccaataatgtatgatttattcaaaaacgatgtgcaaggaattttgctagacatcccagtagtgggggtgggaatgggggtaatgacacagatgcattcagggaatttaagagtcattagaggctgggcacagtggttcacacctgtaatcccagtactttgggagctgaggagggtggatc

SEQ ID NO: 193294 - DNA, 422 bp, Homo sapiens
gtcgactccgaggatcccttattcgtgttgcacacaagtagtgatagagccaacgggaataaaatgactccactagaagagataactgctacaacctgacaagagaacacaacggctgcattttccagtgttccaaataggtaagtatactcactgcttaagacaaaattcttttgcaaaattttctaacccatgagatcaccagaaaggttggctttgtaaaaattacaaagttgtactgaaaatgtcaactgattttgaaaagatttctctaggtagaaatctgaagaaatggcattacactgtgaagagtgggaggaagtagggttaaaactgacaataaatatttctaatcttaacatctcaggaatattctaggacagaatgctgtatggggactttttttttcttttttttgagac

SEQ ID NO: 193295 - DNA, 278 bp, Homo sapiens
atagaaaaaataatgcactgtatgtacattattaagcaaagtggaatatttattgggtcattttatcatgcagaaattgaactctacaccactcatctaattagttgaattttacccattcatctacctgttcaaatatcttgctgtatagtactggataaattattaaatagtctctcaatagtgcaatatgcagtttcagtgtcagtaaagtgagaaatataatctgaagataaaggagctgttttcacgttgtcacaaaacaccagtgccacata

SEQ ID NO: 193296 - DNA, 274 bp, Homo sapiens
acggtggaaccagcagagaagagaaaacgagacagccacagcgattgtttgcaattttgaaacagactgcctttaaccctccaactttttttctgtaaaaagccttttttctttcttcctctgaaagctttgcattgtgaacaatccatggtaaacaaggctccctctacagccgcgagtgcgaagtacaaccccacaggttcagagcccagcgtttacccgtcagaaaaataaaatgatgacaagacatcacattagcgccacgcaggcttcc

SEQ ID NO: 193297 - DNA, 151 bp, Homo sapiens
agcaggggccgctctgtaatttccatgtctgggacggatttcaggactgagctgttttcctctttgacccggcagaggctgttgcccaagtcaacagtggtgcgtttttgaatttgtctttgttggttttctttttccctttcttcttctt

SEQ ID NO: 193298 - DNA, 655 bp, Homo sapiens
ggccagcccccgcccactctcctcccccatccacactgtgaaacaaggacagaaacaaagggcctcagccacgccaagacgagaagcagcagcgcatactgctgtaactgccttggacaagcagaaaaaggctcctcttgaatgcgcctgtgggcccagctacttgggaggctgaggcaggaggatcgcttgagccctggagattgaggccgcagtgagccgtgatcacgccactgcactccagcctgggcaacagagagagaccctgtctctaaaaaataagaaaaaagaaagagagaaaaagccttttctccaccttgccctgtctcagggaagaaggaactgcccttctccccgtggggacctggctgcctgctctgacaggtacctgtcatctgcccaccatgggcttctgggacctgctgtagcccctgccacccactgctgcagacccacccactctcagcttagctcaaaagctgttctctaactcatttctgagaataactgaagggctggagttgcagttggcccagctgtctggaccagatggggaaacaagcccagcagggcaagatgattggtctaaggtcgcagccaggtgacagctgggtcacttctcctcccactgtcactgctgcctccatctgacttg

SEQ ID NO: 193299 - DNA, 107 bp, Homo sapiens
ctgctgggctggtgcagagggagtcaaggatccctaagagagaggcaggggtgttcagctctcccacctctgctggatgaacttgcagagcctccttggtgactgag

SEQ ID NO: 193300 - DNA, 567 bp, Homo sapiens
cgggaggtggaggttgcagtgagctgagatcacgccattgtactccagcctgggcaacaagagcaaaactccatctcaaaaattaattaagtaattgaagttcaataattgcttcaaaaataccataaccacctttaatcaccatcatttttctggaagcattgattaaacatggtggattcaattagacatttatgtcttccctctcagaaccccactgaaatgtctgttaagtaactgaaattgaagtaactcaaaaaggccaagattgagtgagtgcacaattatgattgagagatttccaaaaaaatcttaaagataggaagtagatggtgctctgacagcagaaggagctccaccttaagtactgtaatgggggaagccatttcttcctctggagtcccagaaaaggtcaggatttggaagcatcaggttctacaggaggtagaggttacagaggttcatgtttacacacgaaataagaggttcagtcttttacgttgaaatggagtctagactcaaggtcataaggcccacctgagggcatggggtcaggcctgaaaagag

SEQ ID NO: 193301 - DNA, 459 bp, Homo sapiens
taccgtatcgagccggaacccatgagcaaatagggattcagagttctaaaattatgtggcctgggcctctcatttcactcacacagaactgactctggctttatttcttgtttattaaagtaagccaagattttgtttctggtaaaattagttgagactactttagttggacttttagtcctctgaatgtcacatttagatatggaaaatgttttttcacagagtagaaacaaagtctgatcacaatcccaaagctttgtttattcttatataatattttggtactgataccttttcagccacatactttcaaaataattttattaaaggtaagccaacaaataaaacatagaggcttttgaagtgctttaatattgatttaaaaaattggagttataaccagagtatgactgaaaagctattatagtcttcctccttttccaaaaactcaaggataag

SEQ ID NO: 193302 - DNA, 637 bp, Homo sapiens
tattctcctttaacctggaacagttcctctatcttttggttggtttgattctcatggtgttgatatttgagagtacatgtcagagcttttgtgtcccacacttggatttgtctgtttctaattctcataattagattcaggttatgcatattttgagattaatacccaggtggtgttgcatccttcccactgcatcacatcaaggaggtacagggtatcagtttgtcccattactggtctcactgagtttaatcgtttgttcaacataggtataccagacctttccattgtaaggtatttttccctctttgtaaggagtcagtagtctatggagtggtactttacacagtacaggactagtaatattttttttcttcaacagtctttcacctagtgcttttagcattcattgatcgttccctaaatcaaatactgtattagactgaaggttacaaaatgattattttctagttcttttgtttttgtttttttgagatggttgagatggaggtaggtggtagtttgtgtttaatatttttagttgggtgatgaggaatagtgtaaggagtataggggtaattatggtgggccatacggtagtatttagttggggcattaggagaacgcgtacaaatcg

SEQ ID NO: 193303 - DNA, 407 bp, Homo sapiens
atatcagaagcatttttttctcttcgtatggcgagcccatccctgtagggagccaccttcacccttctcaaacattttagcagaagactcagagtttgggtccaggaattctatatttaagaaatgtgtcctaagggaaaaatcatgaaagtctgcacagatttagttgcaaggatgctcattatggagttgtttatcatggccaaaaattaggaaccaacctaaatgcccaacaataggagattacttaaaagaaattgtagtccttttgagaacagacaactaggcagccatttaaaatgactctgcaaaagataagttattgacatgcaatatttgccaccggcttcacctgtgaaggtagataatgaaagggtatcgagtatttgtacatttatgcttagaaa

SEQ ID NO: 193304 - DNA, 400 bp, Homo sapiens
tacgatgctcgacaaagtgaggggttgaggagaggtacaggtgaaaaagccaggcagtagctacttgtgcatattcaaggatggctaagttgtttgtttggaatatagttcaaggtaggcagtaaaaagaaacagagggaggatcatgaatgatcctatgtgctatgcaaaagatttatagattttatcctgaaaatgatagagaactatcaaaggatattaagtagggcaattaagtctgagaaagttccttctagcattatggtgcatatcagggtcatggtaggatttatattaattcacagatttgtggactgcatgtccaggtaggtggtgggtgggaaagacaaatagttccattctaggaaaacagaatcagtagtaggagttgtcgagagta

SEQ ID NO: 193305 - DNA, 399 bp, Homo sapiens
agaggatcaactaactgaagctttaaatgggtatcaaatgaaggtaattccactctgacttgcacagtgagctacagagtggtagtgacagcaaattttctaaacagtatcataatttataagtctcttttacatactcatcatctcttttgtttcttagggaaaatctgtgaggttggccaaatgtagttattgtacctatttcatatatgtgaagatgagactcaagatcccataatgagtaaataaccagaaccttgatttggaatcaagatcttataagatcatcttctagacatactaatgtaccaataacagagatattgaagaaggcatttaaaaaatcaacttttttgaggtataacatatatacacaataaaatattcccattttaagtg

SEQ ID NO: 193306 - DNA, 303 bp, Homo sapiens
agactgcactactgcactctggcctggtgacagagcgagactccgtctcaaaaaacaaaaacaaaacaaacaaaaaatgactaagtactaatacatgctacaatacggctgaacctgaaaacatattaagtgaaagacttcaagccagtcacaaaagaccacatattttcacaaaagaccacatttatatgaaatgtccagaacagttaagcagtgtagtggttgcctagggctggggagtagctgggagagaaatggggagtgactggtaatgggcacaggatttcttttggggggtgataa

SEQ ID NO: 193307 - DNA, 636 bp, Homo sapiens
gtgcgcgccgaggacccgacggcagaagggacgatggcaacgtacaaagtggaagcatacactaagacgaggttatatgctgggccataaaattagtctcggttacatgtcaggaagactgcaattctacagaagatgttctctgaccacaatgaaattcaattagaaaccaagatatctagaattcccaaatacttggacatccaacactttgataataacacatgaaaattatgtgcatgaacttatgtgatagagctacacgcagggtttagtaggcaaatacacagctttcaacatgcctatgtaggacaagaagggttgggacatcgatctcaaatttctcactttacgaagctcagcaaataaagaacagattcaaacccaaagtaggctgggtgcggtggctcatgcctataatcccagcactttgggaggttgacacatgtggatcacctgaggtcaggagtttgagaccagcttgaccaagaaggtaaaaccctgtctctactaaaaatacaaaaattagctgggcttggtggcagctgcctatagctactcgggaggctgaggcaggataatcccttgaacccggggtacagaggttgcagtgagccgagatcgcgccattgcact

SEQ ID NO: 193308 - DNA, 541 bp, Homo sapiens
ctggctattcccaatggcaggaaagagcttctgctcatgagaaacttacaagataggcccaagatgggatctgacatcaatactgatattgataatggttaatagcaggcattaggggttaagtgctgccccagaggtgcagattgttacagacatgcagagaaggggaaagatgctttctcaaggaagcttggaagtggtcagagagtcattcatgtgagggaaggtcaggggaccaaaatagaggaatggaaacagcttgagcaaactcatagacgaggaaggaaggcataagtctttggattttcccaactccaactgacctcagcatgaaaagaaagcagggcttgactggaaaggaagctcactctctggcaatgtggaaggccttgctcatgggtgaggatgtggaaggccttgctcgtgggtgaggatgtggaaggccttactcgtgggtgaggatgtggaaggccttgctcgtgggtgaggcagttggatgcgattcaggaaagaatgggggttctctgagggttcagtggag

SEQ ID NO: 193309 - DNA, 331 bp, Homo sapiens
aaatctttgtacacttctccaattctagattggaattgttaaaaataaatcatagaaatagactactaaatgaccatttatatgactaaaattttaagtttgcatattgctcacttgtgtatgatggtaggggcatttcaactagacctagaaaggtgagtaaactgcgtggaagatgtgaatgtaggaaggtggcaggaaaggtgaaaggttagtctgaaaagggtaaaaaagcagaatatatctctttatctcaaagattcgaatgcaatttaaaatggaaatatatgccagctattaatctgacttggtgatatatgctactattaga

SEQ ID NO: 193310 - DNA, 255 bp, Homo sapiens
tcacctacatatgcaattaatcagaatactatataacaaatgaaatcataaagaatgtccacatacagtggtaatacataggagagaatgattaactctgttttgttgtgggatggcatggggtcagggaatgctatagctgcattttaaatcagtccatactgaagtgaataggagtttaacagatagctttaaaaggagacatacaacttgtttaaataaaatgtgcaattaagcatcttgggtagtcacaga

SEQ ID NO: 193311 - DNA, 400 bp, Homo sapiens
tctcaaaaaaatcaggataattatgtatcctttttgtggtggtggttgtgattattaaatatttggcacagtgccagtcacataataagcactcagctgcttcatcaatatcatcctaacgttagtcgttgtgtggacagcaacagattaagtaaaaagttatacccctaccccaattctgtttcagtctttctgtgtttggcgaacttcccaggtgattcttacatttaatacatgtgaaaaccattaccctaaaggtcctttcatagtgaacttcatctaggacttgccaaagccactaacatgaaggagttgagatcaaattcattttgtctaacactatatctcaaatgcataatattttgtctggcatatagtaggcattcagtaaatagttgtt

SEQ ID NO: 193312 - DNA, 640 bp, Homo sapiens
gataaacacagttattgtgattcacaatatttgtgtaaaaggcaccacactagagccttcccaagtactcccaacaataatattttgagaactttaattttttatcttgggtggctccatgccacttggattcagctcggggctccccctcagtgttaacacctacagtaagtcagaggaggcttgcaggatgacccggtgcttccaggaattgcctgtgccctccagaggcaggcggccgatttccctttggcagcaggtgtcagggaggtctacagcacctgatcacctttccagatcagcttggagggtgctaaaagcaggggttctccaacttgagtcaccgtcagaatcacctggaaggcctgtgaaacagatggctcaggctcaccccgcagtggctgactcatctgtgctggggcctgcaaagatgcatttctattttttttttttttttttgacagagtctggctctgtcacccaggttggagcacagtggcgcgatctcggctcactgcaacctctgcctcccaggttcaagtgattctcctgcctcagcctcctgaatagctaggactgcaggcgtgtgccaccacacctagctaatttttttttgtatttttagtagagacaaggtttc

SEQ ID NO: 193313 - DNA, 482 bp, Homo sapiens
tacaaatataaagggggttatagtacatttacttgtatcactgatcctattgcacacactttgcactagaggaaaaccttgaagcagttgctcaagctttgttcaacaacagggaatttatattggagatgagtcctgcaaatgtaataagcttagaaacacttattttttttttcagaaactacagcttagaaaacaccagagagtttataccaaaatataattttgcaaatgtggtaaatataaaaaactaattcaaaatagaatgtatttaaatatcagagaatttacagtagaataactaaggcactgacacttcagacattacactaaatcagagtgttgagtataaaaactaatccacaactacagtttttagataaatgatttgcatgtaactgtaaaaggagtagatttttggaagcattgtaattacattgaaagtatacttgtttccttgaataaaattttttgaaaactgc

SEQ ID NO: 193314 - DNA, 753 bp, Homo sapiens
ctcaggcatgatctctagaaaagccatccctgacagcttttattctcattctttaaacacctgtgcctaccacttagcaggaactcaataaatatttagtaaaataaagactgtctacacagagatgattgctacagtctagcaacaaaggggatagacatgcaaagacctgatgtgcagctcagatggtgaagtgacactagaaaaattcaaaaagtacgaagggagccccaagaaaggagacacctgtgtacgtggagaaaagatagccagattcagggaggacttcacatagaattttgagccttttttcctttttttttttttttttctgtttttggaaacaagtttttactctgacacccagggtggagtgcaatggcatgaccgagactcactgcaaactgaaactcctgggcttaagggatcctcttgcctcaacctcttgagtacctgggactataggcacagaccactatgcctggcaaattttctatagagtcagggtttcactatggtctctgggctgatcttaaactcctggcttcaagcagttatcccacctgggccttccaaagtgctgggattacaggtgtgagctacgtgcccagcctacattctgagtcttaaaacacaaaaataaattcctcagaattgtagaggaaaatatttcagatgtaaaaaacagggtgtacactgtaaaggtataacagtaacaaaaattttgcaaattattagtaaataacgtgctta

SEQ ID NO: 193315 - DNA, 319 bp, Homo sapiens
caggggtggcagggaagagatgccgtgtgtgctcaaaggcagctcaatttggaggctgggagtgggaacacatcatccctgtaaagatgggatcagattgaaacttctgggacctgatttcaggaatgagctgcaacaaaatgcccgcacacttcttgaacaccttccttttcctccccagctaaaatcctttcctgattcctcagtctcccttgggttcattcacttccctccagccctacttttcccctcttgcttctgggcagtatctttagccattaccaggttttcactcacaccaggacctttgcacatgcca

SEQ ID NO: 193316 - DNA, 222 bp, Homo sapiens
ggctggtcggatcaatggggctcagtgtcagatgaggcaaagccagcaggaggcaaggatgattctaccttgagtgacagaggtagatgtcactcagatgctaagatcggggaaggaggagggagaggacaaatttgatttggggcacacggttttcgacatgtacaaaggacatccagatggcaatgggctatgtgagcctggagactgtgctgcgagttg

SEQ ID NO: 193317 - DNA, 391 bp, Homo sapiens
ggtacacgaagagctccaaggaggtctggtgaggtggtgccatcttgatggtcactttcacggggacccctttttttgaacttgatcttgagaatttcaggggtgttgtgggctttggctaggtcctgggtatatcggtaatgacatctttgcctttgtgttcatttttgaaaaatatttgatctggctgtatgatttttagtctcacagtttttttctaacagcactctaagaatgtcattccatttccttccagcttgcataatttctgacaagacatgtgttattatatttactcctatattatgtgcctttttttctgggtacttttaagatttttttctttgttactttttttttttttttttagcaatttgattatatcatgtca

SEQ ID NO: 193318 - DNA, 431 bp, Homo sapiens
gattcttgtttaagccagtccccaaccacatttctaatcactggctggagcctttcaaccagggtctccagccaccttcactgctgttctctggctgacagaggtttcaggcctcctgagtgagagctcccagggggaggaccagactgtcatctttgctgtttggatgactcagccagttcagtcttagagtttcagagtgtctgaggagaccaggggctgaagtgaaccccccgcacagcatagccactctacaaaaacgtggccagacttcttttttaaacaagtccctattcctgttcctccttactaggcaagacttctcaacttgcttccagtcacatcctacaggtgtgttcagattggcaacaggttcatacctcagaggtacagagctcccagagggaagggcaggttatcgtctttgcttt

SEQ ID NO: 193319 - DNA, 104 bp, Homo sapiens
tcttggaaaatgggacattacctctggggtctcagtgaacggagggagctaagtggctgctgtgcccctccctgtctttgcgtctttggtcctgggcacagtta

SEQ ID NO: 193320 - DNA, 606 bp, Homo sapiens
gcacaaaagagatgaaaaacaaaaagatcaaaactattttcagtaatcatattgttggttgcatttagtactgttattctgaaactattgcatgttgtgtgggttaaaggaaataaacaattatgtaatacgctaattgtatttaccagtaaccttaagaattgtggttcatatctgggaaaaaggagatatagatataaaccagaaaataagatattgcatggatttattggccaatatcatttcttcagactaaggaacacactgtacagcctgtaatgtccagcaataggcagagagatattctccttagagtaatggtttgatagggaagtagaacaggcaattaaaacattgatttaaaaccactatttaaaagcataaagattggattacacaccttcatgactgtgtgctcacactcaacactagtggaactaaaggatctaaaattctccatttttctggtgcatctgaggaagagggattggagagtatgcaggtatgactatgcgattcttgccaaggggggaatatgctggtataatgatcctacttttttccttttctccatgtattacctcaacttttatctccctacctgat

SEQ ID NO: 193321 - DNA, 238 bp, Homo sapiens
aactatatcaacaatgagtaggaacgtcagttctgtttaaagacaggaactgccttacaaaggatgcaccatggatatcaagcaatgtatgatgttgtgaccaaaaccactgatccagttttgtacaaaaaccaaaatacttccccagctctttagttctcatttcaaaaagtaacatactacttgtagaaaatctgagaaacagaaaaataaagaaaaaaaattagtcactcatagc

SEQ ID NO: 193322 - DNA, 161 bp, Homo sapiens
tgtagtcttctggatatggctgatctgaattggactgaactctaccatattcctgctgagtgggtcattattggaatgagacatttgctcttcagagaacaactttatttttattttttcttgagatggagtttcactctgtcgaccaggctggagtgcag

SEQ ID NO: 193323 - DNA, 175 bp, Homo sapiens
ggcggacctgaaagctcgaagtactatggtagaaatggcgccatcttccttttcatgcttaaaaaccaccacgctcaaagcactgtattggcacacatatttaccttctaaaaaatgcccattttattttagttgtatataacgtatattactttgatagcaaatggaggaggat

SEQ ID NO: 193324 - DNA, 265 bp, Homo sapiens
acaataggacagagcctgtcaggtgtgggttgaactctgctcctccttaggaaggaagtctcaagcttggcctaagctttgagaattctggggggcagagcgtgaggtctgaaaggggctgttgtggcaggcagggcggccacaacagcccctttgctctgttgtgtgggtgcagccgggagtcagccggaacgttgagcctggcagggagagtggacccgcgcagagctcagtctagatggctgggaggcttgtggggagaaga

SEQ ID NO: 193325 - DNA, 485 bp, Homo sapiens
ctccagggctcggccaagggattcaggtggaatctcgggggcgaccagacgtctttctaagaagacagtgaagcagtattaattaccagaaatcattttatctgtggtaaagaaaaatatttaaaaagagaacagcatgtggaggctcacgctgtgaacttttcctccgagaaccaccgcagggacgtgccacaaagagttcacggatcctgtggacaaagcagctcacagctgcaaactccccgggagccagaatgctctgctgccctcttgacagtgccacctcctggctggaggccaccaacgcaaatggctacagcaaattctaaccaacaaccctgctccaaggaaggagaaagcaacagctaatcccaccacctgcaacctcctggctgcccacaggtcccgagtctgtccacgtgacaacttcactgcagcataaccagcattcgagaaagccagtgcactcaacaaaactacaacca

SEQ ID NO: 193326 - DNA, 202 bp, Homo sapiens
gcaagccagggaaatgccagatgcttataaaaccaccagatctcccaagactcactcactaccatgagaacagcataggggaaactgtctccatgatttgttcacctctacctggtcctgcccttgacatgtgggaattacaattcaagatgagacttttggtggagacacagccaaatcataccaccctttaagattcata

SEQ ID NO: 193327 - DNA, 501 bp, Homo sapiens
agcaggggagggtggaatctttgcttgcattggggtggagtcaatgtccaggggaaaaacaaggagttgctgcctaaagaaagaggagagaaggaaagcaaccaccagcagaatgtgcccattctgctttgtcccaggtggcttcaagccctgaaataagaaagcagtcgctgaggccaccatgatgccttctttcttctttctttgcttgaagtaggggaatgttccttacaaaaaaaaaaaacaccggaatatggtaaacctcctgcctctcctgacaacctgcagctgccttctggggccctcctctcctttccctgcctgtgcccggcccagctagccctgccacagaactgtttctgggcagaaatactccaagtatccctgtgagataagtgccgtggaaggaggtgcatggatgatgcacatgtactgctcgctcaccgcatgggacctatgactgttgtagcaaatgatcataaacctgacggcctcaaacga

SEQ ID NO: 193328 - DNA, 495 bp, Homo sapiens
tacttgcagataggtaggttaggagaggccttattgagcaatgatctgaatgaagtgaaggagataaagaaagagtaatggagcagcaaaaaaggaggggaccacggtgagggctttcacttttactctaagtgaaatgggagccactggaaggttgtaagccacagaggaacagctaatttacattttatttatttattagaaacagagtctctgtggcccgggatggagtgcagtgccacaatcagagctcactgagccttgaattcctgagctcaagcaatcttcctagctcagtctcccaaatagctgtgaccacagatgcataccattgtgcccgactaattttttttgtgagacggtttcgctcttgttgatgctgaagtacaacggcacgatctcggctcaccacaacctctgcctcccgggttcaagtgattctcctgcctcagactccagggtagctgggattacaggcatgtgcaaccacgccca

SEQ ID NO: 193329 - DNA, 1471 bp, Homo sapiens
cggactcctggtctcaagtgatcctcctgcctcacctcccagagtgctgagattacaggcatgagacaccgtgcctggccttctttgcaggatatatatatagatatagatatatatataaatcagccaggtgtggtggcacacgcctgtagtcccagctactagggaacctgagtcaggaggatcacttgaacccaggaggtggaggttgcagtgagccaagatggcaccactgcactccagcttgggtgacagagcaagaccctgtctaaaatatatatatatttatatatatgtacgtgtatatatgtatatgtatgcctgcggggccctattgtgagtttgttacacaatttactgcaacttcaattgtgccaccagcccccacaatatggcaagctaaatagagactcagttatgctagggctggttgagggcattttgcaagattagcatggaaagggcccttcatttagcactctgctccgttcatttttgtcaggtcactttcttatcttgaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaaatgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagatttgtcagtatactttaaaacaatcctgggaacagttctagattgaaggagactaaagaatcatgtactaagtgtaatgtctgatgtttgattggattgtgaattttttaagccatgttatgattgggacaattgtgaaaatgtgtatacggaccgcatagtagacaatgataatatgaagttccattgagtgatgatagtcctctggttatgtcagagaatgccttggttcttaggggctgcacactgaagtcttcaatggtgaagggtcattatgtctgcaactgactctcaaatggttttgtccagaaaatgtatagacatacacacacggaaagctaatgtggcaaagtattagcaactactgattccagatgaaagttatacaggtgttcattataccatttgaaaatgtttcccagccatcctaaggcttaaaggaaaaaaagaaaatgtttaaaataaaaacttgggggcagaaaaagaataccaaaaattttgggctcatgcctgtaatcccagcactttgggaggccaaagagagaggg

SEQ ID NO: 193330 - DNA, 709 bp, Homo sapiens
tttccaaaaattgttacaatgcatgaaatgtaaatttttcatggtacaaaggtttcattttaaaactctgtaaacttttaaaatgtattcccattcctcaaatttttcatagtaattcattactagattgttgacagagatatatgtgaggtctctgtaagccttaggcttccagataccatgtggattttgtttttctttttataaacttctgtgatattctgattaaattaaacaccctcacttgctgcccaagttcctttgtgttttcaaagagtttgaggattcattactaactaaataatgcaaaatatctgctgatattgtcacattaccttccttgtactttaaggtgtaagtgttctcattgctcagttctctaatagcctatcttaacaggcacatattgccacaaaggcaaaagaaatgtaaataactgtgtaaaatctcaggttgtagcactgcctgcaacatggtttaatttcacatgagatgtgtacctccgtaagacattttgtccagtttacttgagtgattactatttagtaataggagttcacgtacttaatgtttgctagggtttagcatgtattacctaataatggaagctataatttgtgagtgcacgataatttctagtttgtctacatgatttctgtggttctgcatgagtgtccaatgtttgtatttaaagagcaaatgaaactgc

SEQ ID NO: 193331 - DNA, 226 bp, Homo sapiens
tatctgaactgacacttggcagaaaatgcgggtgggcagagaatggcccctggactaaggtgcgaactatgtgagggctcactctggaggtatacctctgatgctgctgcagcggcatgaatgtgaaatgtctaactggtcctaggactatctaacgtggtcagtacagttcccttctgccttttattgttttattatcaatgatatttcatttttatttcagttc

SEQ ID NO: 193332 - DNA, 533 bp, Homo sapiens
cagaatccagagttcagccaatgcttccagagagactgtggctgttaactgtccctgttgacactgggacctgtctcccctggtgacctgagtcttaccttgattctcttaatgacggagagggagacattaagaacttgggagccaatgccaggcgcgagctacactggtctccgcctcctgctccctgcagatactgttggggaccagcctcaacaccacccgtagggtacccaaagtccggtggcgacaaaggaatgagaagagacaggttaagagtgcataaagagtgagggccagggggccaattgcaaatcggaggctgcaaaaggcgcagggttctggtctccactctattgattgagtaccatcacttacagctaagaagcagacgttcagggcgaaacagtgaaagggaggcagtgcgcccatcatacgtccttggtacgcggcgactcgccacgggttggggcgtcaagaaacaggatcagcgcgccggtttacagcgggtacacgggaccagtccacttagg

SEQ ID NO: 193333 - DNA, 318 bp, Homo sapiens
taaaaaaaaatacagacaggctctcactatgttggccaggctagtcttcaactcctgggctcatgtgatcctccttccttggcctcccaaactgctgggattacaggcatgagccaccctgcccagcctttggaagccttttgttagggagttacttcccaaaccctcctgggaaccctacctaggtgctgggaaaaaactgggggtggtgggtgggacagggtgagagggtgtagggggaaaaggaattgggaagggaagaagaaagaagagggaaggtgggcaagggaggaggaaggaggagggaaaagaggagca

SEQ ID NO: 193334 - DNA, 367 bp, Homo sapiens
gctcggcccaggtcagtcttaattgaagctggggcagttacgtagctatcagaaacaataccttagagggtaggactgactatgacagcaacatagactaaagatgtggagaaaagctctaactgggtccctatataggacaagagctgataaggatccatgtcataacaggaagagactctagaaaaccatgtgctggactactaagactagggaagctgcacagaaattagatgcttgctccagatgtgagtagatgactcactctagaaatccaaggggatactgagggaaggtatggggcccaaaatctattatctaaaggatgtagaaatccaagccaagaaacaaacttaagactggtcct

SEQ ID NO: 193335 - DNA, 190 bp, Homo sapiens
cttttgggtctcataatatttttttcaaagagtgatttttaatcactgggtaggggaaagcctgaaaatacgtttacttatgttttaaggaaaaggaaaggtaggatctatgggatttgaaatactgggataactcgggatcagacaaccctatttcacaatatttgtgtttttatcttaggatgcatac

SEQ ID NO: 193336 - DNA, 383 bp, Homo sapiens
agctgcaatgtaaggaaagaaacacagaaaaaaagacaacaaaattttccaggataaagagagaaaactgttcacaacagaaaatggaaataggagacagaacaagattcatctaagcgcgaccagaccacgtaggaagctttagataaagaagggaggaatagcaggaacaagagagaatagagtaagaaaggtggttagtggcagaaacggtagataagaattctcagtccagtcaatattgaagtcaacttcatagggatggtggtggggactggagcaggggaaccttgtaactcaaaatataaaaatgtaaaaaataaggcaaatatattaaaacatatttgagtaaaaaatgttaatccccaaagtatcaaaaggtg

SEQ ID NO: 193337 - DNA, 357 bp, Homo sapiens
aaatgtaagaatgcacatactgtagtgagggaagaatgaatttaatcaaggcatttttttttctctttaaaagtcatccattcattcgattgcaatggctatcagataagcttcgggccactgaaaggcaaattggacattaatttctttcatttgagtgctttttcctttgcaactaccaataatgaaattaccacagagtccctgtttgggggaaaaaataactcaaacgtttgttgttgttttcttttttcacatctctagaaacagaccaaatagctgagcttacagattgcaatgctcttcctgtaacagtcacctcacagaacctgctgccaaagaggtgagaagactaga

SEQ ID NO: 193338 - DNA, 418 bp, Homo sapiens
tctgtaggccaagattgataaaaacataaaataaaaataaataatacattaaattttttttaccttttccagatcacagatttaaaaagaaaaaattttaaagaaacagaaacctcccatgtgcccctccttatgccatctcctgcaaggaggtttaaacactcctaaattttaagaattttcttgttaaactttgttaactgctatatgcttttgaactacataaattgtgatagtgtatatattttgctgcaacttattttttactcaacatgttttttagattcatctatattgctgcacgtagcacacttaaataacactcaagacaggctacaaatattaatttatctcatcctcatatcaagcctgtgtgattgggcaggtactatatttgcagatgaggaaaatgaatcac

SEQ ID NO: 193339 - DNA, 507 bp, Homo sapiens
ttaagatcacctgtaatcagctcctctaaatgaaacaactattaacaattaagcatatatcctttcagtcttaggactcagcacatattacagacagaggggctgattcagtacataatgttctaagtcctgttcttttcttccaatcatatattcacaagcatctttctagtcaacatttgcacttccacagcatgatttttagtggctgcatggcaccttgcatatgactacaccacgctttgctcaaccaatccccaatgcccagcgttttagcttgtgtccatttctcccctgtgagaaacagtacatggtttattcttgtagttacctctttgtaatcaacctagttatttccttaggacaccttcctggaattggaattactggccaaagggtttatacttttttaaaaagataaaatgcaaaattataatactatcctcccttcctataatgaatgtgtaataattaggtaataaataaaaattagaaaatatagataaa

SEQ ID NO: 193340 - DNA, 639 bp, Homo sapiens
tatcagagaaaaggagagtacaagcagaatgtgccagtggggagcccaactctggagctgactgcttaggtttggattctggttctgctcctcactagctatgtaactagggcaagttacccagattctctgtgtttcagtttccctgtctataaaacagggatggtaagaatagttcccacctcatggggttgttctgaagatcacacaagctaacatacatgaagcatttaaaacaatgcctggcatagaacaggttctatataagttgttgctatcattatggaatgaaccacccaagagcaaataccctgtctttctcatctctgtattcccagcacctctccaagtgtctggcttacagtagatgcttgatcaatgtcatctgggtggattctggagggcagtgctgatattttgaggaatggccaccatgataccatctcactcagtacatctatggtgtgacatctccctctagatcccttccatggggttcttcatgctgaacggatggcaattgttctactcgcttgtttggagtactgacagttaacaagataaaagggacagaaactgtactgccacaacacagcaaagtttagcaatggcctgccatcgcctcctctgttccagcca

SEQ ID NO: 193341 - DNA, 265 bp, Homo sapiens
cctggactgaaagataaaggagaaaagtcacatgatcatatgaatcatcagaagaaggggggaggtagagacagggcagaagaggacatgaactctggcaccctcagtaccctgcttattgatgtgacaggaggaatgtttctgtggacattcaaggttatggatcactctcctgttgccatccagctctccacagctggtgcccttgtgggcctggagtccagcatcctggttcaggcttctgtctgcagtcagtgggcatacc

SEQ ID NO: 193342 - DNA, 353 bp, Homo sapiens
tgcctggctaattttgtattttttgtagagagagggtttcactatgttgccccagctggtctcgaactcctgggctcaagtgatcctcccaccttgacctcccaaagtgttggggttacaggcatgagccactgtgcatggtgctgagactttttttcagtgtctcagagactgttgtatctagaaagagatcttagaggtaatctaatctggtctagagtttttttttttaaggctttatttatatacaatgtacatatcatgtaagttacatgatgtgactgtatatcatatatgattacgtatcccatttaaagtgtaccattcaactttttttttataggattgtacaa

SEQ ID NO: 193343 - DNA, 833 bp, Homo sapiens
gcctctgggttcaagtgattcttttgcctcagcctcctgagtagttggggttacaggagcccgccaccacacccggctaaatttttgtatttttagtagagacggggtttcaccatgttggtcaggctggtcttaaactcctgacctcgagatccacctgcctcagcctcccaaaagtgctgggattacaggagtgagccaccgcacctggccaattttttgtattttagtagagacgaggtttcactgttgcccaggctggtctcaaactcctgtactcaatctgctggcctcggcctcccagagtgctgggattacaggtgtgagccaccatgcctggccttgaattttttaattaaaaaaatttttttttcagaatatcactctgtcatattttatctaatttcaatggtaattaaattaaatacttttttgagcagtaataccgtcacatggcttcaaattcaaggggtacaaaaagatatagtaaaaagcttccctcctatccttgttttcaacgccctcagttccttcccccagcagcacctaatgttaccagatacttaggtatccttccagagacatttcctaacatatatacaagcaaatacacacacacacacacacacacacactgaatgtatattctgcatccttcccccagtttttatacagatgacagcacttagagtgctggagtttaacagctgctcttttgtatactcaagaatacagggttcttcacttaacagtattccttggatttttttttccctattagaatagaacttcttcattcttttttgtacggctgagtagagtattgtattgta

SEQ ID NO: 193344 - DNA, 360 bp, Homo sapiens
ggggacttttcctcaaatctcagtcaaaacctaatgaagctcctggagataaaacttatgaaagtgtggaggcccccataagactggacctcctagtagtttttaatttgcaagttagtatacactgagtctccagcaattcattaattacagtttaaagctttgctgctgatactggctcttgctgcacggttctgctcctgggcttctactcaaagccatgattctctgtatttgcctgtctttctagttttgggggcaacctaatgcatcatgatggattgagttgttaacgtgtagtttgttcagcatttttcttgtgagatgggagtaacagtttccaagctctttacatggtag

SEQ ID NO: 193345 - DNA, 347 bp, Homo sapiens
ggaagtgatgtggattattttggggggcgggagtagggggcacttgaattagccagctgatgagccctcttatcgtccccttccaaataggattgaacaggagtggctcccaagtcctgccccacagcaggaggccgggagtgtgcaggccgcctcatccacaggccagagcctgagctgttggactcagcagttccagctgccagagcactttcatacagaggcctgagctttcaaaactcggcccattggcaagaatccatgttttatggttaataaaactgaggattggtgaacagttaaatcagtcattgaaatctcaggggtggggtccagagttgcttata

SEQ ID NO: 193346 - DNA, 253 bp, Homo sapiens
atccgcccgcctcagcctcccaaagtgctgggattacaggcatgcgccaccgtgcccggccaaagtaccttctattgagtattttctgtgtgccaggtgttcttggattttggggatacaaagtgatcagaagaaataaaaatcctagaccttaatgtagcttacattcttgtgtagggtatagcaatatatgataaataagtaaaatatgtagtatgttagatgctgataagggctgaagagataaatatag

SEQ ID NO: 193347 - DNA, 152 bp, Homo sapiens
cagacagattgcttgagaccaggagtttgagactgtaactgcccattgggttccccttctccaccgcttggacagagctgatttatcaagacagaggaattgcaaaagagaaagagtaattcacacagagctggctgtgcagaacactggag

SEQ ID NO: 193348 - DNA, 169 bp, Homo sapiens
gaattctactctaggggtttcctaagttttatttgaccccttcaaagtagaggcttatatttttctcatgctatatagactatgaagtaggagagaggcaaaacagaagcatagtatacagttggaagggtccctaaacacccatttgagaaaaggttgttctcttgct

SEQ ID NO: 193349 - DNA, 258 bp, Homo sapiens
ccatcagctctcgtgagaactcactcactatcatgagaacagcaagggagaaatctgccccatgctccagtcatctccctccaggcccgtccttcatcacgtggggattataattcaagatgagatttgggtggggacacagagccaaatcatatcagaaaacaatcagataagtatttgtctcaggtgagcggagggatgactttctgtcccatgcctgtgaagataagctatcagtttacattggtaaaattcaac

SEQ ID NO: 193350 - DNA, 271 bp, Homo sapiens
catttaagggcctttttaactttctaatccatccctaatgttttctcccaacttctcaagccaaaaccctgcataaggtcaaaatgacccataaccatcctctgaatctgttgcattattttatttacttccttttttcatatttttcttttattttttagacacaagttcttactctgtcgcccaggatggagtacagcggtgtggtcacagctcacggtggcctccaactcctagaatcatgctatcctcccccgtcggccttccaagt

SEQ ID NO: 193351 - DNA, 313 bp, Homo sapiens
gagattgctgaatcataaggtacgcccacaccgaacactagtgaattgctcttcaaaatgatgtaccacagtctacactctcattgtcggtgtagagaagctgcctgtaacctagtcaggcattatattacctagctttataactttataatttttgccaatcttatggtcataaaatcatcttataagcttctctctgcttggtgaccactctgctgttgatccaccaacctccagctggtactgagcatctgccatttttctgctttgaagaggcagcataagcaagaggactccatatagttccacctcc

SEQ ID NO: 193352 - DNA, 819 bp, Homo sapiens
gctgaaggatgggagagggagggtgcgcccaggaggaggcacagcttgagcagaggcgtggctgcatgaccgcggagggagggttcacacccggggcctgtggtacggctggcaggcgtgggagagccaaggtggggacacagagaggtcaaggaggccgaggccgaaaagggaccacagaatttggctacaagaaagcagtttcagtttaacgatgacaagggagcccgagtgaagaggaaaacctgtcaactcctcgtgaaagtcgggagggtttctgcgtagaaaaaaacagcgttcagcagctcagttggctgccgtgaagtcatcagaactagaggaagagttggacttgctctagtgaggacagcttttgaagtcactaaccacaaggaggaagccttcccctctgggcctgcaggaaacagattgcgtggctttgtctgtcctggctggggaacgcatgacacgctgaagggttttccagctctagggaagaaaattcatctttctgtaaagtccacttcgtcttccattatctaccagacttcttgatgggaccatttttagagccttcagtgaaagaatggaaaacactaacttggataaacaattaagagtagggagggaaataggtgaagacgcaactctgatgaaataaacaaaccgcaaccgtggaataacattctggttattatgggtcgtgattaacggctccctgcgttgatggctgaaaacttgtgctttactgcacacttccagcagaatttagctgcttttttctttcttgtttcctttttttttttttttttttttttt

SEQ ID NO: 193353 - DNA, 579 bp, Homo sapiens
  misc_feature (24)..(24): n is a, c, g, or t
aaagccagccgttaccgactgcanctgtgcctcagtgaacgatcagttaaagggagataataaaatgtgcctctgaggactgtcggaggatacagtgagagaacacgtgacgtgtgcagcacagtgctggtgagactcgtgggaatcgtactggctgtgcatgatgagtgtatgaaggaggggcctctttctgccctactcagagaaaaatctcttagatgccacatttaaaaagcaaagaataaaatctgtgtgtattaatgtggagggtgtcctgggaggagcatggcctgtgccctctggcatcgtcagattagtaggggagacaaaacagattcactcattcattcacccactcagtgttaccgagtccctgctatgtgccagtcgggaataggacagatgaagtccctgccctcatagaggtaagcatccagtgggggaaatcagacaacagaagaggagacagatagaaagaagggaatttcagcaacttgatgaatgcgctaaggaaatacttagcgtgaagtcaggacaagaggcacaggttgctggttcagaagagtgggcagtcaggac

SEQ ID NO: 193354 - DNA, 114 bp, Homo sapiens
accattactttatattatattacaaaactattgtgcctcaaacagttagcaggatggtatagttaccaagtgccattttggaggttattgtgtaggatcaatctatataatttg

SEQ ID NO: 193355 - DNA, 295 bp, Homo sapiens
ccactgagacatgatgtttctctgcctgcttagtttagttctagggtattccaggagcttcttaggctccatatagaggcacgatggctgtggcagctcccaccgaacaagatcccaggttcaagtcccttaaggaaatgtgaattatctgctggttgcacctgataaggctctaaggtttacagtgcttgaatccactgatcttgtttccaaccattgaatctaaggctctgactgaggggaagttagtgtgctgattggcttggcccagggtttgtaatctttctaatgggga

SEQ ID NO: 193356 - DNA, 296 bp, Homo sapiens
tcactcttgaaattgcaggtaccaaggatgatgtaaacctgaagctgctggtggccatctctgccacatgtggaaagagcctgcttgacaatgaatggagctctcacagaggatgcagtattaagaaatggaaaaataaatactcctgaccctgtaaattaaagcacggatcaaaccatgcctaaagtcacctcaacctctgaacgtgaaagccatcaacagggaagaattctacagagtagatctcagttacgaagagaaacacaacatccaccttcataaaatgtaaacactat

SEQ ID NO: 193357 - DNA, 411 bp, Homo sapiens
ctttttttcttttttttgagatgagtatcactcttgttgcccaggctagagtgcaatggtagtctcggctcactgcaacctccgcctcccgggttcaagaatcctcctgcctcagtttcccaggtagctgagattacagacatgcaccaccaagcccggctaatgctgcattttttttagtagagatgggtttcaccatgttggtcagggtggtcttgaacacctgacctcaggtgatccacccacctcagcctcccaaagtgctgggattacaggcatgagccaccacgcccggctacttctccataacttaataatggtgggaggtacaactcagtcatatctgatctctatgggggaaaatgtactctgattgacaaggtggttttacaaatctaacaattttcaaac

SEQ ID NO: 193358 - DNA, 518 bp, Homo sapiens
tgcctcccattctattcagttaaccctttgcttactgagatgaatgtatatctgattgcctcatttggagaggctaatcaggaactcacaacaatgcaaccatttgtctcttaactaccaatgacctggaagccccttccccttgtctcaccttcactttcacctggagttgtcccgcctttccagactgaaacaatgtacatcttacacatattgattgatgtctcatgtctctctaaaatgtatcaaaccaagctgtgtccccaccaccttaggcccatgttgtcaggacctcccgaggctgtgtcacaggcgtgagtccttaaccttggcaaaataaactttctgaattaactgagacctcatatttttggggtgcaaatagtcttaggccttgagagccctctcgtagtttccatatttttgccctcttggatgctggcaccaagcaaaccttggctatcctgcttaaagggacatttggagaggggttctggagggcgaggggcgacatggag

SEQ ID NO: 193359 - DNA, 580 bp, Homo sapiens
tgtaaattgacctttgttttaaaccaaataatccactcattccttcattcttattgacttcattcgaaggatattgtaaaaaaggtttgatcccttgattaaccagtactgatgatgaaagtttctggttttctaaatgcatgccatattcatcatttaaagaggatgatttttctgattcataggactcaggagcaacaacaaagcaagaaccagctctaaacacattctggcttttagttttgctctgatgtcgttttaatgttgtatgtacatcaaaaagtaaagaattaagttcatgttctctaagctttccagaaaaactagttagaaatggaatgtcagcatccctggaataaggtaggtctctttcaagaatgtaactcaaaaacagatcaaggaatttaatatattcatcatcatcacgttcaaattcccaaacacctattacaggaagtgtattttgtgataacttttcatgatcttctttctttgtaggattttctttctgattacacattttccttttatcagttggcttatgaattgatgttaattccatgtgatttggggcatttct

SEQ ID NO: 193360 - DNA, 133 bp, Homo sapiens
ttaaatgtgggaagaccaaaagaagttagttattacaagatatcatggaatgttgcaaaaatcatggagttttgaggagccttaaatatttttgggtacaactatcaatctgatgtttgaatacccttaataa

SEQ ID NO: 193361 - DNA, 182 bp, Homo sapiens
taatgattctcccaatgtctggactctctgttccattctacctgcctgatagagcagaatattcaccttgagaaggattctgctggctgaaccggggaacccagccctcgcttggtctcaacagcaccttccaaacaccaagggttgtatgcatttgagctctcgtgtacggccacgtttaa

SEQ ID NO: 193362 - DNA, 358 bp, Homo sapiens
agcttggagttcagtcccttcaaatccaggacctggtttgtgatacactgggaaagagtgcccactgtagtgtctttgatgtcttgtaacaagtgtttaactccaatttccttagcttcctctgctgcagtttcactggtcacatgctcaaatgttttcaaggctgaagttccatcttcatagacttctactgaaatatatgcttctgtaggcagccctaagtcctttggcttcatgtcactagtgaccaatactgagttacggcagtatcttttcatgatttcattgaaggcagtgtcattcttgtgtagtttagggcctatgtggtaccactcaactattctttccctggcattca

SEQ ID NO: 193363 - DNA, 470 bp, Homo sapiens
attacttcttagtctgaactcacagttttattttgcccagaacctttgctctttgcaaattaagcctgtttgttcatgcctgaccgagtaggtggtctggcagtaggtgggaaacttcaccttcttctttgagatcatttgtaggatgggatactatacatcacgatttcagtcttatttccagactaatgacttttgttgtgccctaccttggtagctgcctaacctttgtacttggacccttgatttctcactctaggcccctccctgtcttactctctggggccggctgtgttcctggaaggttggaccttccatggtttaggtttgaattataacagctgttgggcttcccgtcaaggttctggtttactacttataattccagaagccagaacctgtccgtcctctttggggacatacctgcctggtttctctggcccagcctgttagtaccagacaagtcctcc

SEQ ID NO: 193364 - DNA, 389 bp, Homo sapiens
tatttcatcgtgatttcttctcggactcatggactattcagaaaggtatttcttaacacctacacctatgggattctctattatcttatttctagattaattctgctgtgaccatacactttgtatgattttaatcctttgaaatttgttgacactttctttagggccaagcatatatacaattttgaaattgtgacgtacatttcaaaggtatgtggtatatatgtcaattaggctagggaggtaattgtattgttcaaaccttctatacattcttacagacctttttttctgactgcctgttccatcagttactaacagaagtaagttaaagtctcctgctgtgactcataaatttgtaaccagaacaagaggaactgtgaaatatc

SEQ ID NO: 193365 - DNA, 390 bp, Homo sapiens
tgtgtgcattgtgcctcaagcaccaagtatctgccgattcagaagaaatggaacatcttagagttttatcatgcatatcctctgaatgactggggcaaatactcataactaacgaagacctcactgtagggcctttgtgagtcatccagaaaatagtaaatccatctggaccagagttgcaccttatactcatgaagactgttcagctgcagttatgtagaagaaaaggcagggttatttgaaggtgactgtgtagatgtaacaattaagagactaacatgatttcatgtttatgtatatctttaggcaaacctaaaatacagaattatataacgaaaatgtaaaaattaggatgattactaaaatttaggctctaaaatgaaattatat

SEQ ID NO: 193366 - DNA, 643 bp, Homo sapiens
gcaggaagcatgagaaaaagataaatatttagtttaactctgataggcatcatctccaattcagttgttcttaactgaatagctctatatgctcttcattctaagagctttattaacattctttaggagaatgaataggtaaccacatacacatacatatctaaatgtgaagaggaaggtaaaggtaactctactgatatccagaatcataaaacccattattgaggtggattttcaatagctacaattacagttatgtatattaaataactgtcaatagaacaaagcaggaacaggtgcacaaatccatgtagaaacacagcatttatgaccagactattcctaaatcactcagaagtaaacatcttttctggccatctccttaatagtttccactatgtctcctaacaaagtaaattggactttagttatttaacgttaacaacagcatacaattaatgagtatagccagatcataattacaggaaagaattataaggtaaaaaattttttttacatatttcccaggaccttctctagctttcatgtcactgtgcaaaaatcaaattacttttacttctttgtttaatgaatgaaaaaagtatatttttagatgatcattatgcatgtctcccccagtaca

SEQ ID NO: 193367 - DNA, 285 bp, Homo sapiens
ttccaaggggctgggagggtggtgggtactggggagttatagtttactgggtacagagtttcagttcgggaagatgacaacgttctggaggtggatggtggtgatgggggcacagcagtgtgaatgtacttagaaccactaaaccatatacttataaatgatttaagtgacaactgttatgtatattttaccaaaataaaaacagtgtcatacaagtgtattgaattaatggaaagttgttcatgatatatcattttacatgagaaagggtgccatactcacggt

SEQ ID NO: 193368 - DNA, 448 bp, Homo sapiens
acataaactttagaaaaagttgtactacagcatgtacagtcactatgtagctcagcaatgaacagtatttatggtcctaacaatgtaaattctgaatgttaattctacaaaaattccaaattgggaatgaggggaaaagtatgtgtcttaaatatggtgacggtgacttgagtctactgctgtgataaaatgccatagaactgtaaaccaaaagcaaacaaacagacaaatagacaaaaagggcgcatgcaaatactggtgaaatccaaataatgcctgtacctgactaatagtattttatcatactcagttttctggttttgactgtatgctatggttatgtaacatattatcactaggagaagctgggtgaagaatacatgagaactctaatgttttcaactcttgtgagtcttaaactattttgaaataaaaagttatttttaaa

SEQ ID NO: 193369 - DNA, 517 bp, Homo sapiens
tatgtgttctattaacattgtcctgttaacttttaaaagcttccttgcttttggcacaaaagatgttctgggattcacctcatacttttcccaccccatacctggaatcattcatttcttcaggggctcttgttcctttaagtattagtgtagaatgaataagaggctataatctgggcgttaggggtgcttcctattactttgattctaaatttcttttgaaagacattattggctaggcacagtggctcacgccagtaatcctaacattttgggaggctaaggtgggagaatcacttgagcctgggagcttgagactagcctgggcaacataacgagaccccatctctacaaaaaataaaaaaaaatagccaggtgtggtggcgtgcacctgtggtcccagctacttaggaggctgaggtgagaggatcacttgagcccaggaggtagaggctgcagtgagctgtgttaatgccactgcactctagcctgggtaacaacaggaccctgtctcaaa

SEQ ID NO: 193370 - DNA, 650 bp, Homo sapiens
ctgctgaatgactgcaaagctgggctcttcactcccagatgacagtgtttctcctcactcacattcacccacccacacagagcagaaagcaggaaggtttccatgcccgcactgacggtaagttgtgggaggcagtcgggcaacatttctggagttcctatgaatgatgtgctatgctttttggcctgcagacgttcaggtggactcagatctgagacatattcaaaagtatgtttgcatcctggcccttggtttatgtatttcctcttccctagggcattctacaaagcatttccaaaaaggctggtccctgccccttaactggttcctcctcctggcaacagcattccagctgggctttgggaaatctccctactccttcaaaacaattgtttctcccctggcttcttttcaggtttcctatgagtctatgaggtcactccacccaatgtcttccaaggaactgattatgctcaggttagctggtgacctcagaactctgaccagtataatgaactgtgacagaaaggaatgcatcctgttgaccaatccccctgcagtatagcacagacaacaggggtactacaaagctccattgcctaggagaaacagccagcacctgtactggctgagacatagaaacttcaaaa

SEQ ID NO: 193371 - DNA, 246 bp, Homo sapiens
cagagtttcaaaactagctcccaaagtccagaatcatgactcagagattttactctgcagtgtagcacagctgggtttatccaaaccaataaataatgctacattagaatcctgagccagggactgtgatggtgttagacaatccatgatgtccacaagttaataaagaccccactttaagaacaaaatatggctgggagcggtggctcatgcctgtaatcccagcactttgggagctgaggcagg

SEQ ID NO: 193372 - DNA, 349 bp, Homo sapiens
ttgggaagtaaggcgataccactggaaacttacaagctgaatcagcagactgttttcttttgcatttcttctgataatttattgagatttcccaggaattgttgcctatataaggaagtcactgattccctcattcagaatgtgccaagagtatctagcagtaagacaaacagtgagatacatttaactatcaatgagggctttacattcatttgggcaagatttaactttgtttaaatgggttaaccaagcagtaatatttgcatccatctggccagtatgctctagttaaaggagattactttgcactaaaccaatggttctcacctgaggtcatctgagcccctca

SEQ ID NO: 193373 - DNA, 402 bp, Homo sapiens
aaacatagactcaccatgcccacatgcccaccacccttgtgcacctgcctctcctgagcagcgttggttctgctgaagagttcctgccatgaaaatgtatgaacatatgtcctcagcgccacggtcaaaagggaattcaatcaagaatctggtgatgcatttgcaaattaaaattctgtaccataatgagcagagccattcaaactaataattacataaactcccgttacgggtggcccggtaattacaacaggtacttttagcaaatttaaaaagcaacttaggtttccattatcaccatgaagaataccaagggcagctgtatccttgcactgttaggtggagacacccccttaagaatgttcctggacatagtaaaaagggtgcagaaatccctaaccc

SEQ ID NO: 193374 - DNA, 633 bp, Homo sapiens
tctagcccaggctctcttctaggcttaagggatcctcccgcctccgcctcctgagtggctgggactgaaggtacacaccgctgtctctggctaatttttaaatttttgtagagatgagtccttgttctgttgtgcaggccgatctcaaacttctgggctcaagcgaacctcccactttgacctctcaaagtgctgggattagaggcacgagctactgcacccagctgttctgtcagtttttgctttacgtgttttgaagctcagttactatatgtattcacatttaggagtgttatatcttgatgagttgaccttttgtctccttgtgaaatatacatttttatctcagtaatagttcctatcttgaagtgtactttgtctaatgttaatgtagccattccagctttcttatgattggtatttgtgtggtatacatttgtccctcttgtccttgggagattggtccagtacttcccaaggaccccaaaatttgtggatgcagaggctgaagtcttttatataaagagagcagtatttgcatataacttatagcacatcctgctgtatactttaaatcacctctagattacttagaatgcctaatacagtgcttacacataacctcatttgcgt

SEQ ID NO: 193375 - DNA, 627 bp, Homo sapiens
ccccaaaaaaaacagcctctcaaagaaataggattcctcaatactaaaaggagatattttcattttcccaaagtaagtaccacaaaatactagttcatagctacttttcttcttttaaaaatattcattcttttaaaaaaaaggagaacatggcacatcccatcgtaaccaagtcatcaaagttaacactagtctccagacagacaaacaccacgtcccacccaacaaaatgcaaggaaaacatggatattcctgctcaaaatgcttaacctcaatataagcatgaggaagcactggacaaacctgagttaagagacagtctataaaaatgcctctagtcttcaaaaaggtcaagggcatgaatgaaactcaaaacactgaaaaactgttctaaaataaagtatattaggccgggatggatggctcacacctgtaatcccagcactttgggaggccgaggtgggtggatcacctgaggtcaggagttcgacaccagcctggccaacatggcaaaaccccatctctactaaaaatacaaaaattggctgggtgtggtggcaggtgcctgtaatcccagctacttgggagactgaggcaggagaatcgcttgaaccaggaggaagaagt

SEQ ID NO: 193376 - DNA, 507 bp, Homo sapiens
  misc_feature (52)..(52): n is a, c, g, or t
  misc_feature (66)..(66): n is a, c, g, or t
  misc_feature (68)..(68): n is a, c, g, or t
  misc_feature (78)..(78): n is a, c, g, or t
  misc_feature (87)..(87): n is a, c, g, or t
  misc_feature (108)..(108): n is a, c, g, or t
  misc_feature (122)..(122): n is a, c, g, or t
  misc_feature (124)..(124): n is a, c, g, or t
  misc_feature (155)..(155): n is a, c, g, or t
ctcttcaagactctggtgcgcagtatcttctacaggggagagactaccctancttgcataagatananacaaccagtnagtaaatanacatttcccccagataattantacttggtgacggngnatgaccgtgagacagtctactttacactggncggcctggtaaaacttctgtgaggagtcaagtgatgcaggattacttgatgactgatggagaagtccggggagtggacacaggtgggaacagcctggtgggtcagaacataagtaccacaaaatactagttcatagctacttttcttcttttaaaaatattcattcttttaaaaaaaaggagaacatggcacatcccatcgtaaccaagtcatcaaagttaacactagtctccagacagacaaacaccacgtcccacccaacaaaatgcaaggaaaacatggatattcctgctcaaaatgaaaatatctccttttagtattgaggaatcctatttctttgagaggctgtttt

SEQ ID NO: 193377 - DNA, 508 bp, Homo sapiens
ctagttcagacactgtatcccacaagcaagtattcaaacaactggtaactattttttctgccttcacccccttcaccctaacctgccttccactgacagatcaggccagatctacttctctaagaaacccaatgcttgctggatgtcatctagatttcttcctttctttccttttctttctttctttctttctttctttctttctttctttctttctttctttctttctttctctttctttctttgttccttctttctttctttcttctttttctttctttccttctttcttctttctttctctctttctttcctctttctttcttctttctttcctctttctctctttattttttttgatagagttttgctcttgttgcccaggctgaagtgcaatggtgctatcttggctgcccacaacctcctcctccagcgttcaagcgattctcctgtcgccgcctcctgagtaggtgggattacaggcatgtgccaccatgcccggctaatt

SEQ ID NO: 193378 - DNA, 221 bp, Homo sapiens
aaatgtcctcatttaggcaaatccagagatataaagtgggctgccgggttaggtgaggcaggaattgagactggctaatgggtgtggggtttcttcttgaggtgatgaaaatgttcagaattagtgatgtagttgtacaatcttgtgactactaaaagccatggaattatacagtttaaaagggtgaatttaggcagggcacgacaaggagactccatctc

SEQ ID NO: 193379 - DNA, 433 bp, Homo sapiens
gacatctgcctctcctccctacctcagtgagcgttaactgatctctttccttaatagtttctcagttatctccgtttatcacttttatcacaaagtttgtgctatatcaaaatagtttttcctccccataactcttcagccaactagatttttgtttgttttttgagacggaattttgctctgttgcccaggctccagtgcaatggcgtgatctcggctcaccacaacctctgcctcccaggttcaagcgattctcctgcctcagcctcccgagtagctgggattaggcacgagccaccatgcctggctaattttttatttttagtagagatgaggtttcttccacattggtcaggctggtctcgaactcccgacctcaggtgatccgcctgcctcggcctcccaaagtgctggtattacaggcgtgagccac

SEQ ID NO: 193380 - DNA, 302 bp, Homo sapiens
caacatcattaataccaccacaccaccagtactgccatgcacactcttcccaattgcaattatacccacttaaactggaatatgtggtgcttctcagtattgattatggctccataatactgagtgaaagtaaattagaacccaatgcttggcttagaagaggtatcaaagcctaagcaggtaaggattctaggactcaaattctgctgaaattctccccttcttttcattcattgtgtgtatatttctctttgagtcttcggacatatttattatggctgttttaaagaccttgtctggaa

SEQ ID NO: 193381 - DNA, 422 bp, Homo sapiens
ctggaattagccaatatgacttcctcacttttgggcactgtctagatacgcactgtctgactagcacaaccagtgctagaggctgttgggttaagaaagggaaaggttggctcacacctgtaatctcatttctttgggaggctgaggcaggaggatcatgggaacccaggagtttgagaccagcctaggcaacatagtatgacctcatctctacaaaaaaatgtaaacattagccaggcagtgatgcatatctgtagtccctggtacttgggagtttgaggtgggaggattgcttgagcctgggaggtcaaggctgcagtgagctatgatcgcaccactgcactccaaccaggatgacagagggagactctgtctcaaaaaacaaaggaggggtggggaagtgtcaatttaggggaaatgta

SEQ ID NO: 193382 - DNA, 461 bp, Homo sapiens
agccccacctttattggctcctaggagcaccgagttgacagaataatggtgacttttaaagcgactgtccgcgaccacccaacgtgcggctaacctgagcaggaccacttgtgcgcttctcgtttctttggcttttctatctttccctcctcggcgcactcccgcggcgcgggaagctgcaggaaaacaaagttccacttccacgtgcgtagtgacttggtaaggataaaggtacagggagccaggattgttcctggaatatcaacagatccaaagaatgttaggactggggcgctgaaggatgcgctgtcgtttttcatgttcatttccgttccccctccgcctttgacccttgtccacgcagtccctgcgcgcacccccgccgagccgcgcacctcccccgcggcgttctggccggcacgcccttccgaaggagccctggtccccgtagagagaaaaaa

SEQ ID NO: 193383 - DNA, 542 bp, Homo sapiens
gtaattcagaaataacttgtatagtagtatatcataggaagttagcttgaggccagagtcagaaaagattctattgcagtgtttggtcttaatgtaggacttgaaaaatatataaaatttggatcctcaatatatacttagtattagctgtaaagaaatctgtaatggtggttcagatttcaagaagctgtagcccacttgcagtgcacacaaggcaagtcacacctcctagttcactagtgttgaagtattatagcagtgtaaagaaggcttctgcccttggaaagacaagacagacttaacatggattacaaccaaacagcgcagagatagtttcagctaggagcctagagtaaggatgctaagaacaggggaagagttttaggcaaagtgaaaatttgcctggattatgacagatgggcaaaattttggaagactggaggggcttggatatgatcagtggaattgagccttggtatgaagctggaactgcagaaactgacatgagggttgctcatgactgaggtgataacaagctttag

SEQ ID NO: 193384 - DNA, 1835 bp, Homo sapiens
  misc_feature (1498)..(1498): n is a, c, g, or t
tgagacggagtctcgctctgtcgcccaggctggagtgcagtggcgtgatcttggctcactgcaacctccgcctctcgggttcaagcgattctcctgcctcagcttcctgagtagctgggattacaggtgcgcaccaccatgcccggctaacttttgtatttttagtagagatggggtttcaccatgttggtcaggctggtctcgaactcctgacctagtgatctgccctcctcagcctcccaacgtactgggattacaggcgtgagccaccgcgcccggcctgaggctggtattaagaagtgaagtgggacccaggtggaggtaaggaagagtctggtggggagttatctcagaagtgaggccagcacaggctgagtgcagccccagggtgagaaggtgcccaccgagaggactctgcagtgaggccctaggccacgtccgaggggtgcctccgatgggggaagcccctccctgggggtcaccggagccatgctgtcccgcaagggcatcatccccgaggaatacgtgctgacacgcctggcagaggaccctgccgagcccaggtaccgtgcccgccagcggagggcccgctttgtgtccaagaaaggcaactgcaacgtggcccacaagaacatccgggagcagggccgcttcctgcaggacgtgttcaccacgctggtggacctcaagtggccacacacattgctcatcttcaccatgtccttcctgtgcagctggctgctcttcgccatggcctggtggctcatcgccttcgcccacggtgacctggcccccagcgagggcactgctgagccctgtgtcaccagcatccactccttctcgtctgccttccttttctccattgaggtccaagtgactattggctttggggggcgcatggtgactgaggagtgcccactggccatcctgatcctcatcgtgcagaacatcgtggggctcatgatcaacgccatcatgcttggctgcatcttcatgaagactgcccaagcccaccgcagggctgagaccctcatcttcagcaagcatgcggtgatcgccctgcgccacggccgcctctgcttcatgctacgtgtgggtgacctccgcaagagcatgatcatcagcgccaccatccacatgcaggtggtacgcaagaccaccagccccgagggcgaggtggtgcccctccaccaggtggacatccccatggagaacggcgtgggtggcaacagcatcttcctggtggccccgctgatcatctaccatgtcattgatgccaacagcccactctacgacctggcacccagcgacctgcaccaccaccaggacctcgagatcatcgtcatcctggaaggcgtggtggaaaccacgggcatcaccacccaggcccgcacctcctacctggccgatgagatcctgtggggccagcgctttgtgcccattgtagctgaggaggacggacgttactctgtggactactccaagtttggcaacaccntcaaagtgcccacaccactctgcacggcccgccagcttgatgaggaccacagcctactggaagctctgaccctcgcctcagcccgcgggcccctgcgcaagcgcagcgtgcccatggccaaggccaagcccaagttcagcatctctccagattccctgtcctgagccatggtctctcgggccccccacacgcgtgtgtacacacggaccatgtggtatgtagcccggccagggcctggtgtgaggctgggccagcctcagctcagcctccccctgctgctcatccagggtgttacaaggcacttgtcactatgctatttctggcctcagcaggaacc

SEQ ID NO: 193385 - DNA, 334 bp, Homo sapiens
  misc_feature (50)..(50): n is a, c, g, or t
aatcgagctcggaccagtcgtttctacattaggtttttaactgtttaagngcattcttttatactgagacccagaagaagcatcctccccagcttcagtggaaagccttagagctgatggaaaaccagtttcgagttggaatgtggaggctatttctggcctttgtgacatcctgttcaactttcagaggagcctgggaagaaaggggtgactcagactactaagcttatttttagggaaacaacgctaagaattcagtcagagccactcggattccctattgcctgccatacagaatgtgctgttggtggagagattgatgggcagaaatcct

SEQ ID NO: 193386 - DNA, 466 bp, Homo sapiens
ctggagccaagaagccactgactcaagaggatttcaagcgagagctgcttgcgggtaaacaaatggcggtacatcatctgtacaacggaatatgcgaccagaaccaggagcgaggttctgattcacgctagagcgtggatgaatgtcaaaagcaggcggagtgaaaccagccagacacaaagcgggctcgtattgttacattctatttataggaactacccagaataggtaaatctatagcggcagaaagaagattggtgattgccaggggctgggggagagggtagtgaggagtgactgctttgtgggtacggggttcccttttggggtgatgaaatgttttggaactaggtagaggtgtgcaacactgtgaacctattaaatgcctctgcattgtatataattgtaaaaatggtgagtttgatgttatctgaacttcacctcaattaaaaaggaaaaaaagtat

SEQ ID NO: 193387 - DNA, 342 bp, Homo sapiens
agcatggtggaagacagtgagtgctacggaaaagagaagtgggatcagggtgccaaggggagggggactcgtcagggtggtcaggggaaggggcgtttgttagcttcgagtgtcagagttgaaaataggctcagagggtgagggtgacactgaggaagggatgtagccctaggacctagtttcaaatcctccctccttctggctcctaacttctatttaacttctttgttcattttgaacacctggcctgcaggaacaacacttatcaattagtgagggcagtgatggttcgaagttaacactgggactatggagtccaatctcaatttgaataccactgtg

SEQ ID NO: 193388 - DNA, 462 bp, Homo sapiens
tctagagatcccttcatatggcaaggccaagagtttgagacctgcctgagcaatacagtgagaccccatctccacaaaaaaacaaaagccacaaaaattagccaggcatgatggcacctgcctgtggtcccagctactcaggaggctgaggcaggaggatcattttgattccaggagttcaaggctgcagtgagctatgatcacgccactgcactccagccaggccaacaagagtgaaactccatctctaaaaaatgaaaaaaaaaaaaagaaatagtatatatcagtatatcagcggccggccacagaagacctagaccagtgatccttacggtggacttccctatacttggaagggaactgtgaaatagtcccatcttaagtgtatcccaaagtttcccatttaaacttatttatagctacattttcggtggtaactgggcctggcaatattgaagggta

SEQ ID NO: 193389 - DNA, 237 bp, Homo sapiens
gttgaatgctaagaaatccaaagaaacaggagatgtcttgttccacgagacttgtacaacaggcccctacttaactgtgataattgatggatgagtgctaacacagttctaatggagtcagaggcaagataggccagttttttgactgaggtgtttggtggaggcatcatgggggtgactacagttgaagagatcttaaagacttttccggttttgcctagactgggtagtcacaga

SEQ ID NO: 193390 - DNA, 294 bp, Homo sapiens
atgaaggattacctggacaagaaacttagacataacttaaaatgtttttatttgcaagcctgatttaaaatagtcattgaattgacattataatttaaaagaaaacaatgggatcagttaattggttatttttttccagaaatgttacaaagtttaactcatcgtttacctgaaacatggtaattaaatgattaaaattggacaattgggatcataacaagttgcgtgatttttaaaaccatatgccttggttagttttaagttattttgtagcaaatagtttttaaaatctgt

SEQ ID NO: 193391 - DNA, 623 bp, Homo sapiens
cgtgaaaccctcccggcctttcatgggaagttctcaggtcacacctcaaggcggggagcaggagctaagcctgtcctcagcatgcagcggggcagtgctggccgcccgcagcatcctccctccgccctcggaccccagtcctcctctgtaattcttctgggctctccaactcgggactttatctgtcggttcaaatataacattcccatcttggaaacccatcgtggccctggcatcttgcagccactgggcaccaggcagagaggggccacttgtacgtacgtttcccacctgcccgggagcctccttagtgctgggtagcttcagaaaaagtgtttccttcctagtcgaggttaaaaagttgctctcggccctaaagggtggactggaggtatgaatgagggagaggataagtggtgaaaaggtacatacatcagcaaagtaaatggtaaaactacttttgatcgctggagacaatgaacaccaatgacttaattaaggactttaaaagcacatgaaattaaatgattagagtgaggtcatgatataaaataggagtctggagtttattccaagaaaaatgttggaaaccccttgactagaaacatggtctttctgaaaga

SEQ ID NO: 193392 - DNA, 490 bp, Homo sapiens
tgggtagattgactgaggtgaggagtttgaaaccagcctggccaacatggtgaaaccccgtctctactaaaaatgcaaaaactatccaggcgtggtggtgcgtgcctgtaatcccagtattcggcaggctgaggcaggagaattgcttggaaccggggggtagaggttgcagtgagccaagagtgcaccactgaactccagccttggcgatagggcaagaccctgtctcaaaaaccaaaaacaaataaaaataaaaataaagaacattatcatcatccaacaagaaactctggacctataagccatcacctcccaatcctcatatcccctcccccctgggccctggtaaccaccaatctccgttctgtttctatggatttttctattttgggcatttcatggaaatggaatctacactatgtggcctcttgtgtctggtttcttcctgagcatcacgttgtcaaggttcaaccacattgtagcatgtgtc

SEQ ID NO: 193393 - DNA, 662 bp, Homo sapiens
tatgcaataataccacggagatttattgaaggttatttcagcactaatgctttctattccaacttaaggagaaaacattctcaactcagaaacactctgcctgaaacatacacaggttgtccaactggatgctgttgatgggttctggcttggggtgactggaaatacatcttaacaaaaagccccatgcagccctcggagatgggtagacagttaacttcaaaggaacaaatagcaaccttgatcttttctagcaactagaattctgtttccctctctagcatgaagtatgtgaaattctaaacttcttgaaaccgatcccatattttgagtaatagagaaaacgctaatctgtgatccaactgaaatctacagtggtgagggaaacaattatgcagaactgagccaaaaaaaacccacttgaaggatttctgcagcgatgaaaacattcaaaggtgtattgatcatggaggaaggctgcattcaagggaaccattatttggcttgtaacagcctagaggagctgaatacttcaggcaggaatgctgctgagagacgaggaaaatgcaaactagttatgtggtggctatttgcttctgagttttaagataatcaatgctggagcagaagagagagggaaaaaaaagttaagctgttttatc

SEQ ID NO: 193394 - DNA, 603 bp, Homo sapiens
tatgagctcgacaactgcacacacgaacacacacacatatcattgaatccttgaagttagggaggtaagatgttattattctcatgtcaaaaagctagcaagtgacagagacaggaaaggaacctgcatctctctcacaaggaaagcacactactagacaagaaatggcgagaaaagaatgtagtctcaatgcatctaaatctcagtggtaccttctgggaatgagaatgcatagaaaccaacagaccaaacaaaataccaaaatctacgctactgccattctttgctgctttgaagcaagtctctttttgccagagttctcttacttcctaggcagtcaaattaagtagctacaagtcagaacatgacagatttactttaaagctatcaacaattctatactttggagtacttctagtcactattatcacagatgcttcctttccaaggatggcagaaatctctgtgatagaaagaatataaataacctgtattttacttcagattgccttggtccttttcaaaataggagaaggcatacaacaagttatattagcgcagctctttccactgcctctataaatgcataaagtagcaattttc

SEQ ID NO: 193395 - DNA, 387 bp, Homo sapiens
atttaaacccatcatggtccacatcttcctaagacataacaatgcctaacattgactgagtatatcagacaccgtgtgaggtggtctacacagtcacttattcaacaaatatttgctaagtgcctcctatgtaccaagcactctgctagatgctggggatgaaagacaggataaagcccgtgtactccgagagcttatgttttactacaggagacagatggtaaacatgtaaacatggcgacctctagggaggtgatatctgagttgatacctgaatgataagaagagagagagccctgatcagatccataggatgagtgatacaggcagaggaaaaacagcaagcctataaggaagagattactatcatcttcattaagagattag

SEQ ID NO: 193396 - DNA, 339 bp, Homo sapiens
ttcatgaggtggagtacggaatgatggctctaagcttctttcaatttctagatctcctgttatctgatctaatgtctgacatctctattacaccaagttgataacatttcgctcatttactggcttataaacagttgcttacagatagccaaggaatttcttcacaagtgtgggtttctattgaaatttatctaaaatcacattgaaaggagtggcagcacatatctgattcgtgtgtagccagttgtgtggcgtgtattatggcatccaccttcttccttgccttctttcctgcagattgtggccagtatttcctcaggctgatccctggatgccgta

SEQ ID NO: 193397 - DNA, 386 bp, Homo sapiens
actgactgatgaggttgactggtgtgggaaggtaacaagggagagaccccctccccatggaggacatgctgttgactcaggtcagcagattctctgggatgaaaaccttcaaaccctaccttcccgcaaatggtaacagtgagggctgacaagctttctcaggagtgagaaaatccttcttccaaatgaaatcttaaactgaaccttaaggctgaaggatccagagtcctggtggcctgacctttcccgtccccatgcagaaggactcccttacaattctagggatctgagaaaaaaaaaaaaaatctgaaaagcccaggccaagtccaattgctggaggctgacgttcaaaggattttagggcaatatggctacgtggtcagcac

SEQ ID NO: 193398 - DNA, 270 bp, Homo sapiens
tgcaggaaagaaactgtctttgatacatagaaattaaaacatttaatgattttcctaaagtgcttttgtattctgtagagctttaaatttagattttttattttttgtactcatttcacagtaacaattaagtagacttgacagctacctagaattcataatctttttctcaaaaacagtggcaaattgtgaaggtttgattaaaattcttaagtcattaaagctaaccttttaaaatctgaatgtaattaattgaatgatttgaagatt

SEQ ID NO: 193399 - DNA, 663 bp, Homo sapiens
gctcttcattcttttaagtacctgaaaaaaatgtcttccaaaaatggttttcctgaagcaaatatgacagtatttcaacgacagcacccacctcaccatctctcagaattaagtgactaagaactgttagggatcaacaatagtacctacctcatatcattttgtaatgattatatgaattaattcatttaaatcactcagagtagtgtgctagaaataagtgttagtttttattattactattattatggaaccattcctcataataaagggtgaaaagcctcttagagtcacatactctgtttatgtagaagtgaggcgtgttcaggtaaaatttagttaattcacgcatcttgcctattaataatttcacaaaggattaacttcctcctaactttcgttggaccaattaacaagcccttaatttcatcagtgataacttattttcaacagatattataactaatgagcacagccacatcataattagagatgatagtagcacaaggcttctagaagccacctctgtctgctgtaattctgactgaggtgttggggcataaattcctgataaaggcactgacactcttggggtacagacagcgttaagaaacacttacatcgcactgtctgtgctgaatttttttagaatacattacagtt

SEQ ID NO: 193400 - DNA, 268 bp, Homo sapiens
tgatgttgcagtttttcgtaaagactggatctctgtgttacccaggctggtctcctgggctcaagcagtcctcctgccttgacctcccaaagtgctgggattacaggcatgagccaccatgtcctgaccccagtttgttttaaagccaagcgatgcaccaagatgtttgtgtgcacatctgacagtggtaatctttgggtcagggaattatagataaattttctttaaattttttctgagctttctaaaatcagctgaaaataaaacc

SEQ ID NO: 193401 - DNA, 481 bp, Homo sapiens
tacgccggctcttacttggaaacaacctccgtgtcatcactgtactctgctgaccctcctagtcagcagagtatttgagataagtgcttctgcacgctaaggagtacaagatttgaaaagccaaatgtttctttatgacttatccttccatgtgtcttttgctgttacaatatttagagacaggaatcttctgcaggtttttgacttgcatgtctgtacataggtgaggatgactcaaaggctcagctcatcttggactgcaggctgcattgcctatgggtggctcagagcacgaattccatggaaaaaggcaaaggcagtatggtggttttctgttctaaccactgaggttatgtagtgtcactttcttcacattccactggactcctgacaagtctgtcattaaggacagttccagattcgagtggaagggaattagatcccagtcatcttcaaaacctccacacagccttccacactc

SEQ ID NO: 193402 - DNA, 450 bp, Homo sapiens
cagtctgaataaactctctggtttaactctcttaaactctctgggtttaacagctcaaagtttggtgttttaaaaggaaatatttatcttttatcagaaatggagccaggtattgaatttaaagagccacacaatctgaaattctttatgtggatatagatggaaagaaagaaatagttcttgtttttactgaacagtaaactaagaataaatagaactaagaatagttctggtttattactgtttttgcagttagattttttcaccaataataattcaatagcagtttctctcataaatatgtgctttttaaaaaaaagtttcctacattttaaacaagattttactcttaaaactaatttctgattttatagtgaaaattttcagatctctccctttaatcaacttttaaagaactcagtttttataaatgaaggctgcttttgtcaa

SEQ ID NO: 193403 - DNA, 129 bp, Homo sapiens
cttatgactttctttttaaataggagaaagcttgctactctgtgcttccaaagattagcctgggaaaagctacatataaaaccaatgtaacttgtacattatactaaattcattcctctgtttgcccag

SEQ ID NO: 193404 - DNA, 174 bp, Homo sapiens
cgcggttatataaactccaacccagtgcatgaagaaaatatttcttatgagttctcattatgaaaacaccactaccatccatactgtaaacagaatataaattacaaggccactcctaagaaagataaatacagaacagtcatctggcattacatcaaattatgatagagcttt

SEQ ID NO: 193405 - DNA, 844 bp, Homo sapiens
atggatacaataggacactcaaattgttggtataagtcatgtaagaggttaatacatgagagatcccaagtgtagtgaaagaagaaatgcttccagaattctagaaaacacttaaagcagttcaataggagttactccgtttattataccatatttatatataaatgttggtctaatcctttagagtttataattcccaaatcaattacaggtagagcatattgtttgaggctaaggcctcagattaactctaaaaagaaattcaattacataaattcatagacttgtttattcaatgactgtatattaactactatgaattgggtactctactgggaactagagctacatcaggagacaaaaggacatgatcttgacctcatggagcttagaaacgagtaaagaagccagatatttggtaaaaatgaatagcatatgtaatgggctaaatagtggtccctaaaatatgttcatatcctaatccccagaaggtgtgactattaccttacatggcaaaagatatgattaagttaaagactcttgagaggaggcacttatcctgacttatctgggttgacctgaaattcaatcacatccattattataagagaggggcagaggaagattacacagacaagcataggagaaggtgacatgaaaacggaggcagcaattggagtgacacagccattagccacaggacacaaaggaatgcctgcaaccaccagcaactggaaggagtaaagaacggactctcccacaaaatctccagagggactgtggccttgccaactcattgattacagaactgcgagagaataaattcttgttttaagccactgag

SEQ ID NO: 193406 - DNA, 508 bp, Homo sapiens
tcaaatttactttgcctataaaggaacaagtccctctggcctttctaagccactaatgtaaggtaaacctctcttgccctaaatagttcacaagtagcttctagttgatgctaataggtttaatctgcttataacaaatcacttataaatgtattatcaacaaacctaagtatatttaaatgtactatcaacaaacctaacactaaattatattttagtgttaataacaaataccatggtctgtaaattaactactgtaattaactggatttagaaaaaaaaatttactgagtttcattcttctaagttccaatagtttcaagtccagtaaaaggaaaaatagtctttatgttaaatggacactaaatttggagatatatatataccatctaaggaagtaaatcataccatatacatacatatatatctgcctataaagtagaaatcaaaaccaaattaacatttgaggaaagtggtgcttctgcaagatgtttgaatactatggtca

SEQ ID NO: 193407 - DNA, 659 bp, Homo sapiens
ctctgaatttggctagaactcacaggtagatttgtttgcttatttctttttaaccacaggtaacatgaccaccttgaaacttgttctgcctcatcccaacaccactccaagccatgaatccccatctttcaatgtttacctcactaccagccaagaatgctaagcagggtgttctggggaacctttcatcttggtctactttaaactgtttctctgatgaacaccagactgaaatggctctggttctgatggggggtgctaaatccccagcctttgtgcagctaccagctggggatctgaggggtctcctaccatgatgcctagacactggcagcctggctagaagagctctcattctctatcactttcttggtgactagggccagtttgtatggcagcccagtgaggctactcgatttgtattcagtgcacaaaccctgaaaaaaaaccctgccagccagcaactctgaaaggatgctttgtgtgagtgagcagtgtctgagatggacagggactctcctccctcccctgaaaacagcctctctggcccagcaacttattggtgctttggatctggcacagagctcctggggatccctccccaagaggagaccatcttgggatcccagataacactgagcaacttacgccctgtcctt

SEQ ID NO: 193408 - DNA, 163 bp, Homo sapiens
tcaacctagtagggcagtgaaggaatgagacctgtgagcgggacataagattccaggagaaaaatctcatggaaacacagactggataatcttgaggatatgctgatggtgcactattgcttgtcaaccagaaaaaaaaaaaaaagacaattagaaactccag

SEQ ID NO: 193409 - DNA, 222 bp, Homo sapiens
tctaatattcaattttgtgaagctgccacaattcatccattctatcgctgattggcatttgggtggttttcagtttggcactagtttttagtttttggctattatgaataatgctactatgaacaactttgcttttttaagactatggttcaaattccttaggttatctactaaatactaaggggaggccagccatggtggttcacacatgtcatctcagca

SEQ ID NO: 193410 - DNA, 238 bp, Homo sapiens
cctctcctccactttctttaagaatcagggggtacagaataacctacaaacaacctcttcaaagtacccttggaaattgaagttcaatcttaagttttttgctgtctttaatttactagaattgcctaatttttagttgatttctctacagagcttagcttgtgtagttatttctcttttactgttgctttggtgtgtcttgaagtttgattgattattttgggtcattgagttctta

SEQ ID NO: 193411 - DNA, 401 bp, Homo sapiens
gagaacaggatcacaggctaatggtgagtacttctttggaccttactagatataatgtgttgagaagctggaaaaacagaatcgagtaaggtttctcacagacaagctgtttgcgcctgcgaactttggtgagggaagggaatgaatgacagattcactattgtgctgcatttccaatctcaagtggctggggagaagcaaagtctaaaaaaaacatttatgtctggactcttacctggtgttttatgtcaaaactttcattcaggaaaatagatttttctcaaggccttgagagcccaccttttgcatcagcatgccctgtatgtgggacatggagtcaaaggatattactttggagctttaagatttaatgactgccctagatttggcaccatgcttgt

SEQ ID NO: 193412 - DNA, 615 bp, Homo sapiens
cagtgagccagggcaggagaggaggaaggtggtgcacaccaagtggtggctcaaaagatgagcaattggcagtgaacaatggtattgccaattgtgcttagtctcagtaagcacggatagctacagcaccaataacttcatgtctgtgtctagtatacacctgggttgttggaatttcattagcctcagtcttgagggattatgttcaaggctaccaagactaagtgtctgatttcaacctgttttcccaaatgtacaaaggactcctgcttttgttacatttatgatcctaatttattattttaaggtctttcaaattggagctgtctcttctgtccccctttattccctatttgcagacaagatcatatttcagttctttggccacagtgaaagagaaactgagagacaccaagaatctgaggcaggttaaaggatttcactcgttctctaatcctgattaattacagtgtcaggtttcacctgtagtgcttcagccttctcaaacagccttaggttccagagcagatagaaatgagggggccactcacatgtatatatatgcaacaaacctgcacgttgtgaacatgtaccctagaacttaaagtttaatta

SEQ ID NO: 193413 - DNA, 205 bp, Homo sapiens
ttttcatattactcccgtatttcctgacatatctgcatttttctacttactgtgtcccgatgcagctgctcctgtttttcacatccaaggtttctcctccatggcactactgacgttttgggctgacgaattctttggggacaggatggggcatgtcctgtgcattttaggatgttgagtagcagccctggcctgcatccactag

SEQ ID NO: 193414 - DNA, 366 bp, Homo sapiens
ctcaagctgacaactagcaagctgaagccttctttaacttgcagggaactcaatcctctatgcttcctctcctcctcccaccgtgacaacaaggcatatttcactaactagatcacgaagaatccaatgatcaaaagattttagttcaagttccagctctgtcccttgaataggagtgcaacctgggccacggtttcttgaaatataaaatggaagtaacaatgctcacagcatcaattaagcctatgatgcgctcatgagggagagcagtgttttatgagcagtacaggcttgcacggatgaagtatgattatgatcattactgcttgcagtcagagtggcagctctgagcctgcttcccctgac

SEQ ID NO: 193415 - DNA, 482 bp, Homo sapiens
tttgctaatttcatatgtggtttctggttttcccttttcttcccctgacctttgggataacttcaagtgacttcagaagatagtgctctgttgcagtttctttcaatgcacatacccacttcagccaccatccatccatcagctatccatccatccatcatctagtcacccaccttcctcctaaaatagtttgtgtaaaattcccacagatgataccagaacaaccttgtttgcccctttattgaggaagggataataagaacacattttatatttcactaattcttggtagctttccttggctctttttctctgctaattatcttttctattctattaatatagagtggtatgctaaagtggttgcacgtggttgatacagctttatatagatcaggctttttaaaagaaatatcaactatcccaaagactcctcaatctggcacccattcaggaacaagattatgaagaagttagcatgc

SEQ ID NO: 193416 - DNA, 518 bp, Homo sapiens
ccttccaagatgccctccactcgagttgtgtttgtgttttctgtctgggtgtcccgcacacatgtggctctgaagggaaggacccattccttgaaatcagttcaccccacagcctctgtgatgccttccctcatcttccaacttctgcatgcccgtagctctctagttacatcctgacactggaattaggtcatctgccttgactaatcccagtgtccaggatgtaactagagagctacgggcatgcagaagttggaagatgagggatggcctcgatagagaaaggcatcagctaaggaagttgttcaggtgggcagtgaggttgtcgtgctttggaaagatgttcaggctgcactaggaagccccctggcttggggagagactccaggagaccccagcggggagcatttgacagtaaattcgagtgatgcgagggggacctgaactgtggcctctgtcatgggaacccagaggaggtcgatggcgtttgtggttgatgtgggaaggagagagagaga

SEQ ID NO: 193417 - DNA, 338 bp, Homo sapiens
gatggtggaggagagggagcagtcagaacagttgtgcccaaggaacagggacagcagagttgctgacactggcatatggaagaagtgaagaccaccaaactgctgtgagatactccctgggcttggtttttttaatacatgtgctgtattgagatgaccgcaggccactgaagtggcgattgaaagacacatataggacacagtggtgtgaccaagccaaatggaaaccagggctaggatggaccacacttagagccatctggcaaatggcctcagtgagggttggtggtcattcacggtactcaggtgtggtcaaggaagatggtggccaagacaat

SEQ ID NO: 193418 - DNA, 747 bp, Homo sapiens
tgcattccagcctgggcaactgagcaagactccatctcaaaaacaaaaaaaagaatacctaaaaacattttttatatcagaatttttattctttctagtggtattcataaaagcatattgcatatgatgctttttaaaatatcatgtgccctcaccccccacccgccatgcacaacttgcagaatggaaatacttcgacatggtattaacaggtttggtgtttttattttggagagagatgaaaaaggcgtctgttagtaccttaataccgcaagtatacgtttagcaatgacagccaataccaatggactagattggatgatattaatgaataactattagttttcttcagtgtgataaggtattatggttctgtaagagaatgttctgatatctgtgagttgcatgccaaagtatttataaatgaaatatcgtatctgtatatcacttttatattgttcagctaaaacaagaaaaacatgtgtgcgtatgtgtgttatacacacttgaaaatgaagcaagtgtcagagtgttaaaaaactgttgaatctagatgaacagtgtatgggtgttgtactatctttttttgtaggtttgaaagttctttaaataaaaacttaggagaaaaaataagctataaacaactattcttccctgcaggtctcattttcttgctaatttggttaatttgttataacatcaaactagttaataatgttaaatatacctttaatattggattgagaa

SEQ ID NO: 193419 - DNA, 418 bp, Homo sapiens
caccaagcagcacctttgctgagtgtcattctttctggctctggtcagttgtgtctagctttatatcttgacattttccctccactctacatgccatggagatgtggtgttcctctgcattgctccatgtagaaagtacagtctttgctaagattcaggctcccaacttttattaatcacctgggggattctacacacagaatcttatttagttcatctaagaatttagatgtggatactaaaaagttcagtccttaatctggagccaggaattttgagtagggtaaatttacttgttccgattgatacctactcattggcccactggaaatccaatcctggaccgtttctgcaatgtcgtggctttcagaatcaagttcagaccccaagtatagtgcgtgaagccctttcgctcttg

SEQ ID NO: 193420 - DNA, 225 bp, Homo sapiens
agcataaaatctgtctgcttcccttcccttctctaaccttttctgatttcaaaacaccctcatatcttttttggaaggataaggtttatgtggttttttttaagtattcagaattgcctgctaaccctagacaaagggagcacatcaatggtgtttctgaaacaggctattatctccccgctggagcctcctactccatcctcccacccctctcctctcggcaca

SEQ ID NO: 193421 - DNA, 546 bp, Homo sapiens
ggcagagaagacataatcagaggtggaagggaaatggtggtgtagggaaactgagggagaaggtccatttccaaaatgtggagtaagggtaggcagaggagattggccaggtcagtggtgctgaaagctgcagaaagggacatgggcgctgactctccatttacaaggtaattggtactctttgtgataagagtttcagtagattaataggaatggaaattccctgtaacatgtgcaggaatctatctggacccatttgcttctccccagtgagacttgggggaacagggactgatgcaaatatgctaatgctcaaaaggtttgctatgctacagttgtaacgtcctttgtttctgaccctggagtctcgtgtcttaccagtattcaagaaactgtgacgggctaacttgtagggtaaaatctcaggtcctttatagttattattaaaactaccatgcttttctagaaacttgccattcctccattaagaagtggagtctgattcccctccttttaaatctgggcaggcttgtgactcatttataa

SEQ ID NO: 193422 - DNA, 764 bp, Homo sapiens
gatgatggtatttggacttatttagtcataatatgagtggttaaaataaatgaatactaagttggtggtggtgtagagtcaactaggaaagtgacctcactgttactagtagtagcaacagaagcagcagtatcaatgatcagcgttcattgcatacttaatatattcctgacacagtgtcaagtgtctcatttaatcctcctgccagccttatctgttaatcccttttagtatcccattttacagatgagggaactgaggcttagaataagtagcttttctaaggtcatacaactaataagtagtggggctgggatttcagtcatggtgatctgagtctattgctcatgtgcttgaccactgtattgcatttcttcattgtggtatagggcttaagagcacaggctggtgaaggtcaagaagtagtaacctcactaaatcttacttttttaatctgtaaaaagtaggtgggaataggccgggcatgatggctcacacctataatcccagcactttgggaggctgaggcgggcggatcatctgaggtcagttcaagaccagcctgacaaacatggtgaaaccccatctctactaaaaatacaaaaattagccgggcatggtggtaggtacctgtaatcccagctattgaggaggccgagacaggagaatcacttgaatctgggaagcagaggttgcagtgagccgagatcgtgccactgcactccagcctgggtgacagggtgacagagcaagactccgtctca

SEQ ID NO: 193423 - DNA, 199 bp, Homo sapiens
gttagattttaatagggtaagtggactgtcgtcctcctcgtcattaacttacaaacagccaccacctccagttgtcactgtagtcaaaaacctgggagtcatgtgagtggaccccacctctcccaggaaccagccaggcctgtgggtgcagacttcctgttctctggcctttgttctgagtctgcattctcccccgctt

SEQ ID NO: 193424 - DNA, 515 bp, Homo sapiens
cttcagagtattctaactgctgcagagagatgaggtctcaatctgggagagaggcacccccaaatatctcagtctgcttggccagaagtggaacatgaacagctgaagataaaggcaggaggggtaaggccactgccacagttctgtgtacgatgatatcaggactcagaactgagcaagcccccacccccttggccacctcccatacaaaactgactcaaactacaggagaaaggtttttttaaaagcgtgggaaacctggagaggaaatggggtatgcgtcaaaacaattgggtggtaaaactgaagccaggggaagactagggcgaactgtcttgttcgccaagataatggaaataatcatccctctcacccttcaccccatttctgcttggctaatccctccctcctcatccttcaggtttcagtttaggcgtcacttcctccaggatgtctcctctgaccctcacagtgaggttaggtctgtcacgcgctctccggcaccctgcatgcct

SEQ ID NO: 193425 - DNA, 185 bp, Homo sapiens
caatgtgccttcagttttgtgccatgatcttgagtgatagagattccaagaagcaaaaatttaattttcagaacggagagatatactcaggttacctcagtctaagcttaagactaatacaagccccatgtccttctctgccacactctggcaacgaggagtgggaaggtgattcagcacacagt

SEQ ID NO: 193426 - DNA, 561 bp, Homo sapiens
tatgatggcaccactgcactctagcctgggcaagaaagtaaaaccctgtctcaaaaaaagaaaaagaaaagaaaagaaaaggggaaacaccagggcttgtttaatcatgaaaacaaggccacgtgcaactggcaaggccggcagagtaacagcggaaaattcccatgacattgatcatcactggatgaccctgaggaaagcagaggcatgaggttggaagttcacacggacacggctgaggaatcagaccagagggaggaagcgcagtcagcagacagagaggcctcaagagcgatcttcccaggataaaggaaaacataataaaacaggaggatgaggaagtgaataagggttgtgtgttgtttttaatttgagcacctttaaaaatccgagagaatgagacccttgagagggaaaagttgcctgtaagaaaacaatgtagtcaacggcatcagactctgagatgggcgtgcagggcccaggggaggcccagctgtcccatactggcatctgccctaacagactgagtcagcacagcaaggtcacgccttgaacttgaac

SEQ ID NO: 193427 - DNA, 621 bp, Homo sapiens
agtgttcagaggatccccaaagatctttgagcatcaccgttaccaattggtgtctgcatctcactcatattgtccgcctgtcagctcattcaccagcctgtgactgagtcctgctgagcgctcggcactgctgagtccctggagagtcaacatgaagctccaggtggagggtacagattagaagcccagggtggggttagacgcatccttgctctgcctcaccgggtgtgcccccttgggcgaatcgcttaacctatatcctccgctgatgtgtacagaccactgccatgtgcccggcactgggggtggcagtggacatggcagacaagccctctgccctcgtggaacttagattctaggggacagtccttttggtcctcctttgtaaaatggcaacagtaatagcgctctcaccaaataacgtgaagattaaatgaggaaatgggtaaagggcttagcaatgcttgatacatggtaaaatgctcaagtatgcattctcttcattccactttaatgtaagctttattaggcaaggaatggtatggttggcgtctgtgttcccagtgcctgtgagcacagtgcctgacatatatggtaggtgatgctcaaagatcttggggg

SEQ ID NO: 193428 - DNA, 415 bp, Homo sapiens
tactgagtgtgtcggtggggggggtggtgtggaggggagggtttgggtgctccatttattgaatcctcccataatatatttccaactagtttggactaaactaaactcacacttagggccttgtttgcagaaagattcaccatctttttaggacacttaggtttatttacaaaataattctttgaaggcccgaacatttctagaatctgattgatgatgagcaggagagagaaagtgcatactacaaagcggcagtgttttaaaaattcaacatcagcctaattaccaggaatttgcagtttagttactctgtgtacatgtaactatttataaattttgacatcaacagcttctattttaactgatgagatgtccaatttggacacaattataaatgctgtgaggctgggtgcag

SEQ ID NO: 193429 - DNA, 323 bp, Homo sapiens
ccttgccttttatttattaagcacctactatgggccatgcactggtctatatattagggttacggcagtgaataagacaaaaaataaactcctgctcttctcctggaggtgacattccaggtggaggtgtgggagttgaaatacttcaagatacaccacaatgcgtagtgtgttaggtggtggcaagggctatggaagtgaagcaaagtcagaggatggagagatggggagcaagctctgcagatatttggggcagagcatcccaatggcaggggagacagcagtgcaaaggccctgaggtatgcgtgtggaatggcaagaag

SEQ ID NO: 193430 - DNA, 377 bp, Homo sapiens
ttcaaaacctcagtatgaatatagagctttgaaacgtatttattttaatgtaaattgcttagatgcagtataaaggagaatggctctttccagtgctgagagagcagttgtgaaggccaagattaattagaccttcatcatcttagaagatgaaaaagttgttttgggagataggatagctctgacctgtaagatgaaatcattcatgacgtcagtgccccccaaatagccatttgtaactgagtaagtgcaaatgacctatgagttcttaggaaagaaaaacctttcacctaagttgcgtcaacacaatgacaaaataactaattaaaaggtgagaaaaccagtaaattatctacatgatacctgacagccatttt

SEQ ID NO: 193431 - DNA, 237 bp, Homo sapiens
gctgagctctagatcaccgaggcctccagagacaagaacttgaagtagtaatggacagggctggcctgccgattagggagaaggatcaaatgtcagaaaataaaagcattttcaagtaggtggtgggaatggaaaggaaaatcccaaatatctgctccaaggtgcagacagagctcagtcagccagaaggaacagaccgagccgagctggtgagttcgaggtatggactctgtcatt

SEQ ID NO: 193432 - DNA, 588 bp, Homo sapiens
ctaagagcaccatcaagtgggcagttagacatctgagtccgaagataccatttccatgtatgttgattataattgaaatctatgggcatggataagaaagcctaggaggagaataagaagaggaccaaggggcatatgttgagaaactcctttagaagccaaatagaagagctgagtgaccctggagaggtcagaaaggtatcaagaaatcgggaagaatcacagaaggcagggagaggtctttctagaaggaagactcagtgagtagagtcattgttttttggagataatgaagacgagccctaaacatcttccatgaagcttgtaagacagaggtgtcaataaactatagctcaggctcagttgcttgcttttgtaaaagtaaaagcttgcttttttaaaacttcttgaaacacagccatgttcattcatttatatattatgtatggctactttcactctacagtggcagagaagagtagttgagacagagagcaaatggctttgctgtttgctttctggccgtttatggaaaatgtttgctgacccctggtgcagatgtataattcaagagtgttgtaggtttga

SEQ ID NO: 193433 - DNA, 184 bp, Homo sapiens
tacctgagagctctgggacccacagtagctgatgggtccggccatgtttcacagcagataaagcaggactccagaggagcccacctctcccttaagaggggaccagccagtctactctatgccgcctcagctcccactggctctccagctagcatctcctttttttactaatgccattcagcct

SEQ ID NO: 193434 - DNA, 337 bp, Homo sapiens
cttgatctcagatggtcagatgttgaaccaagtggattaaagctgatttcttaaaccggacaaggctgctgccattgtgcattccctggtacttataaaatattatggtttgaaattttattcttatttctgtaatcatcttattcaccttaaatacagaaatacagacatctggctgggcgcagtggctcacacctgaaatcccagcactttgggtggccgaggcaggtggatcacttgaggtcaggagttcaagaccagcctgaccaacagagcaaaaccccatctctactaaaaaaatacaaaaaaaaaaaaaaaaaaaaaagctgggtcatgc

SEQ ID NO: 193435 - DNA, 309 bp, Homo sapiens
cagtaagagcaggccaagaacagctcacaagtatggtataaagctcaaagagcaaagttcagttcatgcccttaccacttataagggatctttgcctttcagcaaatcacttatccttctaaaggttttcctgccctataatggaaataatgctatctactatacttgcttgtgatgaatattaaatgaaaatcatatgggaagtacatagcacagtgcctgagacatagcgggccttcagtaaagatcattacctctttcccagtctgcttttcttgtttgctttccctttcccaggcctcattccta

SEQ ID NO: 193436 - DNA, 299 bp, Homo sapiens
aaacctgaatcctaccttcaaaggagctaaaagtctagtaatggagatgagatgtgcccacagtgcaaaactagaaaaacaacgccataaaacaagacatggataaagtactatggctgctcagtaagagattacttctgacacaaaggaccagagaagcctcacagagatggtcccgactccttgaataatgagagtgggtaacacttgcacacaaatgataagaaagagcaatccaggcaggaggcaaatcaggaaaagcaaaaaggacagagcgcatgaagcatatatggaaaacc

SEQ ID NO: 193437 - DNA, 149 bp, Homo sapiens
gttaccaacatcgagacagagactagcaaaactagtggactttaaagaaaaagaaaattagattattgggctttctgacagcaacacttaatgccaaaagaaaatggagtaccgtatttaagaaagatacacaagcgagaaaacgagcc

SEQ ID NO: 193438 - DNA, 510 bp, Homo sapiens
agtaggtagacagtcatgccttttaataggaagtttctaaatgtatccattcattcatcagcattaattgaatgctaaatatatgccaaccactttattaaatgctggagatataaagatgactaagattcagttgcttccccagggagccggtttatggtctgttggggaagacagaaatatgaactaagttataattcattatgctaagtgcaatgctggagacaggccagtgagagcaaagcatggtacttggagatcatagacagggtggtgggagcataaattataaggtgaaaagtgaggctggaggggtgggcagaaactagatcccacaagatggaactggctggttaggaagctttgagtttgtcttctaggcctcaaggagccatggagtggttttaaacagggcagtgataaggacaggtttatgttttagcaagataattctgtgggctgggtgaaggctggagatgatggaggtaaaactagaagtagggagactaa

SEQ ID NO: 193439 - DNA, 380 bp, Homo sapiens
aacaggagtctgtagtggttggtgggaatgtaaactggtacaagtactttggaaggccatttgacagtatctactaaggctggatagacaaatgcccatcacttctacgctcaaacatttacaaatatgtatgaagctgcaatatttttaaatgccaaaaattgggaacaacccaaacgttcattgacaatagaatggatgaataaagttgcattttatatacaacactacaaagcaataaaaattaatcaaccggccaggcgtggtggctcacgcctgtaatcccagcatcgggaggctgaggcaggagaattgcttgaacccaggaggcagaggttgcagtgagccgagattgtgccactgcactccagcctgggcga

SEQ ID NO: 193440 - DNA, 409 bp, Homo sapiens
tattttcacagaaacatctaggatagcatttgaccagatacctgggtgctgtggtctacccaagttgacacataaaataaccatcatacttcccaaaaagacattagaaagggagagaccatcctggtttgctcactttttaaaacacctcacaagcaaacaaactctttacagcttttgaagatgagaaaatgtcatatgtcttgacatttctcctcctcctttctcaagcatctgtctccgtactaagcccaagtagaatgctttaaaagaaaaacagttgctaaatttaacaattcaacacatgtcttgagtacccatcaagtgccagtgattatactggatgccaagaatacagagataaatgaaaacccattcatgtctgcctccctttaattctaaaggaaaa

SEQ ID NO: 193441 - DNA, 490 bp, Homo sapiens
cttctggcggttctgcgattgtacttggcactttctccaagggtgcaggaacaagagggggctcttatcctttcactcgctgagtatgacacaccggtgagcagaaaagaaagtataccctaaaacaaactaggactagaacacctccttgcccacctttgtctctgaacccacatgttgtctcctatcctgggtatgaaatgtccagaagaaggctagtccctccatttggtcacgggcccatcccctctcgtctaccaaatgacatcattcccagacttttctttctctcctgtatccattttcccttttgactagatcattcccaacagcatacaaacacgttatttcttttatcttaaaaaataaaaacacgaaacacctctcttaattccttcattttcccccttttagttaccactgcatcactctccctccctgtactgcaggaacaccacacgactttctgtgccaatggaaatgttcaata

SEQ ID NO: 193442 - DNA, 653 bp, Homo sapiens
ccccaatggaatcatgatcaaataaaggacttttgtattcccaaaatagtctcatataccaccactaataatatgatgacaaacataatatactttattgaccacttgctaacagaaaatgtgcaatatgtaattgatattatcatcatcatcctttaacctacaaaacccccctgggaggtatttactattatcccattttataaacagaaaactgaatcttacaaaggggtaaaaaacctaaacaacaacaaaaaagatggcaaggggcagagaagagatcagaactctgcttccaaaacttaagcttttttccactgaccatagatacttaatgtactatctacagaagcacaacttccaaacagttaccattctcttcacaatcaaataaattacatgttattaaggaagctgtgctattcacatatgtatgcatgcctgaaataatacaatattgcttttgtaaatggcttagtggatttaagtcaacaactatcaagcccttgctatgtacaaggcaaaacataagacactgacaataagatgaataaaccccagtcccagacaccaggcagctcactttgtggacagagcagagataaagcgagtgcatgattagagccatggagaggattcagtagtaagctgga

SEQ ID NO: 193443 - DNA, 183 bp, Homo sapiens
taaatttttgagatcatcatgtctgagctctcttctttacagaatttatattatattttgcttaagaaagttgttcccacccccaaaattataaaatattctcttacagtctttacatgtttttcaaatatctcttttatccatctggaatttattttggtttttagggtggggagtcactga

SEQ ID NO: 193444 - DNA, 879 bp, Homo sapiens
catggctctgctacattaggtctttggttggatcatctgtggtgactcctcctgagtgggcttcctggccataggcactggctcttgtgaagtctttctgttcattcccagccacttggcctacctgtctgacctacttcctgcatcttgttatcttctggcttgtggccagccctatgcaaaaacacatgtttgtagccactactagaaacacgtgcagctacttcaagatccggaatgatacaggggagtggctttagaaatacaagaataagaggaagcagggaacctgccggtgggttctgtgccagctaccttttagagaatgagctccagctcaaattttctgaacaaaacctagttctgttcatcttgtggcaaatcagatattttctccataagcatattgtggcagttgagttaggagaaggcatgattcgtgctaacagagtcagatagtgatactgggaaccttaggagtaagggctgaggattgttgttgagggcgatgctcatggaattagagtggatgagttgttctccggacatgcaaatagccagaaccaaggtgtttcctatttattgttacccctgggatcccttcaagggttcttcagttcagtagaaacattgttgtcatcatcagggtgtctctgcttgaagctttccaggaggaagggaaaaagggctgcttatgacatcctggctccagccccacagaagaagtcagcgtggggtaggccatttggccttgggagcagtctagcctgccatcgtaataatcgccagtccaccaagccatcttattcctgaccttgtttttctccctaattcttcttggttttctccctaattcttcctgactctctggaaggcacc

SEQ ID NO: 193445 - DNA, 345 bp, Homo sapiens
tcaagcgattctcctgcctcagcctcctgagtagctgggactacagatgcccgcccccacgcccagctaatttttatatttttagtagagacggggtttcaccatgttgaccaggctggcctagaactcctgacctcaggtgatccacctgtctcggcctcccaaagtgctgggattacaggtgtgagccaccgagcccagcctaaggttggttattaatactaaataacatttttgccccacagcatcaacatcactaccctaaggatttgaaaaatcagaagcatctccctcactgaggcaggaagtcttcaatcacctctgaattctgacctcccatccatt

SEQ ID NO: 193446 - DNA, 152 bp, Homo sapiens
ttttactagaaaatttctagactaatccctcctgtttcctgtatctaagccatgctttactttgtcatttctctactctcaaaattttagtgcctggatcctccattgcctttacaaggaagccaagttcttaaaatggtattcatggcctt

SEQ ID NO: 193447 - DNA, 467 bp, Homo sapiens
aagcttttgaactagcgtcttcaacatcattacctgaccaaataatcctattgttttttgtatcctcattttctacagcatttgattatattcaagtcactcccaggttaaaccatgacaaaaggactgtctttgacacaagtccttctccagatactgctccagctcttctctccatcacaggtatagtgaacaactatagagcagttttttacaaaatcatccagacttctaggtaagtgactgcctggggtcagagggtgaacaggagagaagagggaggggagagaaactgggaatgactgctaatggttgtggagattcttccatggataatgaaaatactctaaaattgattatgctgatggttgcaaaactcttatcaacatactaaaaaccattgaattgcacactttaaatgagtgaaggctatgatatgtgaattatacctcaaatcaagctgtttt

SEQ ID NO: 193448 - DNA, 109 bp, Homo sapiens
ctggatgacgagagtgagaccctatctctaaaaacaaacaaacaaacaaacaaccagcaaaaagaaaaccagtgcgtagagcctatttccatttgtgtaaaaaataaag

SEQ ID NO: 193449 - DNA, 274 bp, Homo sapiens
tgccaatcaaattctttcaagattttggaatatggacctaaagagagttgaggcagtcttctcaatgactggaactgaaatatggaactcaggatctgtgaagcagccatattattcccattatattcccccaagagcagagaaagtttgttttgtttactggagaaaattaagagataaggtcctgagaggcaaacagagagtcttaacttttatttcctgccatcattccattttatgagccattcatatattcctattttttcaactcccc

SEQ ID NO: 193450 - DNA, 530 bp, Homo sapiens
gtgctgctgtagatggtttatttatggttctgataaactggaggttggcaagactttaatgggaatataaagtaagctccattatacttctgattaatcaaagttttccaatattaccatattgctatatccccaaactccaaataccaaaagcaagttagaatggattatttggaataactcattctacctaattttcttttcctaaaacacttttaacatctaaacattgaagaagtggcaattatatttatttgcagagccaactgtgaagatgctaaggacaaaaggaaaagagtaagtatcaaactccctgagatatctagcataacacatgcctaagcttcataaccagtactgcacttttgctgcaaaatacactgatgaccaaggcatttaatcccacttactagtaagctattatctagtacattctttcccagtcctgtgtcctctaagtaacctaagtaaatcttttaagttctacctttaataactacatcctttcccatctgagtacacggcatcac

SEQ ID NO: 193451 - DNA, 321 bp, Homo sapiens
ttcacatatcctacactaccaaattaaaaatcttcacatactcaagttccttattcatactttttttttatcttaaaaggcaatttcactccactttaagaaatgaggagtatcaaccatgaatcgccccaactttgtggcaacccccacttacttacatatttccttcctattctcctcaccatcctctaaagaggaatgttcttaacttgttcagagtcacctactacatttacactcttgactcactcaccattgagcccatctctcctgccccactccaggcaattctctgggaccttgttctatcaattagtacct

SEQ ID NO: 193452 - DNA, 328 bp, Homo sapiens
atgagagaactttttgggatgttagatatgttcattattgtgattgtagtgttagccttgtgggcagtatacatgtgtgaaaacttgtcaagttagatattttatgtgcagttgattgtatgtcaattatacatcaatgaagttgttaaaaatgtaagtacaaagatgttcattgcactgtttttatagtagcccaaaataggaacaacaaaatttctaaaaatagggagtggataaataaacaatgatgcattcataaaatatcaagtagccactaaagtgttttcagaggatacttaataacatgagagaaaggccaagttacaac

SEQ ID NO: 193453 - DNA, 333 bp, Homo sapiens
tcacctcctggtctaacccagagatcagccacccttctcctacccgagtatcttcacctcctggtctaacccagagatcagccaccctcctcctacccgagtatcttcacctcctggtctaacccagagatcagccgccctcctcctacccaagtatcttcacctcctggtctaacccagagatcagccgccctcctcctacccaagtatcttcacctcctggtctaaccctgagatcatcagccagcctcctcttacctgagtatcttcacctcctggtctaaccctgggatcatcagccagccttctcctccagtatcttcacctcctggt

SEQ ID NO: 193454 - DNA, 1093 bp, Homo sapiens
agaagatcatggatggagctggaggcctttatccttacaaactcatcgaggagcagaaaacctaataccatatgttatcacttataagtgggagctgaatcatgagaacacatggacacatgggaacaacacacactagggtctggtggaggatggagggtgggaggaggaagaggatcaggaaaaataactaatgggcaccaggcctaatacctgggtgatgaaataatctgtacgacaagtccccatgtcatgggtttacctatataataagcctgcacatatacccctgaacttacaagtttcaaaaaaagaaaatatgcatcttcaattttattaaatcatgactgttttccaaagcagttcactgacttacatgaataccagtagtatatggtagtttctgtggtcccttatccttgccagaatcttggtactgtcacattttaaaatttttgccaatctgtataacagtatcatattaggcttttactttgcattttcctgatcactgatgatgttaaacgtcttatgtatattacttatttggattcttcttttctgatagtttctctacttcaactccaaaaattttcatatgttatgcttgtgtagcccctgtgaaaagaaagcacagtaggatgacctagttactcacttgaaaagtatgatggagcccagcgacctttgttctaatcccagatgtttgacttggtcagagtcccacacctctggccctcagcatcctcatttgctaaataaaagtattggctgggttagagcagcagttctgaaccttggctgcccatcagaattatctaggatgctttaaaaaaatgtttagaccacatctgcaccagaaagcctgattaaattggattaaaggttactatatccatttcaacattctgtgataacgatagaataagtctttaacacctagatttcatggtttcaatcatcttccttgtctgcaccctgaattaagtatgccagagactctttatttgtaagactataatctacttttgtaaatgcgttatataaaggaggagactccttaatttagtccgtaggggaaacttggcgtcat

SEQ ID NO: 193455 - DNA, 1009 bp, Homo sapiens
gagcctgggtgattgaggcaagtgaggagggatgccaggcagatgcttggggatctgtctgctgatatttggtgctcatcttgtgcccggaacctagttggtgcattctgaggataggggaatctgtagcctccccaccacacagaccatgggccccatgggtcacttggtgtggtctagggacctgcatgctgtgggtggctccactcagtctggcgaggcctgccacggggctctcctctgctcccaccttccatggggaccagccgtggctctgctgcccttgtgcttagcatcctggcccctcagcctggggatgcccctggctcccactcactgtgtgtgactcccgaggaaggccacatagttcagggactacctcactgtgtgttcaggtgccacctcactgtcttgtttctacaccctggagccattgtccccacagcatcccccatcaagccaggtcccctgagctgtgtgtcctcccttctcccctagctaaagggccaacctgcgctccgcagaatctggggaggcctcttaccttctaggtaagcattacatgaggacactgccaggctccaggccaacactgcttctcaacaccacctgctttcttcttgttgtccgtgggctccctccaccatcttgtggctgatttccaggaacagccttctcttgagctggatgggcccctcctgtggggtcagagcactgggtggagacaccttgggcttcatcccccagggcctgggcctgctccagtggagacttggaagagatgaggtggggcctaaaggacttgaggctggggctgagactttcagcaaggcagatgccgcctctccagaccatctagacgtcactggtgcccctgcagcccctgacgcttgtgccgctgaagcagggcagggtcaagatcctctaaagtcttcctcagcctcctgcttgtccctgaacaggggtgccctggctgctagggctgccggcctcctgtctgcatcccgta

SEQ ID NO: 193456 - DNA, 1038 bp, Homo sapiens
tacatcgtcatagcttgattcctatgatggtaacaggagttgagatagcacggttgagggatgccaggcagatgcttggggatctgtctgctgatatttggtgctcatcttgtgcccggaacctagttggtgcattctgaggataggggaatctgtagcctccccaccacacagaccatgggccccatgggtcacttggtgtggtctagggacctgcatgctgtgggtggctccactcagtctggcgaggcctgccacggggctctcctctgctcccaccttccatggggaccagccgtggctctgctgcccttgtgcttagcatcctggcccctcagcctggggatgcccctggctcccactcactgtgtgtgactcccgaggaaggccacatagttcagggactacctcactgtgtgttcaggtgccacctcactgtcttgtttctacaccctggagccattgtccccacagcatcccccatcaagccaggtcccctgagctgtgtgtcctcccttctcccctagctaaagggccaacctgcgctccgcagaatctggggaggcctcttaccttctaggtaagcattacatgaggacactgccaggctccaggccaacactgcttctcaacaccacctgctttcttcttgttgtccgtgggctccctccaccatcttgtggctgatttccaggaacagccttctcttgagctggatgggcccctcctgtggggtcagagcactgggtggagacaccttgggcttcatcccccagggcctgggcctgctccagtggagacttggaagagatgaggtggggcctaaaggacttgaggctggggctgagactttcagcaaggcagatgccgcctctccagaccatctagacgtcactggtgcccctgcagcccctgacgcttgtgccgctgaagcagggcagggtcaagatcctctaaagtcttcctcagcctcctgcttgtccctgaacaggggtgccctggctgctagggctgccggcctcctgtctgcatcccgta

SEQ ID NO: 193457 - DNA, 267 bp, Homo sapiens
ctgcagcaaagtaagctttctgtgactcagtttcttcttctctgtaggatataaattgtaataatcctacttatgtctgttatgaggattatatgtcagtcaatacacagaaaatatgaacataaattctgtgcaaatgtttactattatgttcctcatttgacactggctacaataaagctctcttgattcttgaacttttttttttttttttttgagacggagtctggctctgtcgcccaggctggagtgcagtggcgcaatctc

SEQ ID NO: 193458 - DNA, 371 bp, Homo sapiens
aattagctgggccgtggtggtgcatgcctttaatcccagctactccagaggctgaggcaggataatggcttgaacctggaggcggaggttgtggtgagccaaggccttaccattgcactccagcctggcaacaagagcaaaactctgtctcaaattaaaaaaaagaaaagaaaagaaaatctttacaatgaaatcccttagttctttctgttaaagtgagcccaagaaccttctaacttaatatatatgtgaaaataaaggtgagtgttctgctagactaacctgaaatactctaaacttggtggtttttacacagtacagtcacagaagatagagcaataattttacctgcatgaattaaatcttaagat

SEQ ID NO: 193459 - DNA, 120 bp, Homo sapiens
ttaagatacagagtctcagtgttgctcaggctggcctcaaattcctgggctaaagcaatcctcccaactcaacctcccaagtatcattttttttcttggatttcaatagaagtttgtgtt

SEQ ID NO: 193460 - DNA, 798 bp, Homo sapiens
aaaaaaagatacaaattattaatataaaaaataaaatggaggctgtcactgttgatgtcaccatgcagataccaaaaacgtctaggggaataatactctgaacaactctgcgcatatcaatttcatgactgagatgagatggaccaattttttgaaaagcacaaactaccacaacttactatcaaatggataatttgaatagctctattatttttaaggaaattgaatttgtaatttggctctcccccatctctaggcccaaatgatttcaatgaagaattgtagcaaatgtctaaaaaagaattaatagcaactgtatataatttcttccagaaaatagaagaagaggaaataattctaactcactttatgaagctagttttatcccgatatcaaaactagaccaagataatactaaaaacaaaaacaaaacaaacagctacagaacaatatccctcatgaatctaggccaccccccacccacaccaaaatccttaacagtatcttaccaaatcaaagccagcactatttgaaagaattctactacaacatgaccaagaagggtgtattctagggatataaagctggttcagtatttagaaatcaatcaaggtaattcaccttattgacaggctaagaaagaaaaatcacatgattatatcaattgatgcagaaaaattatttgataaaatgtaatgcctatccatgataaaatctctcaggaaagtatgaatagaaggaaacttctttaaactcaatatggagtatctacataaaacctggagctatcattgtact

SEQ ID NO: 193461 - DNA, 265 bp, Homo sapiens
cctactgggcgtatgtgatacgtggtgtcgtatgcctataatcccagctactctgaagactgaagcccaaggatcagttgaaccgggggtgggcggtggggcaaaggttgcagtgagccgagatcatgccactgcactccagcctgggcaacagagcgagacgctgtctcaaaaaataaataaaataaaaaactgttaaatttggggaggagtcaaagttacatgcagattttcaattattaggggagtcagcacctctaaccac

SEQ ID NO: 193462 - DNA, 193 bp, Homo sapiens
tcagggggctgcagtctggttgggtgggagagatgtttgtgacctatttgctaggcctggggtccccatccacccaggacacacaggggcacccacttctgttgcatcttcatgctcctgcccctagtggccatgttctgagaggtcttaacatctgtccgtcccgtgctgaagtacagagcagccatgtggt

SEQ ID NO: 193463 - DNA, 250 bp, Homo sapiens
tgattcctattttaaaaggtaggatccttcagtgtctgttagatgcaagttaccgtggcaacctaatagcaaactgcaaatcccaggtcatgctcagcaaataaaaaacattctcagcaaataaaaaacatcgtcatcacgtagtgtttgggtgtactgtcttctatatagaatctcacattccttgtgagaagcgtatcacattttccctagtgcgttatccattagcttatgtctgagtgcttgctaa

SEQ ID NO: 193464 - DNA, 671 bp, Homo sapiens
gagtaggcttcctcagatttaaaggatgggaaagtatattttggcgtttagaggaaactcagcaaagatacagagaaagggtgactgagaaaagacaaacttggttgtgaagcaaacatggagaaacagtaaagcaggcgttcaggcttatgcatttgattgtaaagccactgggtgaataataaaaggtgataagtagcgaaggatcaggcattcataaagtaaatatgaaaactaatattggtagtcatgcatgggatgccccagggttctgcttaggatgcagtatttataagcgaggtaactgattctggataataggtttggcagtggggtagatagtgcagatacagccgaatgattttgctgaagttgtaccagtcacatttagcagttggttgtatatagaggataggaattctgcaaggaattttaccttgaagtgttagtttgggtaatgaaggatgtcaaggaaattgagaggtccatgatctcataacgtatatcaggagcactaggggtgcttcttggaaattcagataactggtctcagtctacatctgttgaatcagaattgttgacgattgggtctctctgctttagacgatgagagatccaataggaatagtcaggtggagagaagaattttctgatcttctgcctttcgggga

SEQ ID NO: 193465 - DNA, 215 bp, Homo sapiens
gcgtctctacagtggccaagccctgctcctcacatacaaacctcactttaaagactagtaaaaacccaaggctgcttccactaaattccttagagtcagtcaaaagagaaaaataaaaccctcccttggaaatacagccaataatctctgctgggcttgggctgagaagccttcctcctagaaaacatctgtgctaacacttgggctgccagact

SEQ ID NO: 193466 - DNA, 220 bp, Homo sapiens
ctcgcctcctccccaagaggctcaggaggggacaaggatagggacagaggtcgcaggaaggccagtgcgccgtgactgtgtgtaaggccacagggctggggccgtggtgggaagaagcgaccatactcgggatgtattcccagagcaggtgccgggacacacggaagtcaggagctgaggaagggtccggggtgagggcccgctgttccacggcatctac

SEQ ID NO: 193467 - DNA, 637 bp, Homo sapiens
ttttcttataaaaattttcccttgatgacttgagcgactaaatcaagcttgcattcagaaaaagtccatctggagaggtcatgataaaagacttcaaaactcaaaaacttgtactttgtcaattatatcactttgtccacattttaaataatatgtgacaaaccaatcatggaactttagtgatagctagacagtttaaataatggagtccatattactatggctagtagagtcagcaaatctatgatagtcaaatagctgtaagaagagtctgggttgctgattatgctactcatttcctccaatggcttttaagaactaaatatctggcgttttctcattactacacactctttgctggcatcggttccttatttggctatcacaaggtcatgttctctcaaagtaggtaaaataggaaaatgtacagttcagaaagcttattaacctctaaatcacagctctaatgatctaaagagggatgtgaaatgagaagaaaagcagaaaagggaaagagctggtttaaggttaagctagtcctgttatttatgtatgcaaatgacacgacaataataaaagactttaaacctgctgatcatctcacaagtaaattaatgatccacagaacatctgtggg

SEQ ID NO: 193468 - DNA, 320 bp, Homo sapiens
aaaaggaaaagaagaaagaaaataatccaattttaaaattggcaaaagtactgaatggacatcttaccaaagaagatataaggatggaaaataagaatatgaaaaatgctgaacatcatttgtctttagggaactgcagattagaacaatgagatacccacttcacatctactagaatgtcactgtgacaatgccaaacaagagaaaatcttattattgccagtgagaatgcaaaatggtatagctgctttggaagactatttggcggtctcttacaaaacttactactaccatataatccagcaatcatgtgctactag

SEQ ID NO: 193469 - DNA, 554 bp, Homo sapiens
aagaattcctggatcacatggtatagacctttgaaattttgatggaaaatgttcttttgagtaaaacaataacaaaaacctaatagggagatgagttactcggacctgctgctgactatttgttgctttaataattatgtggatattcgagttacacagcaaatagctcatgtgctaatcatgaaagattggtcacaggaagcatctacacacagatagttccttttatgacttagtttctgaccttggggaaccaggataataaaaactacaagggtgaaaagacaataacaagtgttggtgagaatgtggagaaatgggaactttcgggcattgctagtaggaatgtaaaatggtgcagccactttgggaaacagtttggcatttcctccaaatgttaaacacagttaccatatgatggaaaatgttcttttgagtaaaacaataacaaaaacctaatagggagatgagttactcaagtgctctatttagatgctttaataattatgtggatattcgagtacacaacaaatagtcagcagcaggtccggcta

SEQ ID NO: 193470 - DNA, 514 bp, Homo sapiens
tgatggaaaatgttcttttgagtaaaacaataacaaaaacctaatagggagatgagttactcggacctgctgctgactatttgttgctttaataattatgtggatattcgagttacacagcaaatagctcatgtgctaatcatgaaagattggtcacaggaagcatctacacacagatagttccttttatgacttagtttctgaccttggggaaccaggataataaaaactacaagggtgaaaagacaataacaagtgttggtgagaatgtggagaaatgggaactttcgggcattgctagtaggaatgtaaaatggtgcagccactttgggaaacagtttggcatttcctccaaatgttaaacacagttaccatatgatccagcaattccactcctaggtatacacccaggggaattcaaaaatgtatctccggcagggcgcgatggctcacacctgtaattccagcactttgggaggccgaggtgggtagatcatgaggtcaggagttcaag

SEQ ID NO: 193471 - DNA, 188 bp, Homo sapiens
tgatgatgatgtccatagcctggacctcttcccatctggctccttggattacctcacagcccttcctaggtacccagaatgtttgctctttggttataaggccagatgaatgagcaaaaactcccacctaaatctgtagcatgcggacaaccaaatgaatagatatttgattctactcacagatatca

SEQ ID NO: 193472 - DNA, 620 bp, Homo sapiens
ttttggtactgcttctatccactgccttttctttgtctaacttttcctctctgaggcctttaggggaagccagtttcttcctcagattctctgagtctccccgcacaaagcccctcagccctttcagctgccctcctaagagttgggggatcatgacttggcctcacagaattccatgccatcctctctggtctgggcagcctctccagggcaatgggagtgcagcccaccgggtctgcagagccccagctgaggcctgagcttccaggcaccgcaaactctcctgggctgcagggccagagtcagccccagtgcacccccagggccagaacaccagccgtatccaagtctctttccccctaggaacttaaggaatttttcttaagggttgtttcagtttcatacctttgaaaagaacttgcttctcctttgacaccttcgctgggactggggccagaccgtggagcagataatagttttgccacgtgtagtctcccatctccccatttattcaaggacatttattgagcacctacttgccaagccttgtgcctggagctgggaataatggtatcacttcgtcctgagggagttcctgggttggcataagcggacactac

SEQ ID NO: 193473 - DNA, 398 bp, Homo sapiens
gtggcttcaccatgttagccaggttggtctcgatctcctgacctcgtgatccacccatcttggcctcccaaagtgttgggattacaggcgtgaggcactgcgccgggcctagcataacaaactcttattagctatcacccagcttctagtagtatcaatacattacaaaatttgttcatttatagcttcccacctgctatcccttgctggttactttaaaaaatacttttatgtatacttttaatttacataccattaatgattcatcaatcttaagtatgtaattaaatgatttttagcaaacatacaaagttatgccataatcagcacaattcagttttagaacattgccattattccagttcatctcctgtggctgtttgaagccagtctctact

SEQ ID NO: 193474 - DNA, 230 bp, Homo sapiens
agcactttaaatatgtcatgtcactctcctgtcttgcaaggtttccactgaaaagtctgctgccagatgtattagagcttcagtgtatgttatttgtttcttttctcttgctgcttttagaatcatttcttaatctttgacctttgggaatttaattattaaatgccctgatgtagtcttctttggattcagtcttctaagtgctatacagcctccttgtacttagctat

SEQ ID NO: 193475 - DNA, 359 bp, Homo sapiens
tcagcttccgttaccctccctatctacccgcactgcagctgcctgctcaagcattgactggacctgggcagtcatactctgtttagaaactgaaacgacatcataggtacaacacgaatcaccatgaagacacacaaggatgcaggtatttatgctttcagttcatttaaatcttcctcacttctctctcctcccttctttctccctccctccttctttatggtataagctgagaaattcccaccccctcatttttttattgccgatgataacaggaagattaattgaagtatgtgcagttatacctaaaaatggtagatctcttttaatgtaaaagaaaaggctatctctgatttaaa

SEQ ID NO: 193476 - DNA, 268 bp, Homo sapiens
cccagggctctgcatacttggagggaccctagtctaactttcttttctgtactctgcttttgtggaagccgcatctcccagtcttgatcagtttttcctctgtggtgtgcgttgagcagagagtcctgagagactggcctaagctctgggggccaataaggcccccagggagccccttctggggagacctggtatgcgtgctttgacctaaccctgctggggacggcttcccaggcagagtgagctcgaggccggtccttgagggatg

SEQ ID NO: 193477 - DNA, 284 bp, Homo sapiens
cacgtggtccggaagtctattgctctatgcacttcacagcttctggcttagtatgaatgagaaggcatgaaaaagaggagggactgggagcaaggagttctgcaggtcttagaatcctccctgggatacatatttaggcagttcttactccaggtggcaaaaccctgcacagccattcttcttacatgaggagtagaggccgactgaaggctctacgatcctggcatggccatctcctatctttgggacattgagccagtatttagcccatctctttctcatca

SEQ ID NO: 193478 - DNA, 194 bp, Homo sapiens
cccatgcaccttggtcaacagattaatgaattgtagtacatccacaggatagaatactactcagcaataagaaggaatgaactactgatacacacatcccaccaaaaagtacatgctatatgatgattctatccatataaaattctaaaaaatgcaaactaatctgtagtaacagaaagcagattagtagtagc

SEQ ID NO: 193479 - DNA, 564 bp, Homo sapiens
agactgtctaataccctgcgacgttgtggcttatgtctgtaatcctagcactttgggattacaggtgtgagccactgtgcttggccaccaaaccctaattcagagcaaggccctaactcccttcaattcactgaaggctgagaaaggtgaggaacttgcagaaggaaagcttgaagccaatgggttggttcatgaggtttaaggaaagacaccatcttcataacataaaagggcaagtaaacagcaagtgctgatagagaagctgcagtaagttatccagaagatctagctgagatcattggtaaagctggcttcaccaaataacaaatcttcaaatgtagatgaaacgactttgtattggaagaagatgccttcaggctaggactttcatagctggagaggagaagtcaatgcttcaaagtttcaagggacaggcttttgtcccttgggctcttgttaggggctaatacagcttgtgactttgagttgaaggcaatgctcattgaacattctaaaaatcctagggcccttaagaatgatactaaatgtactctacttgtactc

SEQ ID NO: 193480 - DNA, 241 bp, Homo sapiens
ctcctcagcttgcaggtggcctataatgggccttcaccttgtgaacatgtgagccaattctccttaacaaacgccccttcatacatacatatatcctaaagacctttttagattattttaacatatttaaaaattttaattgaaatttttatcgagtgtattagggttctccagagggacagaactaataggatatatgtatgtatgaaggggcgtttgttaaggagaattggctcacatg

SEQ ID NO: 193481 - DNA, 367 bp, Homo sapiens
gcaggtcgacctagcaggatcccactacgtcgcatatggggtacagaaataggaagtgagtaaattcttagcccatctggggtggcttctcaccgtatggtggaacactagcagacatcacagatataaagatgtctaaggtctcttttacctttaatatactaatatagaaggaagcaaattcaaggagatcttaaggatttgaaaactttagttgggaaaagaatgattaataaagactttcaaggcctatacttattttaccaattttttttttttggagatggattctcactctattgcccaggctggggtgcagtctgtatttcgctttttttttggagatgtttttgcaacattttgctct

SEQ ID NO: 193482 - DNA, 248 bp, Homo sapiens
aagcaatgggtagcagccagaaatacagacgaagcttcaattgttacccaccattcacctcctgctctgtggcccagttcctaacaggccacagaccagtacatgtccatggcccaggggtcagggacccctgctgtggcacattgctaatagaggactgtagcagccatgtgccctgacctttccttttttttttttttttttgagatgccagaaacccagaattttttttttttttttttttttaa

SEQ ID NO: 193483 - DNA, 419 bp, Homo sapiens
atagttatccaaccattggatgtgcctgcggttttcacagggaagaccgtagacctcaggatgataactgagtaagaaagaagttttgtgtttgagcccatgtgtttctaaccagagtgctcttttccatggaataaatgtttcctaacactagtgtgaagatttaatcaaatacacacttcctcatcaaacgcacagtcaacttttatcttaaaatttattaatgtgatggttttcattttcaaatgtaagcattttcaaacacttaattgtttaactctcgatttgcaaaatgagttttttggtgaaatgtgtcatttgagggtcttttaccactgtttggttttatagcttgcttttcttgtttactttatgatgtaaactaatttttactaccaataaaagttttaggaatccta

SEQ ID NO: 193484 - DNA, 1002 bp, Homo sapiens
gcgtctagaggatcccggaacggcagagggagagagttgtctctggggaatacttcttggaaggggtgatctctgagctgattttgccaggaggccgaggggaaggaagtaggacagtctaggtagagagaactgtgggacaaaggcagttccctgttttctccgagtgggtgcttccaactacagtccagttctgtgccttcagccatctgccagcattcgcacaggtttagtgagcttcactttaaaccaacaggtaacagttataaatgcaaacacatcatctcttcctcctctaagacctgacctccctttgcttgctaatggtcccactaatctcccaataatgcactcaaaccatcatcttcgtctcttgccaccttttcttacttacatgaaatcagcatggactcctctctctcccttcctcccatccttgcttcctccctttcttctaaatcgtatcagagcgctgaattccatttggacagtgagttacataggacatcaagatgtcatatccctgtttgtgtcaggaaattgcagtttggatcccagtgtccttagtgagacatccccgaagcccacaaggaggaagcctagctctgtcctttctggcttttgctttcagtacatgttaccctttctctggagcgctcagtcttagttttgccctttcttatttcattctttctctatttctgtattttttttaaactggattttcattgcagtcagacggacctgggtttggatccagttttactatttgctgtgtaaccttggacaaattacttaatctcactacacctcagtttccttatcagaaaagtagggataataacgggaggacctcataaggctgtcgtgaggatggattgagacagtctatgtgaaatgcttagcacagtggctggcatggagtggatgctacctacgttttggctgcaatataacaataataatcattactattgtcctgctctggtatgtcttttgaaa

SEQ ID NO: 193485 - DNA, 255 bp, Homo sapiens
tgcagtgagccaagatggtgccactgcactccaagcctgggcaacagagcaagactccatctcaaaaaaaaccaaaaaaccaaaaaacaccaagctgttatttgcagaagatgcatgtacttagaaaatctaagataatttacacactattaagaaaactaacacatgaatttcacagggcattagatgtaatacaaggtcagtacaccatcagttacatttctatataccagcaataaacaaagacaaaggtga

SEQ ID NO: 193486 - DNA, 344 bp, Homo sapiens
ctacaaaaataggaccagaattctttctggatttttgcagagacccaaagccaactctgtctttggcagtgtctgccttggccttctccggcgcctcactgctgcagcctgatggctgccccctgcccacatgccactgcctgcagacatccccacactggtgcccgggccaaccacaggagagcaatgaaatatattaagtagactcagttctatcatacagtagtgaaatccaatccctgaaccagataaaaaagcaaacagacccctctgttatgtacagctcctaccaaagctctccaaccctgacacacacacacatacacagacacacatacagacac

SEQ ID NO: 193487 - DNA, 787 bp, Homo sapiens
tatgagtatttaatatgagggtagagaagctatcttttccagcttgtgtggaaataaagggcacacccactgacactttccctctgttgggtttgggaacattgctaggctgagactagcatgtaaatggaagggtttactgttaaagctggatgactggttgacggtgtatccactggggagtggagaggtctgccaagagaatgagagctcagtttgggtctaggttacattgttgtattgtcctcttctgctgctcagtctccttgcttcctttagatactttctctttagttaacctgtgccttgaggtccaatcacccttcacagtgtgcccagggctgtggctcaagtctgctcataaactacctctacttttgctttccatttcttctcaagggatgtagctctcagttatggcatctgtgcagacgtagcccctgtggttccaggatttagcttcacttcctccttgtctgacattccaaacttctatgctttctggtccatgtgaaccactcaacagtctctgctttcacatgtttacccatcctcccagactcagcctaggcacctctgcagagtagccttccccatgtagaggtaatcattccctctctggcacacccagcgtgctttgcattctttagttacacactcataaccttggtcctcctttgttttcctcctattggaaggtcaactcttcaggggtaaaggctggatcttaattaactatgcatgcatctccagcagttagtgtagtgcttatccaagatattgtgtg

SEQ ID NO: 193488 - DNA, 350 bp, Homo sapiens
cttgctgagcaaacagtgattattactgttgttgatgatgataacaataatcatggatggtgatcactattatacggggtgtgcaatgggaacaggggcctatgctaaggactttgcttatgctactgccaggagcaacacatccccgtgacacatgcgcccattttacagatgagaacactgaggctccaagaaggcaacaaacttggttccatgcacacgagcagtgagaaagaaaaccaaggcatgaatttggatcttactctcttactcaggagccctgggagaccaacggggattcttttgcctgtttagagatgaggaaaagagggggccgagagtgtagtgac

SEQ ID NO: 193489 - DNA, 147 bp, Homo sapiens
taaaatcgagctcggtccgaatgatggatctaagcattgattatcaatgcttagatccattcattcaataagatttcagacttgctctcactgtgttatttcttcttcctaagtatcattgtaactcatggattttaacatttggct

SEQ ID NO: 193490 - DNA, 551 bp, Homo sapiens
cattgttaactctctcttagaccctcatgtgctgccttcctaacaattcttatttcccattgttttccccagaacctggtgtaaggcctgggacacaaaatgtttgttcactgactggataatgaacagataaggcaatagatgtcactggaaaatgatctttccattccaagaaagtgctaaaagacatcatgaaacatcaaaagtttcaattgccaaattctgtgttatggcttacacagataatgtagtctgttaataccaaaaagttaacagaatggcccaaaagaatgcctcatttggttaagaatctcacatatgttgtaaaatatagacaaagtgaagtgtatactcagatatttatttactggaacttcattaataatgagcaaacaataattaagtaagcagcaacataaagctatgcttttaaaagagggctgggaaagagttcttggcaatagcttagggggccacatgatgataatgatcacaatcatggttaactatatgctacagacactgttctaaatgctttatttaaacctatt

SEQ ID NO: 193491 - DNA, 316 bp, Homo sapiens
ataaaaaattataagcacgcaaagaagtgggaaaatataacccataaccaggagaaaaaaaatttaaaaatatcctaaaatgacagcaataatgaaattagaaagtagaacatgaaaacagttacgtacacctgctacatatggtcaagaatctagaggaagactgaacatgataaagggagatatagaagatataaaaaggacacaaatgaaacttctagagatgaacaatacagtatctaaaattaaaaaaaattcacaagatgaaaataatagcagaggctgggcatagtggctcacatctgtaattccagca

SEQ ID NO: 193492 - DNA, 671 bp, Homo sapiens
ctgtaccctaaatttattatgtgtttggtttggacttctatgtccacaaatttctaggattcatttgcaaaatggtaagttaattttattctctcaaacatgagcaaagcatcaaggaaaaggatcttaaaaggtagtgtgacattttattctataaaattcccaacagcagaatctgaatgtctgtacacaatcctgtataccacctaactttaaaaacttttaaatgatataggtatttgtcaccagatggcatgggctataaaggcaggtaccttgtcttatttactctggcatctaatgcagtgtctggcacacagtaggtgttcataaacatgtatcacatattcaccatatgagtaattataatttaaggtggctttagaatttgagctaattatttcctttcaaacttattctttcagtctttcttgtcttagtaaatggtaacactgattactcaatggctaagccagaaacctgggcactgtccttgggtcttttctctccctcacacctcctatttaacaatccgtgtttttgctgccctgtgctgctgctgtgcaaaagtctgccacatcatttctgcttggacctctgcaatagtgcccttaccagtttctctgccttaactcttgtctgttaaaatctgttctcttcacagtggccag

SEQ ID NO: 193493 - DNA, 206 bp, Homo sapiens
ccctagaatcctcaaacttgatccagactcagaacctctgcctggaacattctactctctgatagctctagaactagaatataaggtaaataacacttgctgatttgaaaaatatactacaaacctaagtggtttaatacaatgtctttttttttttttttgctaacattacagtccagtgagagtacggcagcaatcaagtcacc

SEQ ID NO: 193494 - DNA, 655 bp, Homo sapiens
ggtctccttggttagttgtatcctaggtatacattttctttgtggctaatgtaaatgggatagtgtacttagtttgtactccagcctgggtaacagagcgagactatgtctcaaaagaaagaagaagaaatagagtccttctgagatcatatttagttcgctttaacaactcttacaggccagtaactgtgctggcccttaaagttgcaatgataagatcttgcttctcagagattgatgagtttggtgggagacatatataaacaatgacaactgaagtatataaatgcaatgggatcatagaagagggaacaaccaattttgctaacagttagtggtagtgaaaaaatgacttctcagtgaaagggacatttgattatgttttaatttgtatacttgtattcctccttttgtaaattataagcattggaagtaagaaatgtcttcacatttatatcaaagagtgttttaggcatttatttaaattgcattcatttatttaaattgttcagtgctccacaaagttgacatctatggcaataaacaactaaaggatcgatttgtatgagtatagtaattggataaacattttgagaatcatttatttctaataaaaattaagttatcaaaactaagcattttatagcagcaagta

SEQ ID NO: 193495 - DNA, 271 bp, Homo sapiens
gaccggaattgtcatttcatctaagtttcaaatttgttacataaacggttcataatttctaattcctttttcaagtctgtagtatccttggcagtatcccctctcttgtactttatattggtaattccttttttttttttgggagacagagtctcgctgtgtcacccaggctggagtgcagtggctgatctcggccgtgggcgacagagcaagactctgtctggaatacaaagaaaaaaaaaaagaaattagggatagtggtaaacccgag

SEQ ID NO: 193496 - DNA, 471 bp, Homo sapiens
atccccccttttgctctggaagagccttttgctctggaagatcaggtttaaggcaagcccttgctccttgtcttttccatacagcatgagtggcctctcagctcaggatcccaccagcacttatgctaatgtgggcacattatggtaacaagcacctaataatagagggaaatttaattccagcagcagcagcagcggcggcggcagcctctcactggagaggagccatcctccttaggaggaggaccggtgccgtttgcatatgagggtggcaggaagccaacacacttgcctcctgaatttggtttccttccctttattcacgtctataattgagcctttgtaagcagagggatgagtgtaaaggagctaaatttggagctgatttcacgggggtgatgagagctctggaggccagctctaccttatgttcatcttgccgaccaagaggaaattcttggccctgatcta

SEQ ID NO: 193497 - DNA, 542 bp, Homo sapiens
gatagctgatggtcgatctagaggatacccccgagtggccctgcatagacagggtttcaccatgttggccaggctggtctccaactccaggtgatccgcccgccttggcctccccaagtgctgggattacaggcatgagccactgcgcccagacaatatttaacaacttttaacctaagaaatggcaatatagtggttcatcctaatacttcccttgtaccttcccccatatacaggggaaagtgaagcaatgagagatcaagcaccttaatacaaagctgggcgtctgactcctaagtccattcgagtacccacagtgcacttcaaggctagtctcagtgcccctgcccggccaaatttgcctggatgacctcttgctcttcaagagagtgcctttttttttttttggaaatggattcttgctctgtcgcccaggctggagtgcagtggcccatctcagctcactgcaagctccacctcccgggttcacgccattctcctgcctcagcctcccgggtagctgggactagaggtgcccgcca

SEQ ID NO: 193498 - DNA, 589 bp, Homo sapiens
ctttgctctgtttatgtctcgtagttgtcttctctttagttaaatatcctgtttcctctctcttataaggtcacttgtaattgtatttggagagatgaggaatctctaaaggaattcaggggttggtggggagggaggatgagggccaaggcaggagggctattaaaggtgctctatgccttctgaaggtaaagggagaactaggaaaaacctcagtaggcaatccctagtacacatatagatgtactctgcacaaaggtgtctagcttgggggtatgagtcgggcctgaaatcatgccctagcaccatgcacaccaacttggggctggttcagaggcgtgtcagccaagagtaaacatatgctcacttgggaaaccatttttgaaatgtgaaaagccacttacatgcaagcaaccatctcaactaactgaagatgaatgtgccatagctctaaagttagaatgcctgaattcatgattcatggagctctctgggttttcctctctttattcctctgcagcattcagtaaagatgtctttaaacatgacagccttgtgttagttatgacatatgttgtctactcttggg

SEQ ID NO: 193499 - DNA, 500 bp, Homo sapiens
aacactgaatactaaactgattccctaccggatctgccggaagagaagcatgcagccatttgggaagctgagggtcaaggtcatttatattccaggtattctcagacaggctcttacatgtcagtgcctagtgcttgacagaataatttccctcctgagttagatgattcattggaaaatgaagccctcctgtcgagccctttcaaaaaaaagtctcctttctttactcccttaattgcagaaagtagaaagaaggtgattaaatccccattagcaacccagggatcaagctgctaagaaacctcagaattgcataagcaccagccctcttcactgcagtcagatgggccaaaacttggaagagaaattgacttgctgtgatggccgctcatttgacagccatgcctggccactgagccgtaaatctgacaacacctgagcaatgctctattttctaaaaccagacttcgtttttgttctgaagatgctgtggtttaact

SEQ ID NO: 193500 - DNA, 268 bp, Homo sapiens
ctttctggtaaacagcacccatacattttatgaaatattttagtctttagagaataaggcaaaaacagctccaggagtctagagctgacatcccctcaccacaaggccaagtcttttttttttttttttttttgagacggagttttgctcctgttgcccaggctagagtgcaatggcacaatcttggctcactgcaacctctgccccccagattcaagcgattctcctgtgccagcctcccaactagctaggattacagaagcaggcc

SEQ ID NO: 193501 - DNA, 407 bp, Homo sapiens
cattaaaacattttcatctcattacaaatgatttcttcctttaaaatttcccagaaagtatggcctctgtattttctgctgctcagtttaaacacatcatcaaagacagataattattaatgtcatatgagcataacaggagatttataaatcagaaatgtattttctgggaaccaactttcaagttagtcaggtaagttttattaacttcactggtgaagtcctaggataaagcagtgcctagatcaggcttgtttacccttggccttatatggcaccaaacactgtttcaggacagtggaagaacagcctgggaggccttcggccttggccagccttgccgaggcccgctcaccaggagaaataggaaggaaggccagtgagtgtgcaaaggagcatggcttatt

SEQ ID NO: 193502 - DNA, 241 bp, Homo sapiens
ttcatttatttatataaaattgtatttttcttctatgtagcaggcactatgctaggctctggggattcggtgtagagataacagtagtaacagtaacaatacagtgtgacaaatgctatgataaggagaagtcagccaacttatgtattaggggagctcatttactgtaggtatcagggatgacttctttgattaagtgcttgtaagtgatgactatttgaattagccaaataagaggtag

SEQ ID NO: 193503 - DNA, 574 bp, Homo sapiens
ctcccaggttcaagcaattctcctgcctcagcctcccaagtagctgggattacaggcacacaccactacacccagctaatttttgtatttttagtagatatggggtttcaccatgttggccaggatggtctcgatctcttgaccttgtgatctgcctgccttggcctcccaaagtgctgggattacaggtgtgagccactgcgctcagcctaatttaatttttaaaagagctggaatgcgtccattcctttcccatttgcaaagggctccagaatcatcccagatgatggctttcaaaatgatagttcaataagggagatttaggataaagtgcttctttctgatgcttcacttaagggtccctgagagtattagtttgctagggctgttgttaaaaaacaaaaacacaaactgagtgacttaaacagcaaacatttattgtctcccagttctggagactaaaaggctgagatcaagggtgtcaggaggattggctcctttcgagggctgcaagggagaacctgtggctctctcctaacttctggtgtttgctggccgtctttggcattccttg

SEQ ID NO: 193504 - DNA, 437 bp, Homo sapiens
aggtgatccacctgcctcagcctcccaaagtgctgggattacaggcgtgagccgccgtgtcaggcccacagctggtttttaactgaagaaaactccacttccacaggcctaaaactcaggtgaagcataaaattacgttcttgtttgagtcccttgataggcacatttctccttctggaggtaacaaatggagcagtcgtgagtccgagggaaggacggcctttctggctttcccgaggggggttttcatctatgattaagtctttcctttgcgtctgggtgaaatagaaacagcctagccccagggaccccagtctctggcagacccccacagcccagtgtaaactttttatgcctggggacaaaagacctcagttgtatgtgtttcatttagtgaattctttttttatttttttttgagacggagtcttgctctg

SEQ ID NO: 193505 - DNA, 301 bp, Homo sapiens
tggcatttgctcttggtgaagttggggtggatgacggcccactggaatgaacccagaagtgatgtgatctttaacactatcactctggctgcagtgttgagaacagactctgggtcaagggtagaagcagggaggctggtaaaggggaggctcaaaagacagtgggaaaggaaccagaagaggcttgtactgtggagctggagccaacagggttgactgaggacttggggtgtagaggagaagagcaagggtggcttcaaggcttccctgcatctgcccagcctggccctcacatcctgtc

SEQ ID NO: 193506 - DNA, 246 bp, Homo sapiens
tgactacaaagcaaaatctataatggataaactaaaaataaaaagcaagtatttaaaacatactaccagacaaaataaacccaaaagaagacagtaagagaggaataaaggaatagaggagttataaaacaatcagaaatcaacaaaatggcagtagtaagttcttactactatttataataaccttgaatatatatggactacattctctagctgaaagacatagagtcactgaatagataagaa

SEQ ID NO: 193507 - DNA, 128 bp, Homo sapiens
tttccttcctcaatctctacaccctcccaatgtggaagagaaaccacatccaggtggcatgagtgacttttctctccatattgacattggccaccgtgtccagcacacagaggaaacagatggaagat

SEQ ID NO: 193508 - DNA, 387 bp, Homo sapiens
ccatgtagagtagaatgttagcttcccatggggacaagtgcaggtaatgctatttgccaggatctgactgctaacaaaggaagtcattggctgttgtttacgttgcatatccatgaactttgtcctaaaggaagtaactgtatttggtgaagtctgggattatccgaaactctacttctcaatgttcaagtcaatatcatatttttcttaccagaagtctccacactcctggctgaggtcaggctataatgtagtccagctctaatttccaaaatatggagaccactgaacatctcccagctgcactcttctgtaccagctcttcacaggagagctttgcaataacatggtttcctgttacagccacacctcattttttttttttct

SEQ ID NO: 193509 - DNA, 276 bp, Homo sapiens
agcctgtccaatcccgcgcactccagaaacccagaacacgggagacattgaagccaagagtcgagtctttgggcactttggacgttctacccgggcagagtcagctgggggactccaacggccaaaggtccacctgctcctcaccgtctgctcttcactgcttcccccgcctgctcttcaccgtctcaaaagtcgccggcccctctacaggcgacaactgcagcttctccggcggaagtcactcgctttcccattcttagccccgcttcacacctt

SEQ ID NO: 193510 - DNA, 1396 bp, Homo sapiens
aagtggagctgaatccaccatcccttacgccacactgccattgcagacccaaatgggcacatggagaccagcaaccccatcccctctgtgccaacattgccaccattgtgaacacacatatgaatgccaaggcctggtgcctctctctgtgccaccactagcatgaacacatgtacagatgccaaaaactgccaccactgcaaacacacgctcagaggctggcagccctgtgcctgccagcagtgtgatatagtgccccacttctactggtgtgagtgtgagcaagaacactgaaacagcactctgatgatactgcaccccagccaacatgaatgcaccccagcacactgccactgctgctggcatgtgcaaatgaacacattccactgccaccatccctaaaagcgctttggctggcaccacctattgaaatattgtggttagtggtccaggaacacatcaacctctctggcacagctggtgtgaatgtaaattacttcagccagcatggaaagcagtttggtgatttctcaaagaacttaaaacagaattgccattcagctcagcaatcccattatttgttatctacccaaaggaatacaaatgtttctgccataaagacacatgcacgcatatgtttatcacagcactattcacagtagcaaagacatggaatcaacctaaatgcccatcaacagtagactggatgaagaaaatgtgccacatatataccatggaatactatgcagccataaaaaagaatgagatcatgtcctttgcagcaacatggatggagccagaggccattatcccaagcagagtaacacagaaacagagaaacaaatactgcatgttctcacttacaagtgggagccaaatattgagtgaagatggacacacagaaagaaacaacagacatgagttcttacctgagcgtggagggtgggaggatggtgatgatcaaataactaccaatcatgtagcatgcttcttacctgagtgacaaaatagtctgtacacaaaacacctgtgacatgcagtttaccaatataacaaacctatacatgtacccttaaaattaaaatacaggtttttaaaaaatcctcaatctaatggtctagaaactattggggaggggatttgttaaagattcctgaaatgttagcaaccaacagaccaagaacattgacactttgtaggtagttttagttcagattaatagatgcacatttgtttcacctggtaagtctgcagtcaggagctctgggagtcaatgctgtatgtttcaacaataaccggacggcaataacccggacgacaataacccggacgacaataacccggacgacaataacccggacgacaataacccggacgacaataactcggactacta

SEQ ID NO: 193511 - DNA, 319 bp, Homo sapiens
acaaaatcattataggaataaatcagttggaacagacagacgcatacgtggttagtactctatgagaaaactggggcttgaggggtagtatggaacaaagttcaacaagaaaacaggtcagaaacaccagtaccttgggatggtatcttgacctatgatgggggtgctcaggggaccagggaagggagtcctgctgatgctgctctgcttcagggtctcactcagggcctttgtgctagcagcagacatagggcaatgtctgaaaacaaatttggtcgtcacactgggagtggatgctactggtatctagtgggtggag

SEQ ID NO: 193512 - DNA, 491 bp, Homo sapiens
atttttgtatttttagtagagacagggttttaccatgttgaccaggctggtctcgaactcctgaccccaggtgatccatccgcctcagcctcccaaagtgttgggattacaggcgtgagccaccaagcctggcttatttctgtataccatattttgatgtgtaaatctaaaaaggaaagaatgagtgtgtatcatttggggaacattaatttgcaattgaatttgacaagtctataagtagctgccaaaaataagtattaaggcagttttggtttttatttgtttgtttgtttttttgagacagaatcttgctctgcccccaggctggagttcagtggcgcgatctcagctcactgcaacctccgcctcctgggtttaagcaattttcctgcctcagcctccctgagtagctgggactacaggtgcatgccaccatgcctggctaatttttgtatttttagtagagatgggatttcaccgtgttggccagg

SEQ ID NO: 193513 - DNA, 501 bp, Homo sapiens
aaaaaaaacacacatatatatatatacgcacacacacacacacgtgtgtgtgtgtttaaaaaaaaaagtctggccaaagtaaacacaaaaggtaaaaaatttctttttgacgcggtagccagatagagatctttctcagccccaaacagactgcatgtcttgcacgactgcgtctccttaagcctcaaggtccccgcttccgtagtggggttaataatagaagccagctcggggtgggaatgaggattaagcaggactaagccgctgtgagcacagtgcctggcgcaggggaaagcgcaggtcacgtagccattggggtgggggtcggggtcctgtgctgctgctaagttggggggtgggcggagggggaggggcagagctcagaagggggccgctgccccggcggatgcttggggctcctctcgggggacccctgggcgatcttccccaccgcgccgggcccaggccccctacccggccgccggcctcccctgcggccgc

SEQ ID NO: 193514 - DNA, 333 bp, Homo sapiens
cacctgggtggttggccagtttggtctgcagtgcaagcagggaattctgtccactctgagttttttaataaagtggaatatatgctatagtttccactgagttgaccttttatgaccatttttgaaaagtttgggaaatcctggcttagggcacctgtcttcacttctcagaaattctcctggtccctgaagtaataaggaaagataattaacaagtagactcttaccagttaggagagactgtacagacacagaactccacagtagcgccagagtgtcaggatttaccatcagatgttatggacacactcttgccctcagttttatctttca

SEQ ID NO: 193515 - DNA, 162 bp, Homo sapiens
accaaataaaggctggggtttggtgaatggtagtgttccaatgtcactcttttagtttcgacaacagtaccacgacagtatcagacattcgcaatctgggaagtcgagtactgggaggtctgtcgttgcctctagagggatccttctgctccctcgggggct

SEQ ID NO: 193516 - DNA, 392 bp, Homo sapiens
ttccagtctatgctaacaaagatgctaatttgaccgcattcctaagatgaatgaattcaccacgagggcccttgaagcagcaagtgtgtttcagctggcactacaacatagcatctccaggacgaaagggacttcagggtcctctagtctagtacccatttgcattaaatcccttcgatgaccttcctccaactagtcatctagtccaccattttccaggagagcttacaccatcagttcctgtggcttacaaacagcttcccaggctttgtgcaagacactggtatccagaaaattaacagcagctagctcagccttaaggcactcacattatagagaatttttagaaagtcttcacaaatctaccttcgtgttacctctccctatagctt

SEQ ID NO: 193517 - DNA, 298 bp, Homo sapiens
caccacgtgagttgagtttgtccaggacctgagctgtattgttttgtgatgtgggacaatcttctcgagcagtatcaatgcttctgagtcacaagggtcagaagagagttatttccctggggctacaactttctgagtttgcacaacttccagatgcagaattaatttcctgaggtcatctgcagcatggtgcagataggtcacttaccctgcaagcagtttggaaacctgatatctagaattgttgactattctgtgaaacttgtttctcatatcttatttctccacaatggcatgc

SEQ ID NO: 193518 - DNA, 361 bp, Homo sapiens
atggctgaggaggaagttgtagaaagagaatggaaaagcaagtaaaaaaggagatcattattaaagcaagaacttgcaagagggagaaggtttgaggtcaaaggcaagaggaaaggggtaaaaaaggaagaatgactatgttgaaggaggaaagaaaataaggatggataagaactgtaaatcaatttagagttgcaggagaagtagaataagtccagaatgataggaatctggaaggaaagatagaggatcatccagaatgaaaagaatagatgaactccaggaagaagttataaaggaaaattttcctgactgtaacaactatttcctctgtgaagtagggaaggtaatctgcaaagaa

SEQ ID NO: 193519 - DNA, 467 bp, Homo sapiens
ggaaatctagattgccaatgcaagctccagtttaagaaaaaggcccaagttaactaaccatggtttgacaaaaattacccagttcaagctgtggaattgcctgatgcaagatccaggctgcagcaggacatgtggttatatccaaggaccaacatcaccgcttataaaacagcatttcatgagatttcaagttaagggggtttagcaatccaccaactgcaaagctcaacatcaaagaaaattgaatgaaatgtctttcagttttgccattacttgcgtcttaaaatttttacaaacatacatgtgcacatatgcttacacatttgtatacattttaccaaatgcacactcatattattagaattagaaacaggttttaagatggtgaccagattaatttattgatttgaaatgtatcagctgagtacatattgctactatacattgttcttggtgctacagatttc

SEQ ID NO: 193520 - DNA, 491 bp, Homo sapiens
gtctttaaaggctcattgttgacaatcacttccctagatccaaaacttttcatgagagctgtggacttcagggcctgccttgttttctgcactatttcaaaatcaaagaactgtatttatttatttatttttatttatagagacgagatctcactatgttgcccaggctggtctggaactcctggtctcaagtgatccttccgccttggcctccaaaaatgcagggattacaggtgtgagccaccacgcccggatggattttcttttattggtctgtcttgggataatgtattttcatattacaacgtgctttaattttcctgggctttaaatttcctggaaccaaaacatagtttcagtctcttttacttttgtctttacatttgtaaacggttaacgggatttaatattagcatcctaatcgtaacgtgcatattggttggatagtatactatattactgaatggggtgatgctcaaagatcttggggg

SEQ ID NO: 193521 - DNA, 333 bp, Homo sapiens
agaagctgtattaaatctgtaacatctctttctaccctgagatcctacacatctattccaaggtgcctgctgtccctcttttccccctttagtcttctatttccaggtgtccctgctaacccttgggcttgcttgaaagccaaaaaataataataaatctttgaaatatattctacatgatcatctaaaaatgactacccccgttgaaattactttttcttaagacttaagaagttactttggtctctatgaagtctattttaggcaagtttctttatttgggacacgttcattcaacaaataatgatagaatggctcctatgctttcaacac

SEQ ID NO: 193522 - DNA, 301 bp, Homo sapiens
tgtctcatacaaagaattttcctgccacaaacagctgacaccaaatgctgattaagaaaataacagtccaccatggaagaattcaagcagagcagcgttgtgtattgggatggagtccggagagtattttcccaacattttcagctgtgttgttttattcagaaaatatttatgaaatattgtgtgtgatctgattagaaagtaacattttttaaaagtcaaaaagctggacacagcagctcatgcctgtaatccaaaccccttgggaggagaaggtaggaggactgcttgaggcaaggag

SEQ ID NO: 193523 - DNA, 246 bp, Homo sapiens
atgtcctcattgttgagaaagcatccctaagtatatctttgtgattaagaacgaataggtaaaaccactcaggatgaggacctgcttgttgttgacttgagccagttgatccttaaggagcaaagaagtcctcaaagatgaggagagataagttccagaaatacttttttccatgatgaaaagtagagacaagaaaagaggaacagagcaagacctaattttaaacttctggaggacagagattct

SEQ ID NO: 193524 - DNA, 531 bp, Homo sapiens
tctgtaagctccataccagggagatgacaatatatggtgttcacatagtaccagggagatgacaacatatggcgcgcacgtacaccacttccttcttccttacccaaggcagacatttctaatcgatcggggctccttcctggtggtgcaggtccagcctcaccatcctcaatgcacagcttcagtatctgccgatagtcggcgctgcccctagaggtgaaacctatcagccttgaagccctcaccttgctgccttaagacaaaaatgcttgctttgaaattcccacagagaatagcagaaatgactgagggaggactcagtcacttacaagagtaacttggttggtgcatccctctgtgtgggaggtggattgtatgcttcatggtcttagacattctgtcaccagccaatgagaggggttacccagggccacctctatctgttctctataccaccttgtctgctcatcaaaattacaactgaaaagcagaaggggaaatcccagactcggaaatgacagcccgagagca

SEQ ID NO: 193525 - DNA, 473 bp, Homo sapiens
gaataaaaccaaaaacgacaataatacatggggctgggggaaggaaatgtcctccagggacagctgagagctaaggtctggggaaatgcaagaagtgatcagagacagaatgattataattcttcaaaaagaatgttgcagactattggaataaaggcagaagaggttaaatggatgtcaagaccactacctttaggcacagaacattctactaagatttccatttttatgtaaggttaattttaatccctaggatttcaaaattctctctttcaggatcctgctcaccctatcttcactattgcatacctgaaacttcaaatcacctctctctataaaaatttaagggtggagaccacagtcattgcttcaaaggcatcaaagtagaacatatctagaagctaactgcatttcaaccaaaatattgatgaaaatttattacaaactagtctctctccagacccctgctttta

SEQ ID NO: 193526 - DNA, 393 bp, Homo sapiens
ctagtatggaactcaaagtctcccaaaacctgttttgtctcctaatatattattcatattacattgtcttacccatcagtaatttttatcagactgaagacatgccttgcctttcttaccctttactattcccttaattttaaatacatttcctgtattttaaaacaaatgctattctttaccatttaggtcaaggtcacccattcattaaacatatcaggcccttaacatgtgctagggaaagttccagatcctggaggcacaataatggaaaacacatgctgttaccctcaaagtgtcccagggtccagtgtgaagcctttcctaattacttctgttgaaagcagatttcttttcggctgggtgcagtggctcatgcctgtaatcccagca

SEQ ID NO: 193527 - DNA, 510 bp, Homo sapiens
ccttttacacaaacttccagaacacagggaaggtgttcctcagctcactggcaaggctgccacccccacccccacccccaaccacctaacaggacaaggacagcacaggaaaagaaggttgcagccagtctcatgggaccctcaacagaacatcggcagcttgattccgcagtgggtggacagacctatgtgctggggcaggtggagcttagcccagatacacgaggatgcttcatccttaggggatcctcagcagaacatcagcagcttgatcccacagtgggtggacaggcctatgcactggggcaggtggagcttagcccagatacacgaggatgctgcatccttaggaagtctctcagttagtacacagacttcaaagccgaccagagtctctcagttaaagtacacagacttcaaagctggatatgagtcctgcctccaccttttccaagctgggtgaccttggacgcatgtctgggactctcagagccttggcttcctcagctg

SEQ ID NO: 193528 - DNA, 412 bp, Homo sapiens
tttagtactgaaatcccacatcctgggaaacctatgcggttggccaccttacgggattgcacacttcacagatgtggaattgtgcagtcacacgtgcccctctctcagaatcgccctgtgcttggcttaatgctctgctattgccatcttcaattcttagtaatttttcaacaaggggtcctacgtttttttgcattgggtcttgcaaagcatggagcccatcctgatgacttgtcaccctatattctggacctgacaactgttttgctctgtaagttggctttctgtctcctgccaggtggagcccactgtctggagggacccttacagtctggttccatcttccctgttcatattctttcccaccatagccacctgagaccatctagttttctggcctctggtctctggg

SEQ ID NO: 193529 - DNA, 410 bp, Homo sapiens
agccgagcaatacatcaactcatgacacgggagcctaaatcccctcttttggtggtctctcgtctgtaggtactgcaaagggtggataacaagataatgagccatttttcctgtgttcagggtacatttgggtctcaaaacagtcggctctggaacagcctaaattccaggcagcacctggaaggggagggaaaccccactagggtgtgcttttctgtttgctttttagggtgtacacagaacagaaaaggtcttatgacattgactttcccttctcctcatttcacagatgaggagtcaaggagtcggagtctaggtgctgggcagggatgaagaccttttagggacccctggtggatccgtgttagaggccagatcagagctcagttccctcctgattgctcagcgct

SEQ ID NO: 193530 - DNA, 178 bp, Homo sapiens
atgtatccagagtgatctatacacagaacactttcactcttaccctttatggaagagactgctaattgcttactggtacccaccttccccttcttacttttactaatggaagtcactgaatggtagctgggcacccatgcctacctttcttagtctcccttgcagctaggtaaggaca

SEQ ID NO: 193531 - DNA, 569 bp, Homo sapiens
cggcattgagtgggtggtggtggggagacaaaaagctccttgatgtggccagcacgtagaacaaaagaggggatagttcacagagaggagttaagtagcattcagatgatgcagactttatctataaagaataaagaaccactaaagggttttaagctgaaaagcagagttcaatttacattttagagaataccctctagtagccatgtgaagaactgatttcagggcagtggtctgagaataagatggtggggaccaagagctatgtagcgtgaatgaaaaagtgaaggaagttttaagaatcacggtggaaaccatcataatgccaggatgaaggtcaataaaaacttttacacttgatcatgacaaaagaatgctattcactatagtttacactccttaatgacagactcaagtagacgaccttactgacatcttagcctgacagttcctaaatacaaataaatttcagtgtactgtatgtagactaacacagtaaagttatcactaagaactgccgcatattccaaagctcaaaatctgaaatccttcttgctactccggtacat

SEQ ID NO: 193532 - DNA, 422 bp, Homo sapiens
ctacatcggagtccctaaatttggtattgagcgcccctacacagatgcagcacctggagtgattagtgcccaagtaagatttagccatttaaggttcagaatgtcctctctttatagaatcaggtgaattaataaccaattgactctatgattttagtcatattggctaatgctatatggacaggtctatcataggaaggcaagggagttgacaactactttaagaaatatttacaaaccattctacagtttcttcatagggcatatgggagcctgatgcttcttaccagaaataggtgaataaaataggactcagatagatgttcatataggtttttagaaaagaaatagtctttgcccagagagcagaaaagattacaaataaattaagactacagataaagccctttttaggattatgc

SEQ ID NO: 193533 - DNA, 208 bp, Homo sapiens
cctccctccttccagcccctggcagccacctcagcgcctttcggttgctataattttgtctagcgtaggcacctcacggtctagtggaatcatatggtacttgtctttttgtgactagcttattttacttagcataatgtcctcaaggttcatccacactggaacatgtcagaatgtccttcctttttaaggctgaataatattccat

SEQ ID NO: 193534 - DNA, 168 bp, Homo sapiens
catgtcctgaaacatgcctttagagaatctttggcttgaaaaagatctcttggctgggtgagatggctcacacctgtaatgccaacactttgggggctgaggcaggaggatcactttggcccaggagtttaatccgagcctgggcaacatagtgagaccctgtcacta

SEQ ID NO: 193535 - DNA, 277 bp, Homo sapiens
agtagagatggggtttcaccgtgttagccaggatggtctcgatctcctgacatcctgatccgccagcctcagcctcccaaagtgctgggattccaggcgtgagccactgcgcccagtcgatatatttataagtggtattggttagttaatgtgaatagtttttaacaacttcacatacagtcattgtttcttcttgaaattacttctacactaatttaggcaagatagcaggcatccttgtcgacgcggccgcgaatttagtagtagtaggcgccgc

SEQ ID NO: 193536 - DNA, 592 bp, Homo sapiens
caacagctcgtgaatcgcgccgccctggcaggtctccgggggtggaatctggatatctcatagtccgaatcatggctggaatgttctcatagtctgaagtgtcaacgtgttgactttcaggatgaagagaaggggccaatagagagggaagagaggacagttgatgaggcaggctccaagagaggagggcaaagcgagatcaggggctccagtgaaatgcctgagtgtgatgagaagagcgctgtcttgtgaggctagagagggaaccaaggatgggtgggcctgggaaggctggagaggtagcctgtcagggagctgctaacccacttagaaatactcttattgacataacaaggttttttgttttggttttttgtttgtttgttttgagagagcgttcgctcgttccccaagctgaaatgcaatggtgcagtctcagctcactgaaacctccacctcctgggttcaagcgattctcctgcctcagcctcccgagttgctgggattacaggtgcatgccacgggtgcagtggctcacgcctgtaatcccagcactttgggaggtcggggcgggcggatcatttgaggtcag

SEQ ID NO: 193537 - DNA, 393 bp, Homo sapiens
gtagacgtggtgactccacgcttcgacatttcatgaaccactgaaaaataaaaaactgggagggaactccaaatagcgatttggccacatatagacgtttgcacaaacatcaaaatcaacacatcacaaaagaaagaacctttaccaagaaaaaaaatgcaacgaacagcatctcacaatgaaggtttatctcttaaactgaattaattaagtttctgaggtgttcattgcaatggccctattatccttactcactgacgatggggatgctgggagaattaagtgagaagagtatcaacagagagacaacaaaaatatgcaggaagtagtagtgccaaggaatgtgtgagcctcagagaacaagactagacggtcacttcgttccacacaata

SEQ ID NO: 193538 - DNA, 525 bp, Homo sapiens
tatctgaatcagagtaggaggctcctatctgaatccagatagcacgtcctcattgctccatgaatggcaaataataccttcaccattatctaactacttttagatctttattcaaacaactcaaccttcctggaaacaccctacactcatgtctattacttttcttcaagatccgggaagcttttccgggctgacttcaatccctactcttcaaaatgctctgtaggtattctcctaacaatttaaaaagtttctccagcctgggcaacaagagcaaaactctgtcttaaaaaacaaaagaatattggaaataaggaggagtgaagagtgaaaattttaatctctgtcctgctctctgggagagagagtgctctaattttagacaactagacattatttttagacagaaccattgctacagaagggcagtttgccataatttgatagaactgttgcctaagaatgttcaactttcatttgttccaattctctgcttatcaagcaactttctgatctctaatctgg

SEQ ID NO: 193539 - DNA, 166 bp, Homo sapiens
caaaagaccaataatcaactggaaaaataggcaaaaaccaggaacagacaattcataattaggaaacttgaaaagtccaataatctggaaaagatctcaacttgggtaataagcaggaaaatgcaaatccaaacaacaataaaataccaaacttggccgggcacag

SEQ ID NO: 193540 - DNA, 496 bp, Homo sapiens
tttatagctttctaaaaataactgctggtaagctcgtaagttcattagttaatcccaatgggactcaataacgcatattacagatctcctgattgttatatattagattttctcaagaattcccttacctgttattatcaacatagctatattgacagggtcttcattacttcctaattgcccatactcctttttcttgttaaagatcaatttttaaaatcaagccttgtcattttggaaatatcatagacatattatcctgttaatattaatgtgtttcatatctttctagtttcctgcctcctttatcatagtaatttacaaagtttattcattacctttttctttaaaaatgtattattttgtggggggcagggtgagagggtaggggcacatgtttgggttttttctccctggaacaaagatataaaagatgatctttcatattcaaaggtgaacaattgatattccctattctaagccagaccctaggaag

SEQ ID NO: 193541 - DNA, 815 bp, Homo sapiens
tgccatcaccctaaattattatgctgaagctctaatactcaatgtgatggtattagaaggtgagcctttgagaggtaattaggtcatgagggtggatcccttgtgaacaggaatagtgctcttataagaagaaacatcacagaaatgacttctcactgccatgtgaggacaaagcaagaaggcacctgtctgtgaaccaggaaaaagaccccaaacaggaaccaaatcacctgacaccttgatcttggacttctggcctccagaactgtgagaaataatgtttgttgtttaagccaccctatctaggatattttgttgcagtagctcaaagagactaagatgttatgcttgttagtagtactctaaggcaggcagaaccccaaattatgagttgctgctgaattgataccaggttctgtagcagttgaagaactagttatcaaaaagtgagaaggtaactgagagtactattatctacgcatctctaaaaaacatatataataaattgttaagtccatgttttttctggattcattataaagctttaactttgcaacagaataacattaaatactccctataaaatttgtgaaattctcctctccatgtaaactcagacaattcaagccatggcagatttgttattattttaaaataacttagggtgcgttcatcttcacagcatatgtggacaacagtgttccataaaatgcagtacttgaaaaagaaacacatattcttggaaatactctatcacactgtgccagcaatgccatctatcatatgcatccataataaatttagggttgatgagc

SEQ ID NO: 193542 - DNA, 555 bp, Homo sapiens
tacgatcgaggcggtaccgactgcatctgtgcctcactgcaacctctgcctcctggttcaagcaattcttctgcctcagcctcccaagcagcaggtgcacactgccatgcccggctaattttttgaatttttaatagagacgaggtttcaccatgttggccaggctgggctcaaactcctggactcaagatccacccaccacggcctcccagagtgctgggattacaggtgtaagccaagatcataccactgcactccaccctgggtggcagagtgagaccacatctccaaaaaaattaaattaaaatttttttaaaagagttgaaagggccaagcagggtggctcatgtatcctataattccagcactttgggaggccaaggtaggtggatcacttaaggccaggagttcgagaccagcctggccaacatggtaaaaccccatctctactaaaaatacaaaaattagccggccgtagtgacaggcgcctgtaatcccagctacttgagaggttgaggcccgagaatggcttgaaaccaggaggcagaggttgca

SEQ ID NO: 193543 - DNA, 334 bp, Homo sapiens
tcctagaggtatcccccgtcccttccaccagcataaataagaggcctaatgataataatggctaatagttaagcacttaaaatgtgtcaggtactgttctaaattctgtacatttgataatccataaaatctccataacagcactatgaggaagatactgttactttaaattttgcatcagagcacagagaataggaaacctgttgaagattccatgcctgttaaatggtagagccaggtttcaatcaggtcacctaactgcacagctccctctcaaaaccactctactttctgcctcaaatttcaagaccgagatttccagatgcctttcagt

SEQ ID NO: 193544 - DNA, 342 bp, Homo sapiens
taataccaatccttcaaaaaatagaagaggaaacatttcctaacccatcctaggagtccattattggccctggtaccaacaccagacaaaggtatctcatccacatatataaaccaacaaaacacagaatggatatataccaatatccattatgactattaatgtaaaaatactcaacaaagtatcagcaaatgaatgcagtgacatttaaaaaggattatacatcatgaccaagtaagatttatcccagatattttagatgggttcaaaataagaaaatcaatcaatgaagtagtatatattaattaaataaaaaacaaagatcacataatcatctcaaca

SEQ ID NO: 193545 - DNA, 265 bp, Homo sapiens
tgcagtatttgtccttcttcacttagcgtaatatccatcacttagcaacaaggttcatccatgttgtaacttacgacgagatttctgttttaaggctaatattccactgtatgtatacaccatatttgctttgttttttcatttaagatggattttaggttgttactaccttttggttattgtgattaatgctgcagtgaacaagggggtggtgcaagcatttctacaagattctgatttcagttttttttgatgaatatccaga

SEQ ID NO: 193546 - DNA, 451 bp, Homo sapiens
gccaccgagcccggccaagaatcagtattcttaatgctttccaaggagggtaaacagtggaacaccgaggtcatgattgagagatcggctgtgcctaaatcctgccactcactctggacgtagtaaaggtctgagagattgccggtgaatttggagatatgaacaagagtccttcactcaaagaacaaaggagacatcccgggaagtcacaaaaccaagtctaggttcaggtagagacttttaaaacagtgcagatccccagaccttaccttttttgatcctggtgagtgagtgttggtggggcctgggatttgtctgggaggctgcccaggtgcttggggtcacactgtctcaagacccacctgtgctggtgcagcatctcggaactgaactggacgccccacttggcacagacaggaataatcttgcagatgctcagtcgaacggactt

SEQ ID NO: 193547 - DNA, 276 bp, Homo sapiens
gtcactgaacttggaaggcaaaaacttggattcatgtcccagcatggccctcaactatgcaacagccgaaaaattgtttactaactctaggtcctaactttaaagtgtagtccttcaatgatgtgattcctactgtctcttccagctctaaagtaaagatgctaagaaataaagatgataatgctaccattatctggcatgcaactgacggccacgggacaggcgacttattgatgtacatcaaatcctaaacctgtaattttgttcagcagtgtc

SEQ ID NO: 193548 - DNA, 519 bp, Homo sapiens
ttcaagttgactgttcagtgaaggatggaagttatgaaacaaggtgtgtgcatgccgcccttcatattaaaagaaaaatccacgcacatggatgtttgtatgtaggatctcttagaggtggctgttactagactggggacgagggacaagcaagaagaggagttactctagttactctatattgtatccttttgtaattttgaatttgtgtcataattttgtattatgtgcatgtacagcctgatcaaaataatcagcatgttgctaaacagacgccatctctagaagggtttacagtctttacagcgggtcagcatgttgctaaacagacaccatctctagaagggtttacagtctgtacagccgggaacacatggaaatggtgtgggcaccgtaaacatccggaaggcgttttgacctgcagaagtgacgtttagcctcaatagtcagagcattcgttctcagtcatgtcacttaaaatccagcgggggctgggcgggaggccaaggcgggtggaac

SEQ ID NO: 193549 - DNA, 711 bp, Homo sapiens
ttatcccaggtatgcaagtctgattcaacattcaaagttcaattaataaaatccatcactcaacagactaagaaagaaaaaacagatgattacattaatagatgaaaatattggggtttttgttggatttaacaaaataatagcaacaatgcgttcagttaacagtgcttacatatatgcttatgtataagaaatgagtaacagcaatgataacaagggatggaaaagaaaagttagggttattttgtcatataggatacttgcactatctgcaaagtgctatagtgttattacaaaatggacttcatgattcatttcattcatttatgataaaaactctcagcaaactaggaatagagggtaacttccttagcttaacaaatattttctacaaaaacctacagctaacatcgcacttaatagtgagaaaccagaagctttcccaccaaaagcaggaagaacgcagtgatgccacttctcaccactgtttttcagcatcatactggaagtcctagccagtgcaataagacaagaaaagaaaataagaggtatactgattgagaaggaaaaagtaaaacaaataatgtcatctatgatcatgtctttgttcacagatgacatgactatctatgtataaaatccaaaaaaaaaaagactaaaaatcctcctggaataaatcatagcaagattgcaagatataggattaatata

SEQ ID NO: 193550 - DNA, 545 bp, Homo sapiens
tcagtgtgttttgcccaactgaaactcctttccactttgtaacctatttgaagcccatctttatttcattattttttaaacacagcacagggagaatcaaaatgagtttccaaagaggaatgacaaatgacagcacatatcataaccaggtattttctgatattttttcatccatgcctcttctcaacaccaacagttactaaatgtccacacctcagaactcctgataagtaacagcaataagccgcattggagcagagtaaagccaaaatcttcacggtggtcttcaagagcctcattgtcaagattcccccatccctagactaacgcctgccattcttccctctccttccactactccctggctccctgggagccctcttcccctagatagctgtattgtgacctccctcaacaacttcatctgtttgctcagtcactttctcaaggaagcctaccctgcccaccttatataaaatcgcaaaaccctttgccctggaattcctgaacccctttatttgctctactttttaaaattgcatttg

SEQ ID NO: 193551 - DNA, 1068 bp, Homo sapiens
gccgagatcgtacaactgaactccagcctggggtgacagagcgagactccgtctcaggaaaaaaaaaacaaaaaacaaaaaacgttggaacattgtgtagagatgagcactggataggggtttggaaacctggattctggtcttggttctagtgctaacaagccatgttatactgggcaagtcccttctccctgtctgtgaaaaacaaaggaactgtgttcctgaaattctctgcattgtatgatcttctacaacaaaaatgcaagctttgctaaagcagtgttgtacgccttgtctggggctgagtcctagaatggttcctggtaccttgcagatgactcaggaaatatttattgctattgaacagcttatggtgtgcactggccacagaaaaggctctgttgcatgtataaagctgtagttatttttcaaaaggctttcagttagcaggcactcaacactcacgggtctgaaatattccatttgttctcaaggggaacacaccttacttgctcatacagaaatatgggcatggaggagcctagtggacgggggaagaagacaggcttaggagtcagaaaatctggctcaccactaatgactgtgtggctttgggtaagtcattctgttctccaaagttccgtgctctcatctgcaaggtgagagagctgactcagaccccgggacccttctagaggcacacctctgactctggtcctcttattcttgtaatagataacaaacgaatattaagcgcagatgaaagcattcagaagaatgtggggctgatgaggaacaaaggcaagaaaattagcacagaggcaccagctcattagaaacatcaagacaggcagactatgctttttatgttcaccacataaaatcctttatgagcatctgctggggtgtctcttcctttgctgttactggctcagcaaagcaggtcatgccctcagccatgtctgctgcccaagtagctgtcacagggaggtagcaccaggagagaaagcctgccagcttgcaagtccatggcaatgtccgtgttctttaaaccgcccaattgtggtg

SEQ ID NO: 193552 - DNA, 559 bp, Homo sapiens
agctggcatcaggaaaggagagtctaactcccaagcacttactagactcacagtctctctccgttttgttttgttttattttttgagccagggactcagtctgtcacccaggctggagtttggtagtgcaatctcaaactcccgggctcaagcaatctccctgccttgccctcccaaagtgttgggattacaggcatgagctaccatgcctgccccctctctcagtttaacgagagagtggctacttgcttctcgaatagaaaggaatgtcaggactgggcatagtggctcacacctgtaatcctagcattttgggagactgaggtgagttgattgctcgagctcaggagtttgagaccagcctgggcaagatggtgaaactctgtctctacaaaaaatacaaaaattagtcaggtgtggtgtgcctatagtcccagctacttggggggctgaggcaggagaatcatttgagcccaggaggttaaggctgcagtaagccgtggtcctgccactgtactccagccagggcaataaaatgagaccctgtctcgaaaaaaaa

SEQ ID NO: 193553 - DNA, 335 bp, Homo sapiens
gaaagaaaggggcggagaaagactgatacagatagaaaggctgggagcattctggattacaggagactaaagaatactgacagttgaatgcaatatgccatcctgcactgaatcctgcactgggggaaaacagttgcacagaacatttgtggaactacttgggggaaatttgaatatggattgtatattaaataattttattgcatcagtgactcatttcttggggttgataatggccttgtatgttatgtaggagagtatccttcttcttgggagatttatgtacaaatatttaggggtgaagtgtcataatgcaaattactttcaactgtttc

SEQ ID NO: 193554 - DNA, 215 bp, Homo sapiens
aagtgtaggtaattatactttaaagagaacttgctttgtacattttaatttttataaagaaatgagcagttatctccctgacaccttattaaatgtataattaaccttatgatccctagctcacttgtgaatgcttggcagtataattggagaggaataatgtttctttttttcctctttctttgcagtcctaaaccttattctgtggttgttga

SEQ ID NO: 193555 - DNA, 369 bp, Homo sapiens
aagtcctccaaggcagccaagacttgaggggccacgattccaaagaaaaaggaaatgacagcatgttccacttctgaagctgcctgtgcatgagaggaaaggctatggggactaagcagaaagcagctgctcagaagctaagaagctcagtaatgaattcaagagtctcatagtattggggaatgaaaaaatggagttcagagacaaggaggggaggtttctacaaaacacaataggctttcactggagtcctgggtcccctcaacaaatttccactttgtctcaagagagagaaaactataaatagattggttaaccttcacatggcctgaaacccatttccttcccttcctccctccctccctcctt

SEQ ID NO: 193556 - DNA, 445 bp, Homo sapiens
tcacaaggaagaaacacatacaaattatttacaaagaggaaagttcattttaaggatgcacatgggctaaaaatgaaatgacctcactattggcacaggtcctaagattacattctctgagaatacacaatgaagaaatgggcttcatgtgtaatagcgacaataattaacacgcgtactgagcagttaattcctttcaggcaccctgctaagtgcatcctaaccactaagccttttgatcctgatgaaacatgctctgagatggatcttgctcatgattggaatggtgtaaaattgttgtataaaatgggaattgtatatggtgaagaaactcaggcttgaggcggttaaggaggtcttccaaagttatttcgagagaggatggcagagccaggatcccagggacagacagccactgagtcagctgtggcagctcgagggatgt

SEQ ID NO: 193557 - DNA, 323 bp, Homo sapiens
gctctggtttcagatgccagcagcctccccggccgacctagtgtctcttttcaaggtctgcccaggatgctgcttcccggcatgcaccttgtttccatgttgtcatcctcccatggcttcccctgccctcactcccctctggctggggaagtgtttcccaatcctttgaccattcctccccaaaagcattttaaagaggcggttgcaggactctgagctggaaattgaatttgagtttaaactccacgttaagctgtcagcatacacaaacacccaaattatgccatgatctcaaataaaaggaacattttttttccctcttt

SEQ ID NO: 193558 - DNA, 602 bp, Homo sapiens
  misc_feature (456)..(457): n is a, c, g, or t
  misc_feature (490)..(490): n is a, c, g, or t
ctggcccatcaaggagtccctgaaggccatgattgcctgggaatggacgatagagaaggccagggagggtgaggaggagaagacggaaaagaaaaaaacgcggaagatatcacaaagtgcccagacctatgatcctcgagaaggctacaaccctcagccccccgaccttagcgctgttaccctgtcccgggagctgcaggccatggcagaacaactggcagaaaattaccacaacacgtggggacggaagaagaagcaggagctggaagccaaaggcggtgggacccaccccctgctggtcccctacgacacgctcacggccaaggagaaggcacgagatcgagagaaggcccaggagctactgaaattcctgcagatgaatggctacgcggttacaagaggccttaaggacatggaactggactcgtcttccattgaaaagcggtttgcctttgnnttcctgcagcagctgctgcgctggatggacatntctcaggagttcattgcccacctggaggctgtggtcagcagtggcgagtcgcaaagtccccacatgaacaggagattaaattctttgccaagatcctgctccctttgatcgc

SEQ ID NO: 193559 - DNA, 309 bp, Homo sapiens
ctttattagaacttttcctgatatattacagaagtataaaacagttatgttctagtgtctaactccatttcagaactgtaaactgcacaagtacgttggctaaaatcacagttttaatttgttgctcatgctgtctagctgtcacaagatatcataagtcaatctgaaatcatctacattgatgatgattttgttaactttacaaacatctttacactatcaactatgtgtcagaatagttagctaactgtatggagctcacactctagcaatgacagaaagcccttaatgttctaaatgttcctctag

SEQ ID NO: 193560 - DNA, 470 bp, Homo sapiens
ctcagcctcctgagtagctagggctacacatgtgcactaccatacctggctaatttttttatttttgtagaaatgggatctctccatgttgcccaggctgatctcgaactcctgggctcaagcgattctctcgtgtctgcctcccaaattgctgggattacagacgtgaaccactgtgcccaattttcctgcttcttcctaatctcttttcctccctctgaggatgaggataattcccaaagatgctaacaaagctgtgaatgtggaggaaccagaattttgctctgcgtctagggcaacgttttatttggttgttagaaacacctaattaatatacacaattttacttcacgtgcctgttgtttcttgaaaggcgaggggttcctctttgagtatcatgcaatcccatctttatcaaatgttatttgagaaaactgccactgaaaaatcaataaaacagttattggaaa

SEQ ID NO: 193561 - DNA, 968 bp, Homo sapiens
cacagatgcctatccttgggacatacactgcttgattgctctcctggctagagataaccagaagctaaaccttgttaaaataaatgacctaagtaagacaactttctcctccaggaccttgccctttagttatctcttctttctgtatcatccatatcattagtctctgctggctttccactcaggctacaaacccactcaaccctttaaaatgaaacagacagaggagagagagattgtcccgtgtctagctaatgccccttctctcctttccctgtcttaaaagagtgttctgactacccagggaccacttgtttacttccatttactccttaacattggcagcccgatctcttccaccattccagtgaatcctctctgcagaatatctccagtgacctgcacattgccagttttccaatccatatcttcctaagtctctgtgccatttaaaatttttgactactcgacgctcccagatactcattactcccttgtgcgggatccttctcaactaactcctgtatctacacctaaatataactttttaggattatctctgtttttcttgtggagacagggtctcggtatgttgcccgggctcttcacgaacttctggcctcaagcgatcctcctgcctcagcctcccaaagcactgggattgtaggcgtgagccaccatactggccgatgttttaggattctcattctgggcaattgcgcttctttctactgacttttcttttgtcatttcatttattatcacggctgcagctcccacactcacctttatgctactgcgtgagctccctcaccataatcctgtccttactgcttctctgactgctgggacgtaacaggaggccctcagcctcaagataatttttttcttctgatatcagctcttcctcctgcattccctccctcaggtagtgcatcatacactgaaatagaaaacctagtcataat

SEQ ID NO: 193562 - DNA, 416 bp, Homo sapiens
tgatctgaggatccccagactaacccactctgctatgaagaatatggcgaaaggtccggctgcatattctacgttaaagcctgatacaagttctgactctccttctgtaaggtcgaacggggctcggttggtttctgctagggttgagataaatcatattatggctaggggtcaggatgtaaagattattcaaatgtgctcttgtggtgtgtccgggtaatgtgtgatgtgctttgttgtgcatgtgtagtacacaaatgtgatgtgtatttaggcttgtatggagtgtgtgatgtgtgtggtgtgtgtatgtgctgatgggatactgtctggcatgtaagcacacgcatgtgtggcgtggggtataatgtgacatgtgtgcacgtgtgtggtgtgtggttgtgggatatcgtgtg

SEQ ID NO: 193563 - DNA, 456 bp, Homo sapiens
tgcgccgcccgccggttcaaagttgattctccatgtcataatgaaatcaaacacttgccaggaagtcaacaggagagagaaaggagttataaaacacaggcatgcgactccttctgtagctgctgtttttaaagaaagatgcgagaagaaaagaactgtaatgaatggcgcagtgacgctgacatgttgtagaatgtgctgggatggagatttttctttgcaagcatcactgagcatccaagaagctaagaaacagtagatgtagagagtctttgaagaaccacatgccctaaatatcgtacttgatgacatgtcttctgggttcaaatccctatatatattgtccttctgagtgacgctccaggtacaatcgaatttttctgggcaagtatctttgcttacatgtgtaaaggtataaaaactaccatttgggcggggcacggtggctcatgattg

SEQ ID NO: 193564 - DNA, 319 bp, Homo sapiens
ttttctttatggtgataaattcctggaaatcttggtaaaccccagctttatttttctgtaacagaatgcacataaaataggtaaagcacatacaggaggtaaagttacgctcattttgaaagcaaaggaatgtcaagggtcttaatggctgagattaagattttgaatatgtggaaataataatagattgaaaatgcagttgaccaccagtttatggaaaggaaaatacatattttggtggttctgtttagggttagagtctgggaagataaatatatactcaaaactaattgttttgtaacaaaaggcaaagggcagt

SEQ ID NO: 193565 - DNA, 318 bp, Homo sapiens
gccaaggtttgattgctccataattaaccgcagtgcaaataatatctgcatctataacttccagcgatgagatcagaagccaattgaatttggcactgattgaagctgtaaatatcccgtggtgaaaaatgataggtttgttctagagggaaaacttacagaaatggacatctagcaaatgtgatcgggggaaagaaaagggcaccagaggaaacggcaggaaggaagccttacctttcatgctgcctttttccaacattaaaacaactcttttttcacattccttttggattagtgactaggcgtgctatatttcct

SEQ ID NO: 193566 - DNA, 322 bp, Homo sapiens
ctggatgcaaggtcggcccacctggttccttcctgctctgtgtgagcagctcaggccctcactgagagtctgtttccccctgtaacatgcgggttcccgccttgcccaccacccagggtgcactggggcagggagggtggcacagctctcctgctggacctgcagcccatcttccgggtgtctgacctcacctgcactggcgccacctcctccaggtagccctccactcccaccacacccgggccctgtctgagctgctccaaccctgtccctgtaggaggcattgtggcccgtggtgggcaaacatggggcttgtggctca

SEQ ID NO: 193567 - DNA, 222 bp, Homo sapiens
taactaacgtatcttccattctttctcaaagacattgcataactcgatccatctctctcagtcttcccccgtccgcccctctcgccacctaataagctactgtgatcatgctccgtggatggcagaatgagctcacccctccacctcgcccagggacctctggaagaccccccagggtcatgtaccccttcctcctggctgtcctgccatgacttattattt

SEQ ID NO: 193568 - DNA, 286 bp, Homo sapiens
accttcagacacatacataccccaaaagaaaaacaacaaaaattatcaccaagtccagatggtgttactggtgaatggtatcaaacattgaaagaagaaataatgctaatcttataagactctcaggaaactgagtttattttataaagccagaataatgagtatacccaaacttagaaagacattacagaataagacaatgataaatcaatatctctcatgaatacagacacaaaaatatgcttaagaaagtattagcaaatcaaacctagcaatatgtaaaaaa

SEQ ID NO: 193569 - DNA, 474 bp, Homo sapiens
gagatggagtttcactcttgttgcctaggctggagtgcaatggtgtgatctccaactcctgggttcaagcagttctcctgcctcagcctcctgagtagctgggattacaggcatgcgccaccacacccggctaattttgtattttgagtagagacagggtttctctatgttggtcaggctggtctccaactcccgacctcaggtgatccgcctgcctcggcctcccaaaatgctgggattacgggcatgagccaccgcgctcggctggatgaatataatttttattgatacaatttacatggatgagtgaccattttaaatcgtacaattcaataatttttagaatactcacaaggttgtacaaccatcaccattatctaatttctagagcattttcattacctaataaagaaccacatacccagtagcagtcttttcctagtttcccctctccccagaccctagcaaatgcag

SEQ ID NO: 193570 - DNA, 144 bp, Homo sapiens
tcttgaacaccatcaagtctagacttggtggcttcatatttctatcataatccctgggggtaagaaatcatatagtcccaggttgggaaggggaaaacggtttgcaacattctcctccttgtaggaggtgagctctgtctcact

SEQ ID NO: 193571 - DNA, 230 bp, Homo sapiens
gctatcgcccaacactttaaatatctcaagagcataccacattttaaacacattatggtcatgtagctatttcaactattcctgggagtgttggggataaatcactcgcccaacacccccctcaccctcagctctaagaaactattactgcattttctgtctcgacaggtttgtctattcttaatgttttgaataaatgggctcataccatatttgatcttttgtgttgg

SEQ ID NO: 193572 - DNA, 258 bp, Homo sapiens
agcaacttaactcttacctctctgagcctgttttcttatttacagaatggggctgaaaatatcagtctccagcatctttttgagaacttaatgagatgacatatataaagcctctattatcctgtctcagataaataaatgttagcaatgttagttcttttcttcctctttcttctttcccataattctctacccaactgcactttcttcaacttttgacaatagggtctgatacaaaaagagtaaaaaaaaaaaaaa

SEQ ID NO: 193573 - DNA, 673 bp, Homo sapiens
atatatgcttaccattatttagctcaatctatttatcacttcaaggatttttaaaaatagtttataagaactgtacctatactttattatggccaatgctcaaaaaattattgagttggcagcaatgccaccaggtcactggaatgcagaggaaggcatctgtttgacatggtgctgactattggcaaaaaagggcttctgaacatatcgatcagccaaaggggtagcctgttgcttaaagggcagttacagctgcttatggatgagtctactgttacaaaaccagcaaacaaagggaaaaactggttcagagaagctgcttcaggaatatacagcttgcacaagttctctccacaagccaccagttagttggaaatatgatgggtacccatcctaataacatagcaagttcccctccaatgatgtggctggcaggctcatgccggccggacggcgggcagcctgctatccatactcaaaaaggtgattctctctagtagactttaagaaagggtcagactactgttttctcagattagaatcatgagctgccaactggtagtctaatcaaatccagctcatgacatgatcatttggccaggccaaaccttgaaagcttagacaaggcatctgctctgagtttgccaaagtttccaccactcccaattgtctc

SEQ ID NO: 193574 - DNA, 508 bp, Homo sapiens
gaactttgcttttcctacggcttggagggggtcattttagccatgctaacagacatttttgcatgtctacaggcaatagttattttgcattgctaccaattacctacaacttacggaggtatgaaatggatcaaaggctacaatcagataccttggaagggtatgctctacacaatgcatagttttccactggaaatactcagtaatgttttctgctaattccaaatttcctcctactatgacatggaaaataaaaagagaaaaactaaaggtgtggatgagaacagaaattcatggaggcaactccaccgctaaataaaaatgcaaactaaaatgaggaaagattaatgcacccactgtgccccatgattaaagcacccactgcgcctacagggtcatatagaggaggtaagtggagcctgggaccacagaagatgggtgaggggatgacagtgaagtgagtcagctgcccatcttcccaacaggcacagaccgcacccgggagtcc

SEQ ID NO: 193575 - DNA, 736 bp, Homo sapiens
ttgcatcttcctccacacccatgcctgcttcctgttctggtgccccttgcctttcattgtggcaactgcgtgcatgatctgtctgcctttctgctgctgcttttccaacaccctcctcacctggaagctgggcagttaaggcacagtcattaatgtgtcattgcaatagcacctacagtcaaagcaaaaactacaactgcaaaactggtgttgcgtaaacagaacagccaatgacttgatccagatagatgatatgtttctactagtggttgatggcctctttcagctccatcgctatggaggcgaggttcatcaataactcagagaaacttgtgtccagagttggtcttgggtatgctctatgtattcagttttgtaaataatatatagattagatcaagttgtgatgtaaaattttaactcaaattgggtactactggttggaattttacattaactacaaataaatgattaggaacagaagaaaagtggaaaattcttgcttagtggtataaagattatgcttagatttctgcctatatcttgtgttttatagcttgttagtgaggcatgggctaatgcagaatgtactgcatttatgcaattagcaaataactgctagttttcattttatctattatattagcaacaaaaatggcatttaactgggtaaagctcctacctaaatatttgagtattgtgacatctctacttgcaaggtttgagtgaaagatta

SEQ ID NO: 193576 - DNA, 429 bp, Homo sapiens
ggtaataaacatgggaagctgagttataggtggttgtctgggaaggatgaatttcagatggatttagtcatgaaatagagccagaatggacttttggacataattgagtccaattgtctcatttggaagatgaagaaacagaagtcctatcacttaatttatccgagtctcaagatagaaatgtcaaacagagtagaaattcagatgtggagatggattcgggtctatataaggtagccattgattttcattcaactgggctagttcttaatttatgataagagatgaaagctgtggaccttctcatgcctcttactgtgaactgcacataggcacaaaattgtgcttacagattgaagggtttgggattctactgcttatctgtgaacctcgaggaatgggggactgcagattaagaacctgctagaa

SEQ ID NO: 193577 - DNA, 644 bp, Homo sapiens
cttatagatccttttgtcagagttggattccccttgttatggatgaagctatatttactactaatttctgggaattgaaatgttgattgtattttagagaaactcattgaaatttattcggtatgttttatatggtgaaaattatccttattaattgtttgataaacagaaaaagaatcctcatgttttaaaaaatcattcttttttattgagcttatcagtaaatagaatttgatcagttcatattgttttctgtttgatttaaaatatagctagaaatgtgtttcataggttatagttgaagaaaagcagattatttgcccaattttaactctggaaacaaaaaagttattgcaactatattttaaattttcacaaatttgggggatctttatcacataagtctttaaatgttgatggagtccctttgggaattgaaggagtaaaatctggaatccacatcttgctttgtattcatcttgaatgttttacttagtttatgtcaaagtaatggaattttttttaaaatttaggtaaattacaacattttctttttttcgaaacttttcctatatagtgtcacaacacactgccatatttctagtaaaaataatatatgtaataatttcaaactattgatgatt

SEQ ID NO: 193578 - DNA, 140 bp, Homo sapiens
ttcacacaaactacttttttgaactagagtgtgttggaggcagagaaaaatcaccctgtgtgctggctttgcctgccgtgagccagtgaggagtccgagaagaggtgggcaggtcagtgatgggtttggccagagatgcc

SEQ ID NO: 193579 - DNA, 554 bp, Homo sapiens
ttttgtttttcccgtggtgaggatagcatttttgacagtgtttgagtaactgtaacatccatattgaaagacagaaaagacataagcatcatcactttgaaactattcatggatacaatgaaagtcacattaagaacaatatcctagtgatgacttaaaagattgggattgcttctcagcaagttagttgaccatacattctcaggagcatactactgtgcagatgtggtccaccttgcagaggacctaaagcttctgtctgtctagcccatacctctggtctttgccacgtaatttttccaaaaagagaaacctgaatacagaagagcagagtgttatttgagccaagagctggtgaaacattaagtcagaatgcttcctagaaatcagtagactaagactgtgttagctcatgtttcatattacacaagagaaaataaactgaaaggtcagttgaacagttacagcattgcccttttccaaggtaatcagcagagcatgtagcaaagacctgaacaggagcgtgactggaaagagagtggctgataaagagg

SEQ ID NO: 193580 - DNA, 507 bp, Homo sapiens
tagtgggctggggtgaaggtctctgctggagatctaggagttttccctaaatcctcatctgatcttcctctcctgtagattgttaggataaatgagcaagaagattctgcgcaacaaactgataccttgctttcttttgtgagcagcagagctggggcgtggagagggtacgtccagtgttggatgtcaggaagttcacgtcccagggtatctagtacatctgagctctaagcctgcaaaggaaccttctttacaaattgcaccattgttatggttggcattctggttaaaagttcatctggatctcaacctcgcgtgaaattgcagagctacgactggaaaactcggcatcagttgagaacctttggggacttctcagacattacagttagaattgagcaaaacatgctgagttccattcactcacattttggtgagtgggttaaaataacagtttagtttcgtcatttttattacctacttttcagacagatccagaaaaataaa

SEQ ID NO: 193581 - DNA, 573 bp, Homo sapiens
tttctcaccattttctcagttattttgaacgtctgctgaaggcacgagggcctcatctgcagcctctttcctagaaagccatctgatacctgtcagcgcctgctaacttgagcaggtccattgggaaacatgtttctatttcttgtcagttacactaatgaccattccctggagagcagagagctcttcctactagaactctgcctctcagcttcagagtcattgcctgggagctgtgtggggcaaaagtgaaagccctaagccagggccgggccaaccgcatttgaatctagtgttctcccttagttagccaggtgaccttttcagagcagacagtgagttaccatgaggcccaactgaaagaagtgtgaatgagttctctgcagagcattgtgcagatgtcacaggggatgtgatatcatcatcagtaacagcagcagtgatggcccctggaacagcacccagatggtggactcagacccctggggagtgacccacagttccatgatgggagggaccctattttgttcagcactgtgtgcccagctagctcctagcatagggtttatgacg

SEQ ID NO: 193582 - DNA, 272 bp, Homo sapiens
acagagcagaagtgccaaatctgaataatgggagtcgcagaaggaaagagaaaaaaaaatggagaaaatatttggaaaaataatgagaatacatttcccagaattaaagaaagatcaaaggactcatagaataattagtaagaaaactgtacaaacagaaacattgtagtgaaagacatttaagaccaataagaaaagcagaaattctgaaagctctcagagaaataacagatcaaatcagatggacatcaggctttttaacagtatcagat

SEQ ID NO: 193583 - DNA, 491 bp, Homo sapiens
tcttggctttattgaggatgataatatccaccttcaagggttcttttgtgatctaataagatattctatggaaatatccagcagtatgcctgccatgtactagagatccataagtgctgattgattattttttctaacattcttctttagttgacagtgatgttaatggaatgtaagaagtaactaggataaaattttcattggatggattggcacaacatgttaactgactggatgttgatatatttggaaacaagattcatggattatactaagatttgtaagctctatttttagttttgaagaagggaatgggaccagatgcgatggctcatgcctgtaattccagcactttgggaggccgaggctggtaaatcacttgaggtcaggagtttgagaccagcctggccaacctgctgaaaccccatccctactaaaaatacaaaaattagctgtgcgtggtgacaagcgcctgtaatcccagctacttg

SEQ ID NO: 193584 - DNA, 488 bp, Homo sapiens
tggcctggagttttcttttttcattgtgtctctaccaggttttgatatcagaatgatgctagctgcatagattgagttagggagaagttcctcctcctagattttttgagaatcatttcagtaggattagttccagctcttctttacacatttggcagaattcagctgtgaatccatctggtccaggaatttttctggttggtaggtttttttattactgattcaatttctgaacatgttattggtctgttcaggtattcaatttcttcctggttcaatcttgtgaggttgtatgtttctaagaatttatccatttcttctagattttctagtttgtgtgcagagaggtgttcataatagtctctgaggggtttttttgtatttctctggagttggtggtaatgtcacctttgtcatttctaattgtgtttatttggatcttctctcttatttctttattaatctagctagccatctatcaatcttat

SEQ ID NO: 193585 - DNA, 436 bp, Homo sapiens
gttctgtgccttgattggagcgatggttgcataagtatacaggtttgtcaaaactcatctgacagtgtacttacagggctgcattttattgttaagttatatctccatagagttaatttacctttttaaaaattaaaaacattcaggccagttgtggtgactcatgcctgtaatcccagaactttgggaggccaaggcaggtggatcacttgaggttaggagtctgggaccagcctggccaaaatggtgaaactccgtctctaccaaaaatacaaaaattagccaggcctggtggtgggtgcctgtaatcccagctacttgggaagctgaggcaggagattcacttgaactcaggaggtggaggttgcagtgagccaagatcgcgccactgtactccagcctgggcaacagagcaagactgtctcaaaaacgacaa

SEQ ID NO: 193586 - DNA, 233 bp, Homo sapiens
cgattcagatgcacagagtaaacggctcctccattccccggggtgtgcacgttaccagtggcctggacttgcaggcccgagctccagttcaacggctttttgtttaatcgtagagtttcaggaagaaaactctttaggcaacaaaactataaaacacacagtgtctttaaggttcaccttgttttggtgaagcaggaagtcctgggagtggttgagcctcaggtctttttggg

SEQ ID NO: 193587 - DNA, 584 bp, Homo sapiens
ttcaagaggatccccgttgcactttgctacacaggcagcaggcaaagacaattcccaaaacctcgacaaaagcaattccaagggctgctgcagttaaccaccagctcattttgtcatcagtagaaggacgcttgagttcagtacttggaagagtggaagggtgcagtattccttgggccctgtccctttacgtttcatggtatgccagggatgtctgtgtttactacctccaaccaatgcaagaacatacctgaacaacccaaactcctgactggggctaattggagttagtgacagagaagaacactattttacagtgttgggtatttttgttgttgctctggaggttgggagggattagtctttgtcaggagataggatttagcagaatatatctatttatatcttgttttatctattacatctccatcctattgacttctttcctgaaccggaattaagcaatgaatgctgtttgggcatttttagtgtggctgttcattattacctggataattcagagtacttctaggtcatgacataaaaatgctgttatttgtattagcttacagatactgttggtc

SEQ ID NO: 193588 - DNA, 767 bp, Homo sapiens
aaaggggcgagaatgggaggagagttaagagcctgttgccttagaccaggtgaatgatttggccagcgtggactcatcttgccaggcaacccttccagtggtgtaggaatttctgttaaaaaccagaaaattgacaatccaggttaacttgaaagcaggagatcaacgttccttgagcaggcttgagatattaagacagaaggttaaaaattctaatgatttacatttctgctgtatctcttcttatataagagacacatacacacacacataggttaaacataacctatgtttctatataatttaaactatcaatagttttaacctaagctatgaaaaccaacatgcctacaaatgtcttgagttccatcatttgaattcatttaactctttattaactattatacatcctgtgtgtggctcttttggcttccagaataaacttttgttgagtagatgctgagattaaggtgctagcagactgcttatgagaagtgacgtcttaggccctgcacagtggctcatgcctgtaactccaacactttgagaggcagaggcaggtggatcgcttgaggccaggagtttgagaccagcctggccaacatggcgaaacctcgtctctacaaaaaatacaaaaattagtcgggcatggtgtcacgtgcctgtagtcccagctcctcaggaggctgaggcacaagaagcactcaaacccaggaggcggaggttgcagtgagccgagatcgcaccactgcactccagcctgggag

SEQ ID NO: 193589 - DNA, 457 bp, Homo sapiens
agggaatgggaaattatgattcaataggtacagaattccagttttacaagaagaaaagatttctaaagatggatggtgatcattgcacaatagagtgaatgtacattaattaccactgaactgtacagttaaatatggctgaaatggtaaaatttatgctgtgtgtattttatcacaatttcttaaaaatcaactttctaggccaggcgcggtggttcacacctataatcccagcactttaggaggctgaagcaagtggatcacctgaggttgggagttcaagaccagcctgatcaacatggagagaccccgtctctactaaaaatacaaaattagccaggtgtggtgatgaatgcctgtaatcccagctactcgggaggctgaggcaggagaatcgctggaacccgggagggagaggttgcggtgaactgagatggtgccattgcactccagcctg

SEQ ID NO: 193590 - DNA, 164 bp, Homo sapiens
gtctgtcttcgtcatgccacctgggagcttacaggcaacttcaggcagggccatagtctctcctctctgggaacccagcctgagccatggtgcctggcacagagccatgatctggaattcccatgacaacacacctacagccgcccagaggacacaaatcccca

SEQ ID NO: 193591 - DNA, 384 bp, Homo sapiens
gtttaagaatcattgctatagcccacctcttcagaaagtgttacttgattgtgtttggagcatggggtgactagggaagagtgattaaaatacagagctgtaagtcatgagcagagtgaagtgccaaaggaaagtgtttgaactttgtccttaggccagtggctgcaccttagaattacctgacagctttaaaactatagcagtgtctgggatttgtcccagaccagctgaacccaaatctgagtttctgatgcacagtgagagttgtgaactatatatagttctgattataatagtgtacatatttattgaaaatgtatcaaacatggtgtcaagtagcttacatgcataataattaaacaacacagcagttttatgtaggta

SEQ ID NO: 193592 - DNA, 538 bp, Homo sapiens
ttaaggaaatataagtgattgaagttaacaactaatggaaagagtgctgtaagaaaacacaaaccttttaatgacatgtagagatttccagttcatgtgtgggtgaacagtactatgttaactaaggaaggtaacatggagcaggaagtttgggtgaggaggtgataccaaaagggagaatatgatcatgattttacttagagctattttatatctgaagttacttatatcatatctaaacctcagaacccaggaataagatctgggctaaggtgaaaaatttgggaatgcatttgtgtcagaataagaaaattcggaactgtaaagggaagtgttagaatttaaaagttccaacatataccaatttctccttcctacagattaaattaattgtcaagatctgcacaccatttgtctctcatcacacttcaaatcctttacctggtaattctatcatgtacagttgacccttgttattcctatgaatcaactgttgttccacacctgtgaatttacctacttgccaaaatttattgga

SEQ ID NO: 193593 - DNA, 477 bp, Homo sapiens
gtcactaccttcttcattccacagctcaacctgaaatttgaaaggtatcagccttggctgtcccatctacacccctatccctaactccttaaccatttgtcatctagattccactcccacaaagctagggaactactttctcaagatcacgtaccagccacagccttccagggtggcaagtagtagctcagagaagatagctccaaaccagacttcagctggaggtggtcaaggaaggctttctggaagaggcagctctcaaatggaggttttaaaggacaagtaagacaaagaagaaagaaaaggaaccatatgtaccattgatcctggaatagggagatcttatggtcttttataaactgccattcttctttacttcttgatattagtgactcatcaccatagtgacctgggaagaggcatgagaagggtggggcctagccactgtgatgcagttatagcacatccccttgggag

SEQ ID NO: 193594 - DNA, 391 bp, Homo sapiens
tatattttcttttagttttctctgctactcttaagggtacatgtaaatacatttcttagcgtagagcaaatgttgcatgcaatatgactggccagtggcattttatttcaaagatctcatgctaatatataggagactatatattatttttttttgtatcagcatgtttaatttttttaaggttaactgtgtgcaaatgcatatttgctgtccaaactagttaatgggcttacaactgaagggtgtaaattctagtatctgtattctccagcttgaagcagtgttgtctgaagcctgaaacggctgatgttaatcttcagcttattttgttgatatccaaaaattaacttgaagtagaataaaatgtgatgtaaatcgacttctctgcata

SEQ ID NO: 193595 - DNA, 602 bp, Homo sapiens
ccccttcaccttctgccatgattgtaagtttcctaagacctccccagaagctgagcagatgtcagaatcatgcgtcctgtacagcccatggaatggtaagccaattaaaactcttttcttggctgggtgtggtggctcacacctgtaatcccagcactttgggaggctaaggcagacagatcacctgaggtcagaagttcgagaccagcctggccaacattgtgaaactccatctttactaaaaatacaaaaattagccgggtgtggtggcatgcacctgtaatcccagctacttgggaggctgaggcgggagaattgcttgaacctgggaggcagaggttgcagtgagccaagattgcaccactgcactccagcatagacaatgaagcaagaaaaaaaagaaaagaccttgtctctaaaaagagagagagagaaaccctgcatggacctccattcatatggccgttctgttactagaagggtccagaccaacacaagagcactaggagccaaagatgaaattcacaaaagagcaattatgagaaatgggagaaagatggagggactgcaacatagggctaatggaagttttagaaaaacag

SEQ ID NO: 193596 - DNA, 344 bp, Homo sapiens
gcatgtcgacgtggcttcagtgggcagttggtatttggcctctggcttgatgggaatagcagtgcttcctgtcacattggttcattgcagctaggtattaagccaaataacttagcattttctcatccaaaaaggaaagtagaattctgttgtatttattcaatttccccgtcactctttatacactccttaaagcttctttgtttttttaagatgtgggttggctacaatttttcaagtcagcaattggagtcactgaaaagctgtaggaccccattacatattccctcttcaaagactaggtttttagtccccagcagcattatcccaatcagtgaagcact

SEQ ID NO: 193597 - DNA, 482 bp, Homo sapiens
acatgctcctccccagctgagcgactactttctgtttcctttcccgagtctgggaagagacgcggcggccaccctgccctggcctccgactacctgtcttcatgagcgtctcggccccctgcccgggccccctcgcccctctgctgtcccgcgcggtccagggagaggagactctcggtctccgaatcccctcaagtggggacccgaagaacggggaggggcactgagcggggacagggaacgcgcggagcgcagctggcatcgggcgcccccgttccacgtggcagagccgaggggttacgatctcggcgggagacgggagggcgggaggctgggttggcgacgcgggggagccaaggtgggtgcggggaccatggggacggcccctcgcgccgcgaacccccgcacgtcccggagactagcaggtgggcgggctcggccccttcttcccgttccgcgctccccgcggacagggcggccgc

SEQ ID NO: 193598 - DNA, 180 bp, Homo sapiens
tctaacacttcactttgcctgcgtagacagacagacacacacgtgacccacagcttctcagaaagaccacagtcagcatcagagaagcccccttctcaacaggcaggaagcaggttccctgaggctctgcacagtgcccaagggacactgattcacgcattccgcttggtgaacattcac

SEQ ID NO: 193599 - DNA, 343 bp, Homo sapiens
tgctgagattacaggagtgagcctctgcgcccagcctgtactttcttatttttccagttacttcattttttcaataaatatgtgttgaaaacctggtatgtactatgcacctaggtgaagagtgaaaaaaagaaatatccagtatcttggagctttcatcctacttgagggagacacaatgaagaataacataataaatagtaaatgtaagaaacaaattcttagaagatgataagtgttgtggaaaaaaaaatatagaggtgggaaatagggattgtggtgctgagggttggggcacaggtttcagtgttccacaagaaaattggggtaggccttagtattg

SEQ ID NO: 193600 - DNA, 197 bp, Homo sapiens
gtgtgtaatgtatgagcatgtgtggatgtgtgtgtagatggttatgtgcatgtctggtgtatgtgtatgtgtgtggtgtgtgtatgtgtggtgtatatgtgtgtaatgtgtgtgtagatggggtttgggtacatgtggtatgtgtgtatggtatatatgtgttgtatatgtatgtgtggtaagggtgtagttgatgt

SEQ ID NO: 193601 - DNA, 379 bp, Homo sapiens
acagcctctgtcatagcacccatcactgcacttgagcaccacaggagactatttactcacctgtcctttggctgcctcgcctgctataatatcagcgccacaaaaacagggccttgtatctattattcaccactttatccccagggctcaacacagtgcctagtacatagtacatgctcagtaaagttgtgatgattgagggaaccctgcctccactgtatacagtgcagaacaccaagccagggccaggaaaacccctgacgttccctaggtctgagctgggagcaagagaaaagggaatgaacagtaaccctttgatgtattcagtaactgtctaatgagtcccttgtgctaagacttctaggggataccacaaaca

SEQ ID NO: 193602 - DNA, 459 bp, Homo sapiens
gtgagttcccgcgagatctgatggttttataaggggcttccccctttgctcagcactcattctctctcctgccgccctgtgaagaggagccttccaccataactgtaaggttcctgaggcctccccagccatgcagaactgtgagtcaattaaaccccttttctttataaattatccagtcttgggtatgtctttattagcagcagactaatacaaacccaaaacccaagcagtcacagaaacagatgggttgtctaatgaagctgaagcagggtggcaagcaatgagccagtcattaatgatgagtaggagtgatgggaaagtcagcagagcacagttacaaggtggacaaaaggatgtgtcttacccatggctgatgctccaaagaggagggttatcacacgaggggggaaaagcaatgatccaggacagccatgacaagaatgcgtgccaccaatc

SEQ ID NO: 193603 - DNA, 200 bp, Homo sapiens
gattcttgcccataacaatcattactgtggtatttgcctaatggaaagtttctatttccataattccttccacattttcaattggaattctactctaaacaagagctgtctcttcttccttttaatttattcattcatttgtaccaatatagactcataaatcttggctcactacaacctccactccctgggttcaagca

SEQ ID NO: 193604 - DNA, 121 bp, Homo sapiens
ttaaagtgtacttctatccaaatagtttccatttctcacaaaagttaaatcactaaagacaaccaatcataccaaaacaaaaatttgaaaatctgaacaaagagaaaaagcaaatgagttc

SEQ ID NO: 193605 - DNA, 332 bp, Homo sapiens
ggggattactcagggtatgagtacttgtaagtgaagatcattaagagtcatttcagatgctgctaaccacagcagttgagtatagacgcatatgttttggaggaaagggagaaagactgagtaagattcagagacttttaagagctttgctaattttgcttctgtctttgcccaagcaccttggttcagtcttttgctttcttttttttttgccatagtggcaaaaaccacacttttgcaccaacctaatagcactttgcttcatgtttgctgtattgttgtttccttttgagagaatttaccctgaaaatagcctcgcttatgtgttcacc

SEQ ID NO: 193606 - DNA, 514 bp, Homo sapiens
tctttttctgcacactttccatgctttctcctgcagaaggtaaggtagtaaatggcagtgttgggtctggatgcaagccactttgttaaccctgctggagagaaacatatctgcttaattcacaattgggtcattttattattagcacacactcagttcctttatgagtctttcagatattgattgagacatggcaggaaaaaaataaaaagaaaactcttagttccttaacatgctggacttctctgtgacttttctcttggcgaacatctcctgacattcctttggcaagtccccacctctctctttcagtccatgtgttgggggaggtcagggctggccaatcagggtcctacatggttccagcctcagcgacttgttcaaagatgagcacatgaaccaaggccaactatagacttaatctcctccacaaccctgtgaaattggtactattataaattcctgttaaagatgagaaaactgagacacagagagatgaaataatttgcctgag

SEQ ID NO: 193607 - DNA, 471 bp, Homo sapiens
accaactgagacaggaaaggctgagggcagataaggataaagtgttgtgtggtggtgattgaagagcagatgtttggcttccctatattatttatcttgctcttctctaatcctcatcacggcccaattagagggcactactctgtgtctagtgctctgccaggtacatcacatgcatttctctcatttaatttatcagctctttcacaaatgcgaaagctaagatccagacaggttgaatcacttgttctatgtgatagggctggtaaagttctatatgatagggatttgactcaacgaccatctcctgtggtcacattctggatgtattttgtagctgtgttaccctggacaacttagttaacctttgtgtgtgttaacattttctacaaacaatctgacacactttagatgtaagagcctaaggccagtctgagtgtgtaggtgtgttaatttactcagggagatgtg

SEQ ID NO: 193608 - DNA, 357 bp, Homo sapiens
gccaccacccctggccaatatgataaaatattttaaatctcccgtatattttgtgagtgaaagacagggtcagtgtttcttccactgaccctttttcaagatcattcctgataattatggttttattgtcctctaaaagttgctgtggggttgaaatttatgttttgagttgttttaccttgtctataactttctgtaatcttcctcatcactaccatcgactgatctttaggtcatgaagtcttgtcatcatacaggattacatattacttgtactatggtctccatgaaatagtttctattattattattcactttttacacatgactctgagatctggagaagataaataactt

SEQ ID NO: 193609 - DNA, 225 bp, Homo sapiens
tctagaggatcccgttcgacggaagcagatagaagagttagaagatttgggtcacaagtaggaggtgaagggagataaatattgaggaaagagagctagtataatgaatagagggacgaaagcagtggttaccaaattttaatgcatatcacgatcatcaagggaacagatttttttctttatttttttttctttcttaaaaaaataatggcatgcttccggtcg

SEQ ID NO: 193610 - DNA, 123 bp, Homo sapiens
aaacataaagagatatgacttaaaaatttttcatctgaactgtcaatttccataaatagcttaatatagtgaaaaattgagaggttcttgaagccactaagtctaataaaaaaatgcaattcc

SEQ ID NO: 193611 - DNA, 326 bp, Homo sapiens
aatacgaccgggcacacagggcgtggagcacagtgtgagccctcattaaacattaaccgacattatgatgatttgagaggcggtcggccagagcagggctctgggccagaactccggagttagaatcccagcgcacaacttatgcatcgggtgaccttgtgcaaatcacttaacctcttaataccaggttaagaccccctaagactatagtgaggactgaataagctcatacaagtaaagcgttaaaaagagggtctagcccatagtgtttcatgagtgtttgccattattatttgtgggagggttcccccttctcctgtcaccag

SEQ ID NO: 193612 - DNA, 221 bp, Homo sapiens
tgttggctcattacagggatgaaaggaatctcgggctgtgggggtggggcaggatcagagctgaggtcttcacccctgcccgatttcctgcaatgcactgtgctgccttctgagaatccaactccaaaactggctttagcttgaagtttgaaaggaagaacaaagaggcagagatggaaggacaggacagaggatatttaacgggttctctgagcgcaaca

SEQ ID NO: 193613 - DNA, 637 bp, Homo sapiens
ggcaacatggaatcaaggcccagtctctctctctcaaaaaaaaaaaaaatctctcttaagtttatatacctaccttcttaaatagagtatgagtctgatttatacttttcctctcattaaaaatattgagtgtctgttgtgtgcaaggtgctgtgctagtagacaaggagttgtgatgagcatccttaaaatctgtaatacgtaatatgaagaaaaactagaagtgctgtgagagcataaaataggattatccttaatctagatggagttcaggtggggctttctgaagcagtaatgttctgactgagataaaagatgagtggtaattaagcagacgaagggggaagaggtgttgctagcagagtcttttataaagacccctagtgtgaaagaagcagggtatactggagaaactagaagtccagtccagaagtccagaaatgagcccggagatcaaggagtgaagagtagtggaagtagagttcagagactgtcgaatgttgtaggacagtttagattttgttctttaccctcagagtagtgggaagtcattaaagtgttttaaagggacaattgatagatcagatttgcatttttaaaagattcctctgacagctgttgggattccattggggga

SEQ ID NO: 193614 - DNA, 367 bp, Homo sapiens
ggcataagccatcacacctggctccctcctattattgtattgcagtccatctttccctctagatctattaatatttgcatatatacttcagagctccactgttgtatataaatatttataattgctatatcctcttgctaaaatgacctttctcattatgtagtgaccttgtctctttttatagtctttgatttgtagtttattgtatctgatataagtatagctattcttgttctattttggtttccagttgtatgaaatatcttttccacccttccactttctgtctttgtgtttctttataggtgctaagtttcttataggtggcataaagttgaattgtttctttatctgttcagccagtctt

SEQ ID NO: 193615 - DNA, 455 bp, Homo sapiens
atgccaatcaccactttgtatgcttgtatacccaaagcctatttcagcgttcctgaaattttaaagctaaagaaaatagactcaactctaaagtgagttttgagataatgtaccaatgtattgaagaattttcaccaagaactcccaaaaatatggagggaaacagagctcactagagggaaacctaagaatggcgtaactatactgggaagtaggcactgttttttcttgcacaaatgctttattgatttggtgtacctgtgcatgccaggcactgacaaaatagaggtaaaaagctcttgtactttcatgttctagtcttggaaacaactgataaatgtgtaaacatatacaaatgcctatattctgtttccaaatttaaagtgcactgagtttttaatgtttaaataacctacaaattgtgtttctagataaagacttaaagaaaatattac

SEQ ID NO: 193616 - DNA, 383 bp, Homo sapiens
ggtgcctgctgtgtctcccgtggcttcctctgggatggctcacctccacccatcttccacacagctctcagagggagctttctaagatgcacttctgtgtgtgtcccctctgttaaaatccttaatgaatactcatgcgttccccatctgacccaagcctttcatgatctgacccacactcactgtgacagcctcctcctaggtccccattcacaggcaccctgggttctggccaggccatacgcccagcaggttcctcaccaggccaagtgccttctcctctccatgcttctgcacctgcagggtgcgctaggacagaaattcagcttcaagactgcaaggacagaaactcacactcaaacaaaaagagaaacgatcaacat

SEQ ID NO: 193617 - DNA, 686 bp, Homo sapiens
agtgttaacctgacctccccactttacagatgagaaaactgaggtgaagggaaattaagtaaattgtccaagatgacccagctagtaagaggaggacacaggattcacattcagcaatctggagccacaacctacactcttccattagctcactcacagggctgccttacagatcaaagtttacatttattatctaccttagtctctcctatcaaggtgtgcagcaaatgtggcttctcaaccttcattccatgttaaccttatactgtttacattacccttgaacactgagaccaaggatctcaccacttgctttttctattttccttccatcacccagaatggcaaacattcaaacatttccactcccgaaacatgcagcaacgccagaatgtttatccagaaattcaaaatgagctctagtgaggctggcatgaatatactctaacacaatgttttcaaatatcgtggctcaacaacaatgaccagtgctaaggttgctgcgaatgacatcttaggcctgaaattgctctctgctgtaacccagcactgaaggtgactctggcctttgcatgctggctttgaaaggtcccaagtctgtctacttggaaataaattaaaatgttgtctatatttaacagataaccaggccttactaagcaatctaaaacacatactctagaagc

SEQ ID NO: 193618 - DNA, 460 bp, Homo sapiens
atatgcaaacacaaaggacacatccagacagactaaacccagcaagaccccagcaaggctgctcttcactaccttttcaaaagttattcactagtgttctctaaaccaccatcccttttcacccaaccccacaactttccggaaagacatgttatcttaaattttatcatcaatgcttggctattaaattacagtgaataactaaaaatccattcagaatcattccctgaaaacgtaaaaaaagaaaaaggtaaaccatcctaaagaaggcatttcaggctgggcgcggtggtggctgtaatcctagcactttgagaggccgaggtgggtggatcacctgaggtcagactggccaacatggcaaaaccccgtctctactaaaaatacaaaaatcagccatgtatggtggcacatgcctgtaatcgcagctactcaggaggctgaggcagaagaattgctt

SEQ ID NO: 193619 - DNA, 493 bp, Homo sapiens
aagatttcacagttgcagtgacgtttccaggggggcttgccttcgaggagctaactctacaaatgcaagtgtaagtatttccaaacaaagcagaatgacccttacattccaggcccctgaagagttctctgctacagagcagttctctaacaacagagcagttgttagcaaacagctggaatgtgggggttttctgggttgagcattcgttgtctggctagtatccagtacctggctgcccttctagggtccccctcaagcccttgcctggagatggtgaattggtttcatgttcttctcagggttgttggtggctttctggagtccggtcttgagagggagtctcatattgattcttggcttggtggaacagagcatcatgattaattagggatggctgactttgcactacaataggagaaattgcagcagaataggagaaatagtagcataatacctttgcatttcctaacaatcagagctgcatgatttt

SEQ ID NO: 193620 - DNA, 441 bp, Homo sapiens
tgtcccaaggaaactaagtaggaggagtaagaaaaaaagtatgcactgtgtatatttatgtagccatcacaacaacctcacagtgattattcccattttagagattaggaaactgatcctccaagaaatgccttctccaaccattgttaggtagggaaaagcataggaggaaactaaggctcagagcacttacatggcactgccaggatcttaatccaagtcttcccatttaaagttcaaggcccttttctgtaccaccaagctgccccctggcagtcaaaggaagtttccacctccaatattctattattttactacataaaactgctgtcagtttctgactgtgggcttcgatgaatgtgctctcttggtactagccttgcttttcaaattctcccgctactttcccaacttgaacatcataccgtttcgcgaagtaaa

SEQ ID NO: 193621 - DNA, 609 bp, Homo sapiens
ggtgtttcgccatgttggcacactctcgactcctgaccttagcattaaatgattaattaactcactgacctcaagtgatccacccgcctcggcctcccaaagtcctgggattacaggcgtgagccactgtgcccagcctgataccttctttttaagcagcttaaaacaacatttatttgttagtattaaaatttgttatctgccagtgtctgtgtgtcaggaatctgggcgtgggttacttgggttttctggttctagaacttttacaaggtgctggtgggtgctgcagtcatcttccagggaagaatccatgttcgagctcacttgtgtggttgttggcaggagtcatctcctgggcctttgagctaaaggccttactggaagccacactcaatttcttgccatgtgcttctctccttagggcaacttgcttcttataaatatgtaaaaagagagtgagagagtatgaggtaaaagtcttttgaaacctaatttcagaagtggcattccgtcatttttgctgtattctgttcagtagaagcgagtctctaggtgcgacctatactttaggagagagaattacacttggacatgaattctaggagatgg

SEQ ID NO: 193622 - DNA, 495 bp, Homo sapiens
gcagtgcacgcttgatgctgtggtcgatctgaggatcccccgtcagcagacacagcatttatttgttagtattaaaatttgttatctgccagtgtctgtgtgtcaggaatctgggcgtgggttacttgggttttctggttctagaacttttacaaggtgctggtgggtgctgcagtcatcttccagggaagaatccatgttcgagctcacttgtgtggttgttggcaggagtcatctcctgggcctttgagctaaaggccttactggaagccacactcaatttcttgccatgtgcttctctccttagggcaacttgcttcttataaatatgtaaaaagagagtgagagagtatgaggtaaaagtcttttgaaacctaatttcagaagtggcattccgtcatttttgctgtattctgttcagtagaagcgagtctctaggtgcgacctatactttaggagagagaattacacttggacatgaattctaggagatgg

SEQ ID NO: 193623 - DNA, 271 bp, Homo sapiens
tagccctacagcctgtgtctgctgggaaaggccatttaaacttgtgacgctcattaaggacattctcaccaccatcatggatctctaaattaaagtcaaaccgattccaaattggaacttaaaggtacaagagtcagaacgcggcacaaattgcatcatgccagtgtcagtcccatcctgttcctcttacccttctcttcccaaatggaaaaaagtgacccgtcctgcacatgggagacaagagcttgtgaagggctttccccctcctcag

SEQ ID NO: 193624 - DNA, 147 bp, Homo sapiens
acggcgcccggcgtgcatgcattttttttaggcggttctctgaactcttggggaacgagatgttatcgcgataatattactaattattcaatgtcatcactttgcaagccccagggaaactctaacacccacccccatccacccctg

SEQ ID NO: 193625 - DNA, 265 bp, Homo sapiens
tgatatataattcagtgggaacctgggaggatagggaggaggtgggggagctgaagaaacatgagtggccgaatgcttaacaattgttattgttaggttatggatacccggggggtggttgtactattctttccttttgtgtatgtttgaaattttccattataaaaaggacaaaaaaaaaagagagagaaaactaaaaaagaaaaaatagtgttgcgcttgttagtaaaaccaatcttaaggccagttactaaaaagtaaactc

SEQ ID NO: 193626 - DNA, 300 bp, Homo sapiens
ggttgaattttatgttgaaggatccctagaccctcacctttgcctagccagtccccatgtaaggaatcaacttaaatttaaatggcacttcctctgggaagccttctgatcttctagaccggcttagactgtgctgttacatatgcacagctctctttggtcattttgagcactcgttcagataattcagcaatagcgtgttattggctgtcagtccagccagtgtaagcctgagaacaggagccacatctgcctggctcttcacagtattcccagcacctgcttagcaaagagctttgt

SEQ ID NO: 193627 - DNA, 314 bp, Homo sapiens
cagtatagacactcagcaaattttaccacaagtttgttccctgctgatcttgtccttcctttaggtaaaatgtggtcaaaattaatgccaaaacctacaaaaacctggagaaaaagtcttcaaaagtaaataaaacatagcccagggaggaacctgattcttacagttcccgggccataatgtgtaaggagtttatatccaaattacacataaccaccagtagctgcatccactgctgtttcccatgctctgcttccttggtctctgtttgtttgttttgagacagtgacttgttctgccacccagctcgcgag

SEQ ID NO: 193628 - DNA, 542 bp, Homo sapiens
tctgtgggggagaggagaaggaaaaaagagctgagctgcaactccggtttcagaggttgtgtcctgtgcttgaaaaacacgtaggaattggtgaaaattagtctttttagtctatgcattgactcttgggaaagtatgttgtgcaagagatgagagtaacaggtgagagtactatactgtattagaaagtgagagagccctttgttccatgtaagacagtcttgccagtccagttttggttacatgtggacctgagtacatcaaatttgaggattcagtttaatgaaaatgatgaacattgtaacattttagtttgatttgtttcatagtgctgtaaatactacttcatgctgtttcttttttgttaatttgcttttatgaatatatagcacttatcttgataaatatactacaaatgtgattatttattgaggttggcatgtcccacgaaagtttaaaaattgagtgtgaaacaattttagcaggaatatctttgctcaaagaatgaggtttttcagaactgaaaaaaaaaaaatgcattg

SEQ ID NO: 193629 - DNA, 189 bp, Homo sapiens
ctctaaactaattttctccttatacaacattgtagacccaacaggggaggacaaagcttgaagcaaatggctcccactagctgcctggaaagtttgatttttttttttttttttttacacctgtggttcccttccctaagggaaaagggaaagccccaaaatttttgaaacccgtcacccattgtgctt

SEQ ID NO: 193630 - DNA, 622 bp, Homo sapiens
ggagttcaaggcacccatgggacttgtaagtgggcccttgccatcagcagtcagaacagagctctgaggctcagcggccaggtgttgcactggcatagagacctgggagtcactggcatgttgatgtaaagactcagctagagtcagaggagggaaagacaaggagcaccacttttaaggagtcagcatgtcctgacaatgtccctagtataggttgagcatcagagtaacagggactcctatccctgtggcctccagtggtcacagcattgactgctggtgctggaaggccccaaacaccatggagtgtgacgtcagtttatcagtacatgggagacctgcccagttggttcagtgagcaaacatgttcatagggaagactttagggggccccagaacaggccaaggcccctcatatcccctctcccagcaccctgcactggccctttgaagcatgcattacgtttatcttttaaatgactagggggttatttattgtctttttccccaccagttccacagggaccacatctgcccagcataatacctgaagtgaatgcataaatgaacaggatgctccaagtaaacattcgagaccttggatggtgctacagtaggaata

SEQ ID NO: 193631 - DNA, 183 bp, Homo sapiens
ggcaaagatgaggacaggcagtcgtgtgggtgggaggcagtccttggatgattagcacaggtgtccaggagggaggggagggtatggaaatggtacaaacatgagaggaagctgtgccagtgggtcatcatgccccatttgtacagaacattgagtggactgtaactgtggacaactgaaata

SEQ ID NO: 193632 - DNA, 851 bp, Homo sapiens
gagtacaggtgtgtgccaccatgtccagctaatttttaaatttttttgtagagatggagttttgccatgttgctcaggcttgtcttgaactcctgggctcaagtgattttcccaccccggcttcccaaaatgctgggattacaggggtgagccaccatacctggccgatatctttgttttgtgatacagttctctgattattagtgaggctggacttttagatcttaattactagctcttatttccttttgtgaattattcaatttgtgcctgaatgttatttgtaagttgcaaatgtcgtttgttgcagatatgctcccagtaatatttgttgccattgagtctgaagaaatgtttgcaattccaaatataactgctgtgtggatacatgtctggttcttggtagccattttgagataacatttgtctgacctctatcttatttttgtttttatttttagagtggaggtcttgcccaggctggtctcgaactcctgggctcaagcaatctttctgcctccgcctcccaaagtgctgggattacaggcataagccaccttacccagccttgtctgacctttaaacagaaatccatttctttttatctaaaaggaaagcacttttgagtactgtacaacagtggtgcttcctggctctgggcatggggagaagacagggcaacattttgtccctaatgagaaactaatttagacaagaaacaaaacagcggtcccttctcccccatccattcagggactggtcttattttaaatatttctgagtggtctgagggaggatatgggcaatattgaagtgtccacatttatacatactgttaaatgctttgggga

SEQ ID NO: 193633 - DNA, 262 bp, Homo sapiens
agtgccgaagagtatataaaagcacccatattttaaagggttattgaaaagataaaaggtgaaaatgtacatattgatgatctggaaacttccattgctaagaatccaaatagtttccatcttctaggtattagaggaagacacttagatctgatgtcttattacaaactgatcttcaaaatggtcagtttttagatggtcttcctttctacctgcttttccttttacaagaaataaagcaaggaacaagcatcatgatagt

SEQ ID NO: 193634 - DNA, 370 bp, Homo sapiens
ttttggtgggaatataaaatgatacaactttggaaaaaggtctggcagtttcttaaaatgttatatatatttttccccatgactcagaaattccactcctatatatttacctaagagaaagaaagcatatgtctacaaagacttgtctaaaaatgttcatagcagctttactataaccaaaaactggaaaagtatgttcatcataggaatatggatgaacaacctgttatatccacacaatggaattctactcagctatgaaaatgaatgaactattattatgcaacaacatggataaatctcagaaacatctctgagtgaaagaagctggataaaaagcagtacctatttcatttatatgaaattctta

SEQ ID NO: 193635 - DNA, 270 bp, Homo sapiens
aggttgctcattgtgtctgtccctcttgggggagcacagagaataattttttgtggctactgaaatcttaggactcttccagtttaagtaagtcttaaagaaatactggccttgactttaggatccaaaataaacctgaatccttgtgagtgtctagacaacaactatagaaaacagcaacaatcagagatcacctgacagttaagaactggctaaaaatgtttgcacattaccaagatcaagcaacatataaattacccagagacatag

SEQ ID NO: 193636 - DNA, 115 bp, Homo sapiens
ggcactattataagcactttactggatgttaatgtatttaatcctcatcccaaccaatgtgctatcaatattatcctcatttgacagataaggaaacaaacataggaaggttaag

SEQ ID NO: 193637 - DNA, 446 bp, Homo sapiens
tcctcctcctcctgcctccatcaagatttctccctgctcccaacttttgcccaggctgttcctcctgcccagaatgcctgtcttatgaactcctacacatccttcaaagcccagctagtggtcgcctcctctaggaattacacctctaacctttttggagaagattgagccatccagggaggcttctttatgtttacaccaggggtggggcaagaccaagctagagtctctctcaggtaccaccctcccacataacttttactcctttgctacctgtgccagccatctgctccatttcacagaggtaaaaactaaggcaaagtggggcacccacagtcatagagggagaaatgtggcagagccaggtctcaaacctggagttctatgctctcagctatcaggcagagccgcgcgtggtggctcaagcctgtaatcccagcacttcg

SEQ ID NO: 193638 - DNA, 1024 bp, Homo sapiens
ggagttgcttgcctgtgttgtggataagggatctgaactttaatatttttgaggatttaatcagtattggaattgtttttggatcttgaaatgttctgatgtcaccgctcttgtcttgtgtgtcaattccagaattagtaatacggcaattaagtagttaaactgttagttcatcacattactcttaagctttatcaattcggtgaagatcaaaagtactgattttttttaaagtagtagttgctagattttacgtgactgttgatactaaggtactgaaaaataggctgctaccatagagtacaaataagccactgataagaatcgttagattctttctccttttcaaaagtatttcgataatattgggaacttaacagtagataaatgtgacaagcagtctttcctgactctgaacttgttttggtttctttttctcagatcagtaatgctgatgtgtattttttagcagttcggtgttctaaaagttactgatggaatgagaagaagtgaagttacaattaggttagggtatttttttagtcactaaatttttatcacacttaaggtgtgacatggattcttttagttgaaatgggaggtcaccccacctccagcctgtagtttaggtagagtaaatcttgtcatgtagaagaccagttttccatttacaatgcagacctaagtataattgtattaggttaaggaacagcagtgctggcatatcatgactcaaaaatattaaggaagaatttatttgctcaaatgatattatgtgaaaatactgtctgcttccccaccttttaaaaacaagtgtcataccctttgataattggagctatgtgtaatcctctgcctaaggagaggaaaaactggtggtggtcatgaacagttgagaaatagctttatttaagtgcctcacaagcatcccttaactacaacagtcacatttcacagaacagatgggtttataagaagtttgggccatcttgacatattgagtatttatgaatgagaggagaga

SEQ ID NO: 193639 - DNA, 514 bp, Homo sapiens
gctcatgcaaaggccccggggcagaaatgtgcttggtgtgttcgagcaagtaggccagggccagggtggtagaaggtgagagcagagggatagcaggggccagatcacatagaggtttggaggccaagatcgagagttttaattttacgcggagtgggatggaaagctactggagcattttgagcaaaggagtgttgtgatctgagttacattttgagggcatccctctggctgctgttgagaaaagctgtggggtggaagggaggataattgctgaagcatggagaccagttacaagaccattgtgatggcccaggtgggagataacagttgcttggcctagggtgatagtggtggcctagtgtggtaagaagggatcaggttctagatattatggatagtgtgaagttcctgagaaggcggatagggatgggaggtgacagaggtggaggggttggacacccactcccttatagcaggagagagcagagagtaggcccgaagtgggtcaggt

SEQ ID NO: 193640 - DNA, 681 bp, Homo sapiens
tctacaggccacagtggctgaaaaacaacaggaaagtagcctagatgttcactttttaatagtataacatatctttcctccctattttaagtgaaaacagatctctgtcattaaatgaggatataaatatttatgtcatcattgttgaaatcccaaagaatagaccttacacatttctgtgttcattttaaatggccgtcttttgtgtccaagttaaatttaaaaagctccctcatccctctaaaggtctcaccatagctagttagctttcagccttgatctccttttactcttgcctcctctaaaaactttttgatagttctctaagaacctaatcggagtcatacttggcaatacactgttaaagaaaatgtgtatcctagaagtccagatagtctttgtagatataaattaaacatacaaatcccttgctgtaatatgagcagaaagtgttactgttttagacaagtagctgctattctgtgtttcagtacagaacagggttttggtcaaatcaaggtagtgatgacagaatgtcagaacttcacggtagctaggagtccctactcttcattgtagtcatttattgaatattttgaaaaggtaaaaactgctcattgttttattgtctgtggtaaacagcatgaattagatatactttgggcataaagtgctcactga

SEQ ID NO: 193641 - DNA, 461 bp, Homo sapiens
gcccttagaacttagcagagagacaatcacaaatacttgtaatatgatgcaactgctctaatagaagcatgagaattatgtatgtaaagcacccagcccagatgcttagcacagaggaattgctttcttctccctgttcctctgtaggagtccaagaaagcttcagagagaagcactctgtcttggaggataagtagaaatcttccaagcaaagagctggagatgacaatggtgtgctggtgaatgttcaactggcattccaggagggggacaaaagccgtgattgtatcacttgccaatttccatggtgtaaatactcctcctgcagcaaatctcaagctaccaacatgatgtcactgaacacggagttgggactagaagtgtctaagctagttagagcagctccagcacaccatagggagaccagatgaaagaaacagcccgtgaactgaaaacatctg

SEQ ID NO: 193642 - DNA, 619 bp, Homo sapiens
cagtgccgatgactcactgataaggaacaatttggcattaatttaaatgaatccaatgaaaatatttcataggaagtttataaacaaatactgataggggctattgtattatttccagaacagatagtaggcatgccagtcaacctttgcaatttagtcaacattccctttatccttaacagaatccacatctacaagcattctcatttactcaataaatatatggatatgggctatgtgccaagcactgagcaaggcactgaggaatgtacaaagatgagaaaaatagtccctgcattaaagcattaaaatattcctcttcatcttcatctttccttcctctctctcctaacccctttactgaccgaatgacatcttaaattccttctggaagtagatgtgttattaagtcataataaaaaagtgacctgaaaaaggccgggcgcagtggctcacgcctgtaatctcagcactttgggaggccgaggcgggtggatcacaaggtcaggagatcgagaccatcctggctaacacggtgaaaccccgtctctactaaaaatacaaaaataaaaagtagccaggcgtggtggcaggcacctgtagtcccagctactcggga

SEQ ID NO: 193643 - DNA, 217 bp, Homo sapiens
aatgaagggaagcgagtcctcgcccattgacagggtattgacttttataaattcccttgtgttccacatgtataattagttttcacttaaatttttagtacttatctacattttcttatctctaaaatgggaagatgctactagatttgaagctttgccgcttatgaaaactactaaacctaagcggcagtttttaccatttgaccaaaaaaaaaaa

SEQ ID NO: 193644 - DNA, 660 bp, Homo sapiens
aacaagtattcatagtgccattatatgccaagcattattgtagcttcctggaatatagcaacatacaaaagagacaaactataagtaaattattcagtacattaggtgatgagtattataggggaaaaggagaacttggtaaaggataaggagttctgcaggggatagaagtggcaattttaaacagagtggtcacagtagatctcaatgagaagttaacatttttgtagatctgaagaaagcaaagcagctagcaaagcagctatctggaaaaatatctttagaacagataaaagagctaatgtagacaaaagccctaagggaggaatgtctggaataaatttaaggaacatcaaggaggccagtgtgactagagaagagactttactattaatatgtggattatctatcatgcagacattatgcacaaatttttatacttgtgggtatcctagcatttaataattttctactaattattaaatcagcctacctgaatgtactaaaaaaacctgattcttaaacatacaaatgttaggcttttcacataattactaagaatacagatataaattcatttaaaattcatcaatttaaaaaattgtatcagaactctaattcagtgatcaaagttccattataatcctcatttactcttaa

SEQ ID NO: 193645 - DNA, 418 bp, Homo sapiens
tgttattcaacatagtattggaagtcctagctaaagcaatcagagaagagaaagaaataaagggcatccacattgtaaaggcagaagtcaaactatatttgttttcagatgataggatcttatattgggaaaaacccaaagatttaaccaaaaacctatccaagctaataaacaaattcagtaaagttgcaggatacaaaatgaacttaaaaaatcagtagcatttctatatgccaacagtgagcaatctgaaaaaaaaaatcgaagagcaattccatttataataatggcaaagaaaattaaatacctatggattaacttaataaaataagtgaaagaactctacaatgtgtcgaaatggaacctcactgaggcagagaagaaggcatgggttgagaaactgactggagtttctatc

SEQ ID NO: 193646 - DNA, 383 bp, Homo sapiens
tattattaaagcagttcatatacatttggaaaaatattagtgcatacaacaaaatagaaaaaatagcactgatcatgttaaagaagctgctcgtggccaggtgtggtggctcatgcctgtaatcccagcacattggaaggccgaggcgggtggatcatgaggtcaggacttcgagagcagcctaaccaacatggtgaaaccctgtctctactaaaaatacaaaaattagctgggcatggtggcgcacgcctgtaatcccagctactcaggaggctgaggcagcagaatcacttgaaccccctggaggtggaagttgcagtgagctgggatcctgccactgaactccagcctgggcgacagagcgatactctgtctcaaagaaa

SEQ ID NO: 193647 - DNA, 515 bp, Homo sapiens
  misc_feature (93)..(93): n is a, c, g, or t
agttcgcagtaagatgatgatatttgaggaaggcaggtgatcggagatctatgtgcgggttgtatgatatgggcgtgatagtagtagtactgntgacattgttgttgatgcatcagatttgccttcttgttaggattgccttagctatttgggctcatttttggttccatatgaattaatttttttttctaattctataaagaatgtcattggtaatttaataaaaatagcactgaatctgtaaattgctttgggcaatatggccattttaacaatattgattctatctatggacatggaacatttttctttatttgtttgtgtcatctctgatttctttgagcagaattttgtagttcttgttttaaagatgtttcacctctctggttagttgtattcctaggtattttattctttttatggctattgtgaatgggattgcattcttgatttgactctcagcttggaaattcttgttgtataggaatgctactgatttttgtgcattgattttg

SEQ ID NO: 193648 - DNA, 309 bp, Homo sapiens
ccatgggacgaatgactttgtttttggaatagattaattgtaagggaggagaaataagaatgagactctataaattacaagatacttaggaacatttcaaccatttgcaatgtgtagactttttgagtcctggttcaaacaactgtaaaaaaaagaaaaaacaggtggggccaggcacggtggctcatgcctgtaatcccagcactttgggaggccgaagtcggtggatcacttgaggtcaggagttcgagacaagcctggccaacatggtgaaaccccatttccactaaaaatacaaaaattagctgg

SEQ ID NO: 193649 - DNA, 474 bp, Homo sapiens
ctccgtcttcctgctgcctgtgcagtgttggtgaaactcaggagtgaagagaagatgtgaagagacacgcttgggaggaactcttctcacctgaggacacctgcccaggtgtgtcacacctactcttatggtcagctactcgtatggtcagccaggttcaggcccacacacaccagtgctgggttcctggtgcctgcttatctctctggagccagggaggctccgacctggaagcctggacccccgtctgtgtttatctcatagataccattccatattcccaggtatatgcttgtaatgttattcatgtcacacatacatgtcatgtcattgaaccaaatgcaatttgctgttaatgtaatactgctcgtgacgtggcctacttggatgtctgatatgagcttagaagcctaacaggaagttcacctgcaaaattggaccctccctattcccttgtttccacaataacctagt

SEQ ID NO: 193650 - DNA, 318 bp, Homo sapiens
cagacggatcacgaggtcaggagatcaagagcatcctggctaacatggtgaaaccccatctctactaaaaatacaaaacaaacaaaacaaaaataataattcaaactttggaaaagataatacattcatatgacccaaaatgtagaaagaatgggcacagtggaaagtctcccccaactcttaatcctcctcgacctggctcctggcaggtgcagatatagattcttatccacctctgattttttgtgtgtgagccactgcactccagcctgggtgacggagcgagaccttgtctcaactgcgccactcccgtaccag

SEQ ID NO: 193651 - DNA, 420 bp, Homo sapiens
atgttagtactactaaaaaggaaaatccaataaatgtggttccaatgagacctgcaatctgagagatcatggctcctagttccatctgccgattgtagcataggctctcttctccttctgtagcctctatgactgagtagtatacggtaactggaatgattatgcccagtacaactccccatatgtaaatgcatagttttctagcaaagttgggctggcgaaattttttcagtaaatggccataaaatattttctcatagcatgaagtagtctcttgcgaggaatccttttgcattaaggtagcatagcggcttatggcaatccaacttaaaattaagagactgacaaacatacttgcatgcatggatagagttcccagaaaattgaccactctgcattgagcagattgatattcccatt

SEQ ID NO: 193652 - DNA, 203 bp, Homo sapiens
gttggttttaatttctaatgtgtgtgcctgtagctgtaccactcctcctgatgactcacctggctcctgcgggcatctgagatgtggtttctgctccacacttcctgggggagcagaggaactcctcagcctcctctcaaacttctctcaggttgtgctgttcactccctccccaggcttccggtccacacggacagctctga

SEQ ID NO: 193653 - DNA, 720 bp, Homo sapiens
cttgattatgtcataatttgactgatttgaggacatgggagtgcttctctattctcaagccattattattatgaatctagagtccttttttggcatggtagttttggtgagcctgctacatattcagtccaaaaatctctgatagctgtaattgaaagcattattgagagaaaagatcattttagttcaagcaaataccgaatacttttttactacgtggaaattctctccctcagtaattttgttacagtcagtgtaaaggccacatcttataatatggataagaaaagttactctggacaatgcctcgttgagataactattttcttcagaatgtcctgttgttgaggattacctcaggagcttgacacccagctgcagaacacagagagattttccttacactttaagcctttctgttgccttcctcatgactaaaactgagtagtgaaaataatagtgtatggagaaaacacaaaaaaatgaaaattaaaaaattgtatataaccacacatcctggttctttaccatgttataatgggaggaattgttagctattaattaaaagccaataaaaagtttaaatatctaatttacttgactacatttttagtgtagtgtttattttgtcttttgtttcttgagcatctgtttatcattgacagtattgttgggctacccaccaggagtactgagctaccatccaagcaaaacccattc

SEQ ID NO: 193654 - DNA, 574 bp, Homo sapiens
ctggtccttgaccccccaaatccagacaacacatagagagatgcacacacatctcccatccttcctgcatccctcttctcccactgctcaagaggactcttgtcccttttctcctctcagggcctctcaccatcttaagttccactgtagggtggacaagacgcagaactggaatgaggcaggcctgggtttgatcctggatctatttactgtatcacctggagtagtttacttcatcgctgtggacttcaatttctcatctgtaaaacagggccagtagaccaggtgctgtggctcacacctataatctcagcactctgggaggacatgcaggaggattgcttgagaccagcctggacagcatagtaagaacccatctctaagaaatatatgtattttttaaattagctggtgcagtagcatgcacttgtagtcccagctactcaggaggctgagtgggaggattgctcccagcccaggagatccaggctgcagtgggccatgatcaggcttctgcattgcaacctgggtgacagagcgagaccctgactcaaaataaaaatggggccactta

SEQ ID NO: 193655 - DNA, 509 bp, Homo sapiens
gcattgcttcctcccctgagccttttctcagggtgggccatccacatgggcagtggcctgtcatcacctgggagggaccgcaggcgtggcgtgtttcctggagtcataggggcgctcacatgaggcgtgcctcccttggcagtcggatgttgcctggggagggtcgtaggacagtaaaacccggccggtttgcctgtgagtgtgcaagcatgagccccgtcacgcgccccctgagatcttctcagggagctgctaatcgccaccttccggggtttctgtctgtctgggggaccgcccgtccctggcaccggctcccggcaatcatttattatttgagacaggtagtttaatggcagcctgacccgtcgcctcctggtcgcctgatgtgtctggtggggtgtgggcgtggccctctcctgcgctgctcctgtctgaccagccgcccacggtaacacagaaacatctggcaggatggagtggttggcggaagacacatctgacgagatcga

SEQ ID NO: 193656 - DNA, 642 bp, Homo sapiens
ttgccagtgtaagtggagccgaatccaccatcccttacgccacactgccattgcagacccaaatgggcacatggagaccagcaaccccatcccctctgtgccaacattgccaccattgtgaacacacatatgaatgccaaggcctggtgcctctctctgtgccaccactagcatgaacacatgtacagatgccaaaaactgccaccactgcaaacacacgctcagaggctggcagccctgtgcctgccagcagtgtgatatagtgccccacttctactggtgtgagtgtgagcaagaacactgaaacagcactctgatgatactgcaccccagccaacatgaatgcaccccagcacactgccactgctgctggcatgtgcaaatgaacacattccactgccaccatccctaaaagcgctttggctggcaccacctattgaaatattgtggctagtggtccaggaacacatcaacctctctggcacagctggtgtgaatgtaaattacttcagccagcatggaaagcagtttggtgatttctcaaagaacttaaaacagaattgccattcagctcagcaatcccattatttgttatctacccaaaggaatacaaatgtttctgccataaagacacatgcacgc

SEQ ID NO: 193657 - DNA, 406 bp, Homo sapiens
acgagaagttaagagtaatctaaaatttaaggtaggtctctaaactatcaacaaaacactattaatgtacctaaaatgaaaacttgcgaattccagggctaaatgattcaaacaaatgttaatagaaaaggagggcaccaatctgaccattagccaatttaaaaatttacgcattacttgttatacataatcagggcaactttaagacgccattccaggcagatttggggtagtaggcggctggcttttagctaactctgcttagctgcggggtaaatgtcaaaggtcagccccatggcgaatctccctaagccccctgtcgcaaccgaagccgatggaatcaacaagacaaagatgctcctgacccactggctagaatcgtgaagaaaacgctaatccatgtcaa

SEQ ID NO: 193658 - DNA, 688 bp, Homo sapiens
gatccccccagggtcccatgaaagggcatcatgagaggcatatcccagctagacttcagcagcaagcactggccttcttttgataaagtggcaacataaagtgcagtcctcatatttttcctaatcctcaaacagcttcccagtcgtgcttacctatattacgctctttcacagatgaaagagaaaacaccaagaaaaggcacatatattagccatcattcttgtgtgtgtggaaaaaggtgaaaatagaaatgataatgccatgtggtattctgaacaacagtaatccctaaagaattgcttaatcaaaatttgctttccaaaaagtatccttaagactggaatgaaatgtgaaaaaatgaaagttaattggttgagaggatagaattctagttgactttatttttgactttttattagtattataatattgtttatacagtaaatagaacaaattataattggttgaaattatccgttagtagctgaggggtataacttttcccccaaatatctgaatgatacaaagtcatggtcaaagactgtgtggtggtctgttctgttttacgcacatagtgttttatatattgctcttaaatcacttggtgtttggattgatgcacttgtatttgtcctgtgggagatgcccagctagctctgccagctaactcctgctggagtgacagta

SEQ ID NO: 193659 - DNA, 707 bp, Homo sapiens
cgcggcgcagtgccatgtggattgatggtttgactttttccacgttcagttacagtgagcgagttccctcagcgtcagcagggtttctcagtcacgtagattatttgctgctaagtggaaaacaagttggttggtggccttttgatgtgatgccagcctcacttctggagatgtgggttttcttggaacccaaagcagagaaggctgagtggtgaggtctgtgctgttgtggatgctgggtgttcccagctgcacctggcccgctgtgtccttcccccggtggccgcctcccagcagagcaaggggagtttgacgcccacttgatccaccggactcatagttttaattaatcatgccctccagcctgcgtgcaccctaggttctaaacaacctgccagctcacacctggaaagtgccgtcccccgtttttaaaggcttttgagctgccctgtgggtggcgtagttgctgtttctaagaaagtagaagtgagttttaaggtcaggttttgaaattttagatgatagaatttgaagtccaaaatagtctgaagtattttcccttttcttacagacattttaaaaaataaatggttctaaggtcttttttttttttttttgaaagagagaggttaaatatttatctttcatatgtgaaaaatactagtcacaaagtacatgcactcatcttgggttatttattcttctaa

SEQ ID NO: 193660 - DNA, 370 bp, Homo sapiens
cttccaacatacaatcaaccatggcattatcttagatcaaggtcacaaaaacaagcccttggcctacaatcatgttgtggctctagaacgttcttaacaagctttccaggatacttctttcctctattaagcagtctaggaccctctctatattttttctgaaatcatgaggatcttgtctgaatagacctgtgtacataaaagatgctaactattctcacttgatgtacagtacttttagagttccatccagagactctgagttgggaaggctggcataccacacaggattaggatttaatctgaaaatgataggcagaatacaaatcagaattcaagcagcctgagccactgttcatgatgatggaaa

SEQ ID NO: 193661 - DNA, 291 bp, Homo sapiens
tcgaagctgtgtgtccttgggcaacttacctaccctctctgtgcctcgatgtcctcagctgtatatggagatgataatgtctacctcattgcatttttgtgtgcatgcgagaattaaattaacctaatcatgtaaaaggcttagggcagtgcccggtaaaagagtaaaagataaacaaagcctcttttccttctcccatggaaaaatgacatagggttgcctgttgagttttgttcccatggaaacctgacaatagtgtgaggtcagccggtgccatggattgaatgttcg

SEQ ID NO: 193662 - DNA, 364 bp, Homo sapiens
aaatgacttgtttcttggcctaattttacccattaataaaatgggggccatggggctggcagtagtaatcaaattaatatgatatagtagaaaaaggaccagattggatgttaagaagatgtgatttctagcacattggctgagtgatcttgggcaaatcaattcaacttattgatcctctgttacttagtgtatgagatgggaaaaataatgctgattgctttccttacaaggttattatgagaattagatgacataaactgtaaatacttagatcattattaagtaaactatgactggcttacaagtatataaataaaactgtttttctttgcaatttaaaaattaaattaatttttgattt

SEQ ID NO: 193663 - DNA, 282 bp, Homo sapiens
taaaacgagttaggaaatattctctctgcttctatcttctgaaaaagattgtagaaaattggtatatttccttccttaaatgtttggaaaaattcatcagtgaacccatgtgggctttgtgctttctgctttggaaggaacacttgtttggtgttctctaagtttcctggatctgtggtttatttcctgactttaatttggggaaattctcagtcatagttgcttcgaatactgcttctgctccttttgctttcttctctttctggtactcccatacatgta

SEQ ID NO: 193664 - DNA, 302 bp, Homo sapiens
aggaaggcaagtctgaagcgtcaagtttacaagagtgtgcacagcacaggaaaccagttgaaattgaagatggcaacagagaacggaaaagattgaaggagggaatttggaaagctgagcctagatgaattcccagaggcagtgacttatagggctcggaggccctgtgtatagggaaccaccgctgaacctgtgggtcagagggagtcatcaaagatgttgtctcttgagaaatgaggagctactgaagattctctctctcagatacctcaacattttagagacatggagtgatcctacag

SEQ ID NO: 193665 - DNA, 337 bp, Homo sapiens
tctctaggcaactgcttctaaacccaagcctccaaccctaggaaggggtctcagagtgtcgtgctggctggtgaccctgacgcttccctgtcattctttgtagcttgtcctccggacacctttgggaagaactgcagcttctcctgcagctgtcagaatggtgggacctgcgactctgtcacgggggcctgccgctgccccccgggtgtcagtggaactaactgtgaggatggtgcgtgcagcctcttctggtgcttctggaattacccctgggctgtaagggaagtgggagacaccacccctccacgtcctccttgtctccttcctcccactggag

SEQ ID NO: 193666 - DNA, 617 bp, Homo sapiens
cctgcctcagcctccggagtagctgggactacaggcacccacaaccatgctcggctaattttttgtatttttagtagagatgggatttcaccgtattagccaggatggtcttgatctcctgacctcatgatccgcctgcctcggcctccctaagtgctgggattacaggcatcagccactgcgcccggccgatatcatctttctagagccaacgacaagagcagcacttatttcctgtaccatgaatttgtgggatgattcagaccaaattcctcagccctcttcaggacattttggctaactgaggtcttcttgtcatgttggagaaagggagcaagatggggattctgcacaactcaagccccaacatgtggggacagactcaagtagatcaccactgaggctttttgtggtaatgtggatactgggaagcctgaggaaggctgtggccacaaacaggctcattgaatttaccccttgaaatctgcacagaacttggacagctcactccccgatgagccaccacatttatacctgcagctatgacctttctcttgagcctcagacccttatatcctcctgagcactggttatttctactttgatatttaaaaggc

SEQ ID NO: 193667 - DNA, 552 bp, Homo sapiens
ttcctgagctcagaggatggccagtgaaacaacttgctaaaatgctgagactccctgcactcgcgagactacgaaaacacgtgctgaagtcagtgagagccacggtggccaaagtctttgctcagaaccagctgcgcaggtccctcccccggttcctcctaggctgagtactctggggtcgcagtcttcctggacgtcgcctgttggttgttgtaggggttttaggtgtttttttttagggttgtcttgctgcattttgttgcggaccacaacgcgttgcaatcctagtcagctcaggggcttttcaggtatttgacttaagagctgagtagctgggcaggctgataagaacagacaaagcgagctcttttgcaggctagtaaactttcatcttagactactttggttcaggtgagggcggctaagcaggtgggaaggcagggagggggaggccgacaagcaggcattggggcccatccaagcaggggcctagtacgtcctgtttttttgtagtttgctgacctaaaccggatcaagccaccttgtcttgga

SEQ ID NO: 193668 - DNA, 507 bp, Homo sapiens
ttcgtctctccccttggagccaggtgggcccatttgcagctggcctgtcttggggacctgcagccaggtggcgctcagtaatacctccttgttggctctgaaatgagtctttggaggtgggcagagattctcgaatgcagcctcttcagctcccatgagtcaccccattcctgagtcgagcagccccacagtctcccaaatgtgaggcagaaaagcaaactgtggccgggcatggtggctcacgcctgtaatcccagcactttgggaggcagaggtgggtggatcacgaggtcaggagttcaagaccagcctggccgagatgatgaaaccccatgtctactaaaaatacgaaaattagccgggagtagtggtggtgctcctgtaatcccagctactcgggaggctgaggcaggagagtcacttgatcccggggggcagaggtcgtagtgagccgagatcgtaccattgcactccagcctgggcggcagagtgagactccgtctcaaa

SEQ ID NO: 193669 - DNA, 440 bp, Homo sapiens
tctctgcctgttcccaggtctcagttcactctgcccctgccctagggagtctcccgtgagtcacagcttcactgcatcctgaataagacctccctggatcagcattggagactttccaggatctgacccagacccttttctagccccatctccaacctgtctctaactttgccaacctaaataggcaggctagcccagtggtaagagtaggggagtttagtgcctgactgcttaggttggagtcctagatccaacacttacttattagctatgggaacttccacaagccacataactagttaaagccatagctccctcccctggagaatggagaggttggcagaattcacaatacagaggagctgtggcaactaatggagacacgtatgtctccattagctggtatttgttggtatttgttctcttttaacacatccacc

SEQ ID NO: 193670 - DNA, 129 bp, Homo sapiens
ggaaacccttgatatctccagaagcgctcagagtcactctagacaactggtgataagtatatggagaaagaaacaaatgaaagaaacaaaacaagccaggagaagtggttcactcctgtaatcccagca

SEQ ID NO: 193671 - DNA, 464 bp, Homo sapiens
gttgtttcagcctctgaggggcacaagccatcctggattcccctaaccccatgaggagccattctagcatctcacagcttaaaccagctctagctcagtcctcctggcttagtccatttttcttcctcaggctctgagggcctcttgttccttgctctgtggggttttctccagttgtctcctggctgcaggacatggcaggacatagaatgctgtcatccttccactcttcattggcatctccacccagtgtcacatatgaccctagccctgctctccccttgccagtacccctctgggattttgcgagagtccacaagttgtgcatgtggtggatatattcaggccatcttgtgtgtacaagctagagggtctgcttccacctctggccctcagtgaattgctgactaacctgtctcaacacagcacaactgtacacaccttttcctggcctcatccctaac

SEQ ID NO: 193672 - DNA, 781 bp, Homo sapiens
ggctccatcgaacccgtgtgggagctgctcccgcggtttgaatggctgcgggctccgccatggataggccctgcccggggccaggccttccaagcccagaaatagaaacgtggccacagctcccacctcagtcccgaaactggagccgaagccctctgtccctggccgcaccagagccggcctccctgtgtgctgccagccacgcagcagcttggagaggacccgtccttaaacacttcccgactgccgggtccagagctgcgccctccctcccttactcatcgcgtttgagttcgcagttggtgtcctggttttccacctgagtgggcgctgggatggaagggtcccgcccaggcgtctggtgcggtcaggcgcacataagcagcctttgcaggaagccgtggctgggcctcgatccgagttctagcgccccaccgtaagggagagccaggtgcttcctgtccctcccggccacctcaagtgtaaaatcacggggttcagggcggtggtcttgggggctgcgctgcacagccgtttgcagctacagcagctgctcggagctgtctccgactttgcacccccgtttcacagagggagaaaccgaggcccagggagggcggggcttgcagcggacgggtggaggaagggctcctcctttcaggtcccaactctccacagtggcaatgaggtcgctcttttttcctttttttgagaccttgtctcgctctgtcgccattgcactccagcctgggcgacaaagtgagactctgtctccaaaaaa

SEQ ID NO: 193673 - DNA, 781 bp, Homo sapiens
ggctccatcgaacccgtgtgggagctgctcccgcggtttgaatggctgcgggctccgccatggataggccctgcccggggccaggccttccaagcccagaaatagaaacgtggccacagctcccacctcagtcccgaaactggagccgaagccctctgtccctggccgcaccagagccggcctccctgtgtgctgccagccacgcagcagcttggagaggacccgtccttaaacacttcccgactgccgggtccagagctgcgccctccctcccttactcatcgcgtttgagttcgcagttggtgtcctggttttccacctgagtgggcgctgggatggaagggtcccgcccaggcgtctggtgcggtcaggcgcacataagcagcctttgcaggaagccgtggctgggcctcgatccgagttctagcgccccaccgtaagggagagccaggtgcttcctgtccctcccggccacctcaagtgtaaaatcacggggttcagggcggtggtcttgggggctgcgctgcacagccgtttgcagctacagcagctgctcggagctgtctccgactttgcacccccgtttcacagagggagaaaccgaggcccagggagggcggggcttgcagcggacgggtggaggaagggctcctcctttcaggtcccaactctccacagtggcaatgaggtcgctcttttttcctttttttgagaccttgtctcgctctgtcacctacgctgaagtgcagtggtgcaatctcggctcactgcagcctccacc

SEQ ID NO: 193674 - DNA, 227 bp, Homo sapiens
atcagtatggccaccaagaggcgcccaggatccatcctgcatccacctttcatggcttctgccagctggtcaattgtttctgtacccacaagcctgcatctccctgttctggatccctgcacagaactaggagactccttgatcccagccccaaccttccaggatccactgtgctcattctcatcctttccctgtcccacaccaccaaaacaaccacaagtcccatc

SEQ ID NO: 193675 - DNA, 238 bp, Homo sapiens
ttaaaaccttttctctaatagaaccttttctctaatattaacgaatactactttaggctctgatataatttcaagctttgattctgatatttatgacaaaaatatgccactgcaacccttttttggttgttcatagaggtaatacactgtggtatagtttagagtctttcatttgtgactacagcctttcgtttctgactaaataaggcatattataaagatctaatgttctggatca

SEQ ID NO: 193676 - DNA, 163 bp, Homo sapiens
cacttttcttcacggctgcccgctttataagcactcttacactcccactcattttagcgattgaggagagactcagcaatcagttgaccaaagcatctaacatactttttccatatttctatatccttagtctgttcactgagggtgatttccaaggagtcga

SEQ ID NO: 193677 - DNA, 303 bp, Homo sapiens
gatgctgtggccgaccacacggtgaaggtgttggcacccaaagcctacgggaggcttttctaaaacaaggcctaagtcaggcctcacagcgctcagtaacagatgagaaggtgcggaaccaccttcaaacacccgctacctgctcacaagaaggaagtcctgccaggcgcggtggctcacgcctgtcatcccagcactttgggaggctgagacgggcaggtcaccggaggtcaggagttcgagaccagcctggccaacatggtgaaaccccttgtctactaaaaatacagcaattagccgggc

SEQ ID NO: 193678 - DNA, 506 bp, Homo sapiens
gagttttaagaatggggtggttgagagtcggaggctacagagaggttgaggagcttgaagaataaggaaaaggtcatcaaagtgggtgatttgatcattgtgactatttagtagagtgatgtgggttgaagccaagtttcagaaggttagggaggtaaggcaggaagtagtgaccaaagaggactcttaagaaatgggtggagaaggcaaagtgtatgatagactgcgcagtcaagagcataactgtggagaagagatgtttgtctaggggtgggaggcattactgtgagcctgtttctgagggtgaggaggtaagcttggagacaggcatatcttgaagatgcagtggctgctgttgtggattagagtttggtaagaagtgagaggttacagaattctaggtgttccagatagataaactgctttcttcccttttcatttggctctggctgtcattttaacgttctaattctttaaaatcaccagcagggggacagggcttgtat

SEQ ID NO: 193679 - DNA, 287 bp, Homo sapiens
ttgccaagaacctgtttgtgttagggaaatgcctaatccacactgtcctccagccacaccaggttggggagtctaagtgaagatgtaaggggtggcactggttttaaaaacaaaaacagaatcatggtttctgcctctgagaacctgctcccaccccggtacaatggctgcttccaaagaggtcctgctgctgtgtgctgtgttcccaggagtggccatgaagattccacttgtgctgtgagcatgtatagtcatacctcctgcatgcacgggagacacacactgtt

SEQ ID NO: 193680 - DNA, 508 bp, Homo sapiens
caaataaccagaagacagaacgaaagggatatcactttttttaattatgctttagttggtagcttaatttggctgtaaaaagagggaggagttcatctccctgagcatattctcactaagtaacacactgtgtagcacttttaaatgcaataccttgagatcagtattttaaatgtaatactttgagaagaaaccatgtcaaataggcaaattccagtcaaaacagtgttatgtttatggtcttcgggtcgtttacgacccgaagacaactgcacattcttcagctgcgtgaagatccacaaccagctcatctcgtccgtctccaacatcgcctgccccaactttgatgccagcatttgcatcccgggctccatcacattcatgcccaatggatgctgcaagacctgcacccctcgcaatgagaccagggtgccctgctccaccgtccccgtcaccacggaggtttcgtacgccggctgcaccaagaccgtcctcatgaatcattgct

SEQ ID NO: 193681 - DNA, 411 bp, Homo sapiens
gttagaggtgattacttgggagatctgaatcatgcttctctcttgggtattttggttggaggcggagaagtaatatgggggagcagaatgaggatagaagtctcataatgactcagtagctaatgggaagtgccagtgggaaaaaccagagtgctgtatgataatgacttactgtcttgtaaaaggaagagatacacaagaatacaggcttttgctcccttgtcaccactttcacttctctccccttccaagttttcatgtccatcttgcacaacttctctctctctctccattcctttcttgtttccccctgggtctcggtctctctctctatttctctaactgttgctcaattactcttcaaagagcattttcttttaatatctgccacatgttttagataaacttgta

SEQ ID NO: 193682 - DNA, 719 bp, Homo sapiens
cattgtgttgtacccttggaggttcagatcataatcattagataaagaaatctgttaaactgtatattgtatttttcaattactttgaccatataaccgttttatttgttagtaattaaaaccctaaggagttactgtcacatgttggaaaatgccagcccaagactcaggtataaaatggaggaggagtatttttcagggtaattgactgctcttcctcagcctggatctgaaattgttaacactgagaactaagcaaccctgctcacagtttgaaatgaagacacaaggaagaattccaggttcttgccctgtggtactccctgggtgaacttctgtgtcaattgtaaatctagttttaattgaaagttactaaaatacatcatgataaaaaaaatggtgactctacctgagacctcaatttggtggtaaatcatcataaaatagtgatgattaaggggaaaaatgagttatttggcttatctaaaatagagaggaaacaaaaatgaatgaacatgttctgtaatttgtggagaaaatctaaacacttatctcaacggctaaccacgtttgggcaggagaagctttgctatacccattcaatgttcatttaaatttagaacgggatccacagtgtaagccaatgcttcttaaagtttaatgtgcatctgagtgacatataggcttattaaaaatgcagggcccccaaaaggcactga

SEQ ID NO: 193683 - DNA, 146 bp, Homo sapiens
aactacaagttccatcttgaggtgtgattagattcaggttgaatatttttggctagaaaaattcataagtgaggcaggcacggtggctcacaccgtgagtgtgtaatctcagcagtttgggaggctgaggtgggtaggtcacctga

SEQ ID NO: 193684 - DNA, 427 bp, Homo sapiens
agtaaatgaagataaaacaaaacattttatttttcttaatctgaagtgatgtaacaaatagcagtttgttcgaaataataataccagcaatgtattcagtgattaccttatgaataagtgaaatacatgacaacaatgttataaagaatgaggctgggcgtggtggcttatgcctataatcccagcactttgggaggctgaggtgggcagatcataaggtcaagagttcaaaaccatcctggccaacatggtgaaaccccgtctctactaaaaatacaaaaattagctggacatggtggcatgcgcctgtaatcccagctactcaggaggctgaggcaggagaatcgcttgaacccaggaagcagaggttgcagtgagccaaaatcacaccattgcactccagcctgggtgacctcttgtcaaaaac

SEQ ID NO: 193685 - DNA, 524 bp, Homo sapiens
aaggaactgtttggggaagggctttccagcagatggaatgacagccagggacagctggggtctggaggccagcaggattggagcagaatgggcatgtggacaaaagtagtgcatagggaggcctgagaaagtagactctggaccacttattttgactttgcatgaaatgagaagtccctgcagggttctgggctgaaatgtaacatgatataacttaactttcagcaggatcactctgggagctgtgttgagaatgtagaggaaaacaggggagaagcagggtggacaattaagaggatattatagaaattcaggcaagagatcacagtgcttaggaaaaggtagtgagagatacttggattctaggtaaatttttaaagtagatttcctgataagattaaattagacatatgagagaaagagaggggaggcaaggatgactctgaagccttgggtctcaactaccagaaggatggaacgatggtcaagtgacatagcaggcagagcaatttttggagaggaga

SEQ ID NO: 193686 - DNA, 876 bp, Homo sapiens
cattcaaagcaaatggtaagaaaggaactttcaaaactgttttagttttgcaaagattagaaaagtacaattctactttctcaacttttcatccttgttaaaggcctggaaatttgcagcatttttttctttcttattttacttttctaatttgttacacaaagtgaaattccacacataaacatgcaagctgaaggttgggtttattcataggttttgtcttaattatagatatttagtttattgaatatcttattgagtattgagtacctgctgtggtccaggcatcttctgaggtcccaggtgtacaaagaggagccaattgtggttactgcctctatggaattgcctagaagtgggagagagagagatgagtgagccagcacttataatacatctacctaggataaaatgggagcacagaagaggaacatctgtatcagtgggtctctgagagcttcttcaggaaaataatgctttatctgtgatttgaaatatagtaggaatttagcaagatagagaaaaaggaaaaggaggtaaaatatttttcaggtaaaagaatgtacatgggtatagaggtgatcattattagcaaattggctacatcctaatttgtaagtatttgtggatttttcaaaccttatatttcatgtagaagagctgaatgcattagtctcatctccaagatccaggtattgaaatttaacccatgcataaattgaatttttttctgaagtctttaataagagaaaaataaaaggaaaaactacacagtgtatagtagatttcaatatagcacagcaaacactgatgaattttttttgcaatgagttcaatattataaaatagaacaaaattggagtttttaaaaccaaa

SEQ ID NO: 193687 - DNA, 337 bp, Homo sapiens
acgaaggtaactcctggagatcacatgagagcatgaggcagtggagatggagaagagcacccagcctcatgcctcagtgcttcttaggcttttacagcctatttgttctttcacatttggaggggagaaggtaagtctagagataaagatttgagagtcagacttatcaggaacttctagaggaagcttgagacaatcgaaggatgacagaaatgaaaaggttccatgaaaacatctgtatttagaagacggaaggaggaaggagaaccaagaaggaaatggggcaagaaaggcaaaatcgggtagaccaggaggaggaatcagggatcactggaca

SEQ ID NO: 193688 - DNA, 967 bp, Homo sapiens
aggaagggaatacgaagcctggtaaaggcagtaacaaccctagcccgactctaaataaagtcttcatgatagaagggttctctgcacactcagaaaactcttgggctccaagaaaagccggggaggaactcagttactgaatgaacaaaaccttatctgactcagccagatcccaaaggagtgaagaatcctggagctggatgagaccttgttcattcccctctggagagagtaaaggacttgcgtggggaaactgactagtttgcagtggtatgagattctagatccctggcttcccagttctcagaagccctactgagactacagcactgactcggactctaattgcaaaagatgaacacaggaggtacagtcagcattaagctccagacagtatgaccatttgagcatccataaaaagacactgagcaagcaagaaatatcttaagatggcttccacttagtgtcaaccccaattggctccctgcaattaaataagctgaccagaaccctaagagatgaaagataaatgcacttccttcaaaaatagatgttattcttacttctgtttatacaccaactgtaaaagttctgtttcaaattcttctctagtagggaaagcaggaagattcactgaatgctggcattgtgtgggtgtccccaaatgcactcatttgaccacaaggaccctgagaagtgggcattttatactcgatgcctactgcacactgccggggagaagccaggcctgaacagttttatctggctccaaagtccacagtcttcctccacatcctgttgccacctccgacattcaaaaagatgtcaccacttgcctgacaaacagggcactgagtcacctattcacacagatgcgaaatggcaaaaaaaatacacgagaaagatcctttatgcagaccagtttggccagaagcagcaaactatgctctcagcaaataatcctgcg

SEQ ID NO: 193689 - DNA, 389 bp, Homo sapiens
attcaaagctctacatcatttgttccaaatttctgttctctattctcatctcctactcaaatgccaacaggaagcgtactctgattttgaagaattaacgaccccggtctctgttctcccatggtgcttggataggttatctttaacagttcttaccaatcattttttgctctgtggcatgcatgtatatcttgctccctttctagaatgggaacttgttgatgtcagggactgtttcacttctctttgtgtgactggagagacccacataattgtccaggttgatttaagtatagaatccatttggacatggaaactctctctctctctttttttttttttaaagagatgggggctgggcatggtggctcatgcctgtaatcccagca

SEQ ID NO: 193690 - DNA, 185 bp, Homo sapiens
gagaagctgtgttggatgcagccacccaaagggacctcagattcatggtgtgtgaaggaagccaaacgcaagactatgcactggataattccatcttgaggaggtttaaaaatctggcaccatgactctttggtgatggaagccacaatagtattaaccttggggcgaggggacactgactggga

SEQ ID NO: 193691 - DNA, 305 bp, Homo sapiens
atttttttatagctcatcagctatcgttagtgttaatgtattttatgtgtagcccaagacaattcttcttcttccagtgtggcccagggaagccaagagattggacacctctgctataaaaaatactaagggaattaataaccaaaaattcagactagagattattggccgagaaggaagaggagtaactagggaaggcacaaagcggacttcaaagaaatctacttcttaagctaggtggtatgtacaagggttcatttatcattctcttaaacgtctatataatcttacatggtaaaatttat

SEQ ID NO: 193692 - DNA, 364 bp, Homo sapiens
cgtcagctcggacagtcggtctaccattgtagaagctgggatagtatcagtgatcaagtgagtccacatccacccttgtacagataaccaaccagaggctgggagaggtggtcacggtggcactcagaaccagaattcatgtttttggtttttctttttctttttgagatggagtcttgctcctgtcacccaggctggagtgcagtggcacaatctcggctcactgtaagctccgcctcctgggttaaagcaattccctgcctcagcctcctgagtagctgggattacaggcgtgagccaccaggcccggctgtctgtggtttttctttctggaatttctgttactcagatggtagaaccgact

SEQ ID NO: 193693 - DNA, 327 bp, Homo sapiens
tgtattggtggtgcttgcaattgtttgattttcctggtaccatcatctgaatcaaactggaaaatgttgaggaaattaaaacataaattttaattaaatttctttttctgcacatagatcaatttttcctgttttatccaacctcttgtacttaagagttaaatttcgagaaatcagttaagaaatctaacttacaaagaaatggataaattttatagttgttttcctagacttacatatctgcattttattcagatattgctgtattttcattaaaaattcctgttagtgtttgaatatagaaaactgttcttagagacttaacag

SEQ ID NO: 193694 - DNA, 419 bp, Homo sapiens
aatgacaataaatgtaagtggtctaaatgctccaataaaaaaacaaggattgttagattagatttttaaaatcaggacataactatacgctgccaaaagcaaacacactttaaatataaagatacggctagattaaaagtaaaaaggatgagtaatatatgccatgctaacactaatcaaaagaaagctgaagtggctatataaacattagacaaagtaggttttagaacaaagaatattaaaagggttaaaggagataatttcataatgataagtgggctaattcaaaagaacaaaacagtcctaaatacatgtatacctaattaccaaattgcaaaatacatgataatgaggaaaaaaaatgataaagccataagaagaagtagacaaaatccacaataattgctagagttatcaaa

SEQ ID NO: 193695 - DNA, 467 bp, Homo sapiens
tgcagaatgagagaccacatggaggaccagcctacttatccctctgagaccatcctagatcagcctatagcaagccagtccctgaacatacaagcaagtccagcccagatcagcagagccgcttaccctaggagcagatgcatcagtaaatccagaggagaccaatggcttaaacaataatcattgcaacaataataactggttctgtgttaagtcactgagtggttatttatgccaaaaaaatctgttactagagacaacaattagtgagataggcagaggaggtcagcttgagtaggactttgtaggcatgatgtgaatttggtgttttgtcccaggagttatgtgaaattactgaaatgttttgagcatggaagtggcacaattaggtttgtgttatagaaaaatgaacttggctattctgtggagtataaatggtgggagcagggatttagaatgaatcccta

SEQ ID NO: 193696 - DNA, 475 bp, Homo sapiens
tgaggacctcaattctacaaaagtacggaactgaattctgtcaacaacctgaataagctggaagtagattcaccccgcaaagcctcctgaaagaagctcagccctgttgacaccttggtaggccttgtaagaccctaagtggaagactcagttgagccacactgtacctagacttctgatttacagaactgcaacataatgagtgggtgttgattttagccactaaatgtgtagtaatttgttatgatagcaataaaaaacgaatacacctcttaagaggtgaaagagaaaagagggagatacaagaggcttagaaagcaactggtctaagataaattgatagacaactaggggaatgttttcaagaaaaaattgaatgagttccaagcagtagatagaaatggataaagagaacatgaacatactcagtgacatggtgaagaaagtatttatttattatttactctaaaggaaa

SEQ ID NO: 193697 - DNA, 204 bp, Homo sapiens
cagaatcgcttgaacccgggagaaagaggtcccacagaggcgggaggattgcttgtgcgcaggaatttgaggtggcagtgagtcatgatagtgccactgcactccagcctgggccacagagggagaccctttctcaaaaaaagagaggaaaatcaagattagcaatacggaaaagaaaagattttcttgatccactacccagag

SEQ ID NO: 193698 - DNA, 445 bp, Homo sapiens
cagaaggggagctgggtttgctgttggttttaacccagagtaatcatttaagagggaagagattaagtcagcagaagcccccaaatcttatttttgtcggtagctcccacccgtatgcatgaccccggcatggagcatttttcacccacgctcgctctccccgcctgtccgtccaaatttcattgctgccaaaggaccaaaaaaggctgcctgtctgccaagaggtgacccagagcctgggtccaggcacctgcatgttctcacgcccgccacagcccgtccctcccaggctctgggaccctgggtcctcagctgtgatggcacaattgctccaagcattccccagcaccaaaccccagtgaagtcagattctcccagtgaagtcagattctcctggcctttcctgggtcccgcgttcagactacctttgggttccccagcctct

SEQ ID NO: 193699 - DNA, 454 bp, Homo sapiens
cctccactaggttgtgggaaagcagaaatcatttcaggtgaaggaagttgtaattaaagttttcagctgaaatgtaactacagaaaaacttcttgttgagaaaaaatacaatatcataactgagcagtttcatgagaattgtctcattagaagttgaatcagtccgggcctgatggctcatcccagcactctgggaggccgacacaggcgggtcacttgaggtcaggagttcaagaccagcctggccaacattgtgaaaccccatctccactaaaaatataaaaaaattagccaagcatggtggcgcgcacctgtagtcccagctacttgggagactgaggcaggagaatctcttgaacccaggaggtagaggctgtagtaagccaagatcgctccactgcactccagactgggtgacagagggagacctctccaaaaaaaaaaaaaaaaaaaa

SEQ ID NO: 193700 - DNA, 226 bp, Homo sapiens
gaaaaaagccacgcgtgaaaggttatatattatatgattctacatatatgaaatgtccagaaaaggcaaatctatggagacaggaaaatagattcatgtttgcctagggttaacggatatgaagaagcttcataaaaagatatgatcttattggaatgatgaaaaaaacattttcaacctagatatggtgggctgggcatggtggctcacgtctgtaatcccagca

SEQ ID NO: 193701 - DNA, 188 bp, Homo sapiens
tcagcctcccaaagtgctgggattacaggtgtgagccacagtgcctggcctaagattgcctttcttctgttgctgtgtatacattttcaactgtatcttcctttgactgtctttgaaaaatgatgaattacatggtacccccatggtggacgaatcgagacatagtaaaattacatgtcgctcagtta

SEQ ID NO: 193702 - DNA, 378 bp, Homo sapiens
gaaagtttagaccagtccctaaagagcgccttcatgaccccactctgtaaccatcttccagaagcccccaactctccttatttttttttttcagagggagagaaaggggtagagatggaatctcactatgttgcccaggctgatctcgaactcctgggctcaagcgatccccccagctccagctcagcctcccaaagtgctgggatcacaggcgtgagccactacacccggctacttaatttattttttgagacagcctctctttgtagcccagactggagtgcagcggtgtgatttcggctcaccgcaacctctgaatcctgggttcaagcaattctactgcctcagcctcccaagtactgatctataggagtggtg

SEQ ID NO: 193703 - DNA, 274 bp, Homo sapiens
atgattagctctcttaagatgaaagaagcttcatctggcttcttgctcttgagaacgtgccctaagacgtggtggctcaagcctgtaatcccagcactttgggaggccgaggcgggcggatcacgaggtcaggagatcaagaccatcctggcaaacacggtgaaaccccgtctctactaaaaagtacaaaaaattagctgggcgtggtggcgggtgcctgagtcccagctactcggggggaggctgaggcaggagaactgcgtgaacccgggag

SEQ ID NO: 193704 - DNA, 423 bp, Homo sapiens
agagaaaatgaaaaggaaaataagataaagtcagaggtaagtttaccacacaaaccatatgctacaaggtcctatacagttataagagaaggaacacacatttgactttgagttcccttcctaagagagaaataacaatcagttacaagtcatgatgaccacgtaatacaagtgaaccagctggtcaaaggaaacagcttttcctggtaccgagacgtggagaaaaaattactaccatagattctaatgatgatgatgaagatgataaaaaacaatagatctgaaatgtttccaacacaaagaaatgataaatgtttgaggtaatggatatcctaaatatcctgatttgataattatacattgtatgcatgtatcaaaatatcataggcaccccataagtatgtactatttattttaaacatt

SEQ ID NO: 193705 - DNA, 647 bp, Homo sapiens
caagcttccgtctaaaaaaaaaaaattgctgctttttttgccctgttcagttcatgaatgaatttttagtaacttgtaagctatgggctgaaacttttaggcagctaacctaattctgtcatctactcaggtaagagaaacagaatttatatgtgaatacttgagtttaaaggccaataagtagtgattttgtttttctagtcttgtcctgttttttccatcccatccattttcttcctgcacactgcactactattaaatacctcttgccaaaatttggtttttgtcatgttcaagacttacttttaatgtatttgttcacttattcattctgcagatatttagtgcctactctgatctgggcagtgctcaactctgaattcttccaaccagctgtgcatgctgccatcctctctcttatgcagccttaagtttgtctgtccatggttcccatctttgctttatatccctggtcttaccacgctcttctgaagtacccatcctttccttcaaatacttttaggaaaaaggtctgataatagtgatttataatgtagttggatttaagtcgttgttttacgtctcaagaggcatttacattttgacttttcctataaatgtgaatgaaaagatacctctttcaaaaa

SEQ ID NO: 193706 - DNA, 396 bp, Homo sapiens
caagcttccgtctaaaaaaaaaaaattgctgctttttttgccctgttcagttcatgaatgaatttttagtaacttgtaagctatgggctgaaacttttaggcagctaacctaattctgtcatctactcaggtaagagaaacagaatttatatgtgaatacttgagtttaaaggccaataagtagtgattttgtttttctagtcttgtcctgttttttccatcccatccattttcttcctgcacactgcactactattaaatacctcttgccaaaatttggtttttgtcatgttcaagacttacttttaatgtatttgttcactcatgctcctgacatctgtcatactgttctgctggatttggcagcagtccacctttggttctttcactgccttc

SEQ ID NO: 193707 - DNA, 832 bp, Homo sapiens
gtgaccttctagttcaaaaaaaatgtatagaattatccatgcaagggattctggtataggaggtgtgggcggtgagcaaaaagagatagtggacgtagactacttgtttaaaaagcctgcagtgtatagaaggaaaaaaaaataagctgaccatcagttattggctgggagatgcccaggaaagacatgccttggctcacaccctggggcagattctgagggcactgctgctggaggctttcagctaactgtgcccatcacagctgagtgacaaaatgtcttgcagggagatctgagcggcacatgtccttggtataatttatgccactataaataggacactaacactgaaccatttatgccactataaataggaagctaacactgaacctgatgaacgaatccatcaggaacaaaagacagacagacacgcacacacacacatgcacacgcacacatcagcatggctgtatttggccatctatcagtagtcaacggttaatcagactgtatattgggaacatacatggctttgttttcttacagacttaaatttgaagaacagtgatgatgaactcattctatatcactttggtttaaaagttgcttagcaatgggacaaaaacaaaagcaactaggtttatatttagtgctctatctatatgcatctggagcacattttggaaataattcaaaaaggccaattcatttcatgccttctgctactaaatgaatgtgggagtcaagctgctattttcacagtgcaagacatttattgttgacttaaaaaaactctcccacttgcacataatcactatcctgacaaatgaca

SEQ ID NO: 193708 - DNA, 399 bp, Homo sapiens
cacgtagacgctgaactatgtgacgaaatagacaaaagctacctatggagttgtgccccctacgcaggtacttgcatatggcaaggccaagaacacgacaaagatacccactttcaccacctcttttacttatttatttatttttttttgagatagagtctcgctctgttgcccaggctggagtgcagtggcgcgatctcggttcactgcaagctctgccttccgggttcacgccattctcctgcatcagcctcctgagtagctgggactacaggtgcccgccaccacgcctggctaattttttttgtatttttagtagacagggtttcactgtgttagccaggatggtctcaatctcctgacctcgtgatccgcccaccttggccttccaaagtgctg

SEQ ID NO: 193709 - DNA, 233 bp, Homo sapiens
tctctgccctcatggagcttatagtctagctgagaaaggcaaatagatagacgtgtaatatatcaactggagataaatgctgtgaaggaaaatgaaactgggagtactgagggtaggatattgtgtgtgtatatacatacatatgtgtatgtatatgtgacatatatatgtagttggctaggaaaagctgctgtgatatggtcacatttgagcggagacttgctgttggaata

SEQ ID NO: 193710 - DNA, 571 bp, Homo sapiens
tataagattcacttaattcaaacatatattcatttaatgcactttgcaagtattcttctggaatagcatatgacaagaaactgtatttgcccacatttccttggggacatacacccaggggtactaactgatggctaaaaaagtggcatgcaattttgagagagattgttgtttctccatgtagacaaggagagatatttgtagaagtgatgcagcattttaccagatttatcactgaacaatttagtctagctgacttgatttatctttctgttgaatttaactagtggaataacttatcagtattggacagttgtgtaaaagtagtgaattactcattagcttgctggtaaggatggtgctgtgacagttcaattaaggtttcattaacaactgtctgctgtattttatctcaaagtaagagttccagtttacctggtaatgtgattgtgggataacctgagataacatttgttgccactgatagaatgttgtttatgggttatcaagatatcatatacaatttgaccttctttttgagacattacagcctccaaacacccacatggac

SEQ ID NO: 193711 - DNA, 285 bp, Homo sapiens
agttaggatttgaacgtggactatttctagaaataaagctaatatcagctacccctgattctcttaaatataagattaaattaattaaatataattataaggctaaatataattataaaattaattaccttaaaataagccgggcgtggtggtgggtgcctgtagtcccagctgctcgggaggctgaggcaggagaatggcgtgaacctgggaggcggagcttgtagtgagccgagatcgcggcactgcactccagcctgggcaacagagtgagagtccgtctca

SEQ ID NO: 193712 - DNA, 508 bp, Homo sapiens
tgctgctctaccttcaccttctacccccaccttggtcacattggaagagtctcactattttgtcttaacaaataactggctttttgtttagtttgtttttttatcttctgttacattaatttccacttctattttgatcatttcttctcatatacattctttaggttcacttttcagtggatatttttacttcttgatacggtttgtctctgtgtcacctccggtaggtatagatgaaggacgagtttgagaccagcttgggcaacacagcaagatcctgtctcttttcattacaaaagataaaaaaattagctgggcgtggtggtgtgcacctgtttccagctactcgggaggctgaggtagaaggatggctgagcctgggaggtcagagctgcaatgagctgtgatcacaccaccgcactgtagcctacgtgacagagtatgaccttgtctcaaaaaacttagactaacagtaaacaaaacacagtcatagagaattgagggtaga

SEQ ID NO: 193713 - DNA, 498 bp, Homo sapiens
ggaagtggatgggcatctatgggagtggacggctgggcaccatcctgtcactcaggggctggtctggcccaagtgcccagaggacctctagggggcagtgtcatgccattcaagacacattggagccagctcattcattcagtggtgaaattcatgtttactgagcccctcttgtggtagatactctgggaggtgctagggatgtggtggtggggatgtttcaggcctgggcctgacaaggagagaggaaatcaagcaatcccacatagtactccactctgtgagggaaacaacccagaaaggaagatagatgtggctctaggtggatgggagaggaagtcaagacctgaaaaaccaggagacagatgttctgcaaagagctggggagagaatgcatgcagagggaacactggtacaaaggtcctgaccatactcaaagccagtgtggctccaggggctccagatggagctcattcagctgtgccatgtgggacgcag

SEQ ID NO: 193714 - DNA, 886 bp, Homo sapiens
gacgaaatgtgtttaagagttcaactcacaaatttagtttatttctctgcctataaatagagatttgtagattcttataggtagagaaataaaccaaattccaactgctccttatgatcattcctctaggtgttaagagtgagagagggaaggcttgacaaatttactgaaagaggtatgggagtgtgaaagctttagacaaggtacaaagatccactctcagaaagagaaaatctgaaaaaagctccaaaacattgatcataggtttggagtttgatagttcacagctctatgtatggagaagagcttaaaggtaagcagtaccagaattggtagctttaaattataagcattgcctcataagggaaacatgaagacttggagacatgtcagtgaagacttggagacatggcagtgaagaagaagaaagaagaaaaaattcttcaggaaaagaaaaaaactgaacttagagaagagggtgttgttgaagtaggagctctgcctatgaaatgaacagaaatagaaaagagcaggccacatccatacagaactgtaagaaaaaacaaacaggaaatgtgaatcagcatttcaactgatgaaaatctacccccatcaaaaaaagcaggaaaaaattgacacaatgctccaagtgaaattaaacatcctcaaaccaatgtttggagatttgaaaaataaaattaagaaatattctgaaacaaatacacaagaacaaaaagcattaagaaatgaacacaaagtagattaaacagaaaaatagaagataaaatcataaccaataatgaagttttaacattcccacatttcaaattcaaatttaataaaaagtcttgaagaaaagcaggaaaacaggataattgagatgaga

SEQ ID NO: 193715 - DNA, 430 bp, Homo sapiens
aaatatgattagaaatttgctttgtgaatgtggaaccaaactagggaacgtgtatgtttggaacgttgagtggcatcagaggatgatagcttcacgcaaccatctcagtaggtttaagatatgccattgctttcagcaccagctggagttcatggaccagggaaaccctctgtcttaggtgggcacagccagcctttgttctgattctccttttcctgtaggaaaagcatgtttttgatttcaggataattatacctgtcctcttagagctctgttcattgcgatggtgttgtccacattctaagcatgctcaatgttgaatataaatcatacttaaattacagaccacacttttttctctctttttgcatatactattccatctttataattttgaatttttctgtctcctgattattttatctatcca

SEQ ID NO: 193716 - DNA, 300 bp, Homo sapiens
ccggacacggtttacatgcatgatggacactttcaacccttcacttcataaacttctctatcccaaccttgagggatagacttgaattttaggtatgtccaccatctttacaataacatttggccatctcccaggtccaattaaggtaatcaagagaaattgagattgaatatcatcctagttaacaaaagagtatgtaagtcaaatatatttgattataatttcaaatttctatcttcctagctgtatgatcttgagagagtaacctaacctctttgagccttagtttctgtctgtaaa

SEQ ID NO: 193717 - DNA, 1137 bp, Homo sapiens
ggtgataatgccaggccctgcccccggcagaggcggaagcggagtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagagggtcgataaagacaggagtggagtgatatcagacaccgagcttcagcaagctctctccaacggcacgtggactccctttaatccagtgactgtcaggtcgatcatatccatgtttgaccgtgagaacaaggccggcgtgaacttcagcgagttcacgggtgtgtggaagtacatcacggactggcagaacgtcttccgcacgtacgaccgggacaactccgggatgatcgataagaacgagctgaagcaggccctctcaggtttcggctaccggctctctgaccagttccacgacatcctcattcgaaagtttgacaggcagggacgggggcagatcgccttcgacgacttcatccagggctgcatcgtcctgcagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttagacgtg

SEQ ID NO: 193718 - DNA, 544 bp, Homo sapiens
tgcggctggatttcctcacacatcccattgcacggcctgcctcacagctgcaagtgcaccttctcctgggacttagggggtcgggctgggggacaatcccccacacccccacccagggcgaaggtgacaagactttaagggatttcaccccattcacagacaggcatgcattgcccagtccctggttagtggtcagcagtggggccccgccaggctctgagggctgaggtctggtgggaagcctcaagtgagtttgctgcaactgatcttttgctgcttgaccgttcctctctgtctcagccatgtttgaccgtgagaacaaggccggcgtgaacttcagcgagttcacgggtgtgtggaagtacatcacggactggcagaacgtcttccgcacgtacgaccgggacaactccgggatgatcgataagaacgagctgaagcaggccctctcaggtttcgggtaactcactcactctggcttgtgtagcgtgtttcattttggaaccttggagccgttgaagttctttaaaccttgttggactta

SEQ ID NO: 193719 - DNA, 246 bp, Homo sapiens
atgagctcgtacagatgatgcgagaaccctttgctcccttctggaattccacttagatgagcgtcggccctttcatccctctccctccgtctctgtaccttttcacatctctccgtgtatgtttgctctattcttgattctgtttatttttaatgtacggtgtaacctgtcctttcagtttctaattctaaagatgacatatatttaaaatttctaaattattagttactttcacatcttatctgg

SEQ ID NO: 193720 - DNA, 1378 bp, Homo sapiens
ggtgataatgccaggccctgcccccggcagaggcggaagcggagtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagagggtcgataaagacaggagtggagtgatatcagacaccgagcttcagcaagctctctccaacggcacgtggactccctttaatccagtgactgtcaggtcgatcatatccatgtttgaccgtgagaacaaggccggcgtgaacttcagcgagttcacgggtgtgtggaagtacatcacggactggcagaacgtcttccgcacgtacgaccgggacaactccgggatgatcgataagaacgagctgaagcaggccctctcaggtttcggctaccggctctctgaccagttccacgacatcctcattcgaaagtttgacaggcagggacgggggcagatcgccttcgacgacttcatccagggctgcatcgtcctgcagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaattttaaaataacatggaacttacacaaaaaaaaaaaaaaaaaaaaaaagagaaaaatttaaaacaaaaaaaaaaaaaaaaaaacaaaaactggggggggcgacaggagccccgaaaaaagtttttaaaaacaaagggggggggcggcggggcccaatgagagaaagagaaaagcgggcaacaagagggacaaggaaaacgggggaaaaaaaaagggggggggttcccacgaaaaaaaaaacgcgggggggagacaaagagggggtcgggagaaaaacacagagaggggagaggaggaacaggggggaatacacacgagggacaccaagggacagaaaaaaaaaccccgggaggggggac

SEQ ID NO: 193721 - DNA, 1087 bp, Homo sapiens
agagagcagggcagtagggctgggcaggatgagaaggaggaaaggggggggatttgagggtgaccgactctctaactaaccggcgctacaggtgccaaccctgagaccaaaattaggaaggtgtccctgagcagcagctgaagggaagcgggagggtcgataaagacaggagtggagtgatatcagacaccgagcttcagcaagctctctccaacggcacgtggactccctttaatccagtgactgtcaggtcgatcatatccatgtttgaccgtgagaacaaggccggcgtgaacttcagcgagttcacgggtgtgtggaagtacatcacggactggcagaacgtcttccgcacgtacgaccgggacaactccgggatgatcgataagaacgagctgaagcaggccctctcaggtttcggctaccggctctctgaccagttccacgacatcctcattcgaaagtttgacaggcagggacgggggcagatcgccttcgacgacttcatccagggctgcatcgtcctgcagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttagacgtg

SEQ ID NO: 193722 - DNA, 892 bp, Homo sapiens
tcctgttgttgttgttttcaggcacgtggactccctttaatccagtgactgtcaggtcgatcatatccatgtttgaccgtgagaacaaggccggcgtgaacttcagcgagttcacgggtgtgtggaagtacatcacggactggcagaacgtcttccgcacgtacgaccgggacaactccgggatgatcgataagaacgagctgaagcaggccctctcaggtttcggctaccggctctctgaccagttccacgacatcctcattcgaaagtttgacaggcagggacgggggcagatcgccttcgacgacttcatccagggctgcatcgtcctgcagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttagacgtg

SEQ ID NO: 193723 - DNA, 6006 bp, Homo sapiens
  misc_feature (874)..(874): n is a, c, g, or t
ggtgataatgccaggccctgcccccggcagaggcggaagcggagtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagagggtcgataaagacaggagtggagtgatatcagacaccgagcttcagcaagctctctccaacggcacgtggactccctttaatccagtgactgtcaggtcgatcatatgccgaggacgatgatcccgccgggggagtgcacgtacgcgggccggaagcggaggaggcccctgcagaaacagaggcccgccgtgggggcagagaagtccaacccctccaagcgacaccgggaccgcctcaacgccgagttggaccacctggccagcctgctgccgttcccgcctgacatcatctccaagctggacaagctttctgtcctgcgcctcagtgtcagttacctccgggtgaagagcttcttccaagtcgtgcaggagcagagctcacggcagcctgcggccggcgccccctcgcccggagacagctgtcctcttgcagggtctgccgtgctggagggaaggctgctgttggagtctcttaatggctttgctctggtcgtgagtgcagaagggacgatattttatgcatcagcaacgatcgtggactatctgggcttccatcagacggatgtaatgcaccagaacatttatgactacatccacgtggacgaccgccaggacttctgccggcagctccactgggccatggaccctccccaggtggtgtttgggcagnccccgcccttggagacaggagatgatgctatcctggggaggctgctcagggcccaggagtggggcacaggcacgcccaccgagtactcggccttcctgacccgctgcttcatctgccgtgtgcgctgcctgctggacagcacctcgggcttcctggcccgggggtcacaggcttggcagctgcggctctgctgtcccgagccactcatgacgatgcagtttcaaggaaaactaaaattcctgtttggacagaagaagaaggcgccgtcaggagccatgctcccgccgcggctgtcgctgttctgcattgcggcacccgttctcctcccctccgcagcggagatgaaaatgaggagcgcgctcctgagggcaaaacccagagcagacaccgcagccaccgcggatgcaaaagtaaaagccaccaccagtctgtgcgaatcggaactgcatggaaaacccaattactcagcaggaaggagcagcagagagagcggcgttttggtgctcagggaacagactgacgctggccgatgggcacaggttcccgccagggccccatgcctgtgcctccggggtggccctgaccttgtccttgaccccaaggggggctcaggggacagggaggaggagcagcacaggatgctgagcagggcctctggagtgacagggcggagggagactccaggacccacaaagcccctgccctggacagcgggaaagcacagtgaggatggtgccaggccgaggctgcagcccagcaagaatgacccgccctccctgcgccccatgccccgcggctcctgcctgccctgcccgtgtgtccagggcactttcaggaactcgcccatctctcacccgccgagcccgtcccccagtgcctactccagccggaccagcagacccatgcgggatgtcggtgaggaccaggtgcaccctcccctctgccactttccccagaggagcctgcagcaccagctccctcagcctggagctcagcgttttgccacgaggggctatcccatggaggacatgaagctgcaaggtgtaccgatgcctccgggggacctgtgtggtccgacgctgctgctagatgtgtccatcaagatggagaaggactctgggtgtgagggtgctgcagacggctgtgtgcccagccaggtgtggctgggggccagtgacaggagccacccagccaccttccctaccaggatgcacctgaaaacagagccagactctcggcaacaggtgtacatctcgcacctggggcacggcgtgcggggggctcagccccatgggagggccactgctgggcgcagcagggagctgacccctttccaccctgcacactgtgcctgcctggagcccacagacggccttccccagtcggagcctccccaccagctctgtgcacggggccgaggtgaacagtcctgcacctgcagagctgctgaggccgcccctgtggtcaagcgggagcccttggactcaccccagtgggctactcacagccagggaatggtgcccgggatgttgcccaaaagtgccttggccacgctggtcccgccccaagcttcggggtgcacattcctgccatagcgcagtgaccaccatccaagctcagatctgtctgtctacgctcagatgcgtcggtggctgggctgccctgctcctggtcaggccggagcccgtcctaagacacactctttgcagagctgtgcatgcgcagtctgctagtgtgtgtgtgcagcatacgcaggagcctatcctgaattttgtaaaatatcccaacagttcttaaatgaaaactggccttaagtctattcaagcatgacagcatttctctttgaggaattaaaatctttaggaaagtgatcatggctggacagcttcatgccccagaggcagcgagcacccgtcccatggctgccaagtccacagtcggggatgaagcagtcgggtgatgctcccaagtccgcagtcggggatgaagcggtcgggtgatgctcccaagtccgcagtcggggatgaagcggtcgggtgacacacctagctcagccctcccaggccacctgcagctcccagcctgtgctgtgcaggcagggtcagcccatcgccacagtgcactgtagaggccagcacacggcaaattagaaatacaacacgcggagaaaggggtccgtgagcccactcatagaggaatctagaatgttccaggcagcagaggctggcagcgtgggtcccacactgccccacaccgtgcggcaggtgctccatggcgccatgacagagtctgaggccagacctggactggaattgacagcataacccctgttccttctggacatctcccgagttctcagtgggtctctgcggacggttcttcctaatctgcctcttggtacatcacgtaatacagagttcacagactccgggtttggaagtacagagaaacacacaacgtagagagaagacacaggaaactgcgctgcctgtgggggtttctctctggctggctgtacagttcactcaaatgagggttcccattgccatcctaggagaataattagggacaagacagacaagtattaatagcattaaaacagttgtaaaggcgatattttctgagagtaggaaatttggatacaaaagcataagtcagaaagtgaaggtcaccaatccaccaacccgagaacctacagctgatggtgcatttcaggcttcttccacggtctggcctggaaccccacccggctggtgcaggcatcagatcagggtgtagaagtcaccccaagcaagaggaagccaggcagtgaggccctggggtgtggctgcagctgggcccacctgtgcgggggtgggaaggccccatcctcagggagagggcatcggcgccctgacgtcagctccactgggagtggcaggagctgtgggagcccatgggtgagggacccaccaccccgctgcactgtgcattgtgcctcccgtgtggacgccctctctgttgttggcccgcgggtgagggacccaccaccccgctgcactgtgcattgtgcctcccgtgtggacgccctctctgttgttggcccgcgggtgagggacccaccacccctagggacccaccaccccgccgcactgtgcattctgcctcctgtgtggacgccctctctgttgtcagtggctttgaggtgtcagtgcttacttagatgctggtttaatgctggacccatttgttaaacgcaccttcactttgtcaaaacccaggtttggttggcaggactgggtcttctgcccaatgccaggtgcctgcgcctctcagtggcctggttcttggacagtttgcccccatgtggcagggatagggataaggatctcctctcagtactggaggagaacagccaaccatctgagcccagagtcacagatccatcgtggccccctatgacccccaagccctaccgagggggcactcactctctgcttagccagggggcgtctttcaaaaggtgacctccatgctgtgctgtcgtgggtgtgagacgtgctcatggccttccactgccatctctcccttatctgatgcctaaagtcacgatggggacagagctacccaggggccagccatggggtgaccagccacctgagggtcagtcacctgtggagagcaggcacctgtgaagaccaggcacctgaggactggcgcctacttcccactttggccctacactggcacagagcccctctttattcatttctcatgctgagcatggcacacttctggcctctgggcatttatggatttaagaccaggatggtatttcagaagcttcccacttccttcctattctaaccgagtgcccagctcctttgctgatcatggaaagacccttaataattaggcctgcaggccaggcgcagtggctcatgcctataatcccagcactttaggaggtcaaggtaggaggatcgcttaagcccaggagttcaagaccagcctgggcaacacaggaagaatgtgtctctacaaaaaataattaaaaatcagatctgctgtatccctgaaaaagtctcaatcaacatgcatgttccactcttggagttccctgttctgagggccagccacgtcctgtgtcctggagcttagccctcagcagctcccttcagcctgggcgccgcctgggtcccaaacgtggcagctgctcttccagtctcggggccgaggagggcagggagctcagtgactgagagtcttgtgtatcacatgtcttgagtgtcctggagccaacggtgtcactgggaaaaacaccaggccccaaagatcgaatcagagacgtggctgcgtgtttgcgattgtagccaggcccttcagtgtcatcaaaggagcactggggcctccttaagcacagacggcagcccctgcccaggaggcttcttcaccacgtcctgccctgcagcctcccagacctttagatgcgcccctgcccaaggccctcctggtgacaggtgccagattgagtggtgggttgctgccaggcaggccacgctgtgttgacgctgcactcagcacgtgggtgttggctctgccggttttgtggtgtggggaccctacaggaggctgcggccctgagagcctgggatcagcgaggtgtccgacatcccttcctcaacggcaacaaaaactccccaagtcagcactttggttattttatagccacaaccctcttggaaaacagtggggaagactatggaacatagaaagtgtggatgtatcacttctctctaaaatgtcattgttagcactaattacaggttcatgtttttctgtttatgtagcttttccctatatagctgaaaaagtattaaagtcaaatataaggtgggaatgggatggaagggaggagatcaatacaacttatatttttgcagtttctactggaagaaaaaagttttcaatacctagaccaacttgttgaatttttaaaacttatgcactataaatgcaactttctctactgctttctcagtgcctttaggaagctttcaaatttttttgtactgtggtttgtattaaatttgcaatattgatgtaaaatacatgacatgctagtacatgtttaacaaaaatttaaaaaaaaa

SEQ ID NO: 193724 - DNA, 870 bp, Homo sapiens
ctggggatgtcagctcattacagaatgatatattcgggaagtgtctcagttctgagtgcctttgagggaatttgcacttccgttcccacacagccttgcattgtgtgtgttagaggctgtgggccttgggcaggaggggtgagtgttggcacatacctcccgtctctcccagccttctctgactctgactttccctcttgaaggctaccggctctctgaccagttccacgacatcctcattcgaaagtttgacaggcagggacgggggcagatcgccttcgacgacttcatccagggctgcatcgtcctgcagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttagacgtg

SEQ ID NO: 193725 - DNA, 1287 bp, Homo sapiens
ggtgataatgccaggccctgcccccggcagaggcggaagcggagtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagagggtcgataaagacaggagtggagtgatatcagacaccgagcttcagcaagctctctccaacggcacgtggactccctttaatccagtgactgtcaggtcgatcatatccatgtttgaccgtgagaacaaggccggcgtgaacttcagcgagttcacgggtgtgtggaagtacatcacggactggcagaacgtcttccgcacgtacgaccgggacaactccgggatgatcgataagaacgagctgaagcaggccctctcaggtttcggctaccggctctctgaccagttccacgacatcctcattcgaaagtttgacaggcagggacgggggcagatcgccttcgacgacttcatccagggctgcatcgtcctgcagacccttgctccatcacccaggccagagtgtggtggtgcgaacacggctcactgcagcctcgaccctcaggctcaagcgatcctcacgcctcggacccccaaagtgctgggatcacaggcgagagtcaccatgctggcctgaatcttcaggaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttagacgtg

SEQ ID NO: 193726 - DNA, 890 bp, Homo sapiens
ggtgataatgccaggccctgcccccggcagaggcggaagcggagtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagagggtcgataaagacaggagtggagtgatatcagacaccgagcttcagcaagctctctccaacggcacgtggactccctttaatccagtgactgtcaggtcgatcatatgccgaggacgatgatcccgccgggggagtgcacgtacgcgggccggaagcggaggaggcccctgcagaaacagaggcccgccgtgggggcagagaagtccaacccctccaagcgacaccgggaccgcctcaacgccgagttggaccacctggccagcctgctgccgttcccgcctgacatcatctccaagctggacaagctttctgtcctgcgcctcagtgtcagttacctccgggtgaagagcttcttccaaggacaggggttggcagtggcagatgccgaagatgtggatgaccacacgggcgaacgaaggcccatgtcgttcaggaggccccgagcattggacacccaggccctgagacgtactcagttcggtctgcatctgttgatggtgaatattgcaggactgatagccactgaccgcctgtagtgatgtgtgaggacaatgaaggcaatggtgattcacaggcaggccagccccatatgggtgttagttgtaaattcatggttacataacataataaatttacctacgaattcattatttataaacaaatggagactctgacagctgagctg

SEQ ID NO: 193727 - DNA, 1064 bp, Homo sapiens
ggtgataatgccaggccctgcccccggcagaggcggaagcggagtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagagggtcgataaagacaggagtggagtgatatcagacaccgagcttcagcaagctctctccaacggcacgtggactccctttaatccagtgactgtcaggtcgatcatatccatgtttgaccgtgagaacaaggccggcgtgaacttcagcgagttcacgggtgtgtggaagtacatcacggactggcagaacgtcttccgcacgtacgaccgggacaactccgggatgatcgataagaacgagctgaagcaggccctctcaggtttcggctaccggctctctgaccagttccacgacatcctcattcgaaagtttgacaggcagggacgggggcagatcgccttcgacgacttcatccagggctgcatcgtcctgcaggtgacggaatggcttcacgtgggtttgtggtggtggtgggaggggcttgcttgccagcgtgatgcacctgaccttcaatctaaggagctgggcatgtgtagaattagtttttggagcttataaaagtgagtctcatctttggagaagtagccggttagtgaagtgtggacaaacatgttttcctccccttggaaatggcacagagcagcccatctgcaagacgtggtttttcagtatccggtgggttatttacatgtatgttctggtgttgtggttttttttgttttttgttttgttttgttttgttttgagaccgagtctcgctctgtcaccaacggtggaaatggcagtggcacgatcccggctcactcccacctctgcgtcccgggagaatcacttgaacccgggaggtggaggtttcagtgagccgagatcacaccactgcactccagcctgggtgacagagccagaccctgtcttaaaa

SEQ ID NO: 193728 - DNA, 535 bp, Homo sapiens
tatcatacttgtcattttaagatgttccctctgattcctttccagtctacaggtcacgttaagcggtcatgtggctcctggttcaggctgtttccttcctctagtctgtgaatatctcaagcattcttagtttatcttctttaacttaggatctcaacagctgccttctcggaggttcagttctgctgtggttctgctgacttgctcacggtggagagtaaggagtcacacttgctggatctgtcacacggcttctggctcccactgtggccgtggcaaagccgagtctcagtctcggtgtccgctctcacaggtaaatgtaatgtttcaggcattctgcttgcaaaaaaatctatcatgtgcttttctagatgtctctggttctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttagacgtg

SEQ ID NO: 193729 - DNA, 1011 bp, Homo sapiens
ggtgataatgccaggccctgcccccggcagaggcggaagcggagtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagagggtcgataaagacaggagtggagtgatatcagacaccgagcttcagcaagctctctccaacggcacgtggactccctttaatccagtgactgtcaggtcgatcatatgccgaggacgatgatcccgccgggggagtgcacgtacgcgggccggaagcggaggaggcccctgcagaaacagaggcccgccgtgggggcagagaagtccaacccctccaagcgacaccgggaccgcctcaacgccgagttggaccacctggccagcctgctgccgttcccgcctgacatcatctccaagctggacaagctttctgtcctgcgcctcagtgtcagttacctccgggtgaagagcttcttccaagtgaaacgtcagaggagagagatacatggaaggaattgccaaaagaaaaggaaccagaacttgaagtgcttaactcgtgtgttgctgggttctgtccccctccttctctgttgtatgcccaggacaggggttggcagtggcagatgccgaagatgtggatgaccacacgggcgaacgaaggcccatgtcgttcaggaggccccgagcattggacacccaggccctgagacgtactcagttcggtctgcatctgttgatggtgaatattgcaggactgatagccactgaccgcctgtagtgatgtgtgaggacaatgaaggcaatggtgattcacaggcaggccagccccatatgggtgttagttgtaaattcatggttacataacataataaatttacctacgaattcattatttataaacaaatggagactctgacagctgagctg

SEQ ID NO: 193730 - DNA, 621 bp, Homo sapiens
ggtgataatgccaggccctgcccccggcagaggcggaagcggagtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagagggtcgataaagacaggagtggagtgatatcagacaccgagcttcagcaagctctctccaacggcacgtggactccctttaatccagtgactgtcaggtcgatcatatgtaagtatcggcagacggaccaacttgggctgctttgtatccgacccgcttgggtacccgcttgtgtttcctttgtctgtgggtccgtatcactttgctcccttctggaattccacttagatgagcgtcggccctttcatccctctccctccgtctctgtaccttttcacatctctccgtgtatgtttgctctattcttgattctgtttatttttaatgtacggtgtaacctgtcctttcagtttctaattctaaagatgacatatatttaaaatttctaaattattagttactttcacatcttatctgg

SEQ ID NO: 193731 - DNA, 825 bp, Homo sapiens
ccttggctgcgccccgccccgcccgttcctggcttcctcgatggcttcctcctcaggacgccggtctcccgccacggcgccctgagccaggctccagagcaggcggcttctctgggggaggccgggacccgcctgacaccgaggggaggcccaggcgtgacccggccccggtggctcctcggccgaggacgatgatcccgccgggggagtgcacgtacgcgggccggaagcggaggaggcccctgcagaaacagaggcccgccgtgggggcagagaagtccaacccctccaagcgacaccgggaccgcctcaacgccgagttggaccacctggccagcctgctgccgttcccgcctgacatcatctccaagctggacaagctttctgtcctgcgcctcagtgtcagttacctccgggtgaagagcttcttccaagtgaaacgtcagaggagagagatacatggaaggaattgccaaaagaaaaggaaccagaacttgaaggacaggggttggcagtggcagatgccgaagatgtggatgaccacacgggcgaacgaaggcccatgtcgttcaggaggccccgagcattggacacccaggccctgagacgtactcagttcggtctgcatctgttgatggtgaatattgcaggactgatagccactgaccgcctgtagtgatgtgtgaggacaatgaaggcaatggtgattcacaggcaggccagccccatatgggtgttagttgtaaattcatggttacataacataataaatttacctacgaattcattatttataaacaaatggagactctgacagctgagctg

SEQ ID NO: 193732 - DNA, 267 bp, Homo sapiens
atggccgcctactcttaccgccccggccctggggccggccctgggcctgctgcaggcgcggcgctgccggaccagagcttcctgtggaacgttttccagaggtgcggcctggcaccgcccgggcacctcccgcctccgccgcggcggccccgacccctgtcccgactcccccgaccaaccccgttccctgccggttctactgcggcctcctccgtcccctgtcgggtcccccgcggccccctcccgtcccctgccgccgcccccgac

SEQ ID NO: 193733 - DNA, 342 bp, Homo sapiens
tgttcctgcaggtcttgatgtgcgaggacgctgtgtcttccctgccacattttcttcttctttcttgagacagacccttgctccatcacccaggccagagtgtggtggtgcgaacacggctcactgcagcctcgaccctcaggctcaagcgatcctcacgcctcggacccccaaagtgctgggatcacaggcgagagtcaccatgctggcctgaatcttcagggtattttacggttgaagtgtcacttacttaaccatccctgtttcaggagtgtaggtggtcaccctgtctctgccgctgacctggcctggaccctcggctgtgagagggaggggtgggct

SEQ ID NO: 193734 - DNA, 668 bp, Homo sapiens
tgcagtgcgtggtcaagggcacagaggagtgggcagcggtggccgtggggaccggatgagccagcctggtggggcttgaatatggcagcgccaggcagtgatgccacgtgggccttgctgggggcggcatccgaggctcagcacacctgtagcttttgaaggccatgccctcctgctgggtctcttgtcttcacccctcaggaggccttccccagcctcacttttaacatcacagcctctgcccctctgccctgacaccaccccctctgctgctcgttctctcctagtgcttaactcgtgtgttgctgggttctgtccccctccttctctgttgtatgcccaggacaggggttggcagtggcagatgccgaagatgtggatgaccacacgggcgaacgaaggcccatgtcgttcaggaggccccgagcattggacacccaggccctgagacgtactcagttcggtctgcatctgttgatggtgaatattgcaggactgatagccactgaccgcctgtagtgatgtgtgaggacaatgaaggcaatggtgattcacaggcaggccagccccatatgggtgttagttgtaaattcatggttacataacataataaatttacctacgaattcattatttataaacaaatggagactctgacagctgagctg

SEQ ID NO: 193735 - DNA, 1140 bp, Homo sapiens
gaccacgcgtccgcggacgcgtgggtcgacccacgcgtccggcggagtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagagggtcgataaagacaggagtggagtgatatcagacaccgagcttcagcaagctctctccaacggcacgtggactccctttaatccagtgactgtcaggtcgatcatatccatgtttgaccgtgagaacaaggccggcgtgaacttcagcgagttcacgggtgtgtggaagtacatcacggactggcagaacgtcttccgcacgtacgaccgggacaactccgggatgatcgataagaacgagctgaagcaggccctctcaggtttcggctaccggctctctgaccagttccacgacatcctcattcgaaagtttgacaggcagggacgggggcagatcgccttcgacgacttcatccagggctgcatcgtcctgcagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttagacgtg

SEQ ID NO: 193736 - DNA, 1052 bp, Homo sapiens
ggtgataatgccaggccctgcccccggcagaggcggaagcggagtcggcctgagaggtctctcgtcgctgcaggcgcggcgctgccggaccagagcttcctgtggaacgttttccagagggtcgataaagacaggagtggagtgatatcagacaccgagcttcagcaagctctctccaacggcacgtggactccctttaatccagtgactgtcaggtcgatcatatccatgtttgaccgtgagaacaaggccggcgtgaacttcagcgagttcacgggtgtgtggaagtacatcacggactggcagaacgtcttccgcacgtacgaccgggacaactccgggatgatcgataagaacgagctgaagcaggccctctcaggtttcggctaccggctctctgaccagttccacgacatcctcattcgaaagtttgacaggcagggacgggggcagatcgccttcgacgacttcatccagggctgcatcgtcctgcagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttagacgtg

SEQ ID NO: 193737 - DNA, 1153 bp, Homo sapiens
agcggacagtcgaaacctgagtagtggctgaaaggtctctcgctctttggaagctcctcaggccacatcgcagtgcctatgtggccgtggtgcgattactctgtaccgccccggtcctgtaggtgccgggcctggtgcctgtgcctgaattgcgcggccgcattccgggaccagatcattccgtgtggaatcagttattccatagggtcaatctaaagacaggagtgtgagtgatatcatgacactcgagcattcagctaatgctcttctccaagcggctacgtggacttcccttttaatccagttgactgtcaggtctgatcatatccatgtttgaccgtgagaacaaggccggcgtgaacttcagcgagttcacgggtgtgtggaagtacatcacggactggcagaacgtcttccgcacgtacgaccgggacaactccgggatgatcgataagaacgagctgaagcaggccctctcaggtttcggctaccggctctctgaccagttccacgacatcctcattcgaaagtttgacaggcagggacgggggcagatcgccttcgacgacttcatccagggctgcatcgtcctgcagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttagacgtg

SEQ ID NO: 193738 - DNA, 936 bp, Homo sapiens
gaccacgcgtccgcggacgcgtgggtcgacccacgcgtccggcggagtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagagggtcgataaagacaggagtggagtgatatcagacaccgagcttcagcaagctctctccaacggctaccggctctctgaccagttccacgacatcctcattcgaaagtttgacaggcagggacgggggcagatcgccttcgacgacttcatccagggctgcatcgtcctgcagaggttgacggatatattcagacgttacgacacggatcaggacggctggattcaggtgtcgtacgaacagtacctgtccatggtcttcagtatcgtatgaccctggcctctcgtgaagagcagcacaacatggaaagagccaaaatgtcacagttcctatctgtgagggaatggagcacaggtgcagttagatgctgttcttcctttagattttgtcacgtggggacccagctgtacatatgtggataagctgattaatggttttgcaactgtaatagtagctgtatcgttctaatgcagacattggatttggtgactgtctcattgtgccatgaggtaaatgtaatgtttcaggcattctgcttgcaaaaaaatctatcatgtgcttttctagatgtctctggttctatagtgcaaatgcttttattagccaataggaattttaaaataacatggaacttacacaaaaggcttttcatgtgccttacttttttaaaaaggagtttattgtattcattggaatatgtgacgtaagcaataaagggaatgttagacgtg

SEQ ID NO: 193739 - DNA, 5566 bp, Homo sapiens
gccacccacccacacaggcgcacatacgctggcaccgctgaacagccaaaatatacacgatggttcttcttatggttcaggaggtggaaagttgaaaccatagcaagaaacgtggcctatccaccgcagcgactaaaagataaagagggaaaaggacaaacattggccagaaggtgcagcggctggagcgttcgcgccttaactggaagaggagccgccccgcctgggaggccgctctggcgcccggctggtgccgggcaggaggcccttgcggacccagcggcctcctcgtcggcaacgcccaccccgcggttcagccacggagcggatgccgtgtgcaggcacggaacgggcgaggctgttgcgctgcaggtgcccccacggtcgcgatgcggggcagggggatgccgacggatgtaatgcaccagaacatttatgactacatccacgtggacgaccgccaggacttctgccggcagctccactgggccatggaccctccccaggagatgatgctatcctggggaggctgctcagggcccaggagtggggcacaggcacgcccaccgagtactcggccttcctgacccgctgcttcatctgccgtgtgcgctgcctgctggacagcacctcgggcttcctgacgatgcagtttcaaggaaaactaaaattcctgtttggacagaagaagaaggcgccgtcaggagccatgctcccgccgcggctgtcgctgttctgcattgcggcacccgttctcctcccctccgcagcggagatgaaaatgaggagcgcgctcctgagggcaaaacccagagcagacaccgcagccaccgcggatgcaaaagtaaaagccaccaccagtctgtgcgaatcggaactgcatggaaaacccaattactcagcaggaaggagcagcagagagagcggcgttttggtgctcagggaacagactgacgctggccgatgggcacaggttcccgccagggccccatgcctgtgcctccggggtggccctgaccttgtccttgaccccaaggggggctcaggggacagggaggaggagcagcacaggatgctgagcagggcctctggagtgacagggcggagggagactccaggacccacaaagcccctgccctggacagcgggaaagcacagtgaggatggtgccaggccgaggctgcagcccagcaagaatgacccgccctccctgcgccccatgccccgcggctcctgcctgccctgcccgtgtgtccagggcactttcaggaactcgcccatctctcacccgccgagcccgtcccccagtgcctactccagccggaccagcagacccatgcgggatgtcggtgaggaccaggtgcaccctcccctctgccactttccccagaggagcctgcagcaccagctccctcagcctggagctcagcgttttgccacgaggggctatcccatggaggacatgaagctgcaaggtgtaccgatgcctccgggggacctgtgtggtccgacgctgctgctagatgtgtccatcaagatggagaaggactctgggtgtgagggtgctgcagacggctgtgtgcccagccaggtgtggctgggggccagtgacaggagccacccagccaccttccctaccaggatgcacctgaaaacagagccagactctcggcaacaggtgtacatctcgcacctggggcacggcgtgcggggggctcagccccatgggagggccactgctgggcgcagcagggagctgacccctttccaccctgcacactgtgcctgcctggagcccacagacggccttccccagtcggagcctccccaccagctctgtgcacggggccgaggtgaacagtcctgcacctgcagagctgctgaggccgcccctgtggtcaagcgggagcccttggactcaccccagtgggctactcacagccagggaatggtgcccgggatgttgcccaaaagtgccttggccacgctggtcccgccccaagcttcggggtgcacattcctgccatagcgcagtgaccaccatccaagctcagatctgtctgtctacgctcagatgcgtcggtggctgggctgccctgctcctggtcaggccggagcccgtcctaagacacactctttgcagagctgtgcatgcgcagtctgctagtgtgtgtgtgcagcatacgcaggagcctatcctgaattttgtaaaatatcccaacagttcttaaatgaaaactggccttaagtctattcaagcatgacagcatttctctttgaggaattaaaatctttaggaaagtgatcatggctggacagcttcatgccccagaggcagcgagcacccgtcccatggctgccaagtccacagtcggggatgaagcagtcgggtgatgctcccaagtccgcagtcggggatgaagcggtcgggtgatgctcccaagtccgcagtcggggatgaagcggtcgggtgacacacctagctcagccctcccaggccacctgcagctcccagcctgtgctgtgcaggcagggtcagcccatcgccacagtgcactgtagaggccagcacacggcaaattagaaatacaacacgcggagaaaggggtccgtgagcccactcatagaggaatctagaatgttccaggcagcagaggctggcagcgtgggtcccacactgccccacaccgtgcggcaggtgctccatggcgccatgacagagtctgaggccagacctggactggaattgacagcataacccctgttccttctggacatctcccgagttctcagtgggtctctgcggacggttcttcctaatctgcctcttggtacatcacgtaatacagagttcacagactccgggtttggaagtacagagaaacacacaacgtagagagaagacacaggaaactgcgctgcctgtgggggtttctctctggctggctgtacagttcactcaaatgagggttcccattgccatcctaggagaataattagggacaagacagacaagtattaatagcattaaaacagttgtaaaggcgatattttctgagagtaggaaatttggatacaaaagcataagtcagaaagtgaaggtcaccaatccaccaacccgagaacctacagctgatggtgcatttcaggcttcttccacggtctggcctggaaccccacccggctggtgcaggcatcagatcagggtgtagaagtcaccccaagcaagaggaagccaggcagtgaggccctggggtgtggctgcagctgggcccacctgtgcgggggtgggaaggccccatcctcagggagagggcatcggcgccctgacgtcagctccactgggagtggcaggagctgtgggagcccatgggtgagggacccaccaccccgctgcactgtgcattgtgcctcccgtgtggacgccctctctgttgttggcccgcgggtgagggacccaccaccccgctgcactgtgcattgtgcctcccgtgtggacgccctctctgttgttggcccgcgggtgagggacccaccacccctagggacccaccaccccgccgcactgtgcattctgcctcctgtgtggacgccctctctgttgtcagtggctttgaggtgtcagtgcttacttagatgctggtttaatgctggacccatttgttaaacgcaccttcactttgtcaaaacccaggtttggttggcaggactgggtcttctgcccaatgccaggtgcctgcgcctctcagtggcctggttcttggacagtttgcccccatgtggcagggatagggataaggatctcctctcagtactggaggagaacagccaaccatctgagcccagagtcacagatccatcgtggccccctatgacccccaagccctaccgagggggcactcactctctgcttagccagggggcgtctttcaaaaggtgacctccatgctgtgctgtcgtgggtgtgagacgtgctcatggccttccactgccatctctcccttatctgatgcctaaagtcacgatggggacagagctacccaggggccagccatggggtgaccagccacctgagggtcagtcacctgtggagagcaggcacctgtgaagaccaggcacctgaggactggcgcctacttcccactttggccctacactggcacagagcccctctttattcatttctcatgctgagcatggcacacttctggcctctgggcatttatggatttaagaccaggatggtatttcagaagcttcccacttccttcctattctaaccgagtgcccagctcctttgctgatcatggaaagacccttaataattaggcctgcaggccaggcgcagtggctcatgcctataatcccagcactttaggaggtcaaggtaggaggatcgcttaagcccaggagttcaagaccagcctgggcaacacaggaagaatgtgtctctacaaaaaataattaaaaatcagatctgctgtatccctgaaaaagtctcaatcaacatgcatgttccactcttggagttccctgttctgagggccagccacgtcctgtgtcctggagcttagccctcagcagctcccttcagcctgggcgccgcctgggtcccaaacgtggcagctgctcttccagtctcggggccgaggagggcagggagctcagtgactgagagtcttgtgtatcacatgtcttgagtgtcctggagccaacggtgtcactgggaaaaacaccaggccccaaagatcgaatcagagacgtggctgcgtgtttgcgattgtagccaggcccttcagtgtcatcaaaggagcactggggcctccttaagcacagacggcagcccctgcccaggaggcttcttcaccacgtcctgccctgcagcctcccagacctttagatgcgcccctgcccaaggccctcctggtgacaggtgccagattgagtggtgggttgctgccaggcaggccacgctgtgttgacgctgcactcagcacgtgggtgttggctctgccggttttgtggtgtggggaccctacaggaggctgcggccctgagagcctgggatcagcgaggtgtccgacatcccttcctcaacggcaacaaaaactccccaagtcagcactttggttattttatagccacaaccctcttggaaaacagtggggaagactatggaacatagaaagtgtggatgtatcacttctctctaaaatgtcattgttagcactaattacaggttcatgtttttctgtttatgtagcttttccctatatagctgaaaaagtattaaagtcaaatataaggtgggaatgggatggaagggaggagatcaatacaacttatatttttgcagtttctactggaagaaaaaagttttcaatacctagaccaacttgttgaatttttaaaacttatgcactataaatgcaactttctctactgctttctcagtgcctttaggaagctttcaaatttttttgtactgtggtttgtattaaatttgcaatattgatgtaaaatacatgacatgctagtacatgtttaacaaaaatttaaaaaaaaa

SEQ ID NO: 193740 - DNA, 955 bp, Homo sapiens
ggtgataatgccaggccctgcccccggcagaggcggaagcggagtcggcctgagaggtctctcgtcgctgcaggcgcctcagcccagccgcgtgccttggcccatggccgcctactcttaccgccccggccctggggccggccctgggcctgctgcaggcgcggcgctgccggaccagagcttcctgtggaacgttttccagagggtcgataaagacaggagtggagtgatatcagacaccgagcttcagcaagctctctccaacggcacgtggactccctttaatccagtgactgtcaggtcgatcatatgccgaggacgatgatcccgccgggggagtgcacgtacgcgggccggaagcggaggaggcccctgcagaaacagaggcccgccgtgggggcagagaagtccaacccctccaagcgacaccgggaccgcctcaacgccgagttggaccacctggccagcctgctgccgttcccgcctgacatcatctccaagctggacaagctttctgtcctgcgcctcagtgtcagttacctccgggtgaagagcttcttccaagtgaaacgtcagaggagagagatacatggaaggaattgccaaaagaaaaggaaccagaacttgaaggacaggggttggcagtggcagatgccgaagatgtggatgaccacacgggcgaacgaaggcccatgtcgttcaggaggccccgagcattggacacccaggccctgagacgtactcagttcggtctgcatctgttgatggtgaatattgcaggactgatagccactgaccgcctgtagtgatgtgtgaggacaatgaaggcaatggtgattcacaggcaggccagccccatatgggtgttagttgtaaattcatggttacataacataataaatttacctacgaattcattatttataaacaaatggagactctgacagctgagctg

SEQ ID NO: 193741 - DNA, 505 bp, Homo sapiens
cacaataccctgcagccttgacctcatgggctcaagcagtcctcccacctcagcctcctgggtagctgggactacaggcttgcactaccacacccagcttattttttgtagagacagagtttcgtcatgttgcccaggctggtctcaggagtcactcctgagctcaagtgatccgcctgccttggcctcccacagtgctgggattacaggagtgagccaccatgtctggtcctctgacccttttagcaggaaatccagcccagcccctgaacggcatgttagacagttcaacaaagccttctagaagaccaaagaagactcataggaataagcctcttgctgattaatggaaacatgaccatttgtggagaaagtgcaatctgcattgaacacctttaggggaacctgtcatttaagacttcaagcattaccatgaaaacttcctctgaaacaccttacagacatctctgtaaaacagatttaaaaagaaacacatttctgctta

SEQ ID NO: 193742 - DNA, 603 bp, Homo sapiens
acatcacagacataaatatcggtgcaggcggccagccactcctcaagcccggccccgcccctcctgctcccagcggaagcttttggtgcaggacttcccgggcctcaatctcctcatctataggctgggaacaaaccctggagtctgtgctctgggaggagcacacacgggcaaccctggctcaggacagattcccagcccctaagtcatcactagggcttaacgatccatttcaaattacatctgcacggtgctttactttcatacgttattttatttggagcctctaacgagcctcagctaacagatggtattatttccacatggcaaacaaagagacaggagctgcaaccatccaaagacacctccttgctatgaatgcctggccaggcctccaggcaggaccagcaactccagaccccgtcagggccaacacgggccactgctgtccacacactcctagaaaatatccatctgtctgaagcgagtgacacagattttaccctcttgaggataaaataatcccatctgccaaaatgacccacaaataaaggctcctccttgtctgaacgctgcctcagcgtctgagggataagcccacaa

SEQ ID NO: 193743 - DNA, 751 bp, Homo sapiens
tacagacctcgatggaactgacagactgatctaggtagacagatgtagacatccctaggtgattacaactccaacctggatagatgccatgtagtcttccaattagagatgctatacagccaatgaaacttaaccatgtctttaataggtgtgccaccttttgttaaaatcagttatcttacaagtatcatgagaaaaaacattagtatcaacagattgaaacatttattgggaagaaagtgaggccacagtcaggaaaaatagcataagccacaacctcttagtcaagaatcttagaaacagctgtgtttcgtgtgtttcagaactctgaattgttctgattttaggaaagtgacgtgtgcatattccacttggggcctggggcaacaccctcatcaaactgatattcctgcagcaaaatacaagcaggacgaaaaggatcatgggtcgtctcgtgccaaatcaggttagactttccgccaaatgaagtacacaaaactttccatgtttaggactatgaatttgggccaggcactgtgactcatgcctgtaatcccagcactttgagaggctgagacaggtggatcacttgagcccgggagttcaagaccaacctgggcaacatagtgagacctcatttctacaaaaaattagctgagtgtggtggtgtgcacctgtctggagtcccagctactcaggaggctgaggtgggaggatccattgagcctaggaggtcaaggctgcagtgagc

SEQ ID NO: 193744 - DNA, 364 bp, Homo sapiens
aaaggagacctcagagaactccccagcccctattgccatgtgaaggcacagagaagacagctgtctatagaccaggaagcaggccttcgtcagatactgaatctgatggtgccttgatcttggactgtccagcctccaaaactgtgagaaataaatacttgttgcttaagccatctagtatttggcagtttgttatagcagcctgaaggaactaagaggtaagttaattaagtgaaaatgaggctgttagggtgggccataatccaatccaactggtagccttaaaagaagaagacatttagagacacagagagacaccagatacgtgcacacatggacgaccatgtagggactcagcaagatg

SEQ ID NO: 193745 - DNA, 237 bp, Homo sapiens
tgtccattcatccctctcttacctccccctgaacctctggtagccagtgattgcattatagtctctatagttctgtccttcccagaatgtcaaagagctggaatcacatattacatagccttttcagactaacttacttcactcatgaatatgtatttaaggttcctccatgccttttcatagcttgataacatttctttttatctctgaataatattctattgtctagatgtgcca

SEQ ID NO: 193746 - DNA, 330 bp, Homo sapiens
aactgtctttggttttatgatgataaataaaaaacattaaaattctccaatcaaacaaggtatgcaaggatttttcatgttggcttttttgttgaaatagtgagaggaaattaagttactggaatataaagataagcatgccactaatggagaaagagtattttcacagaaccagtatctttccccatcccatatccatttgatggtaatcaaaacataccattggccattttgttttcttaaaagtacaatatgcgtgtgtacacacaccacttactctacatgtaatataggaatggggggggggggaatgaaagaatagagaatact

SEQ ID NO: 193747 - DNA, 393 bp, Homo sapiens
tggaaagaacctgggcttaggagttggagagtacttgggtttgaaggctgtggatccttgggtaaatcacttaatctctctgaatcagctttctcatctgttgaagagacatcacagtggtggcatctgaaagatgtcatgaggtataatgtgtcttggacacctaaaatcaggacccaggactaactatagacctgataatcagtatttataattattacattattaggacccaggtcctatttctgtgcaatgttgaaagatagtgataagaacaatttagatcagaacttacaagtttgcatgatcttcattataaatgaaatagtgaaacaatgctgagcggatttacagaggcgtaactcattcattaaccagcttagacaggcattt

SEQ ID NO: 193748 - DNA, 315 bp, Homo sapiens
cattttgcgcgacgcttcatcaacatctcagtggggtgcatttctttctgctgccaaactttgtcagctaatgtggtcaacactgttaacactttactggttgtatgagttgttatgtcattatcctttgtttgagtttgtggactgctgaagtgtgcagctgagtcagtggacttcctgaatgcagggaacctagtcgtgcttgggtttgcacccctagatcgtccttttgtgacagtggaggagcaaaccctggctgtagcaggtgtgctctgtgtgtttgatggaagcgtcgcgcatggggtcctctagaga

SEQ ID NO: 193749 - DNA, 120 bp, Homo sapiens
cagcctaccaatagatagaaatacctgaaactggttatcagcagcttcctgaaaagatctcaggagttgggtgaatgggcttaagaaagtgaactaaggggcaaaatggtgaagtcgaaa

SEQ ID NO: 193750 - DNA, 515 bp, Homo sapiens
taaacagaaaagaacacatcactttgtcttttacccctaaaagtacattgaatgacaatagggtgatgtgctgtttccttatggtagatgcccaggagcatcttacctgcttttggggcagctggcacagcacgtgcgaggggtttgggttttccgagtcacgggtggtttctgtatcctggggatgcatacagaaatcctcttcctgaaggtcagtgggttcgtataaagtggtgatacagttaagggaggggcatggggaagagggtcacctgaggaggagtctgactagtctccctcatctttcttccctgcccttattgatctctttgtcttttgctgtggtagaatgagtgagaactgatgagttagggtgatctgggttcaaattctggacccatgattaacttgagtccagaagagatggagaaacaaatattcactttctgtgtatgtaaaacagagttctcacctactttgcagtactgttgtgtggattaaatagcatttgccaa

SEQ ID NO: 193751 - DNA, 280 bp, Homo sapiens
atccttacagtttctcccagtctctcactttcctcttgccttcatgtctttccctacccagcctagagtccttgatccattatgttaccaccttttatcttttcatgcacccacctggcaaaaatgatagccctgactcaatagaaatttcttccttcttgtactaaccttcaggctgtggaatgctgatggagaaaatcacatcagagcagacgggtgctgctgtaaatttctaaattttaatctcagggccgtcatctctgtctagaaactaattagg

SEQ ID NO: 193752 - DNA, 187 bp, Homo sapiens
ccaccctcagccagggtgggtgaaacggttactcaaacaaaaggtgactccaccttctacagatacttctttctttaactctatagcctgaggactaagaaagtcctgcgcagagaatctgcttcttaccttaccttcttcctctctgaagctcccaggtgcctaggagagagttaatgtccaggat

SEQ ID NO: 193753 - DNA, 634 bp, Homo sapiens
ccaggcagatggcactgtgatgtctatgagatcagtgtgcggcataaatccgacagctcaaattctggaattgtataagcttttaaaaagattgccggcatatcttttatttttattgtgctagaaacacaaacgaaaacagcaatgatttgtccttcaataaacaaaagcagtaaaagaataggggagaaaaaaatcactacccactttacattccctgagcctacttctcgctgtgacttagagcaggttgtaaaaaacccatttagagggggctgcatgttcctgctgcccctcgctccctgccaggggctgtggtgtcagccagacccgggttcacgtgtgggtctgctgcttgctggctgtgtggcctcaaatcagtcccttaacctctctgaaccacagtcaccttcctatataagaagactatagttaataaaggtggaaatgcttaagttactgcctggcaggtagaaggcactcaggaaattcaacagttatgatcactgtggtaagtgttattgtcagctgcaaaatgaggatgataactcccccctgattctcaaggtcatggtgatattcaagggagatgacagatagaaaagagctttgtaaactgtagtgcactgtgtac

SEQ ID NO: 193754 - DNA, 619 bp, Homo sapiens
cgaagagatctttgagcatcaccccccattacggggctgctactcccaggatcaggcagcctctgcccaccttttctcacttcaccctttctccttgcagaataagaaagaatcggctccagctatttgtttcttactgtggatttatccatgtgtcacctctcccaggcagaattacattctgaaggcatctctaattgagattgctccatggggaaggactcttagggctcaggaagcaggtggtaaagccctggagtgaggcaggaaccccaaagccctatgacaccccatataggtacccccaaacctgcctatacttcaggccaggcccccagtatagagatgaaaaaatagtcccactttgggtcacagattctggaaaactgtgagattctggggaaatccattttgagtaataccttttagaagaagaaacacctggaagtagcttatcatagaagtgggttccgttagacaaagatggcaattcaggaggaagcataaatttaacaactctcaagtatgcacagctgacatctcgtaaagcggggctggtgactaagccagaagttactgtctgcatccttggtaccttacaactaaccatgaggacccg

SEQ ID NO: 193755 - DNA, 212 bp, Homo sapiens
aaattaccaagcaagagttaggtagacattaaatacaaacaaaaaactgtgcttagggaacacaatttcattactttacaagatcattgaaagtcatgtttattatgtcatgtctattggcatgtctggatccatgtggtcacatgcctcagagtccagaggcctgtagaggagaatgtccatgattccccccctttccatagaatggtttg

SEQ ID NO: 193756 - DNA, 362 bp, Homo sapiens
tgatgagcacaaaacaacatcttttttgctcccacataagagccagaatatgtgatatctgtttttctgtgcttgacatatttcacttaacataatgtccttcgggctcattcctgttgctgcaaatgacaggattccattcttttctatggctgaatagtactccatcatgtctgtatctatgttttctttatccattaatgcttcatgcgtgaaagtagagtggtgttacttgtatgtcttttatggagttaaatatccactgatggatatttaggttgattcagtatcttagctattgtgaatagtgctgcaatacgcattgggggtgtgcgtatccctttgatttcctttcttttgta

SEQ ID NO: 193757 - DNA, 881 bp, Homo sapiens
ccaaactctgattgttgctgggtttattagattgtctctaggtaattggagactttaataagagctgtggtaggtgttggaagcatctactggaacaatttccagatcaaagtgaactttgctgtgctgctggggatgcagctgcaagccttcatcatcatgtgtttttctgtgggtgcagacctggactctcctgaggaaaccccagcccggccccagacactccttggcctcctcctggggcctgtttaagctgctcagttttcatgagccaggttggtcctacttctggcacagccagctggtaaagcatgtggacctgcccgtcattggtgctagatcgacactcctgggcttggagaggataactttgttttcttttgtttttttgagatggagtctcgctctgtcacccagtcttgagggcaggggtgcgatcttggctcactggaacctccacctcctaggttcaagtgattctcgtgcctcagcctctggagtagctgggattacaggcatgagccaccatgcccggctaatttttgtgtttttaagtagagagagtttcaccatgttggccaggctagtctccaattcctgacttcaggtgatccgcccgcctcggcctcccaaagtgctgggattacaggcaggagccactgcccctgaccagagaggataactttactctttgatacacgatagtgagcaaaacacagttgtgagaaataagcttaacaggttgcttaaaaagatagtcatttaatgcattcttggggcaagggtcctttagataattgacggaagctgtgcgttctgtacttgtataatgggacaggattagagggagttgtctatacaaggcacagcaagtcctttgg

SEQ ID NO: 193758 - DNA, 545 bp, Homo sapiens
ctaatcatctcccagatggttcacctcttaacaccactgccctgggaattaagtttcaacataagaatttgggggacatatgaattcaacttatgaattgcagtttttgccattactttcaatgggaaaaaccacagttacttttgcaccaacctaataattaacttgcctaagatgattatagctagggagaggaagagctgtagttcatattggtatcaaaacccttgatgcataagcaggtaggttttttggtttggatcgtctaagcaatattgtttcccctttatttcacatgtgtttatagtcagtgactctgaaatctaggggagcctaggagagcatgagtatctattctctcattgtggaagctctgtcatcttcaatcattggaaacttttggtgtcccatatccatcagacagaaagctttttacttgcatttgtttcagatctctaggatggtcctgtatgtctgcctagaaaaaaataaaaccactcttagaccaagtcatacctgtgttctcttttccacaggaattctgg

SEQ ID NO: 193759 - DNA, 536 bp, Homo sapiens
gaggctgaggtgggaggatctcttgggcccaggaggctgaggctgcagtgagctgtgatcgcaccactgtactccagcctgggcgtaagagtgagaccctgtctcaaaaaataataataatgataaataaaattggcatgacttcttggtggattaaaccttttgttattatgtggtataaacaaaactgtcatgccttcttggtggattaaaccttttgttattatgtggttaccttctaatacctaataaaatgtttctcataaatttatctgatactaataaaattatatcagctttcttttggttagtatttgcctgatatatctctttccttaatgttttcttaatgttcagcttttgtatgtccttatatctcttataaatagtatatgtctagattttattgtttaatccagtctgtcaatctttgtcttagtctatttacattactggttttattgatatgcttggaccattgtgccatcctaaattatttgtcccactttttctgcttctttataatctcttcttaa

SEQ ID NO: 193760 - DNA, 221 bp, Homo sapiens
aaataggggagtgtgtgctgattggttcatgagtggtcttagaaaaaggaccattcaattggttaaaaggcatcgaggaagttctcactctggtcatgggctctctgtggaaccagcagcttgtttttcaggtttcaggctgtctttggcttgaagactggatttctctggggacacgtccttgtctgcctaggaatttgtctgtctcctgtcactatcca

SEQ ID NO: 193761 - DNA, 681 bp, Homo sapiens
gagaagtgtctgttcatatccttctcccactttttgatggggttgtttgtttgtttttcttgtaaatttgttaaagttctctgtagattctagatattagccctttgtcaaaaggataaattgcaaaaattttaaaacagaaaactggggctatattcttcaggccatgggagggtttttgaccattccatggatcctatctgaggtatggcagtgagcagtaaacttttggctttactagcattttctttcggggtctgtaagtcccggtccaccaaaactgcttcctcgtgctccttccagcagtcataatctgtcaccatggcaatactcgcataacaaattccagcctctttagtgagaaccacctctggaactgtggtcatgttgataacatccaccccccaggtgcagaacatgaagctttctgctcaagagataaaacgaggtccctcagttgtgaccattgtcccctttgaatgtcaccagagtcctagcttcttagcagtctctataagaacgtctctcgtttgggggcttggcccccattggaatatggcacactcctctagcacaacaatgacttccatcatagagggactgaggtctcatactggtcctgtcaatgaactgatcaataatgacaatatcgccaggttgaatctcctccctcaaggagcc

SEQ ID NO: 193762 - DNA, 240 bp, Homo sapiens
gctgtcctaaaggtggtggatatgacaggggcttttgacaaatttgacattttcagtaattcatgaatcacttctaaaaacatactcagtgatttgggtggtatctgtaaattaatctatcatccttgtcttggcatttgagttctgccttgtctaagtgggtgtgtttctggagtgggagaagggaggtccgttgtgacattgcatggaaataatttcttttacctttaacaagctgga

SEQ ID NO: 193763 - DNA, 289 bp, Homo sapiens
tggggagaggtaagcgagggagcgagtgggggattaggtcagagaggtaatctagatctttttacttcaaattctttgttctctctagtgcaccacactctcagattctttggttaatcagtttgtaaagagatcaaacatcctgaaattcactgttctttagcgtgatctgtcaattcctcctgccacatttgcctggggtgcttgttaaatacggattattgatcactagacccactaataagaatttctagggtgggacccatgaatgtgcatttaaaaaaaatgt

SEQ ID NO: 193764 - DNA, 271 bp, Homo sapiens
agtaaaccactttccaaatcctttttgggaaaaagtgtattacatgaactcaactattaaagctgccagaggacagaacgatatcttttagcttatttactggaagcactattgtggctgaattgtgttcttcagtaagatacgttgaagccagctgggcatggtggctcacatctgtaatctcagcactttgggaggcggaggcaggtggatcgcctgaggtcaggagttcgagaccagagtcagtgtttttaatgacaccccttaagcg

SEQ ID NO: 193765 - DNA, 557 bp, Homo sapiens
tacctcatgccctgacatggctggacctcaagacactaaggtctggccaggatgccagggagccataacaagtccctgccacccccaccagaggagcacagcatggcccagctggccccctcatctgggctcacatcctgaaaagctctctcagacattctggggtctccagctatagccagactcggtaaatggcctggaactgccatcttgggccagctagagttgcccaggccctagacaaaccttccctctggaccccatctgcaatgctacatgcacccccaccaactgggacttcacacacaggccagtgtaccccatttctgcaagccactggacacataagcactattctcaaggggtttgcaaacaaggaggctctgatacaacagacgtggatctgactcccacaagtgtcattttccctgggagcatgagagagcaggcaagaggccctatggtcggcccattcccaatccagacagtccctggaccatcacttctctggactgaacttcagctctgaaaagcagagcccaggccaacaggccaga

SEQ ID NO: 193766 - DNA, 169 bp, Homo sapiens
gtaaattacaatgtcttactgcatttttttctttttaacattactataaacaattagaagatccttgctgtccaaaatagtgtattatttgcttgtatactttgcagcacaaagcagtctcttatcagtgtgctcaataaagtgggtagatacatacatgacctcagaa

SEQ ID NO: 193767 - DNA, 359 bp, Homo sapiens
tggtgttctggagaacaggatcggtgcccttagacatttgcccttcttcctgcctcctccatccgttcacttgaaactgtagagacttaaacagtttgataccaaattctggtattgaaactaaaatccttcccaggagacaaaactttaacttcacttcctatgaaaaattaccctttgtgaaatataatttgaactctggccagtgctttgattgaactctggccagctccttgcattattgttggttgccataatgtctaaagatatttattgtctgcaccttcacagttcactgaccttcagtattcttcctgaagttagccttgtttgtaatgttactcagaacaccgtcgaat

SEQ ID NO: 193768 - DNA, 334 bp, Homo sapiens
ccacccccagtcgtcagttgttgcatcgtcttctattgttggccttcaggctttccagatgctccacttctgcttggttggttcattcgttttgaacgacacgctgtgatttccagccgttcacaggaggcagccaacaggctggtgctcgctcccactggtcttcccccttgctccatgtctgtgtgtgcacgcataaatgtatatgtgtgcatgcctgtaaacatgtgtgcttgtgtctgtgcatgtacctgtggacctgcgtctccttcccccactgtcagagctcgggccagcgagagcccgcgtcctgtagcctgtcatagaagtgggt

SEQ ID NO: 193769 - DNA, 167 bp, Homo sapiens
tagatcacaagctgtattgaggaacatttgatgatagctctactactaaacatttgcagtattaatggcatttacatttggtagtaagcatggtcaagacaggtcagaaaaagcttctcaggccaggcagaaggggtggcaagatccaagcacaaggcagtgcctac

SEQ ID NO: 193770 - DNA, 546 bp, Homo sapiens
cacacgacacattcacaacacaccgacactcacccatggacgtactcatgacacattcatagacacgacacactagcagacacatggacacacacttagcactcaccaacacggtacactcacacatggacacactcgccaacacacctgtgacacgttcacaacacaccgacacactcacatgacatagacatgcgatacacccacgggcattcatggacacacttgtgggcacactcatacacagacactgacacactcaaacacaacaatagactcatgacacgcttatgacacacacacatccctgacacactgagatactaactcactggcacactcatactcctaacacccgcatccctggcacagttactaacacctgcacacacccgtgtagacgcctacactcacacacatgagatcctgcaggggcggctgctgtgacctgcctccctgctttccaggcaaggcaggccccacacagatacaccttggttggcccggtccccctgagttcctggcactagttgtcgtcagccctgc

SEQ ID NO: 193771 - DNA, 2519 bp, Homo sapiens
gaaaatgtgtatgtgtgtatatgtgtgcgagtgtgcgtgtgtgcgcgcgctgtacctctccctgcgtggtgaagccatcagattgtgcgctcactgatccctgttgttgagtctgataagggtgagctcagaagccatcagatcgtggcctcactggtcccagttgtggagtccgatgagggtgagctcagatgctctgtggtcactccctgtgccgtgcttcggggacgctgagatgctgcaccagccaggcagggcggggtgggccccacttccatcgagctcctgcggatgatgagcaccacccaggagccacctggggggcagggcaggggctgaatcccactgggggtgactgtctctcacatgacaggagtccagggcatgcatggaggctcctccgtgtcatctagcgccagctccttctgtcactcctctgtggcctggagcggcctgctgtctcccggtcacgagccagcccgtgggcatcagcaccgcaagagcagggtccgtccatcttttgaggcacccccacccccgccacacagtgccttctgtttcctctcattgggcagaatcgtgtcatgtggccgcccagttgcaagggagcccgggaagggtgcgtgggccctgtccagcagacctggctgcttgtgataatgccatcagtggccctgttgtcactttggccttgcttacgttgccgattaggttaggaaatggtcttgattctgggatatgtgagcctgaagttaccaatgtaaagcagcacctaatacatgttttggccaaatgggcatttgttaaaaaaaacaacaaggtttggtcagagctcaatgtcaccatctttggacaaatttatgtgatataagaatacatcagagattttattgaaaaatatattgcaatttcatcattacatactttaatggcaaaatatgctattaacagtgcaaggccaatatgctccctgttgcagctgcccgtgaggtggccttccccagggacgctgacatgtctgccacctccagcatggccgtgcagaagcaagacgtccatgggcagctccaatggtgacgttgcctgcacgccacctagctgagcaggaacagttgtattggaggcgtgtgggtgacgagagagaggttaacggctggtgtttgtgtgaaactggagacaaatgaggactgggcattgtgtctacgtgggcgtgtgcaacaactgcgtgcatgacagctgctgtggatcacatgggctcatgagtgtgcctggtgtccacagatgtgcacagtggtcataagtgtgcagtgttggtgtgtgtgcacagtggctgtgggtgtgcgtagtagccataggtgtgcacagcggccatgggtgtgcaaagtagtgggtgtgcacggtgctgggcgtgcacagtggccgtgggtgtgcactgtggtaggcgtgcacagtgcctagatgtgcacgctgttggtgtgcatggtgatgggcatgcacagtgggtgtgcacagtggccgagggtgtgcatggtggtggtgtgcagtgtctgggtgtgcactgtggtaggtgtgaacagtgggtgtgcatggtggtggccgtgcacagtgggtgtgcatatcggtgtctgtgggtgtgcacagtgtcttgggtgagcatagtggtgggcacgctgcatagggtgggtgtgcgcagtggtggtgggtgtgcacggtggtgggcgtgcacggtggtgggcatgcacagtgggtgtgcatagtgactgtgggcgtgcacagtgtgggtgtacactgtggtaggtgtgcacagtggatgtgcacagtggccgtgggtgtgcacagtgtctgtgggtgtgcacggtggtgggtttgcacagtgactttgggcatgcactgtcttgttctgctgcagtgctggtggcgtagtgtccacaggctggctgagcactggtggcagctgcggtgagtgttgcttcttgcctgatgggacttctttggtgttgctgctcctcccttggttggggttttctagagccctgagcgccctcacactgaggtcagcgctgttatctgtgagaagaagctgtgtcaggctctggtgacacacacttcaccctgccaagccccccagtaactgctgtggaccaggcagcaagaagatttgccctgagcggcgcaaggggcaggacccatggctggggctccacactcagggtgtctggctccttcattaggtgatggcttcgccgattcactctcacttgctctccttttcctgtttcttgggcctctcctcgcctggccacctgaccaaaagattgctttatgtgatgtgattcatgtaacaagtgcttctgccttaaacccagagtctgtgccttggctcacgcctgtgatcctaacatttcaagaggcccaggctagaggatggcttgagcccaggaattcgaggctgcagtgagctatgatcacgccactgcactccagcctgggtgacagagcaagaccctgtctctaaattt

SEQ ID NO: 193772 - DNA, 616 bp, Homo sapiens
gagcatcactgagtgagcccataatgtgagtctgcagtgagctgtgatccacaccagtgcactccagcctggatgatacagcgagactgtgtcccagaaacaaaacaaacaaaacaaattgggtgtagggtcaacttggataaacaacctcctaggggaaaatgcctatgcataatatatttttttattgggttatacaaacatttaaaattatatacacatacgcacacgttcacatacatagatacacacacgtatcttcctatatccatatatattcatttagaaatatagatacacagttaacccttgaacaacatgggtttgaactgtgcaggttcacttatacatggattttcttccacttctgccactcctgagacatcaagaccgacccctcccctttctggttctctcaagcctagtcaatgtgaagacaaggatgaagacctttatgatgatccacttccacttaattaatagcaaatatatgtttcttatgattttcctaatgaaactttttcccgtagctttcttcatggtaagaatacagtatatggtacacatttacaaaatatgtgttaatcaacaattctgggtatcagcaaggcttgca

SEQ ID NO: 193773 - DNA, 530 bp, Homo sapiens
tcatggatttttttcatcagccttttctagttaattaagtataagtataagagacctatctgctatttactgagtgccctggagaaattgcaaaaagtgtctctggaaaatgctgactattgcctctggggcatcctgatatggctgcagtgggaggccggcagaagtaacaaccctcccatcgtgcctcagtgtatttgtgtgtgtatgcgcgtgcatgcaaatgcatacacacgtacatgtatataattattaaacagaattttcttgaggaaaaacattttattaatatgacctacactgcattgtagttttctatcaatttcactggattaaaagattgagggaataagattggcagactaccccctagtggctaacttgaagaaagttgtgcacaaattgtaaagaactactgcattaaggtaacagtaattgtttatttccattatatttattaaatatacttattaaatctatgtcccaggcactggatcaggtgcttggaataaaaatccagtaaacagaaa

SEQ ID NO: 193774 - DNA, 463 bp, Homo sapiens
gtgagatgctgtctcaaaaaaagaaaattaaaaaaacttttttttctatctctaggccagagtttgcaaactcaagtgtcttcatggaaaaggcagataattcaagggagtaacgtgggctgggtgaggactgtggcaaactaaagctaaaaggaaatgtctgcagggcttttgtccacatagagccactgacccctgataccaaaactgtgagtctagtgctgcctgatcatcggttttaggcagtaatctccatgaagacagggcccgctctgctttgttgaccactgtctgccccacacatgactcaatgttgaatgaatgaataaatgaatgaatgaatgaacaaacaaacagggcagaggtatggaggaagaggagggaggaaagaaatgtaagagtcagcctctgcactcaactcaagcaggacccctctaggtgggaagatgaaacgagcatatta

SEQ ID NO: 193775 - DNA, 3176 bp, Homo sapiens
  misc_feature (65)..(65): n is a, c, g, or t
  misc_feature (2976)..(2976): n is a, c, g, or t
  misc_feature (3057)..(3057): n is a, c, g, or t
  misc_feature (3070)..(3070): n is a, c, g, or t
acatattcccaggtctgagctccagaaatacctcagaaggcactgagctcatacttctgactgancttcaggctctatgcaagcaggaagtgagggctactgcagagttgttaactgcccgactgagtgttgaaagcattctctaatgcatagaacctcaaaacaaaaactgggagatgactggttctgggcctttaaggaaatctctgtctggccattaactgaccactaagctaactgaggagagacttagtggccacacatggtagataatacagattttgcataattaattcagaaaagttaataataaactacaacaaactctgggggaatggaggtgtatctggtttctggagttgccacattatactatttaaaatgttcatttttcaacaaaaaattgtgagatgtgagaaagcacaagaaagtatgacctacacatggggaagaaagcaatcgatagagactgtcattgaggaagacaagatgctggatgtaccagacaaatactttaaatttatggtcttaaatatcttccaagaacaaaggaaaacttttctaaataatttaaagtataagagtgatgttttaccacatagagaatatcagtaaaggacagaaattatagagaaccaagtagaaattctggagttgaaaagtacaataactgaatttaaactctcactagaggatttcaacagaagatttgagcaggtagtgtaaagtgtaagtaaaaaaggaaataggtaaattgaaagtatccagcttgaggaaaaaagaatgaagagaactgaccagtgactcagagacctgtgtgacatcatcaaacatacaaacaaatgcaaatgcataactgaagccccagaaagggaggagggagataaaggggcagaaaattatttgatgaaataatagctgacacttcccaaagataaagaaaaatgtttatctacacatccaataagctcaaccaattccaagtagggaacatgcaaagagatagccacactgacacacatcattatcaaaccgtcaaagccaaggacaaagagagaatcttgaaggcatcaagagagaagcaactcatctcatacaggagatccttagttaggttaacacctgactttttaccagaaaacatggaggccagtaggcagttgggtgacatattaaacacattggaaaaaaaaatactatcaaccaagaagtttatatctgaaaaaataaaggtgaaattaagacattctcaggtaaatcaaaaccagagtctatcactaggaaatctgtcctacaagaaatactaatgagagtaccttagactgaaatgaaagaacacaagacagtaactcaaaaccacatgaagaaacaaagagcactggtaaaggcagtgacatggggacctagaaaagacattctaggaagattctgggaagatggtggagcaataagcaccagaaatatgtttccctacccagacaacaattgcactggcagaatctgtctgatgtaacagttttggagctctggagtctattggattgcagcttccaggagtaggtttggaggcaaaatgcagttaattttggcacaacagcagtcacccatcctccccaccagccccagcgcagacagttatgcacatgttcctgtagcagtttacagacagctttcaggagcgaggctggcaagaaaaaaggatgttgtccttcagatatttgggattggtgttctgattgctgattgctgttctgatcacaagagtgcaaagaagcaggtgcctattgtttcaccttcccccattgttgcaagctctcctgcactggatgaagtgacttcatttttctccttttccctttttggaagccagacattaaagactaggacattcaaaagcagctgcatgtatggagaaagttagaaagtgatatggcacatacaggctcagaaaagacctgagaagaccttatgtttgtacctaacgctgacccttggcacagagaaagcctacaacaacaacaaaatgtaacaaaaagcaacaaaccccagggaagggggaaacatgattttcaaaattgtgatattagattcaaatgtccgattttcaagaaaaagaatcacaaggcatacaaagaaacaggaaagtatggcccatttaaagaaaaaaagtcaatagaaactgttcctaaaaagacctgattgattatatatctactagacaaagactttaaaacaactgtcttaaagatgctcaaaggactaaaggaagtgtcaagaaagtcaacaaaaaaatgaatgaccaaaattgaaatattcataaaaagatataaaacctaaaaagaaaccaaaaagaaattctgaaggtgaaaagtataatcatggaaatgaaaattcactagagggattaaaaagcagatttgagcaggcagaagaaagaatcagagaacttgaagacaggacaatggaaattattgtctgaggaacacaaagaaaaaatattgaagaaaaatgaacaaagcctaagaaacctgtgggacaccataaaacagggcaacatatgcattgggggagaagagagactgaaagagtcaggagaacatttgaagaaataatagtttaaaattttccaaatctgatgaaagacatgtatataaacatctaagctcaacaaactccaggtaagatgaactcaaagaacccacaccaagatacatcaaacttttggaagacagataaaaagacagaatcttgaaagcaacaagaggaattactcatcacatacaaggaattgccacaagattatcagcagatatcaaaaactttggaggccagaaagcagtgggctgatatatattctgagtgttcaagaaaaaaaaaactaaggactctatatctagcaaaactgtccttcaaaagtgagagagggctgggtgtggtggctcactcctgtaatcccagctgaggtcaggagttcangaccagcctggccaacatggtgaaaccccatctccactaaaaatacaaaaattagctgggtgtggtggtgcatgcctgtantcccagttactcnggaggctgaggcaggagaatcgcttagaacacgggaggtggaggttgcagtcagcagagatcgcaccactgcactccaacctgggcaacaagagtgaaactccatc

SEQ ID NO: 193776 - DNA, 1917 bp, Homo sapiens
  misc_feature (1717)..(1717): n is a, c, g, or t
  misc_feature (1798)..(1798): n is a, c, g, or t
  misc_feature (1811)..(1811): n is a, c, g, or t
gtgtgatgttccccttcctgtgtccatctgtcctacaagaaatactaatgagagtaccttagactgaaatgaaagaacacaagacagtaactcaaaaccacatgaagaaacaaagagcactggtaaaggcagtgacatggggacctagaaaagacattctaggaagattctgggaagatggtggagcaataagcaccagaaatatgtttccctacccagacaacaattgcactggcagaatctgtctgatgtaacagttttggagctctggagtctattggattgcagcttccaggagtaggtttggaggcaaaatgcagttaattttggcacaacagcagtcacccatcctccccaccagccccagcgcagacagttatgcacatgttcctgtagcagtttacagacagctttcaggagcgaggctggcaagaaaaaaggatgttgtccttcagatatttgggattggtgttctgattgctgattgctgttctgatcacaagagtgcaaagaagcaggtgcctattgtttcaccttcccccattgttgcaagctctcctgcactggatgaagtgacttcatttttctccttttccctttttggaagccagacattaaagactaggacattcaaaagcagctgcatgtatggagaaagttagaaagtgatatggcacatacaggctcagaaaagacctgagaagaccttatgtttgtacctaacgctgacccttggcacagagaaagcctacaacaacaacaaaatgtaacaaaaagcaacaaaccccagggaagggggaaacatgattttcaaaattgtgatattagattcaaatgtccgattttcaagaaaaagaatcacaaggcatacaaagaaacaggaaagtatggcccatttaaagaaaaaaagtcaatagaaactgttcctaaaaagacctgattgattatatatctactagacaaagactttaaaacaactgtcttaaagatgctcaaaggactaaaggaagtgtcaagaaagtcaacaaaaaaatgaatgaccaaaattgaaatattcataaaaagatataaaacctaaaaagaaaccaaaaagaaattctgaaggtgaaaagtataatcatggaaatgaaaattcactagagggattaaaaagcagatttgagcaggcagaagaaagaatcagagaacttgaagacaggacaatggaaattattgtctgaggaacacaaagaaaaaatattgaagaaaaatgaacaaagcctaagaaacctgtgggacaccataaaacagggcaacatatgcattgggggagaagagagactgaaagagtcaggagaacatttgaagaaataatagtttaaaattttccaaatctgatgaaagacatgtatataaacatctaagctcaacaaactccaggtaagatgaactcaaagaacccacaccaagatacatcaaacttttggaagacagataaaaagacagaatcttgaaagcaacaagaggaattactcatcacatacaaggaattgccacaagattatcagcagatatcaaaaactttggaggccagaaagcagtgggctgatatatattctgagtgttcaagaaaaaaaaaactaaggactctatatctagcaaaactgtccttcaaaagtgagagagggctgggtgtggtggctcactcctgtaatcccagctgaggtcaggagttcangaccagcctggccaacatggtgaaaccccatctccactaaaaatacaaaaattagctgggtgtggtggtgcatgcctgtantcccagttactcnggaggctgaggcaggagaatcgcttagaacacgggaggtggaggttgcagtcagcagagatcgcaccactgcactccaacctgggcaacaagagtgaaactccatc

SEQ ID NO: 193777 - DNA, 319 bp, Homo sapiens
tttcaaccatggtatgtgtagcttcctatttccaaaagagaaacaatgctccagggctcatgatcactgacaataactctggataagcgatgctgtaatttttaatcgaggttctggaaaattaattgtgcctgttttgcagatgttggtaagattgttggcttaataatgaaatctaaaggagtccattatcaacaatggaattataatcatctactggtagatgcaatacattatctttttttttctagttaacaaagcatctaatattcctggaaaacttgaataactctgggactcaatatacatagttggattg

SEQ ID NO: 193778 - DNA, 341 bp, Homo sapiens
ctcttatttcaatgaattcagtttcaaaatatgtgaatatccaaggttccttagccactaagaaaagaagcaaatacagtttctgagtatgtggcaattagcagaacctctaaattattcaaaagtagtaatggggagggatgtttctataaaccaaaaaataaaaaatggtgactcatggaccaaatctggcttgccaatgtgctttgaaagctgagcatttaaaaatatattttgaaatcccttttgcaggacatgttctcctgatttctataatcctgatacttccagtcctcatgacttttaacctaatcactttacacaagtatttgagttgcctg

SEQ ID NO: 193779 - DNA, 375 bp, Homo sapiens
ttttgcctggcacattttaagggccacattgagggtcactattacctaattgctatcattatcactactactatcacaataactaaaggagaaagggaaataattttagtgttactgtttaatactcagaaggctctatgctcttagtgactgaggtcatttaccaagcaaggatataagctatcttcaatgaaataaaatcggtaaacagtaaaacagcatataaataaaaaataatgtaaataagagccataaggaaagcatcaactctgcctttttaactcatttaatttgtgcctgacagcagactcacattctcatacctgaaaattaatggaatcataaatcatagagtattcttttctgtgtatcttg

SEQ ID NO: 193780 - DNA, 395 bp, Homo sapiens
ggagggtggtattgttatttacattttatatggaaatacatttaattggcagggatgcttattttcaggggatcagtaggagagtcagaatcaggtcactgactttgttgtttacttcttagaggctactaaaagtatcaaataggtaccctatgttcacagattattaaaggtctgtaaattctattttctacccccttacaacaactatataaattatagaaatgtgtctctatctacagttatattaggcatcacagtcaacagatgcatgaaagaaatgccgtgttattgaagacctggaaactagcccagtattttaatattaaataaaaattcaacagagatggagaagacatgtgttatacaaggacgggtaggtatgatgaaggacg

SEQ ID NO: 193781 - DNA, 304 bp, Homo sapiens
aatgaaaggtataaagagtgcatgcaaaatgttaataaatcattaaaaggttaggaaagtttccagcaaggaagaggtctctgagccaaaaggttgaggataacaaggtacctcattcagccatattctgtcatcatctccacatatcattgttttgaaattttaatatggaaagcaggtcattcttttaaaaaactgaactgcatctaaaatcaattagatctcatgatctacatgttcacctcatcttagggcacagtatagtaaatgatcttaacttgtttaaaatattttttcttggctg

SEQ ID NO: 193782 - DNA, 267 bp, Homo sapiens
gaaaggggagaacaggaatgtcccaggagccaaggctcatctataagggacttccacatttaggatgtagaagaaggaagcagaagcagggaatgaccagaaatggccccagagatgagacgaaagttaggagagcggggagcaagcctttaggtttcacaagggaaggagggaaagtaggtgttaggtgctgccaagatcaaggaaaataagcagaagaccaggccatttcagttgcagtgagccaagatcacgccactgcactcc

SEQ ID NO: 193783 - DNA, 298 bp, Homo sapiens
aggcagcacttggacttcgggcctctattacacgcgtattacagccttaggagcacttgatctgtgtcacatgtggctgactccttaggggacagaagggtcaccgcagggcctgaggctgcctctggcatcgctcagctcagtgtcttccagggcagttcccaagttctgcaggccccaggtgcctggaacaaaaaccacacccccctttcatgacgggcacattccacagctgttggcggcaattctgattcacaatatttttatgacagggctttttcttccctacgttattttg

SEQ ID NO: 193784 - DNA, 308 bp, Homo sapiens
gcgcatgctaccgtcaggatgctcagctggtgggaggaagcagttgtgctgctgccttgacactgggaagggcgggactgccttcagtggcaggcagcctaggcctctccagtggcaaggcagcagcacaactgccttgtcactgggtgtactacttgcacctcagtcccagtggtgcttgtgcctcagtctcctgtgcagtagcccatgtttgctcatgtctaagccacataggcagctgccatgcttctcttgagcttcagccctggcactgttgggttccaggacagtacataatctgttgtaga

SEQ ID NO: 193785 - DNA, 441 bp, Homo sapiens
catgggaggcttcagggtagggagggactggaaggtttacagactaagtccttatcatgaggagaaaagagagatgccattctcccacctagaagtcaatgatcagattttaatggtatgccaaaggctgtgaatggtcataaaaaggggaggaaataggccgggcgcagtggctcacgcctgtaatcccagcactttgggaggccaaggcgggtggatcacgaggtcaagagattgagaccatcctggccaacatggtgaaaccccgtctctaccaaaaaataatgcaaaaattagctgggtgttgtggcccgtgcctgtagtcccagctactcgggaggctgaggcaggagaatctcttgaacctgggaggtggaggttgcagtgagccgagatcgcgccactgcactccagcctggcgacagagcgagactccatttc

SEQ ID NO: 193786 - DNA, 569 bp, Homo sapiens
tcacaggatccccaaagatcttggagcatcaccaacaatcacaatagatcatttagatcacctaggcaagcaatgcagtatggccagaggctgccatagcacatattaaaagtacacacacacacgacacacacacacatggtgcaaggaaggggagagagaaatgttactagaaataggaacagagatagctggaaatgagacaatgatgtagacaggaatggaattctaagtcaaaagggctgcttttaaggtgggcatgggaggcagggaaacctgagaacgaatcaagtctgagtagactcttaaatttttcttaacacgcaccaaattcctactgcagaagctgatatgagggctttttccttttctactgaacgttctaattctgctcccacaaacctggttccatttgcctaggaaacctgaaaccagtgtttttaaagtgcattatgtagaagagtaacttagggaccttgtaaatatgcagcttctgattctgtaagcaaagggtggcctgaagattctgcatttgtaactagctcccaggtgatgctcaaagatcttgg

SEQ ID NO: 193787 - DNA, 463 bp, Homo sapiens
gtaacctaaggcaaacttccccttcagccatttcaaataaaagggaagatgccaaagagtgcatggagagtcaaggctggagagcccattattatctcaggtaaaggaaagcagaggccatgagtgggcagagtggccacactgtacacagagagcacagcagacatggaaggagagggcatgggaactacagggggagacagaagcgggagagtgaccaactgactctagctatcccccgctgttaccattaacccagaaccaccctatggtttcagttccaaggaactgtctgggctgccattcaggtgcctaggttcgaacaagattctttttcttttctcttttcttttcccttggcatgtgaagtgagaaggattttttttggtttttgttttgtgaggcagggtcttgcaatgttgcccaggctggagtgcagtggtgcaattgcagcccactgcag

SEQ ID NO: 193788 - DNA, 311 bp, Homo sapiens
ccctcttgcatgttacataatgacttcattgttgacacttctggtttggcacaggcaagtgatatagctatttattttttaaaaacagatttttaagggctgggtgccgtggctcacacctgtaatcccagccgtgagaaatattttaggctcaaaaatatataactagtgacagttttaattttcttcaaatgggcttgcaaaataattatactgatgtaggttttgtctaaatatagcatagtcatttcaagataggagcaatgggtgcttcacctatctaccaatacaatcttaagttcacatctcca

SEQ ID NO: 193789 - DNA, 636 bp, Homo sapiens
gttgcaacagcacccaggctcagccacagctttgctctgcctgtgagcagggagaggccaggcagcaggagcatgcacttccaagcctgcagggcagggggcttcctgggcccccaagagtgcagggatgcccaggtctgcagctgcagttaggtggctgcaactgtgactgggagggtagggcttccacctggtcagcttggaagtgggtggggctcctgcctgttcctggctcctgctggctccttagagcctgcagccttctgccatgcctcccctgctgcttctggcatctttgcagcagctgcttcagacaggccgctgctgccatcagtagggcctttattgtattgagctatgttccttctatacctaatttgatgagaatttttattatgaaagggtgttgaatattgtcaaatgctttttctgcatctgatgatcatatttttattcttcattctgttaatgtagtatgtcacatttattgatctatgtatgttaaattattcttacatctcaaagataaatctcactccatcatggtggatgatcctattaaggcattgtttaattgagtttgctagtattttgctgaggaagtttgcatgtatgtttatcaaggatagtggcctg

SEQ ID NO: 193790 - DNA, 401 bp, Homo sapiens
tgtctgggttatgggggtggatctctcatgaatggtttggtgctgctttcttaggagtgagttctctctctggagagaatgtgatgcacctacaagcttatattaagtgcccctttacaactgaggaattggaggttcagggaaattaaccttattgaacaaagactgagtactcagtacacacaattccctagggtatagtaaagtagagacaaagcttggaagtttgtaatacagtaaacagaaggagaactgcaacttgcaactcggggaaagtgggcaaggtagaaaccagaaagaactatggggtctgggaatacagagaggcctctttcttattggaggaaattagagaagcctcttgtggaaggtggaatggcagaacctgctcattgtcctcc

SEQ ID NO: 193791 - DNA, 302 bp, Homo sapiens
gaactgccccccagacacagtagtcttaacacatttggagagaaatacaaaggcaaaactcctaggccgaggccagctatactccggctacaccaccctccctgccatcagtggtctgccaaggaaatgagtagtggtacagagaatgtgcagcatgatcaacatccagcattctgtctcaagtgcttatggagttaactgggaggtgcccaggtcaatatagaggaagtcaaggagaatctacatagccatattatttttgagcagttagaagtccccgataaaattgcctgagtgagcca

SEQ ID NO: 193792 - DNA, 221 bp, Homo sapiens
tccactccatattcaatgcgtctagtcaaggtccgtgtgtgtagtttaatctcccagtgtctttctgcagattcttccagaactgcttgatgggggagagggaagatcatgcctggcaaaaagtgatttacactaacatatacacaaagaagataatcatcttgttttatgtgccggttgcagtggctcacacttgtaatcctagcactttaggaggctga

SEQ ID NO: 193793 - DNA, 475 bp, Homo sapiens
atagcacccaaatcctaaatttctaaatagcattccccactaagagatcaagacttcttagacaaagagctgaggcaatgaaattacaaaaccaacaaacgaaaaccaaaactaggaacattatgttatgccagaaaataaggaacttttagtaaaaaaaagtgatacattcagatctaatttaatgattttaactgctacataaaattatattgcagagtaaatctcaatttattttccattctgctactgaaaagcatttgaatttcttttaataatgacacaattaacatccatacacctgtttccttttgtacatttgtgagaatttacccggggcataaaagggcttttttttcttccccagtttatcttatattttatgaccgatgtttttaaactcattcattctgctgagtgaactaaaaagggtcatagtttgagtcctttcttgttttactattccatttctacc

SEQ ID NO: 193794 - DNA, 464 bp, Homo sapiens
ggtgaacagtggtgttttcaaacagtttcacttgtacacagttaaatgaataaatgaataaaggcaagtgtctatttttcgtggcaatatgtcttctcttctgaggtgctcaattcatttttattctgtatggaccacactcaggctccaagggaatgcatcaaacatgtctcagacaaagcaattaagcaagtatttgctgggcaactactatatgctctgcatcatgccgggtgctataggtatataacaaaagtaatgcctttcgccatcggatgacccttgcccacaagccgttatcgtgctcttgggcatcccggcctgcagagtcatgagccaatacccagtctgtggtattctgttatagcagcagaaaatggactatgacaaaggggtaaggcctctgagaaagcatcatttctacctattagatctgggtagaaagtgccactgtgggctcaagt

SEQ ID NO: 193795 - DNA, 527 bp, Homo sapiens
ctaccgtccacccattcattcattcattcattcatccatctatcatttaactgttatttactgagcatctgctacgtacctggcaggcaccattctaggcactaggtgttgaattaaacagtctctgctctcaaggatcctatattctcgttggaggagccaggccataaactagtatgtaacacagtttcaggaaatgacaagtattataaagaaaataaagcttagtgaggggatggagagtgatgggaaggcaggctactttagcagggtggcatgaaatgcttctcagatgaggtgacatttcagcagaggtctgcaaaagctgaaggcattcatagaatttgtgaaagctgacgtagaatggggcttccaggtgcttctgcagaggccagcacctctgctccctgctttcttctctcctgcacggagtcatccattcaataagtcatgtggggcccctgctcagggctaggccctgttagaggcaggggtgtggagggaagagagctttgttctgaggggca

SEQ ID NO: 193796 - DNA, 306 bp, Homo sapiens
ctttcacttagcataatgcttacggggttcatccatgttatagatgcgttgccagacaacatactgttgtgtggatataccatgttgtatttacctctttactagttggtagataattgggttgtttccacttattggctattgtgaatcatgccactatctgcatattagttaagaacatcggaaagtccaggttctctcattgaccatgagcagaaatccagctagtcttttgacttgtctaagccaccgcgcccagcctggatgttttatatcactggaatcatacagtatttgttcttttgt

SEQ ID NO: 193797 - DNA, 363 bp, Homo sapiens
cagggaagagggctgcagggaagagggaggagaggtccaaaatatcccgtgggccaggccatgcagagcctggtcagaatgaggcttggattcttttctgcatgcacagggaaacattagaagttcaggcaggcaagtggtagggtctggtttttatatggctgccataggaaaatccaggcaagagtggaggcagggatacctactaggtggctgttgaaaaagttggtcacatgcagtggctcatgcctctaatcccagcacgttgggaagctgagatgggtagaattgcttgaacccaggagttcgagaccagctaggcaacatagtgagacctcatctctagtaaattaaaaaaaaaaa

SEQ ID NO: 193798 - DNA, 356 bp, Homo sapiens
caactatgcctcgtcttgaacagaatagacaccttctgttctttcagtcaggccatatgcacctttcatatgtctagtcattcttctctggcagtgcttcagtttgtccacatctccctgaagcaaataacatgttgcctgtgaggtctgaccagcccagagtacagtaggactaccactaccttccgtgttctggctctctttcttatcacatctgaaagctgatttttaaatcaatttcatactccactgacttgtactgaataatattttactaggtcaccataggccttgaactccaaataaaaaggtagatatcagaagagggaagtagaaaaaagttaagagctacttga

SEQ ID NO: 193799 - DNA, 649 bp, Homo sapiens
acacatgactgaaagcattataaaacataccttgtcaaatacattagattcattataggtcaagggaattttgaaaagtaggctagattgctgcctaagaatcccactctaaagtactgctttgtttaatcattctagataatggaagcttgtaagcctccagaaagttaaaacaaaaaacttctttctgattaagagcctcttaactctatccttatcctctgctatctcaatgtagctattaattgttccctctttgtttctagactccaattttcatttctcaaattttggttctcagtgctgttagtattagtagccttttgtttcttcagaatgtatgtatttttcctcttaaatgtttcctttcccttttaaggttagtcctggaatacatgtttttcttggtcttgtagacttcatctcttctgatttccataataatttgcaccttgatgaatccagaattctcccactgtcttcaaagaatcttgaatagaataatctgctttttgaactctgctatctagtaatctctttagatatctataccacaagtttgaaacatcaaggtcaattttgataatttcctgtcttatgtcttaatacccattcagagttgactgccaactaacaagctcagccttta

SEQ ID NO: 193800 - DNA, 221 bp, Homo sapiens
gcaattaacaaaacaactttgactaaatatagttagcactaaatatagttggttaattggtatttaatatgcttattaaatgtcaattaagtatctttagcaatgaattggtacctaattaacttactatagctatcctgttacttgacatttgaacagctaaatattctttacaagtttaatgttttaataagaaacaaattatctatgtattgctcatg

SEQ ID NO: 193801 - DNA, 579 bp, Homo sapiens
gattttccaaataaggaagtgaacaaccaaatctgagtgacttgattcctaggacgaatctactcctccttaaagacagaggctctgggaagactcttttagtaagccctccagatgtgagcttctgtgacagccaacgcactcattgtatggtgaacataattatccctcatgagtaatccgctaagcctttctgttgagcctctggagaggaagaaatttgcttcattcactttaaaaaaatattttaaaaactgacataattcatataatataaaattcaccatttcaaagtgtattgctcactggattttagtgtattcactatgttgtgcaaccatcgctattatcgaaatcaagaaaagctccatcacctcaaaaagaaactctgttactattagcagttaatcacaattcttccctcttcccagcccttggctaccactgatctaccttctgtctctatggatttgctaattctggagatttcatagaaatgaaatcactcaaaatgtggcctttgtgtctggcttctttgactcatgagaatattttcaaagttcatccaggttgaagcat

SEQ ID NO: 193802 - DNA, 292 bp, Homo sapiens
ctttggaggcacatcctcccttgcagttacgtgtcatgtgacagagtactcattggtggaatttctgaggtctagacacttctaggtctaactcataaaagcctcccgcaagtgattctccattctctgccacttttgttggctggctgttgatgcgcagcgtaacttgaagtcatgtgttgaagatggaagcgtttttgtcggacatgtcactgaacagttgcatggagcaaaggcctactccctccccacagaaacgtttgtattggactaatgtatgggtagtcacaga

SEQ ID NO: 193803 - DNA, 173 bp, Homo sapiens
ggcctctagacacccactcgacagtggcatagatgctagatgcccactcgccagtggtgtagctttggggccttgagggctctcttttcatctgtgccatacacgatgtgtagatatcatcacagggtgcgcctcagctgcagcaggtttggctcaaggatgctggcggtcgg

SEQ ID NO: 193804 - DNA, 538 bp, Homo sapiens
ccctggtgtgactgaggaggtggcaaatgtggctggactgaactagtgggaaaaggagatgaggtctgaaagctaaccggggctactggaaggttttcagcagataaggcataaaatttaacaagtttataggatcattctggctgctattttaagaacagactgaatgaaggtggagagggaaaagggaaagtaaggaaatcatttgggaagcgactgcaacaaaacagctggaagaattagatcagaatagcagtagtagagatggtgagaagtggtcagattcttaatatattttgaaggtaaagctagtttctaagttcaaaataactggaaaaaacatcaggactagaatctataaactgtggcctgcatatactttaactgtagtcttgtaatcagtttagtaaaaaagggtgacttgtactaacaatatactatttgcaaattttttgaagctaaatatagcggggttttttggccacaaaagaaataatccaggctccatctaatgcaaatgcctagagagtttatattt

SEQ ID NO: 193805 - DNA, 396 bp, Homo sapiens
tatttattgacaaggatgcaagtcacagaacaactacagtttcatcttgttagtacaacaaacaggacaataacatagatttaaattcaaatgtaaatatatgtgggtacgcacacaaaaaatctaaaaggaaacatggagcaaaaagcctggaattttcaggttttactttaaaatttctctaatgacaaaaatctttaaaacaagcacgaataacttttttgacttttagaaaccatttttaaaaattaaatactgggaggtcaaaaaggaaaaaaaaatcagtcacgtaacaaacgtaacttcaaccacgcttaacaatgtaatggaactaatttttaaagcaaatgtggcaaatggctaaaaaaatactgaccagttcttaacagtttttaa

SEQ ID NO: 193806 - DNA, 443 bp, Homo sapiens
tatctgggattacattacaggcatgtgccaccacgcccagctaatttttttctatttttagtagagacagggttccaccgtgttggccaggctggtctcaaactcctgacctcaggtgatccaccggcctcggcctcccagagtgctgcaatgacaggcgtgagccactgtgcccggcccctggtttatttcttaattccacaacttgtgctgtgtggaaactattttctaatgttttccactgacacttactatgactaatggtgtctacttacctggggaagaaaatggcaacacataaaaatttcactcagtgacgctgcccttctaaaagacacaaacaggcacagaatatctgcctggtcgataaggtatgctcagcatcattactcatcagggaaatgcaaatgaaaatcacaataagataactactacatgcctgt

SEQ ID NO: 193807 - DNA, 376 bp, Homo sapiens
ttgttagaagataagctaagtggacgtgattgtacgatacttgaataaactaagttacacagaaaacatttctattgtgtttctatctacagtatttagcacagtgcctctaacattatagatactctctaaataggtgttgatcaaatagatgtgttttacttatgaaatttgataaagatagcctgaaagtgtaggaatgttcttctcagttatagtttaagtagtcaggataacagccatttaggtaccagccatttaggtaccagccatttaggtaacagccatttaggtaacagccatttaggtaacagccatttaggtaacagccatttaagtaacagccgtttaggtaacagccatataggtaacagcc

SEQ ID NO: 193808 - DNA, 708 bp, Homo sapiens
  misc_feature (459)..(459): n is a, c, g, or t
tgtggtaccatcgttagtcatcatgtgatcgttccatgtagatcctgtcgtctttcctgcaacgtcggacacttctggatgtttcacagccaggcagtttatgatattaacagactagactccacagacttctgcaagatgccaagaggggaacttgggctttttcttttttccaattgccttttacagagtgatggaaagttaactacgaactcctgcggggaaaagaagagacgatctaggcctaaaaatcgtgtctactctccaagagagcgtcgccctgctttccagtgttatttcatctgtttttataattggatgtgaaacttcttgagaaagggtcctatgactctttaaccaattattgttcaaaggagtccccaaagtgttaagcagtttcaaggacagacatccctcctaccaacgcagtggacttcactggaagatgctatttcaccnaaatctgcaaatgtaaactgaagggcatcggttgtgtatccatgtgagacgatcgtagggtatcatgtgatggtaccatgtggtgcctgtcttctttcctgctaggaacggaccttcctggatgtctcacagccaggcagtttatgatattaacagactagactccacagacttctgcaagatgccaagaggggaacttgggcctattcttttttccaattgccctttacagagtgatggaaagtaact

SEQ ID NO: 193809 - DNA, 393 bp, Homo sapiens
aatgaggaagataaataaaccagagagaacaattactcttcaatatcaaagctagtatttttagcatcactattctttggatcagacaatattttctacaagctttcatcgtaagttaatcatctgaattaacactgcattaggaaactttttaactctcccacctgtgtgctttaccctataaaatgaaccaaccacacttctgtttcctcctacacctaatggagaacatagcaggctcagtaaatcttagacaattttctttgacactcaagaacttttgcattaacatattttaaaagtcaagactggatccaaagtaaaatcaaacttgctgcttagccaaataggctttttcctgatataagctaacagtgaatggctttattccta

SEQ ID NO: 193810 - DNA, 190 bp, Homo sapiens
gaaaccatgaaggcaataaggaatgagacaaactgagtgccaatgtgactcccaggtttgactactgagtctggcaatgactcgtctggatccccatagagcttttgttccctcaactgtagaatgggtataacaagaaaaaccatatagagcatggtaacgaaacattaccaagagctttacttacatg

SEQ ID NO: 193811 - DNA, 332 bp, Homo sapiens
ttcaccatgttggccaggctgatcttgaactcttgacctcaagtgatccgcccacttcagcctcccaaaggggtgggattacaggtgtgagaataaatatgtcattgcttcactgaaagcaaaacaatttccattgttagccacagaattatcagaattgtcgtttcagagcaactgtgcatggaaccaggaaagtaaatgattctttagggttttaatgaaaagggttctgcttggggtgagtagagtaacatgtttgcccacatgaaggcatgaagttggctgctgcttaaagactgttgcatggccttaacttgaccagccactgtctt

SEQ ID NO: 193812 - DNA, 369 bp, Homo sapiens
  misc_feature (34)..(34): n is a, c, g, or t
  misc_feature (37)..(37): n is a, c, g, or t
tatgcttgtggtcgtctctacacggatccccacnacngtcgcatattttttaaatgaaggttggccaattaatattgcccaatgagacatgtgagccttacggtttggctgcttgtcaacccaacacaattatttcctgatctttagccaacacggcatgtctcttcatcagtaagtgaataagcagaatggacctgtgtgtgtgtgcacatgcccacgcttgtgtacgtagcatgtgtgcagcataggtgtaaagcctgcaggcacaccttgcattcttgactaaaattccttctccctcataagaagagagattacatgattgtcttagtcattttcttttcgtgaaatatatgcgatggatagagt

SEQ ID NO: 193813 - DNA, 712 bp, Homo sapiens
agaggcaagaagcagacaagaatcatgtacagcaaaagaaggggttgttcccgagtatagtgtgcactgggggctgaggtgggaggagagagtgtgggccagaaccagcttgggaggggcactgtttgccctacctggtcggagggaccataccctttggtctctggggcaccaccaaaggtttgtaaggatggaggtgatgtctcctggttggcatctttggctctctctctgcagcaggatggaggagggcaggataaggaccctgggaggagcaaagcaccccactgggggtgtcctattggagcctcctgggagagccaggagaggtgtgggcagcctcaactctgtggcagtggggcctaagggtcaggggatgatccatgagtggtcagcaaaaagagagagacagagagagaggtggggggactacctgtagagcagttaacatgcatcagcaccacaagcaggaggaccgctgggcagagaaacatgtatgcacattcatgcacgtgtacatgtgaataactcctctcacacatgctggaggaaaccctcgctgtcatccacactcccaggaatggccacattagacatcttccccctagttcctgagaagcaaacccgggagagcccagccctcagccttgctgcatgcgtgagcatggagttttgcactctggccagttttgcctctagttctttgtttctg

SEQ ID NO: 193814 - DNA, 413 bp, Homo sapiens
ctaggagtcccatttctgcaaaagaaacttttatcagagacttatagcttgaaagaaatataaaatgactaaagctcctcagaagctgtatgaggtcaacagttggaatcctcactgtagggcggcctgaactgtttagggtagtattactttgaacaggggtaaggctttcacacatggagaagttgattcactggaggccatctgttagtgggagatgatgaatactgctggctatgtcagttattaaaattagggcagcattcctagctttttgtgtcctaagttatattaaatggatgacttaaaaaaactgctttgagaaatggcagatttgacactacttagactttaagcaaagttccctcttcccattttacacttcctttactgataatgtttaaactgagctg

SEQ ID NO: 193815 - DNA, 447 bp, Homo sapiens
gctctagagtatctccctcctaccccacggggaaatgtaaacatgataactcatatgaaaagtactaatgttaagaactgttcagcatatttctccctaaaattgaacttgtctaatacattgtgatggtcattttagggacagtgaagatttaagagagagcctttggcctcaagtactttatagaattataaggaaggttagaacagtactgtaaaaactagacaatgaaaactgctttatatgctggtttttttttttttcttaaaagttctatccatggggatgcaaagaagagaagggttaattccaataaagaaagtctggaagagtttaaaggagccatttgcccaagatgttgaaagatgagcaagaatttgttggctggtagagatggagtgagagaaagggaattctcagtgtatggctagagcgtggggatctgtg

SEQ ID NO: 193816 - DNA, 522 bp, Homo sapiens
ttgacttgcaagttaggcataagttagagattatacatttgccatgttcagtattttaaagaaatttgcaagtttagattctaccttgcattagtttagtattttttagaaaatacttgctatttacttaagccaaatatttgcttctgatttgtttcttgatttagcaaattagttgtggtttgttctggatttgggtttgtctttggattctattttaaatccctgagtcttatcgttaagttgaaaatagttgtatttaagtgtattatatcatagacacggatcccaaactgctttaacagctatattaaatgatatgaaatggtaatgaaaacttgatttaacaccaaattataataatatcttacacatctgttgacctgttgctttcttctggggatataaaaataacacttatggaaggagaaatatggatatagtagttttgtctctagaaatgcagaggtgcctgaaagtgagaggctgagagagggagagagaaatgaatgagactgaatt

SEQ ID NO: 193817 - DNA, 634 bp, Homo sapiens
gaaagaaagaggaagaaaaattagttgatggttaactaattcttccttaggctattcattttccatcattattacaccctgaggaggctttaactaaatttcctgatacattagatgatcaatatcagtattataagattgatttctataaggggctgggcgtgatgattcatgcctataatcccagcactttgggaggcgagggtgggcagatcacctgaggtcaggagttcgagaccagcctggccaacatggctaaaccctgtctctactgtagtcccagctacttgggaggctgaggcaggaaaatcgcttgaacctgggaggtggaggttgcagtgagctgagatcatgagactacactccggccagggcagctgagcgagactctgtctcaaaacaaaacaaaaaaagatttatttacataaggtaaatgaatcttagcaacagtgtcacttgttatgccatagtgtgttatgtcacaacgtgatgctgttttattacagaacaaatcagtaagaattgcagaggaatttgctatgccgcctcagcagaattgacccttacctggatgctggatattatcatggataggtatagttacagtgggcccttactcagttatttctgagtt

SEQ ID NO: 193818 - DNA, 429 bp, Homo sapiens
ctcctcataacctgcaactgtttgttggtgaattttgtcttccttgctaaattcaaggatcatttgttcaacagccttctaaccaccataatgctgaatacacagaaggtacacatttcttattctaagcctcaatattttcaattcttacatcaatacgaggcccgagtttttaaaaataactcttccaaatgattgtttctcatgcattgggaggcaaagatgttagaatttttttagagaaaatgccagtgtaaataaactgtgtaaaaatatttcacacaagcctatcaatattacataaatgcatgctcctgagcacaattgcctagtctaataataacgtttcctcctacttagcaagatgtaaaggtaacagccatataggatgggagaaaagctatctagctatgtgaatgaagcatctct

SEQ ID NO: 193819 - DNA, 494 bp, Homo sapiens
gactatggctaatattaattgcattagtccatccttgtgtagtgttgctataaagaaatacctgaggctgggtggtttataaagaaaagatgtttattttggcttatagttctgtaggctgtacaggaaacatagtgccagcatctgtttctgccgaggtcctcagcaagcttacagtcatggccgaaggaaaaggggtagccaatgtaccacatagtgagagtaggagcaggaggtggggtgggagggaggtgccgcactattttgaggaaccagatctcacatgaattcagagtgagaacttactcattaccacagggacaccatgccatctatgagcagtgacctaaacacctcccactaggccccacctccaacattgacgatcacatttcatattgggataaaatttatgggggacaagtttccaaaccatataattaatgtattgtatacttaaacattgctgaaagtaaattttaaatgttctcatc

SEQ ID NO: 193820 - DNA, 416 bp, Homo sapiens
actgtacctggcccatcttaggtttaacttttaagtttgtatttctctgagcttatataccaagtgtcggtggagagtgttgacctggaagtcctgtgattggcaggggacaaccaacttagcattacaaactgattgtggaccaatctgagagtggctaattgatgtgcaagcaattcaaagttgattgcacatgtatatgtctatgtttcagatatatatatatgtgtgtgtgtgtgtgtgtgtatatatggaatattgataatgtttgtgaaggagtcgaatattctgaaggaaagtttttttatagaattaaattttgatgctgccactgtaaaatttctatgttacccactgattgctgtcattttccagatgacttttacttttaacagatgtttatctgattactcttg

SEQ ID NO: 193821 - DNA, 438 bp, Homo sapiens
atcacatcgatgtaccatacaaagctgagtaaacaaataaccccaaaggtcttcaaataataattgtgaggtcccaattggggttcccttcttggttgtcaaaatagaaggggaaaactcagaagagccaaacccccaagaaccttcttgagatgacagctgacatatttaggtttattcctggcatcagtgaaattctaatagcttaatcttctacagtacttgtgggaactgtgaattctatgatatgcttaactgccttaggaaagacttgcttgatgttttttctaaggcctttgtttttcttaagagctagaagcctgaccatgaaaagttaagcctttttctcttccctacctattgttattacattttatgaatcttcagcaactgaagatttttatccagtgaataatttgagggtgaaaatggtgagtt

SEQ ID NO: 193822 - DNA, 228 bp, Homo sapiens
tcctcatccagttttaccaggtattaacatcttacctcccccactgcatcattctctttatatttgtatacaattcctgtttgccaagccacccaaaaattgtgtgcagacgccatgacacttcatccctaaatattccttcatggtctgtcaagaacgaggctattgtcttaatatccagaacaccattgtcaccccttaaaagaactcaacatgaagttcaacata

SEQ ID NO: 193823 - DNA, 589 bp, Homo sapiens
agcctgctttacccacagtcttccccatcccagcttcaggcaacctcattttcgtagtagccactctgggagccacgcaagtgcttttcccatgggggaagcacgatatgatgaacacttcaggagaaatactcgacatgggaaatgcaatatgcctgggcttgtggaggaaagtagcagtatagaaagaaaatctctacaacagtagagaggccaaaaaataagctatttttacaacagcagggaggggataggggacaggataaaaaccatctagaatatgacatgtacaaactcaaaacaatcgcgaggtcagaaaatggacaactttagaaagaatcccatctttctcgatagggctacaggctggacgatggaacaatgaatcaataggaacaagagaaggcataggtgggggggctccaaataattattctgaacctgctgcatctatgaccttgaggggtcctttggacacactccaaagaaatgctaagcaggtggctggacagttctatgtgggaaaaccaacacagagctggtagttagaagcacaggagggtgacatcagataggtacagagtcgtga

SEQ ID NO: 193824 - DNA, 841 bp, Homo sapiens
ggagaaaaggaggtgcccctagatcccaagtcccctggggccgcagcaaagggaggaggaccttgcatcactccagggtgccacgtggacgaacagaggtaacattgggagtgtggctggcagtgttggacattcagaacatgtctgcccaaaacaaacatggccttcgcttctcccagctcccagaaacaaagtaaacagaaggatcacgtctggacaccagggaccagcccctgttacatccctgtcccccccaggccagagcctgaccactccgtgtcacctgcctctactcctgtagtgactgtcaactttttggatttcagaaagccaaaccagcaagggaagccttttcccggggggtagaggtgtctctcctacacacacccctaccccagggtctgagatgacatcccaaatcaaacccggtattctgcagagatacacaaaggttcaaactacagacagccttgtatcagctgtaaaggggggccagattttgctgcaaaagaaaaaacccagtatcccctcgctcagcccactgtgtcaccaagagggagggtgggcggctggccaaagagggctccattttatagtccaggaaggggtggcctgggccccacagctggtggggcagtggcactggatctgaagcaaagctgggcactggaggctgtgccttgggccggtgtgctggcagcgcctgctggaggagccaaggggcactgattcaacactgactgtatttccggaaccagagttagtattgggggtatggtggcgttgtggttacaatctttcaaaagtcctcatctttcagagatttggactgaaagttcta

SEQ ID NO: 193825 - DNA, 135 bp, Homo sapiens
tagtgaactcatagtaacggtttgtgagaacaatacatagattttcatttctatgtagatgagttggtatgagaatatatggaatgtttttagggtctgtttgaatctttgatttgtagactattaaatatacca

SEQ ID NO: 193826 - DNA, 713 bp, Homo sapiens
agcaggtgcaaaccttgattgtccccgacaaactgggatggatacttagcctaaattcataaccaacttctgctgaaggcctgtggtgctaggccatgtgctttatatgcattattttataattctcacaacagagcctcatgagaatgttaacttttatagaggaaaccaaaaacccaaagaggttaagtataatttgtcctcagttaaatagctttaagtggtggagccctcattttatcccaggcctgtctgacgttatacttctgggtttgattgctgtctaattagataggaaatgcaatgaaaatgaaaggttgtagtaaaaagtctgtaggttatgttgcatcagaaacttttgttaatacttaaaggttatccagcaatccccccttttcgtctgttacgttcctgtttcagctattatgcatgtttacacatatttattgttctatttcacaggccctgtaattggatgggctcattgatagatgttaaatggatagctccttgtatatcatttgataaacttaatttaaaatcagaaatgattttaagaaatagcttaataattaaatgatctggaaatactaggctggttggatatctttgaggttagtgaacatgtagtgagccttaatatagtagtaggtcaaatgaggcatctgcatttatggaattatattatatgtacattaatttttccatggcca

SEQ ID NO: 193827 - DNA, 475 bp, Homo sapiens
ctttgtaaagtatgttgaaagaagggacctctatataagtttttaataagttaatagtatcatacctgtaatcccagcactttggaaggctgaggcaggaggattgcttgaggccaggagatcaaaagaccagcctgggtgacatagtgagatccccatctctacaaaaaaaaattgtttaattacctgggcatggtggtgtgcacctgtaagtcccagctacttgggaggccaaggcaggaggattgcttgaggccaggagatcaagaccagcctgagcaacatagtgagaccctgtctctacaaaaaatttaaaaattagctgggtatggtggcttatgcttgtaattccagctacttgggaggctgtgacaggaggatctcaggaatttgaggcagcagtgagctatgattgttgcacaggctggagtgcagtagcacagagtaagaccctgtctctaaatacataaataaa

SEQ ID NO: 193828 - DNA, 130 bp, Homo sapiens
acaggcaatgggaatgagatctacattagtgacatcagttgtacactattcagtagaaaaaggatatcagaaaacagcaatgcagctggtataatgacttaggattaatttgtttgttccttgcaagata

SEQ ID NO: 193829 - DNA, 651 bp, Homo sapiens
ctaaattcgacggcttctccagggcaggtaatgtccccttccaggcctcagcattgtcatctataaaatgaaggggttagactggatcagtgtttatcaagcctgtggtcttcatattaggaccactctgggattacaggcatgagccactgtgcccggccaggaaactttttaacagactcccaggtggtctgcacaatcattaactggacaagccttcttagagcctgggaggccctagaagaagcaaccctcaagtaggttaggtcacaaaggacgagtggtcccagagtttgtgtagattgctgagacgggacaccagaagaggccctgacctctcttggaaggtagcatgcttctgcttccagaaaccctggaaaataaaaggccgtgtttatgcagctgtggagtactagtctgtggcagggagctggagtcccaaggtgggccagatggatgtgcagcctctcggtctctctggatgcagtaaatactcataatttcatatgactcaacccagggagaagagaaatgtggcattgaacgggtgcctttagaaacagaggtcaccgcagtacctgtaaaaggagaacctgtccagcctgggtggtgtccctggagtgaaggggatttgtggggctagaggatagg

SEQ ID NO: 193830 - DNA, 633 bp, Homo sapiens
ctgtgaagtgcatgaaataagttgtccagatgaggaaatagctcagcgaggttgtatagcctgcctggagtcacacagccagtttaacacaaggccaaacttgaagtaggctcacattcccaaccttgtccattactgcagaggtaccccatatattcacaagcctgtccaaatctgaggcatttcattacttaggtccatttagtagcagtaataaggcatatacacaaagcacaaaagtctgctgcttaacagaataagcattcactcagcccccttctgcaaacctatagaaggactaaatgcaagaaacacatgctcagccctaatcccttctcatttcctcctggcacctgtttctgcccccacaggcaccaaacactctaacagctggctgaaaccgagagagaaccaacagataatacactaccacttcagaccaagctctcaccaaaatggtggctgggaaataatggagacagaaccaccaagattttaagagatcaataaactgggtgtcagaagatctcccacattctcctgtcccagtaaaccaggtctccaggtagacaagagtcacacaacctatccttttcactcctcctcctcacctcccccgactaatgtgctgaa

SEQ ID NO: 193831 - DNA, 328 bp, Homo sapiens
tggccggcccggcttctggacttctggtcctcaatatccaattcaggagcatcagtgtccccacaggcaccaaacactctaacagctggctgaaaccgagagagaaccaacagataatacactaccacttcagaccaagctctcaccaaaatggtggctgggaaataatggagacagaaccaccaagattttaagagatcaataaactgggtgtcagaagatctcccacattctcctgtcccagtaaaccaggtctccaggtagacaagagtcacacaacctatccttttcactcctcctcctcacctcccccgactaatgtgctgaa

SEQ ID NO: 193832 - DNA, 947 bp, Homo sapiens
atttcagttgcttcatccttacacgttatgttgaatctctgagaggttttttctggacctaatgttctttaaccctatgattgcatatatatttaaaaaattaagtgtgttcacccaaattacaggcagtgtgtacaatactgatctctgcctgcactggtttttcttaaaacatttgcgttttccaggcacgttctcaattttgaatacattagtctcaaaatattttttagatatctgaagaggaaacttctattttattcattaaacttgtgagttcaggtgcatttgttacattctgtttcatggaagagagaattaaaataatatcaccaaacacatttttgagaatgattttttttcctttaatatctttattttcatggtatgattcctgaatgtcaaagccaattcttcagcagctaagcttttattttgctttgtcttggaaattgtgtactaaaactgtgtttgttaagtagtacaatacaatgttattcacatttataatcttctaaatactaaaataagtttcaggagctgcttatattaagtgctaattgagaaccagtgtacattaaaataatttaccataaaaaataagacatgagaagaaggcaggtgtcagggaataaagatgccaaacagtttggtcttttctggcaaacagttttatttatgtctagcgtacagtttttaagtgggtaagtgatgagaaggagctggaaataggtaagcagggctcatatcataaagtgacttctttgctgtgcctaaggacattcttctgaccgtaataggaactagtgaaggattttaaacggaacggcaggattatgtttcaaccttggatgtgtagtgtgtaggggataaatcagtgatgttatcgcccaacacttaattcgttctggattccacactcatagggtcctacatcattcctggtg

SEQ ID NO: 193833 - DNA, 381 bp, Homo sapiens
aggagctggaaataggtaagcagggctcatatcataaagtgacttctttgctgtgcctaaggacattcttctgaccgtaataggaactagtgaaggattttaaacggaacggcaggattatgtttcaaccttggatgtgtagtgtgtgaaggatgagatgaggatttgggagggaagggccttagctctggacaggggagaaagttgagctggtagtagtgtaataggtgtgaatgacaccagtaattcttggagtattgcaaactagttcatgtttctgaattctgcaaaaaatgcaattggagattcataagagagtggtattgaaaagagctaagcatccgggtctcctttctggcttgctactgctcctctttttct

SEQ ID NO: 193834 - DNA, 642 bp, Homo sapiens
  misc_feature (627)..(627): n is a, c, g, or t
tcggccatgtggaactggagtaaattaaacctattctctttagaaattacccagtctcaagtatgtctttattagcagcataagaacagactaatatgttgggcatatcttttccattagagttctgcccagaacaaagtacaaattgacatttataccaaccatgacagagatagtaacttcctcaggatttagttactagatgagctacatacccagagtaaagaaaaacaaaacaaaacacacacacacacacacacacacacacacgaaaaacaaagaaaaaaatgcttgagctttttctaacttccccttgcagtctgttgtgtgagcagcctgtttatttctctaatattatgtcagtttattctctttaatggactgtaaaaaaatgtaatcacaagagtgccaaatatcttgaaatgccaaaaggcattttagtttcttttctctgtgctctgagtccacgtacaggaatgcttggagtgtcttttctgttatttatagggattctcttaaggcacaccagctgcctgttttgcatggtatttgcaaaaatgcctcttgcgtgaggaaatcttttaccattttttgtttgcaactttggacctcaagaggtttcccttncctccacacgtcata

SEQ ID NO: 193835 - DNA, 1083 bp, Homo sapiens
ggagaaataattaactgaaaccccaatactttacatacctatggagagtttccaggggtttgtaggaaaagtgttacagtgatggtaataaaggattcttactgtactgtcgttctctttgtaagcagattaaactagcagacaaaatccactgtagttacccatggtacccattcctttactttcagtgaatgaaaggtcagaatgtattgtataagcaatcctcttctcttccaatctctgagagcttgggcagggagcttacccttcttgggtctgtttcctcatatgctgaatgaggctagtaatgttttaatcattgaagagtaggcatgccttctatgaagggcttactttccacaaaagtactgcgcaccccccgccgttataacagtgtggcacttgtattatattgcttcgtcagtgtttttgcctttgaggttgcaagagcaaatgcacctcctctggacacagccttctgcatggtaccattttgaaggagcaccacttgagttggatagggcagtactctgccatgcttctgccctgagcagagtcaccacctgtgtgtaacatatcttggatgatgccacagctagattagcatagaggggtttttcagctgggatctgaaagtgctttagggttatggttgactacagtcatttaaggaagtttagactgggattgtgtagttttgggatgatggagtaattgctgtattggggtaaaccagactaaaaagtcccccaataatttttcagataagacctctggagaaaaatgaagcatgacgagacagggactgctgaaggtggtggggtgggcagaggagctcaggaaagaccccaaaagcttttggggtctttgctctttccttcctttgttgaattcacctggcaaagccctagttaaatccaactccccacctgctggtaattctgcatgtccctagtacatttgtttttccattcccaagacaactatttcacatctttttctctttaaatcttcaacatgccgtgagggcccttatctgtttgcttttccaagacacactacaatagccgtaagactttatat

SEQ ID NO: 193836 - DNA, 249 bp, Homo sapiens
aaagtcctattacggtgtcctttttcggtctgcagtgccattttaaaatattttcctattctcttgaacataccaacaaaacttgtcatttatttaaataaagtaaatacagctgtttttttttgttgttgtttgagatggagtctcgctctgtcgcccaggctggactgcagtggcggatctcggctcactgcaagctctgcctcccgggttcatgccattctcctgggaggcagaggtggcagtgag

SEQ ID NO: 193837 - DNA, 1013 bp, Homo sapiens
cactcatgctagtcttggctctgcccatcagttcggatttctcgtgcgcgcgtgtcggtacacttctaagtgacaattgtatctgaataaaaaatatacaagatggttttacagcagaatgaataaagcagaagaaaagaacagtgaactggtatacaggttaaaaaaaaaattaaccaaatgaaagagtgagaaaaaccctgaaaaactgaaaaagactacagagaatgtcgatgatctatgggacaataccaagtcactaatatatgtgtacctggaatccaaaaaggagaagagagagagaatgaagtaaaaaaaaattaaaaaaatattgaccttaagagcctaggaagtaaaaaaaaaaaagaaaaagaaatgacaaagaaatattgacctcaagatttccaagtttgatgaaaatcctaaatccctgaaattaagaagctcaatgaattccaacaggataaatacaatgaaattcacacacagtcaaacaactaaaaatgaaagataaggagaaacatccaacaagtagtcaaaagaaaaacaataacatatacagtcatccttggtatcctcaggagaactggttccaggatgtggaacccatggatatggagggccggctgtactgagaaacaaaaagactgttgacttctctccagaaacaatgcaagctactagacaatagaagataatatctgaaatgctaaaaacaataaaacaaaaaactatcaacctagaatcctgggcctagaaaaaataatccatatgcatcaaagatgaaggtgaactaagatgagagaatttatttccagcagacctgcattactggaactgttaaagaaaattacttggcagaggagatcacaggaagactgtaaaagtgtgagtgatgaaaaacatttggataaattataatgctgtaacaaagccttgtcttaatttctttgaaagacttttgatttttttgaacagaaacaacattataaggtctaatgcatatagtagta

SEQ ID NO: 193838 - DNA, 956 bp, Homo sapiens
cactcatgctagtcttggctctgcccatcagttcggatttctcgtgcgcgcgtgtcggtacacttctaagtgacaattgtatctgaataaaaaatatacaagatggttttacagcagaatgaataaagcagaagaaaagaacagtgaactggtatacaggttaaaaaaaaaattaaccaaatgaaagagtgagaaaaaccctgaaaaactgaaaaagactacagagaatgtcgatgatctatgggacaataccaagtcactaatatatgtgtacctggaatccaaaaaggagaagagagagagaatgaagtaaaaaaaaattaaaaaaatattgaccttaagagcctaggaagtaaaagaaaatcctaaatccctgaaattaagaagctcaatgaattccaacaggataaatacaatgaaattcacacacagtcaaacaactaaaaatgaaagataaggagaaacatccaacaagtagtcaaaagaaaaacaataacatatacagtcatccttggtatcctcaggagaactggttccaggatgtggaacccatggatatggagggccggctgtactgagaaacaaaaagactgttgacttctctccagaaacaatgcaagctactagacaatagaagataatatctgaaatgctaaaaacaataaaacaaaaaactatcaacctagaatcctgggcctagaaaaaataatccatatgcatcaaagatgaaggtgaactaagatgagagaatttatttccagcagacctgcattactggaactgttaaagaaaattacttggcagaggagatcacaggaagactgtaaaagtgtgagtgatgaaaaacatttggataaattataatgctgtaacaaagccttgtcttaatttctttgaaagacttttgatttttttgaacagaaacaacattataaggtctaatgcatatagtagta

SEQ ID NO: 193839 - DNA, 193 bp, Homo sapiens
tcataggtcgcaggcactcagagtgggtgtcttgtgtcgcttctcgcccaacaacagcaaccctatcatcgtctcattggctgcccagaggtggagtttggactctgctccatgtcattgtcacagaagacccaggcagactgaacctccacctttgggaacttcgctggtccccatgaaacagaaaggagaa

SEQ ID NO: 193840 - DNA, 239 bp, Homo sapiens
ctgtggaaaatctaaaacatgcatgctcttctttttcctggagtgatgaattatttttaaaccttcatgaatagaaatattgctgtgatttaaactccaaattcttttggccacatagttttaacattttgtaggttctaaattggatgtttctcagcaaggtccattgattacctgcactcaaatcatttggattgcttgttaaaacgacaacccctccacctgcaggcaatctctct

SEQ ID NO: 193841 - DNA, 668 bp, Homo sapiens
agcagtgcattcacctggccgccgggctcacatgccttttgaggcagacctaggcctatccaagcaggactcccattccctggggtacgttttgatgtggaactgcagaaggccttgccagaggctgccacgggagacctcaggattcggggtacccaggagtagccagtgatgcctcaggggtaacagaagaacctggaaggctgtaggaaaaatagaagcctgtttcccctgcttcactgaggttgtaaggcaaccccgagaaggcagaaggggaccagcagggcagtgcacacccaggagacagctcttaccttgatgacggggctgaccagccggacactgccctgcttggaccttttttatgcccaccacagggcaaccactgcctccagcatcccccctggagaagctgctgcaaagccgtccccttctatgggagccacagcttgaagctaaaacaagagcccaaagcatcttcaggtgtaagaagaggtctctttctttcttgttctcggcagcccatccttccccagctccttctggacatgaggtttcttgttaccctcttcaagttcctttggctcgcagcattgcctctcctccagacaatatggcctggccagtgtgacctgctcctgtatgccctccagccctccccagccatg

SEQ ID NO: 193842 - DNA, 562 bp, Homo sapiens
tagctctcatccgtcatctcctctgctttccttgggtttgatttgtcattctctttcttacctcatgattattcattcttggccttccttgttttctaacatatacatataaggctataacttttcctcttaagactgctttaactgcagcccacaggtttggatattttgtatcttcattgttgccaatgaacttaatgctgagttggggttggcaagcttttggtgaggctcagacagcctctgcttcatccttaccccaaggttcttctttctctctctctctctctctctctctctttcctttctttctttcttttctttctttcatagttgaggtcttcctcttgttaaaggtgctctttggggccaggtgcggtagctcacatctgcaatcccagcactttgggaggctgaagcaggaagaatcgcttgaacccggcgggaggcagaggttgcattgagccgagatcatgcaatggcgacagagcaaaactccatctccaaaaaaaaaaaggtcaggtaatgattctgtatttgaagaaaaaaaccttttttggac

SEQ ID NO: 193843 - DNA, 340 bp, Homo sapiens
ttttcagctattttgaacaaaagcatcatggtaagaacagggagtttccttcctgtttctcttctcagggtttgtgtcagttataaggagtgataaagtgtcaacaacaacaaaaagacaccaatgcccccttctctacaagctttacactacagcatatgatgtcaccagttcacacagaaaattctgtaagaaattatttttgaaggcacagaacaaaaacaaccacctaaacaatatcaagacaaaacttccttctctacaagctttacactacagcatatgatgtcaccagttcacacagaaaattctgtaagaaattatttttgaaggcacagat

SEQ ID NO: 193844 - DNA, 469 bp, Homo sapiens
gtgggaagtagagtagatgaagaggcagcaaggggagaaactaatattaaccaagcatctgctatattaatatttattgaatacttactatgtgccaggcactgttgtaagcatttcacatgtaccaactcatttaattctctaaacagtcctatgagatatgtatcattatctcagttttatagatgaggaaattaatgcactgagaagttaagtaccttccctaagatggcacagtgtttgatagagctggaattcaaacctgggtttgggttcttaacattaagctctgtaccaagaacttttagactggttcctacagcagagacctcagtttaaaggcttaaaatttcagatccacccagcaaggcatatgttattcccttttacaaattaggaagttgagtttcagagaggttaggttatttgtcgtaggtcccataggtagtaagagagaaagccaggattt

SEQ ID NO: 193845 - DNA, 454 bp, Homo sapiens
tgtgccagtagaaatgccagctgcagccaaaggacaggctttccatccgagaaaagcactcacactcgcatttcttttctggttctgttcctcccctacataaccagaaaaagctcgttaacacatgatggcaaccaggctccaatatctgccagttcccctgtacagattcctctttagcattctctcggcttccctcctcaacaattaattcagatgagcagttgggagagtgcaggatccagttcaaaaggatctgtccccccgtgaaccccaggacagggtgagaggccacctgcacactttttttttgtcagctcacaccctgttggccctttgcaaatatttgtctttcctcatgcacgtggttattcccagaaagatccagtgaattgtctcctgaagataaaatacataaaagggcgtttcaaagtataaacagtgattttaatga

SEQ ID NO: 193846 - DNA, 555 bp, Homo sapiens
ctgaggcctgcgatagtggccctgagacttctgtcatagatttacaggggccacccttcttcctttgggggtggctgaactgctgggatgaaagcctagagctgccgggaccatcaggtcacaatgtgatggaggtggaggaggaggatgggccataaaccaagatagaaaaatacaaagcccagagctgaggaaatctcatacaggcatctccggctacccaaatctatttgatgtataaattgtgtatactgagctgtgatgatactcagatagctacaggcactacgttatctcatgttacttggttcctgagttttggatagcaagtggcaagagttcagaaagcaagggattcatctgaaaaattgatcccagttaattcagaccccaacggcagacagggaaaacttgggtggtttcagtagcaaaggatacctgcaattatcgatgatactgcatgagcccctagatccagccatacctgaagctagttaaccataacctttccaattgcatatatcaataaactccctattctggctgaaattaatt

SEQ ID NO: 193847 - DNA, 406 bp, Homo sapiens
ggctgcacaaatctctagcgcgagctccatcaatgtgtatttgaccttctttattcctctcccgaagagaacttctccagtgtatcttattccccactgcctttaagacactgacatcggttcaacaattgtatgttgacttcccaggtgtatatgacaatgcttaagactattgctaagcacagccttaatgtttggaataacataatgacagcaagattcaactcctagctctaaagaaaaaaagaaaaaagaagattccactcctgacatactcggactgcagttttgtatccaacaactctgaaattagtaggagaagaaaagatacactctctgcccctcaaatatttttatcctttacaaagcagaaatgcagaacacctttgatggaagcgtcgcgcat

SEQ ID NO: 193848 - DNA, 295 bp, Homo sapiens
taaatgcaaaggtcgtcttctcatttatagacatgttctgtctttctcaataacctaaataaagccagttaatactatcaattttaggatctgtatgttatgttttatataattgccctcctcttctccctctccctttccccaaatactctggatttcctggaaagccttttcgctaattcctttaggaccctgagatctgacttttcatcctgccgtttctgacctgccagaaaccaagcactgtatcagtgccccatccactttatggaaagctgctcaacaaaatccaggg

SEQ ID NO: 193849 - DNA, 318 bp, Homo sapiens
caaggtcaaggtcacagatcagcaagaaagattaccaacagaactgatgtaaccagctggcttttgatcaaagctcctagggtttttagtacacttagacactctgcacttacccacatagtatatactctgttttaaaaatgttccccatctttgaagtcaagatcttcatgcacttcttattataaagtatgttttgttaaatatattgcattggatcaagaataagaggagaaaccagtatgtttgtttttttttaatagcgacggggttttaccttcttgccaggcttgtcttgaactcctgaccttgtgatcc

SEQ ID NO: 193850 - DNA, 508 bp, Homo sapiens
cagcacaagaaagtcaatcacgttgagacagagagagcaggagaggaagtgggccccagtagaagtgggcgagagagcgttgggtgggaacgtggcacgagagagagaaattatgagattgacagagagagagagagagagagagagagagagagaaagagaaagagagagagaaagagaaagagacagagaaaagaaactatgttgtttaaaatgccagcggaaagtcccatgggggtgaaagagtccggcaatggccagggagttagcagcttggcgtagtgtcttcccactgttttgtctgtcttgagaatagcattcaacgcgactgtgttcccgcagcagacgttagccgctgcccacgccttgagtgccggacgaggtcaacataggctttccgtcacagaatatgtttgggcaggaagatcggaacacttggggctgggcatctaccgctcccccacggcacacacgagtcgtcagggaaatgcccgcctctgtgtgtgtt

SEQ ID NO: 193851 - DNA, 152 bp, Homo sapiens
gttgccgtggtgatctagaggaccccggtcaaccgctacagtagctttgaggaactctgaataaaggctggagcacagatagtgagagggtacatggcatagtataaggctagagaaatagctatgccaaagatttgagtctggaaggtgat

SEQ ID NO: 193852 - DNA, 366 bp, Homo sapiens
gtgaacttgtatgaggttatgttaaacagtaaaagaaatgttatgcaacacactgggaagggcaagcagttctggggtttgaaactcttcactgtctgcacaaatcagttctttaaaattaagataaaggtctcccatggttctcgaaaaccagactaattagtaaaaacagataaacaaaatcaaaagcaggacatttcatatacattttatattcaaatatttttgggagaaataactacattgattttaaatctcttgactttttcttaacagatatacttcattacattttaaagtactgggcgtgttttctaaagcagaatcaagctatcatctttctacttaaactgatacataaaaatg

SEQ ID NO: 193853 - DNA, 361 bp, Homo sapiens
tgaggatctccatcaccctaaatttattatgggtaagttgtccaggctcaaactgctcttccagcagcatttttcatactggatacgcagtgcaaaggaaatttctttatctcaaaatctatttgcctacttaagttagcaaggcgctttcattaactttcattccttagtattaatctacaatatactgacatgctagaaggcaaatatcaagatacaaatttaacagaattctataaatgccttctaaccaaatatgttcagttaaactcatgcttgtggattaataccagcatttggcaatttctatttgtgtgaagacattttcaaagatgaaatacataaactttttttataaatc

SEQ ID NO: 193854 - DNA, 264 bp, Homo sapiens
ccaaaggagagagaaacagaagagaaaattaggtaattttccttggaaatttagaagacacaggagtagatgggattgaccctggacagaatttttgttttaattggaggcaaggataagggagggtggtacgataatagtaactgaaataaatggtgggaatatgaagcacaggctgggaagatcactggacaggatcaaactgtaagtttctgaatttaagcgcttcggctcgaacacgcctccccacctggccatcagcct

SEQ ID NO: 193855 - DNA, 514 bp, Homo sapiens
agagaagaaatttattctggctttaagaagtttctactatgttttttgggggagatgccacatagtctacttaagtttaattactgtaattacagagaaaaatctgtggaagtataggataccttgaataaatggaatcttcaaggtttgctggcaaaccaacagtttgatttctcagaagtttcttagagaaatgatgccagttttgttttgctccagattctcattgttgcatctgccaatcttgaaaataggaagcaaagattttccttgctctgtcccttgggaaccacttacattcgttttactgtttctaggaaattttctttaaatatatacattagagcccactattgtgttgtggatccatgcagtgggcttgccttagaagtaagtgcctttatgataagctcttttttgtttgtttgtttgtttttgagacggagtctcgctctgtcgcccaggctggagtgcggtggcgcgatcttggctcactgcaacctctgcctcctgg

SEQ ID NO: 193856 - DNA, 436 bp, Homo sapiens
ctatgcacctcaaagacataataattctcatgtattttctgaaaaaccacagaccccaaaattctcccagaaattgaatcaatgtgtattatagaaatgtttataatatttacaagttcatgcagtttattaataagaatctaagacatagataactctccattaaaactactaatgaatgatcagtccatggtacacaaaagcatgaaagattatcagcaggggctatagtgacaaaaaacagcctttttcctttttcattcatgcaaatattaagcggccagtatttgtggcacttaatactttgatactatgaaaaacagaaataagcacaatcattgccttcacatggcttccaatgtaaaaagtgaatgtgttaccaataaaataatctcacaataacaaacgtaaaactaaaactggtggcaagtgttgt

SEQ ID NO: 193857 - DNA, 208 bp, Homo sapiens
tcagggaaaaatggagcaaagattacttgagtaagtaaattaaagaattctgagactagatggtggatggggtgattcaggtagacacagaagtcattcacctgacagctaaacttgaatggaacaatctattagttaattccataatcattgaaaaatgtagagaagtgataacgagactgataaatggagtatcccatgatgagct

SEQ ID NO: 193858 - DNA, 1060 bp, Homo sapiens
ttagttgcttacagcctgtaatgacaatcaagcaaattattttccttttctgaatctatttcttcacctgcaaaatgggcattatgaagcatacctcaaaagataggtgtgtaaaacactagccctgatctggcaaatggtgggacttaaatatcttttccttatccctttttctggttagaagaggaacacataccagagaaggatactccagggcaatagaaatgacttgccagctcacagagcaaggccatttgagggctactagaacagacaatcaacctgaaaagacaccttaagaagtgcagaaacccaggccacatccaagtcccagcctaaatttctccccaccataaaatgtttggcagtccattttggacaaacattacatcactgtagatttagtagattaggaaatggaaacccactcctcagctccccaggaaaaatagctctgtgccaacttctggtactctaggaggccggagcaggacctagtgcaaggaaagtagtgagtccaactgtcaacacattttaattagtccaaccttaaaagactataaccacagagattaaaaggagcccccagggaaagcctctgcccttcacacagttcagccaattagatatgctcaagtgccctaatttttatcactgaattctttggggaatcaggcctcaccaagctctgacttctggctaagagtacaagcatacgctcagctcaggaggagcagttaggtgtcagctataacagaagcagcataagtatgcctggaggccctaacacccttcctgcgtaggtaaactgagctaacagaactgccctcttgccaggctccacccctcactccagaatgcaatccattccccagtggctatactgaacctaatccatactaaaaagctagttttggtcctcagttcagaggtaaacacatggccagacacagtagctcacacctgtaatcctagcactttgggaggccgaggtgcgaggatcgcttcaggccaagagttcaagaacagcctgggcaaatccatctccacaaaaaaaaaa

SEQ ID NO: 193859 - DNA, 616 bp, Homo sapiens
aaaaaaaaaagagaattccatcacatcacctccagtggggggatatccaggaagacaatttcagctcactataaagaactccctaacagttggagctacccaagaatggaatggaccaccttgggagtgatgaactccttgtcaatatatgtattcaaggaaagattaagtcttcattgggaaattgaactaggatcctggtgacctctcaagttgaaaaaatgggcaagttctattaggaagggaaagacaagatcaaagctgtgcttccagacaattatgtgactgtatgtgtagaagaaatgggtggggagggatcagaggcaggcaggaccagtaggaaaccactgcagtggtccaggagataaaagaatagactggggctgggcacggtgattcatgcctgtaatcccagcactttgggaggccgaggagggtggatcacaaggtcaggagttcaagaccagcctggcaaacatggtgatctgcctgcctcagcctcccaaagtgctgagattacagccgtgagccaccctgcccggcaccctaaagatttttactatgtctttttgtagcaacttagggaggagggcaagatcagtgttgttgccacttt

SEQ ID NO: 193860 - DNA, 366 bp, Homo sapiens
ttactcattttggtatcccttgcagtatatgcctcatactgtatgcccagattcaaatcctggctcctacccttactgtgtaaccttgaggaagttacagaagccctctgggccttactttgctcatctgtaaagtggagataacaataagacctgcgttacaggatttctgtgaatgttaaataaaatagcgcatgtgaagctcttaggatggtgctggacacatagtaaaccctaactaaatatcagctacgttatttggaatcataaacacctacacctggaacacaagtttctggatcaactaggaattgggtccccgtaggatttactggatgagtcagcttgaggaggcctgttgtgaga

SEQ ID NO: 193861 - DNA, 667 bp, Homo sapiens
gaaaagtggatggagagactctagcttagagagaagagaggtcaatgagactttttgttttttgcttgtttaaaaatagaaaatatgtaaataaagagatccagttaaagagtgaaaaaaaaaagatgtcctaaaaggctgatgtaactttattatcagtacatgacttttaaaactattatagctattaaaataaacaatgagaacatcttctaaaaaaatatgcagcattgagtcttttaacagtctgggtcagttatcttgcagaatgtttccaactttgttttgtcaaattcctctcttacagtgtcatttccttgttcttctctatgttttttataaactaaaacttggaactaaagactggattcaatgcaagttgaaatattttagtaagtacacttgacaggtgagaaaatgtacttcacgttgcaacacaccagccagcgcattctaccagtgggtcccactagcagtgatgttgagtttggctactttcttaaggttgtgattactagatctctttgttataaaaaacaatttccctttgactttggcaaataatatttgggataggaggcaatactttaacataggagaattatttggttcccttcaaaaccaattcacctaatacgttttaccaatagtttcatcatctattgat

SEQ ID NO: 193862 - DNA, 289 bp, Homo sapiens
aatgaacagtgtctgtttatccaagatgaatctactctagataagaatgtatcaacctcagaccacattgtgtctgcaaatatttttctccgtttcccgattgtttaatggacaaagcgggtttgggggagctggggagagttgggcagttctcactgagcaccagtccttgttcttgagcctgtagtttttgtctccacggctgcagagactggccagggtctcatctgccatccaccttcagaatggtggaaacagttgaaaagaacattgcagtgaagcttgggct

SEQ ID NO: 193863 - DNA, 229 bp, Homo sapiens
cttcagtgagtttcaaaaatagcttgccttttaagaacaattacaaaggagtcgtgcaaaggcagagtgacttggcttcagcaagcctcaatttcttgatctgtaaaatagggattttaccctacctcaaaggttgtagtgaagaccaaaagcaagaatttatataaaagtactttgtatcatgctttttcagttataaccttttattctcagggaagtcagcaaatgc

SEQ ID NO: 193864 - DNA, 480 bp, Homo sapiens
gttcaatggcaaatgcaagatcaacgttggagcagtttcaggacactggtgatgttgagctacatagcacgttgctaccttgggaaaggcagaaagagtacgtctttgtggctcttatacagcagctgcttatttagtttttccgagacaggatttttaattagctgtctatggttattctcttttttgtttttcctcaatttatagagggctctagatcacctactagtctaacccctcggcctcccaaagtgctgggattataggtgtgagccactgtgcccagcgaccccatctcttaaaaaaaaaaaaaagagagagagagagagaataggggtataattgtttcaagggaaaagcacttgatatattgggcaggtacaagtagggcataataaccagtgtcatcaacttccaaagctcttgaagagtctcagtgggcttcctcctgactaacccttctcatatttgcctaaatga

SEQ ID NO: 193865 - DNA, 483 bp, Homo sapiens
tttctcctctgtgagtctacagaaacctagagttccgtaagatgtcactaagggcttcatgagatattgtaactgaaaaaaattagcatttttgaacttcatacagaacatgatattagcatttagagtgacagacaatggccaagcagccctgttagcaatgtcaacagtggtctctcagccctgaatggctgtgtgcaggaccacgttcctttgataaagttcattctcaatcaggagttggtagatggtgagagtattgcagggaggagaggatggtgggctgatggcattagcttctccctccagaaacatcttccccaacacctctttatatgctaatgactgatttatagcaacaaacaagctctagctctgaaataggaatcttggaatttttcattctactgagagaatatttatacctcatgagctgactccctggctctgctattgttaacacttaaaaatacacattgggta

SEQ ID NO: 193866 - DNA, 179 bp, Homo sapiens
ctgcttccgagagctctcttaagataaaaagcagaattttaacccagccctacgtggtcttagacattttggccattctcatttcccagcctcacctagcccttggtttcatgtcatcttcgctttcttctatattccctcctgagacacagcctttgcacatgctgccccctctgcca

SEQ ID NO: 193867 - DNA, 407 bp, Homo sapiens
ccaccaccagcaaacaaggggcagcgtggaggagtggacacaatgtctgagggagcttaccagcgcctctgggagtcctcccacgcgaccctgcaggagctgctggaccaagagcagcttctgctcgaacctgcgcccgaccgggagcggcagtccttccagtacaggctcgcatcgctctacctgcactacctggggctgctgcgccgcttcgacaccgtctatgaccagatggtgcagccgcagaagcggcggctgctgcgacgcctgctggacggcgtggcgggccgcgtgctggagctcaaggacgagctggtgcgcgccgacctgtgtgagaaccactgcctggaccgcgtgctgcaggatttcaagctcaccccagtacgtgtgcgcagccgcgaagccac

SEQ ID NO: 193868 - DNA, 289 bp, Homo sapiens
taggaagggctggcaggatgaatgaaaatcaggcaaaagctcaaggatgttgtctaaacattttgttcttatgggaccagaacagttgatgtagttttgaaatttgtccccacccaaatctcatggaaatataatccccagtgttgtaggtggggcctggtggggtattggggttatggggcggatccctcatggcttggtgctgtcctctccatagtgagttcttacagatcaggttgttgtaaagtgtggcacctccttcccacactcactctcttgctcactctgt

SEQ ID NO: 193869 - DNA, 339 bp, Homo sapiens
cttgaaggatgctcaggagtcacatgaggtggacttggaccagggaggcctgcccaccacaaagagaaggcagctcataggcaggcagaaccttgctgggattctcgtgactgcagtagagtacatcctgctctcttactctcaatgatcttccacccatacacacatactagtgctatgagagtggcaaggagatgcaaacccaactgcttgtcctctacatgcaaacatcagatgcttgtaatccaaactcaaatttatttgttcctgcaacatcatgttgccacctttgatatcaactctaactactgatgcagtagcttcagacctcatctctct

SEQ ID NO: 193870 - DNA, 433 bp, Homo sapiens
ctgcttccatggctacctctagaatctgttctcacagcagccagaggaattatcttaaaacatcaatcggtcacatccctcccctgctcaaaatattctcatgcagacaaaggccaaagtgctcaccatggcccagaaagcctttcccgatcctgttcccactcccctccacacccgccctctctccccttcactcccacagcttcagccacactgaccttctccctctcgctcgaacacatgtcaagcatgccgcaacctcaggacctctgaatgcacctccctgtgccaggacccctttcctccaaaatccacagggcttgctccactcagatatgacttcctccacgaggcctactgagtaccctctccatcctagtccctctcccgaccatttcctccttatttttcttcacagaaccagtcaggtcct

SEQ ID NO: 193871 - DNA, 340 bp, Homo sapiens
tcctctgttgactgctgaggatgggcctggggccctgagaacaaaggaagggaactagttaatatgaagtgggacagggagttcaatcttcatgatcacttggataatgaagaaaggctaactagcagggataatgacagctggactttctcaagggctctttctccagcttagtcattgcctgaagtgtaactgcccgatgggttctttctgcccgctacacagacaaagtcaattgactgaaaccatggcattgcagtaaaggaagagtttaattgctgcgaggccagccacgccctaagggagagggagttaccactcaaattaatctcccggaaag

SEQ ID NO: 193872 - DNA, 279 bp, Homo sapiens
taatgggtgcttttctccaagtcaagattatgactttggttataaatccctctggtttgagaaagtagtgatttcctaatacttggaagatagtttttataataattagttgtatatttataatgtaaaacaaagagctcaactgcttatgactaatctgagcaggcagtgttgtgtactgctgctatgacaactaataatttcggtctgacattgacaggtaacttgttagaccataggagcttgcatactcacaattgttctatatttgcctaaatg

SEQ ID NO: 193873 - DNA, 923 bp, Homo sapiens
gtgggtggatcacccgaggtcaggagttcgagaccagcccggccaacatggcaaaaccctgtctctccgaaaaaaatacataaatcagccaggtgtggtggtgtgcacccgtaatcccagctactcgggaggctgagggggaagggaggggaggggaggggagagaaggggaagggaagggaaggagaagggaaagggaagggaagaaaattagagattaattcaggagattcaacatccgcctaatagaaattctagaaagaggaagtagagaatagagaggccaggtgcagtggctcacacctataatctcagcactttgggaggctgaagtaggaggattgcttgaggccaggagtttgaggctgcagtgagctatgattgagccactgtactccagcctggaaaacaaagcaagacctcgtctctaaaagtaataatatgccgggacagtggctccccacactttgggaggctaaggtgggcggatcacttgaggtcaggctttcgagaccagcctggccaacatgatgaaacccaatctccactaaaaataaaaaaattagccaggtgtggtgctgcacacctgtaaccccagctacctgggaggagacaggagaatcgcttgaacccgggagatggaggttgcatgaggtgagatcgcctcattgcactccagcctgggtgatagaatgagactctgtctcaaaataataataataataataaagttaaatataaataaataaaagcaaatgaatataatgagttttattcatttgttttgctgttgttattgttttggagacagagttttgttcttgtcgcccaggctggagtacaatgatgcgatctggtctcactgcaaccttcgcttcctgggttcaagcgattctcctgccttagtctcctgagtagctggg

SEQ ID NO: 193874 - DNA, 199 bp, Homo sapiens
agagtctatattttatagaggccctccatatatatataagagcttttctgacagtatatccattaaatttcaaagataggtaaaggaacaattttgcttttattttttattattgttattattttttaaggctagtcaagtgaagctgtgggagtggagaaggaactgctttaatttttatgtgttggtgttacaggct

SEQ ID NO: 193875 - DNA, 365 bp, Homo sapiens
ttcatagaaaatgacagtgacctattttgtccctgtctaccataatgccttatggttttctgaagaagagttggatttgttagagattatagtgccttttgaggacatgtacctagaaagtgtgttctagaatggacagcattctgatctaatacaatgagcacactgactttggagtctgattaacccaagaatgagtcaaaagttactaagcttttaaaatccgtttccacatctgtaaagcatggattataaataatgacttcctcaaagggttggtatcataactaaattatacggtttctaccatataatatgcactcaggaggtgtttcttccttctgcctccacatgttttctactgt

SEQ ID NO: 193876 - DNA, 422 bp, Homo sapiens
tgtcgccatattgcactatttgtagttcctgaacaagtgctgttctcttgcacctgtgtgactctgcacattctgctctcctgctttagaaagcaggtcttcctttttccacttgactaataccctctgagaagaagcctatatacatatatttctgtctcccactgtagacttaagttctacatgccagggactacatttaaaaacccacaatatagtgctggcacagagtagatgtcagtaaacgtcaggacacttgtttagccatctactagatgtgcttattcttttgttcttgcttggtttcttcagtggggctcctcaatgactcttccatgtcaccgaagccttatagtgttccagccagaccttgaggcaatgatctgcatctggggtggtcggggggctagagaactaggccc

SEQ ID NO: 193877 - DNA, 197 bp, Homo sapiens
gtcgaagcggtgtcctgtgtggtcaggacacttgtttagccatctactagatgtgcttattcttttgttcttgcttggtttcttcagtggggctcctcaatgactcttccatgtcaccgaagccttatagtgttccagccagaccttgaggcaatgatctgcatctggggtggtcggggggctagagaactaggccc

SEQ ID NO: 193878 - DNA, 616 bp, Homo sapiens
acttttaggaatccaacaatcatatacaactatgtttttgattctgctttgagagagaagagcaggaaatcatgaaacattacatatatttctgttgctacttgtcccagaagtcaaaacacaaattcttgaggcttataagacccttctattgttaggaagtttactcataaagttttatagttgccataaagagtagcatatgccgccgggcacagtggctcacacctgtaattgcagcactttgggagtctgaggtgggtggatcacctgaggtcaggagttcaagaccagcctgaccaacacggtgaaatcccgtctgtactacaaatacaaaaaattagccgtaaaccataatggaagcatcaggtaaaccatagtggaagcatcaggtaaaccatagtggaagcatcaggtaaaccatagtggaagcatcaggtaaaccatagtggaagcatcaggtaaatcatagtggaagcatcaggcaaatcatagtggaagcatcaggtaaaccatagtggaagcatcgcatggactttttttggacaaaggatgaaatttaaaatttcatgtacatttatcattcggttagaaaataatttcttttaaaatggat

SEQ ID NO: 193879 - DNA, 480 bp, Homo sapiens
agcatctggtgaaccatactgggagcatcaagtaaatcatagtgggagcctcagggaaaccacagtgaagctcaggtaaaccataggggagcatcaggtaaaccatagtggaagcatcaggtagaccatggtgaagcatcaggtaaaccatggtgaagcatcagataaatcatggtggaagcatcaggtaaaccatagtggaagcatcaggtaaaccataatggaagcatcaggtaaaccatagtggaagcatcaggtaaaccatagtggaagcatcaggtaaaccatagtggaagcatcaggtaaaccatagtggaagcatcaggtaaatcatagtggaagcatcaggcaaatcatagtggaagcatcaggtaaaccatagtggaagcatcgcatggactttttttggacaaaggatgaaatttaaaatttcatgtacatttatcattcggttagaaaataatttcttttaaaatggat

SEQ ID NO: 193880 - DNA, 464 bp, Homo sapiens
ggaggcaccaactgcgagacccccagggccacatgcttagaccagtgttcaggccacggaaccttcctcccggacaccgggctttgcagctgtgacccaagctggactggacacgactgttctatcgagatctgtgctgccgactgtggtggccatggcgtgtgcgtagggggcacctgccgctgcgaggatggctggatgggggcagcctgcgaccagcgggcctgccacccgcgctgtgccgagcatgggacctgccgcgacggcaagtgcgagtgcagccctggctggaatggcgaacactgcaccatcgagggttgccctgggttgtgcaatggcaacggcagatgtaccttagacctgaatggttggcactgcgtctgccagctgggctggagaggagctggctgtgacacttccatggagactgcctgcggtgacagcaaagacaatgatggaggtag

SEQ ID NO: 193881 - DNA, 573 bp, Homo sapiens
gcaaaagcaagtatagttttcattttccttattgtccgagtcgtccctattttagtttacatatccctagatccttcaaccttgggaaggcaatagggaatgctggagagagagagtttgtggactgcattcgtttccggggttgccataaaaccacaaacttagtggtttcaagaaacagaaatgtattctctcacagttctggaggctaggagtctggaatcaaggtgttcacagggtggcgctccctcaggagactctgggggagaatctgttctttgtctcttccagcctttggtggcattccttgacttgtggctacatcactccagtttctgcctccatggtctcattgtctcctctccgtgtaatctctatctgcttcacccttaaaaggacacttgtcactggatttagaacccacctagatatttcaggatgatctcaagatccttagttacatctctaaggacgctttcttcaagtgaggtagtattcacaggtgccaatggtaagcatgtgaacatatctttttgggagccacagtccaacccactataggagctctgggct

SEQ ID NO: 193882 - DNA, 649 bp, Homo sapiens
gaatcatcctgataggaaaacctggcagagacacaacaaataaagaaaatttcaggccaatagcccttataaacattgatgtgaaaatcctcaataaaagactggcaaaatgaatccagcagcacatacaaaagcttatccaccatgtgcaatactttttttaaaggcatgcttcaataaagaaacacttctatttagtcaggagactatctctttgagtctaacatagattacagccttgacatgaataagattcttcttttatgtagtcaataaatgtttacttacagcctattttatgctgggtagtattatgggaactggagagagaaggtctgtctttatggagcttgcagtatagtgacagagatagaacataaatgcacaaacagttgcacactaaagtgatggatgtactaagcgctatgaagaaatataatagccaagtgtggtggtgctcacctgtggtcccagctacttgggaggctgagacaggcggtctgtttgagccccagagtttgaggctgcagtgatccatgattgtgccactgcaccccagccttggtgacagagtgagaccctgtctaaataaaacaaagatgatgcagctaagactaacagacagcaccgactaaaaaaacaagaggag

SEQ ID NO: 193883 - DNA, 581 bp, Homo sapiens
ctctatcatctgttcctcccctaatagcccatcggcacaaacatcctccctcagagttccttccccccgaaatcctgcttcctgctgtccctgctcctccagaacttggacctcctggggatgcaagagcccttgactttcctgcagctcctcagatggcagctcttccccctgcctgatagtcccactttcagcgccttcattctggttggtctctgcaggatgctcttcgcagggagaataatatctggtctgaccagagttatctgaagaggtttcctcttcttcttctgcctgtccagatcccaatgtcaaagaagtaagtcctggccaaaattccacctcctcttcttcgcctcccaggtcactggaaaatggggccatgtctagatgctcactctgaatggggcaggcccagagctctgggggagctagagtccttgcttgtcggcctgctaggctctggggtactgcctcccagtgttccggagtgtcacaggcctcagccacaaggctttcctgattgggctccacatctgcagaaccttccttgggaaaagagggcatcgtctcaatcgcat

SEQ ID NO: 193884 - DNA, 399 bp, Homo sapiens
ctagtcatgacatatctagctccatctcgagacctcatgtcttactgctgacactacatcctcgctggtactttttcttccttggcttcaggggcattgctgtgtaggctcagatccatgccagatggggtgtgtagggggaaaagctgcataagggaggaatgtcacttggcaacactcaacaagggggaatgggcctgcagtattctcccagagatgaatgagcagcccattctaggaaatatccctttgaaggaatatcttctctatggtacatccaaacttttctctggaaaacatgcctcttcattctgatgactttctatttattctcttcatcttaccatggttttacaaaagaggaattttaacatactcattcagcagagttaaggacct

SEQ ID NO: 193885 - DNA, 492 bp, Homo sapiens
tgctgaataattgtcaggcagccatgagaccacagtaagctcccatactatctagaggtcaatttatcatccaagatggcctgctttgcagattgctgcatgcataccctctgcagcaccaggtagcaggcagcaggagaggtagccccacaataacacagcatgtgtccctagagcatcttcttattgaaatgggagatttaaaaccttttaaagaaaactaatggtcctgtttgctgtctaaggataaagacgagtacattttaatggtgaaataaagaaacttcaaataaatttttcacttgaagctggccttctgagtccctctctcaaacctgcccccatctcacagtttcccactcccctgctgctcaggatacttcagtgggaaagtttaaacaaaacacactaagacagtgttttccaaacagtgggtcatgacccattagtggactgtgaaaataaatttagtagatcacaaccaacattaaa

SEQ ID NO: 193886 - DNA, 570 bp, Homo sapiens
acctcctaccccacggaggcttgaaaggtctttttttagcttcctgccccaggcttggcctataagcacctagaggtgagtggtgaactttgaggccaggagattctagtctgcattcaaacaatttgctacagcagcaaatactgtcactaaattgaaaaagtgccatactgttctcctaactcaagggacagatcaagctggagcgctgagtcagaattcagaattcaaaaaggtcagagctcaaaattaaacagggcaaagagaaagcagggaactggggtgaggggtagacaggaagagaagacagtcatcggagatcccagaaaaacttgctatagcaaaaccattttaggggaactccattgtacccatcttgttaatgtaatcaccacagagccagttctctggaagtctgtgctctctgggtggagtcatccttctaagacagccaagtccagtgggagaccactaacttgggaattaggaaatccaagttctcctttcaatactgttaccaactatatgtgacctcgaacaagctgcctaacccctctggctatgaatacg

SEQ ID NO: 193887 - DNA, 444 bp, Homo sapiens
ttcattgcctcaaaaagaaaccctgtaccctttagctatcgcctccccaccccaacctcttcatccccatctctcagccttaagaaatcaaaatctactttctgcctcttagatttccctattctggatatttcatgtgaatggaatttataatctgtggtctttcgtttatggcttctttcacttagcatgttttcagggtttacccatgttgtagcacgtgtcagtactttattccttgttatggccaaatactatttcaccgtatagatattccacaatttgtttctgcttacaccagctgatggacatttgggatgtttccaacttttggattttatgaataatgcctctatgcatatccatatacaaggtttttttttcttttttcgtgtcagatgggtaatgtgccaatgtcataacaaggttcgagggtggctcacc

SEQ ID NO: 193888 - DNA, 522 bp, Homo sapiens
tttttaatcagcacttaaatgtcattcactaccttctggccttcatggtttctgctgagaagccagatgttaatctgattgagattccttgtatgcaatgaatcgtatgtctcttggtgctttcaagagtctgtcttcgtctttgtctcccaacagttgtatgattatagtgtgtcttggtgtggaacctctttacatttatttttcttagagtcagttcagcttcttggatgtgtagattcacattgttcttcaaatttggaaagttttcagccattatattttcaaatattctttctgccccttttccttttctcctgaaactcccattatgtgcatattggtatatttgaaggtgtctcacatgtttcttagactctgttcatttctattcaccctttttttctgctcctgaaagtgtatttttttccttttctttttctttttttgtagagatagggttttgctatattgtccatgctggttttgaactcttggcttcaagtgattctctcaccccaa

SEQ ID NO: 193889 - DNA, 623 bp, Homo sapiens
ccacctccagcatcggtcattacaattcaacatgatatttgagcagggtcaaatatccgaactatatcaccaaagttttccaaagcagtttgaggccctagaaaatgctctctgcagtaatgctgcactacgttgacattctggtgtcaaaccccctgtcttcttagacatctttgctctgtgttatcttccagccccacgcaccccccaacctttttgttttgttttgttttagagacagagtctctctctcttgcccaggctggcgtatcgtggtgccatctctgctcacggcaacctatgcctcccgggttcaagcaagactcctgcttcaggctctggagtaactgggattacaggcatgcgccaccatgcccagctaatttttgtatttttagtagagacagggtttcaccgtgttggccaggctggtctcgaactcctgacctcaagtgatcttcctgtctcggcctcccaaagtgctgggattacaggcgtgaggcaccacaccaggcctttccaagtcctttcaaggcttcattcatactttctttgcttgtacccctacccacagttaccccaggcataaggggggggccgagccgaatcgtatcaggctagtg

SEQ ID NO: 193890 - DNA, 400 bp, Homo sapiens
tattgctagcgtaggccgcagggcattgagaaacgtataccgctgcactgctggcccagctaaccaagggtctccttcacttctttgtcattaatagcctgagtaactaactccactttagttccctcaactgtgaaatggcaagtgatgctagattatctctaatgatctttgctaaaattttatgatccagatatccttatctgattctttctcagaatcactttaacagtttaataaaaacggcctgacatcaagagtttttttttttttaaagaaaagatactcaagcattgattataaatttcaacttgacccttaagtttttgcaaatctttcctactcttcctttaggatccagcccaccatcccatccagaaccacagtgccctttggaaga

SEQ ID NO: 193891 - DNA, 410 bp, Homo sapiens
gctctgttcttaacaccatgtcctcctgcattgtcccacctgttatcctcccaccaacataaatgctcagtgatctcctaaacagagcataaacccagatcttaaatccctagacactgaagctactaccctcctctttttccatcaaaagctaatttcttccacactctttacctccacttcttatactcagctcactgtaccctgatttctgaccaaaccaactctaccaaaacagctctcttaataatcaccaatggctttcctaattactaaacctacacaccccaattcttaatgttatttcatttctctgacaaactgtagaccttttacttttgttttcaacggtatgtgtgatctagaatccgtctgtatgatttctctttctctgcttctcactggctcat

SEQ ID NO: 193892 - DNA, 386 bp, Homo sapiens
ggaccgctctagagtatccccgtatcttagaaggatctcagggtgagaggttggggtgggtatttatagagtttctaggtatgaactcaaatggtttacatcttaggtctttcaatacgaggtctgattgtggttgggtataaatttatcatagaagattttaggattgggagaaagtgaggcaacggtcctgatgtaggtgttgattagtaaacagttggtaagtgaaattttttcctgagtaacttattgttctgaaaatgagactgtttgtctaaataagcagtttattattcaaatacattggtgttcctgaagcaaacagtgaagttatttgttctttgcaatcttatcttcgtggggtaggaggtcgggaaccgagctcg

SEQ ID NO: 193893 - DNA, 301 bp, Homo sapiens
agacacacagactgaatgataaaaggtggagaaaaggtattctatggaaatggtaacccaaagggagcagggatggctgtgtttatatcagacaaaatagacttaagtaataaactgccacaagaaacaaagatggacattatataatcataaaagcgttaaattgccagggagataaaacaattacaaagcatatacatctgtcatcagagtacctaaatatataaaggaaatattgacataactgaagagagaaacagcaatacaataatattagaatacttcaatacccctcctttca

SEQ ID NO: 193894 - DNA, 619 bp, Homo sapiens
agtaggtgggcaactctgtcattttgatggagcccttgttgggggaggcctgtgaagggggatcccagggcctgagcctctctgcaggacacaaaggaagctgacactggatctgtcccgtcacctgaactcaccagtaatttattgatgctggatgctggcacccagcagcctgctgggtcagtctcagggagcaggtgtagggccctcgggcctaccccagcctcacccaggcagggaggggaggggagcctgggtctgcccagcccaggaaaattgataggtcagcccttacaagtcagtccccttctgtgtgccaggcagtgcaggcagaaaaaaaaacaagtgtggttcctgcctggcctgagctcatagagggttgaagtggacatatttcaaataaccaaaatggtgagagctgcatgagggcctactatgtgccaagaacttcgtacctataaccacatttaagcctcatacagggcttaaatgtgctgaggtcgcacagctagtggtggggcaagaggagggtttgcacccagatttgcctggctctaaagccagggcacattactgccatcccgccccactcaggctggctgggccaatgggcattaaa

SEQ ID NO: 193895 - DNA, 736 bp, Homo sapiens
acaccgtattgtgcaaactataggagatgatgacctaacaatacagaatgtagagagggcttttgacaacagaaaatcataagagagtatcatttaatggagagtgaaaaaaaatgatcctggattctttttccccctttatttgttgtatcactttgtaaaacctctctatgccttgctctcttcatcagaaaaatgagacctatggttttatttttacaaagtgctttaggatttaggagaacccagaatgtattatatgatgaaagccaccatggtgcatgtcacatgactatggcagaaaaggaaccaaaagcaaaacatgaatcagcaatgaacactcattttgtttgtttaaaaccccaggatgtgcaaatatatgtcagagctgaagttgaccctcttcctttacaatcacatattactctatcagattctggttttgaaacctgagtttggtagaaagaatatggatgcaggaaggagtaaaggacaggagtaagagggtttctctcaagcaaaccccaagtcactaggggtgtcaccaacagcttcactaacaatcccctaaaggaccagagacagagggcattattagccttgcttcttcgccttcctcaagcattcctttattcccccaaaggattatacattgacagggcaaatcaacaaagcagaagctgtctcctccaactgtccaaagttatatgggtttttagaaccataggagagtcag

SEQ ID NO: 193896 - DNA, 1178 bp, Homo sapiens
tagatttactttgcctaatcccctcttagtgcatgtggggaaactgaggtacacaaaaggaattccccaccaagttaggggcagaacctagcccccttgtctcccagatggatatcttcttttttttttgagacggagtcttgctctgttgcccaggctggagtgcagtggtaccatcttggctcactgcaacctctgcttcccaggttcaagcgattctcctgcctcagcctcctgagtgtctgcgattacaggtgcacacaaccacgcctggctaatttttgtatttttagtagagacggggtttcaccgtgttggtcagggtgacctcaaactcctgacctcatgatccacccagctcagcctcccaacgtgctgggattacaggcatgagccaccgtgcctggctggacatcttgttattaaagcttcttctctctttgtaggggagggggagatgcctctggtggagaagaccagtgtggcagtgactgtgtctgttagtgaacctggtggctggttgagggtctgtcgtggtgactgaggacacatacaaagtgcttttctcagtggtcaccttggtgttggtgaataagggtcagaagatggctcctgtcctagggcactgccagtcggtttggaagctgaaatgcctgcttagcagtttgaggaaacacagaccttggaggatcttctggttgcctcttcaagaattcattctattccccttctgctccccaaatttgcttttcttggggtgggtcttggttggcctaagccaagaaagtatggcatctactccttccatagcaatagctcaggaataggcagtgacccagacctgaaccaatcagtgcatggaattacccctggccaaagtggttgattgaggctgggtgcaagcagagttgtgagaaggctcccatttggtggttggagagatcgcacttgctccagaggtcataatgtgcagatctgaggcttggaactgctgcagacattttgctaccacaagtgaagccaccctgacgacacagttgacaatttggagcagggcagagctgagagaacagcagggaaacagccagagtcttgctcaagcctccctgaagtatctatacccctggactctagttatgggggctaataaatgttatatactgtttaaggtagtttga

SEQ ID NO: 193897 - DNA, 276 bp, Homo sapiens
tgaatattgctaagatggcagtactccccaaattgatctacagattcaatgcaattcctatcaaaattccatctccctctttgtagaaatggacaactggtcctaaaattcatatggaaacttaagggaccccaaataacgaacaaatgttggaaaagaagaacaaagttcatggattcacacttcgacttcaagatttactacataatcaagacagtgtggtacagtctgtcataggacagacatatagaccagtggaataaaattgagtccaga

SEQ ID NO: 193898 - DNA, 453 bp, Homo sapiens
tgcatcgctcatgctgggagctgtagaccagagctgttcctattcggccatcttggctgccctccgacaaaatcagttctttacactactttacttctttaatcttatgcttacctaaccaccatacttatgagacttaagaaacgctttggggccaggcttggtggctcacgcgcccagcacttcgggaggccaaggtgggtggatcacttgagggcaggagtttgaaaccagcctggccaacatggcaaaaccctgtctctgctaaaaatacaaaaattagtaaaaatacaaaaattagggcatggtggtgaatacctgtaatcccagctactcaggaggctgaggcaggagaataacttgaacctgggaggtggaggttgcagtgagttaagatcacaccactgcactccagcctgggcgacagagtgagactctgtctcaaaaaaaaaa

SEQ ID NO: 193899 - DNA, 286 bp, Homo sapiens
ttggatgcccaatgatgggagaggcaccccttggagaaatcaagaaagacgctgcattttagctcagccctatggatcagaaggataaagagaggtgaaagagtgtcccaggcaagggcaaaggcaggagctgaggaaggatggatggagcatgttctgaaaaaggaaagtgtcccggtaggctagaagaaagtgaaaattagacgagggagtttgaagtgtattcagcaggcaccagtgagcaacagaaggttttgtgtttcagcaatgatgggagataagtaga

SEQ ID NO: 193900 - DNA, 426 bp, Homo sapiens
ctggacgtatgagggggttacatctagataaacttactttgaattgaaaatactttaagtcaaaaatgcactttcaacttaacattattttcaacttaggatgggcgtgttgggatgtagccccatcataagtcgcagaccatctgtatataaaatgttagtgataatacctacctagtgggaaagttacgattaataatatatataaaatgtctgacagtgtgtttaacatattgtagatatttttaaatctttactttataaatatatatccttcggtctttttttatttgcttaaatcaagttgcttataaagatttgttgaaaaagaggcagagagaggagtagtgggaacaacactgtaccaggtagcataagactagatttcagtcttaactcttccactaacttcataattcctgtggg

SEQ ID NO: 193901 - DNA, 485 bp, Homo sapiens
cgagctcggtaccctcgtcttttgataggacccagatccagcattgaagagagaaacacaagctattcttcctatgcagtttcattcctttgacaggagtgttgtggtgcctgtaaagaaaccacctccaggtagtttagctgtaaccactgtgggagccactactgctggaagtgggctgccaacaggcagtacctctaatatatttgctgctactggagctacaccaaaaagtatgattaatacaacaggtgccgtggattcagggtcctcctcctcttcctcctcttctagttttgtgaatggtgctactagcaaaaaccttccagctgtacaaactgttgctccaatgccagaagattcagctgaaaatatgagcatcactgcaaaacttgaaagagcgttagaaaaagttgctcctcttcttcgtgaaatttttgtagactttgccccattcctatcaaaagacgagggtaccgagctcg

SEQ ID NO: 193902 - DNA, 398 bp, Homo sapiens
gccccgccagaaacatacgattattgtcaaaggggtccccttcccaatttcctttttatgaggggtacaggggtagggtggttcatggcaccattatttatctggacctcagtttttaggatcaaatttaacctttccctctcccctcattttctctctccctctcttgtgtaagtcagccatctaggcttgtgaattcttctagttagcttgagctcacagttgtcttgaagcaattccttgggcatccaggtacagttctctttcagcacaggtctctccaaacaggtctatttgtctccctccccacgtttctcagtgggcccttcagaaagaaagctgcagctctactggggaggcaagagcttgtcattgaggaggcttgggccagaggcagg

SEQ ID NO: 193903 - DNA, 140 bp, Homo sapiens
agctcaatttgactgctttttataacaggccaattttgtaacaggggaagatagtagggaatatatttgaattttgtttgactttcccatttggcccccaaccagaccactcctctgtcctcacatagggcagctgtgga

SEQ ID NO: 193904 - DNA, 347 bp, Homo sapiens
tccataaccatactgccaactacttgctagaaatcttcagacctatgactcggtgcacctctactcaagtacaaaacagttcatcatcttcagtaccaatcacccgcccaacacagacacacacagagacatgcacacacaacctctgcctcctcctgtcttctctattaacggagttcagcacacttcaaatatttccaatgtctaaagcaccatgttaggcatatgaagacaagacagtatacaaagatgaacaagtccccttgacttccctgtcaagatgagttatgctcctctcttctcctcccacctctccatagcatactgtatttagctctatcactaaa

SEQ ID NO: 193905 - DNA, 323 bp, Homo sapiens
gtctctgagttttaatacacattttgaaagaagtgccaaaatcctaggggtttcaataaaagagaaggtaaaacttggctgttcaccacaagaaaacagattctaagcataaggtgactgctcaaattcaaggcgaaactttaaccattaatttgtcgttgtttttgtttttaataagatgcgctgtttcctttttgtcttcattctttaaatgctttatggtcaatttgatttgtaaattcatttgctctaaagaagcaagaacaataaaagctctctgtgcagtttgccagtcctcactgctacgtggcgagttccccttg

SEQ ID NO: 193906 - DNA, 495 bp, Homo sapiens
ccattcaacaaagctgcacatggaacccccaaggagtgtggtcccctgaccagggcctgggctgtgcaggcgggtgattcacacagccctgtctgccccacgatccctgctgtttccattccttccttcttcagtgcaaaggtaaaaggagtagcagtgtatttacagccaagcatttaggggaaaggaacagcctgcactcaggccaccttcagctcattcctgggtttgctttggaacatatttttccgtgtcttttctgtgtgtttctcacacccgggcagggtttgctggtctggcctggtctgttttgttcaggtctggtctggtctagttttggtctggtctggtctggtctagttttggtctggcctggtctggtctggtttggttttggtttggtctggtttggtctggtctggtctggctttggtctgatttggtttggttttggtttggtctgatttggtctggtctggttttggtctggtctca

SEQ ID NO: 193907 - DNA, 386 bp, Homo sapiens
cagccaggaactccccgcccagtgaccctctcccgcctagggggccatttgaagttggaggcgggtcgggacctgccttgacctaaaggaccagcctcaggcttggtcccaggtagtgacccagctctgagagtccctggacggctcccgagactcagtgaatatatttgggatgccccccgcgctggatcatgggcttcccaacaccgctggccttgaatgattcgggcctaattcgttatggttaagatttcagataatctaagacgggttgaggcctccagaagcggaggcttcctgttgggcgctgccagtgacttggggatgaagctatggaagaatatctgagtgtttctcttttgcttctataaaagtaattaatgacc

SEQ ID NO: 193908 - DNA, 198 bp, Homo sapiens
acttagcgcggggacagatgtgtctgagtgacctgtttcaatcatggaaactgaggcacagagcacttgggacacactgctctggggacctctcagccccaggtcccgccaacacatccaagccagtacttgtccctcctgagcctgtcctggcttgtgatgctctagccagaagtctggggacccccaccacagccc

SEQ ID NO: 193909 - DNA, 450 bp, Homo sapiens
gccgcgctgtgaggtgggcaggcgaggagcgggaagaccatctctgcaagtgcagcatagcctcggcctaggacagcgggagtgcgtggccaaagctgtgagcagaggcacaggtggtggcagacagtagaggcgccccatggggaacatactgacctgtcgtgtgcaccctagcgtcagcctcgagtttgaccagcagcaggggtcggtgtgtccctctgaatctgagatctatgaggcaggagctgaggacaggatggcaggagcgcccatggctgctgctgtacagcctgctgaggtgactgttgaagttggtgaggacctccacatgcaccacgttcgtgaccgggagatgcctgaagctttggagtttaacctttctgccaatccagaggcaagcacaatattccagaggaactctcaaacagatggtgagacaacagtgtctgt

SEQ ID NO: 193910 - DNA, 420 bp, Homo sapiens
gccgcgctgtgaggtgggcaggcgaggagcgggaagaccatctctgcaagtgcagcatagcctcggcctaggacagcgggagtgcgtggccaaagctgtgagcagaggcacaggtggtggcagacagtagaggcgccccatggggaacatactgacctgtcgtgtgcaccctagcgtcagcctcgagtttgaccagcagcaggggtcggtgtgtccctctgaatctgagatctatgaggcaggagctgaggacaggatggcaggagcgcccatggctgctgctgtacagcctgctgaggtgactgttgaagttggtgaggacctccacatgcaccacgttcgtgaccgggagatgcctgaaggtaaggaggtgataggtgccatctaccctcggtttgcctttggctgctgctgtcccca

SEQ ID NO: 193911 - DNA, 652 bp, Homo sapiens
gggctttggtggacgatcaagattttgtgaagtccggattgactgaggaaaaggcagtcctagaaaaatacagatgactacaactaacaggaagaaataaaaaagctgaatggttctataaccacttaagaaattggaccagtcattaaccatcacctcataaagaaaatactgggcctagagagtacaacacaagctacagataaatgttcctacaacagagcaccgtagtaagctggcattgaatgtgtacttattgaatgagtgaatgaacagagaaagtatatgaaatgttcaagtaaagatgagcaggtgcccaggctgaatgataaggtgttggagtagggggacaaaaagccatgagagaaagaggcaagagagccagatgaaaatcctacacaaacgccagcctacggagcttagctcttcaggcagtacggagtcctgaaacacaggaggaggaagaacaagaggagctctgggtttttgaaagcccatcctggacactctggatgataagctggagagtggaaacgtttagacattaagcaaagcaaccgctaggaaggttcctacaacaccacggctgtcggatgatgcaaaagggctaagcttggacaggaacagcaaattagagaggtagagaaggatt

SEQ ID NO: 193912 - DNA, 446 bp, Homo sapiens
cattcactcacctacattggttccattcttcctgtccattgttctgaagaataaaaacaatctctctctacctaatatatatttaaaaaaatactaagagtaaagaattaatgagtgcctgcaatgtatctgacactcttaagtattttacagccaggcacagtagctaacttacgcagtcccaacacctgggaggctgaggtgagtgaatcgcatgagcccaggagttcaaaaccagcctgggcaaagtggtgaatccctgtctctaagggtgaaaaataaacaaataaaaacagctgagcatggtggtatgtgcctgtggtcccaactactccagaggctgagatgtaagaacccattgaactcagaaggtcaagtcactgttggagtgagtcctgttcgagtcacttcactctagcctgggtgacagactgagaccctgtctt

SEQ ID NO: 193913 - DNA, 202 bp, Homo sapiens
tcttgatcacaataacaaaacccatatttttagatttctagatccaaacacacctctcaagtaatttaggacttacaatcaattctctccctcaaaaattgtaatatcctatttgaatatatacaaatagcagcaagcagttttgtaatacctagtcaaaatcacagctcatttctacaataatgttgatagattgtatttg

SEQ ID NO: 193914 - DNA, 329 bp, Homo sapiens
cctcccaaagtgccagaattacaggtgtgagcgactgtggctggcttattcttttttattttttcttcgactgaagaaattggctgcctaaaattcccttgtatcagcatattgtaatttatttggccaggctcctagtgatggatacttaggttgtttgcaatcttttgcggtagtgtatgtactgttcttatacatgggagaggataaattgctgggcaagagtgttttgatgaactacttatcatttggtaattatttttctaatgaaatgagctcatcaggtgacagtattcaatgtcacattggttaaaatgttccaagttttg

SEQ ID NO: 193915 - DNA, 449 bp, Homo sapiens
cgatggagcaaaggccgggtgcccagtgagtcacctgagagaggcctcttggggccaagtccttactgaggctgggcggggaggccctgctggagggaggaaggaggggtccatgggacagggaggttggggctaccctgggcctgcttggagttttatcctttccttgaacttaggactttctggagacttgaagatggtccctcataagctgactgcatcctgcttagagctcaggggcgcacccccaacaggcaccttccacccctcagaaccagcagccacaggcgggccaagggcagagcgcctctccccaggggctccttttcccgagggactgtgtcctgtgtgtgtggagagaggacagctgccagatacaatacataagtactgcatggaacatacttagactaataaattatttgttgtttctctgaaattcaaactta

SEQ ID NO: 193916 - DNA, 203 bp, Homo sapiens
gtgaacacaaccctgctattttgtcccttccagggctctgatgagccctcgcctgctgatggtgggcgagactcgatcctgagcccagctatctacactttgtatgtccacagctgcctctactgccgtgtggccaaagggaactgccgtgtgtgtagatggcctggcagagcagcccagtcccctccccgcacccaggtcct

SEQ ID NO: 193917 - DNA, 430 bp, Homo sapiens
tctgagaaaaaataactacaaaaattaaataagtagttagtgtcctcataaagatattgtatacacactaaaataaattgctttgctctacatacttgccagtgcaaaaaaaaaaaaaaaaagacaaaaggaattaccaaaaatcttggaaattaaaaattgaatagtcaaaataattgttatgctgggcctgttgatgagtgcctgtagtcccagctactcaggaggctgatgcggaaagattcctgaggtcaggagttggaggctgcagtgagctatgatcacaccacagtactccagtctgggcaacaacatagcgagaccctgtctcttaaaaaaaaaaatggagcaggaaaatgggcacagacgaagagcatattaatggattggagtagagcattttccccagacaaatcataaaatgacaaaa

SEQ ID NO: 193918 - DNA, 203 bp, Homo sapiens
cttctttggaaaggctaatcagaaacttaaaagaatgcaaccattagtctctcacatatctgtgacctggaagtcccctccccactttgagtcttcctgccttttcttcacattgacctgcctttccagactgaaccaatggacttcttacatatattgattgatgtctcatgtctctctaaaatgtataaagctaagctgtg

SEQ ID NO: 193919 - DNA, 432 bp, Homo sapiens
catcccagtttggcatggatccttctaaggacagcatttcaggtggccacccccaaatcgtagaagctagcatccaagcaaaagctattttattatgtgcttaatgacttaatgcattactgaggtgtcagtgatttagtctgttgtgtccttactgctgccataagacatgatttgtttggtgatgtgtggatgggtatttttttctgtgatttctttgtaaggacgttatccactgtaacccttagtatcccagatgtttctcaaacttgaatatgtgtaggaatcactggagggatgtgtatgtatgtatgtgtctttccaaaatggagaccccagccccatccccaaggatgaatgaatgcttttctttcttttttatattaatagactttgtattttagaacagttttagatttatagaaaaattga

SEQ ID NO: 193920 - DNA, 263 bp, Homo sapiens
tgaggaagccaggatgcgtagatctgtggcatgcaatagtatgagaggcggactacagagcgaaacctccaggaagaatctgtggataaccttgaactctacttgatggtgaaatatcttgaggatgcaaatgtactgagtaaaaatctatcaaagactttgttgttggtgatgagatccacttacttcacttgaattcaacaaatattaattgagttgtttcattggggatctacgaatcctgggtcctctagtcagccccg

SEQ ID NO: 193921 - DNA, 639 bp, Homo sapiens
taagaattcctgagtacccaaccctttgatatatagtcttgcagtatcctgccatcactgagaaggctgactaccttgcccctgaacttggagtacaaccatttaacttgctttgataaacagaaaattactacactttgcatagagatttcagatggcttccataatggggattcttcctctttccatttaccatgagaatatcacctggctagtacactgttcccagaaggagagtgagaaactaatgaagtcagattgcccccacctgatccagaccaaattggccaaactctaactactaccaagattcagaatttggtccatttcaaataaacagagccatccaccaaacccagcttaaaaaaaatgaaatccaacaacatgtgagatataaacatctaatgtagtttggagggtttttctcttgcagaaaaacataactgataaatcaactctgctaaaccaagagtgtgggaaatatgtacaaccttgttgtgtcaggaattcaggagccaaaagcaaaaacagatgggaaattgcaaaggtttgttcttgtgaggtcgataattaaggctagaagaaatccattggaaagttctggggttggaggataacatcatctcaaatttcctcacg

SEQ ID NO: 193922 - DNA, 205 bp, Homo sapiens
tgcgctgcaaatgcacccatcagccagccctgcagctgaacatttagaaagaggactgaattttcatactagagaatttaaaaattgaacaaaaggacaatccactcaaccctctggttctgcacagagctcactcatctgaggataacaaggaaagaacaaaggaaggaaaaaagaaaataggactgatggaacactgagttag

SEQ ID NO: 193923 - DNA, 122 bp, Homo sapiens
gtacacattgaggcccacataccacatgccaaatatttaaaaggcatatttctagctaaccactgtacatacatatattttttctcttattttcttattttagtttttttccttgacaacaa

SEQ ID NO: 193924 - DNA, 388 bp, Homo sapiens
tcaatgtgtgtgtgtgtgtgtatatatatatatatgcatacatacatacacacagaagcccacacaccttttctgtatcctacaggttttgtataatgaagtcattacctttttttaatcagataagttaatttacaagattaggtggctctctgcaaggaatcagaactcacaactcccaccccccacaacatggctgctagttctttaactgaaactttattttccatcaaccactacagttgactcatccagagcgaaagacagctccaccattcctaggtttagttattgtttctttgcggatactattgtttgtttggttttcctttactagcttccaagtgaaaatctggtgcagctagatccgaatggtgaaatccaggtt

SEQ ID NO: 193925 - DNA, 1164 bp, Homo sapiens
gcagagatcatttgtcaactatttgatcccagatttgaatttggggaggaagggaggagctactgacctgatgggaatatcataatccattcaaggaaatggtcattagtacctcagaggtgaagggaatatgtgaagctctggatcactacaaggagccctgacttaccagttggccccaaagtgcccaggctgagggcataggagcatgatgagatgcaaggatgtgggattatcaaggggcacgtctactaactggtgaaggcagtctgcgggggaggacacctaaaggtatgcggaaagtacctaacccagacctctctgcattaggagtggaggtgcaaagtgagcatctccagtgcagcatgggatgggaagatagggaggtgtcgcccactgtctcggtttagccagcaccacggctggctgtgtgcctgctactgtcagagagcaagggtcatctgtcctgcccagctatgcctgccaccctgttgctgactcagtattggcagaattgctgagatgggccaggtcatcacctttgcctggagtgttcatcctttcagtgccattattctggtgctaagtgctgaagaacattttcaggtctagccgagaatgtcctcttgctcttgcctgccaggcctgtccagatctttttggtacttaaattgagctaactccagccagagtggcttggaattcatagtgcggtggctcagagtataggctcgaaagcccttgagccagattgcctgggttcagatctcacctatactacttactaggtagatgaccttgagcaagtcacttaactgctctatgcctcatttaaaattacatacaactacatgtaaaagggagatgatactgctgcctacctacctacatgatagggctgttacggggattgaaggtgatcatacatgtaaagtgcttggcagagcactgcatgagtgtgttgtcgttattaatttgctattccttgtcctattcagaaaggatttcaagaggctggatgccttagatgtggtctaacttgaaaccttcatgtgggtgtgcgtctgtcttgtttattgctgtgccaggcacaaaataggtatttcataaatatttgttaatatgctcagagttgataagctggattaaagtgacttcttaagg

SEQ ID NO: 193926 - DNA, 342 bp, Homo sapiens
acatcttatttgggggttggtatagacgccaccagcactgcagggaaaaccaccccctaggaggggtgagacagagagaatgtgagattttgatcattgattgctctttctgaaaggcactgctgaccatagtaggtgtggtgaatgtttgtgtcactgcattgggtattagaacttttgctctgagcatgggctgccctaccctgaagagctgaatcttggcttctgacagaagctctgcatgactcattctcctcaagcatattttccttattttcctatgaaagtatctatagtttgcaacaagaactgtctttggttcaagtgtcagtgtactagaat

SEQ ID NO: 193927 - DNA, 542 bp, Homo sapiens
atccactttcatgatatctgctgttacagtaatatagacatactgtaaatgtattttaaaatatatagcccgtttaattccccagctataaatgactgagaaatagaaaaaagagggagagaaagagagaatattactttttccccccttgaagcaaatgctttatgaagatctcattggaatccagcaaatgattaatgtgaagattttggaggaaatctggggagctgtattaaagcctagatctcaggttcatttcgatcagccagccgtgaactctgggccgaattcattacagtttaatagtgctgggagaggaagaaaatgcaatttctcattccattagaaaactagaaaatactctcagtttgtccccctattaagatgtggcaggtgacagggccattctgggggacacggtcaatggaattacagcacactatttttgttcatataaaatattgaaaggcaagcctgactgtgcagaagttattttactgatttggtttttatgtaaataaaatattgaaagttaattaatc

SEQ ID NO: 193928 - DNA, 608 bp, Homo sapiens
gggacttccaaagatctttgagcatcaccaccttcaaccaaagatcactcttcaatatttcatacatcactaggcacagccagccagacagcaactattctgaaccacggcttgttacaagtgccaccatcttgcctcatgtccacatcaacaatcttctgaccctacatctggcttctcttcctgcccctgactttgacgaaaaggtatgcctaattcctttctaaatgttataaattaactcaacccctcgacctgtgcctcccccgctggtcccaaggggcccttggcttccccgactcccttgtatcttctccctgccttccaacagagagggcagcagcctctcccaactggctaattctacgccttgcctttgagggttacttcattcactaaaaccggttcctgctgcccctgttcatgccaccctatgatctggcttctctcctcaattggctctgggaacacctttttttataaattcttggtatctggagagatgagtttcaccatgttgcccaggctggtagtcatcaatttttatgggaccacttcatgcttggatttccactgtggggaaggatttctcaaagaggtaggaagtg

SEQ ID NO: 193929 - DNA, 769 bp, Homo sapiens
ggtggttttggtgaaacctggaaggattctgtggtcacttttcctcactgatgtatgtttcctccaaactcaactgtgtcatttgattagcatgcaagggtctgtgctagcaaggccagaacaaaaggaggttaaggggaaggacagcagttgtaggaatagaatatggccttggggagtccaagatctcctgggcctgggtatctgtgtgtgaacatcatctgcacgtatgtgactatgcttggggccctttaactgttgcacaggccaacatgtggcccccaagacccttatctgacaccttatgtgaaaactcagtggattaaagactaaacaagaaataaaggtatacaatttctagaagaaaacgggaaaaatttatgacattggatttagcagtgatttattggatatgacaccaaagacacgggcaacaaaagtaaaactaagacgacatcaggcttagaaacttctgtgcatcgaaggacacaatcaacctttcccttctgtgcagggaaaaggtaacctgtggaatgtgagaaaatatctgcaaatcatatatctgataaggggttaatatctggaatatatagacaaccaccactcaacagtaaaacaagtcacctcatttaaaaatgagcaagggacttcaacagacacttctctgaagaggatatacagtcagcactctatcgatgggttttgcatccctggatgtaaccagccagggattgaaaatatttttattaaaaaaatgtgcccatgctga

SEQ ID NO: 193930 - DNA, 198 bp, Homo sapiens
tgctgggattacaggcatgagccactgtgcctggcctgcaatgttatataataagaaaacacaaacatcaatgtattttaacatatttagatcagctcttaaatctcccaatttaagctttttaataaggaattgtaaattttgttgcagcataagctggagaaattctctactctcatctacccctacccttgttaa

SEQ ID NO: 193931 - DNA, 604 bp, Homo sapiens
ctcgaattcgacggtttctcgatatttacagaaaagactctgaccagagatcgagaccatcctagccaacatcgtgaaaccccatctctactaaaaatacgaaaatgagctgggcttggtggcgcctcctgagtagctggatctaaaagtgtgtgccaccaggcctgatgagtttttaaattttttgtagagatgaggtcttgctgcattgccaggctggtctagaactcctgagatcaagtggttctcccaccttggcctcccaaagtgttgggattacaggcaggagcctctgtgcctggccattctgcacttttctaaatccttttgttatgttatatctgtgataaatagtatatagctagattatatttatttgttttatttctttttacacttaatagactatgtcttttaatcagtaaatggaatccatttacattttttttattccatgtgcatttgctttgtattttttttaatctttcatgctttttattttgcttcttttcccccttttctgcccttattagatcagttttgtttcatgctctttttccataccctcaactctgtaagtatagtaatgaccatgagagacttt

SEQ ID NO: 193932 - DNA, 372 bp, Homo sapiens
ttaacctccagcatatttcatactcttctaaaattacgtacttgtctatcaaccttcccccaagtagactctaaattcctcaagtcagggactgctcataataggtgctcaacctgattcctttgcatgctaaatgttactgataacttctggcacatttccagacctctaagtaccctggccatcccatatgaccctttctctgccatgtactaattgactgggaggctctgctatggctgagatattttattgctcaaaacacacagcagggttggttgcgatcatctcgctacagtttgaaatgatggtctccaccgcagtaagagttaaaggaattgaggacttacactaaaattagctctatcttgc

SEQ ID NO: 193933 - DNA, 441 bp, Homo sapiens
aattttaaaaattaaacattgaaaggatgtgcaagtctaaaagggctcaacagggttagaatcctgattcgaacatatcaattcactctcaagcatcactttggtctaaaggcgaggaggaaggcaggcagtaaagggagaaaaagagggagatcattgaattactcaataaaagaggctacttaccatcccaacccattgtaagacatacacttctgacataagagaactccttagaggtcgaataaagcgtgtaagcacctttgagtaatgcacctgcccccggagagggggcccggaagcccaacgagggcttagcgaacagacctttgctaatctgtttatttccttgaactggagtcgggctgcgatgggctgcgattcccaggacgatacatttaattagaacaaaacagaaaaaaaaaatgttgtaaaagctca

SEQ ID NO: 193934 - DNA, 776 bp, Homo sapiens
catctgcacgtcttcccagcaaaatggaaagcgagcattccccatacaaaaaccaagtgcactagacttccagccactgggctgagctcttcccccaactccgactctccaccgctcccagctgtcctaattgaaactcagagtggaataccaaggtctttttaaaacaaacaaacaatattcaaacttctcatcaaggacgcagttgagaaaacagcaacagtttgttgttgagccacaaattaagcaaaaccttgcttctgacaaaggacagaaaatgtagaggatttctacaatccaaagaacaaaacagcccaatacaaacttgaaacatatttgaacaggcatttcccaaaggaagatatacaaatattcaataagtacatgaatgaatgcccagtgtcattaatattagctaaaaaggacatgatgggggcaactggtacaatgtgaatatgcactatggattacaaaaattatatcaatgtgaaatttcttaatttgataattatactctatataatatcttgtttttacaaaatagatactgaaataggcctatcatactcaaaaggttgtgaagaaatggtgtatgtctaccgtgtatttataccttctctacatgctattctccctctgtctctctctctctctctcagcaagatgataaagcaaatggggcaaaacgcaaataattgctgagtctagttaaggagtatagaggagtttcattctctattcttgcaagttttctttaagtttaaaattatacaaaa

SEQ ID NO: 193935 - DNA, 231 bp, Homo sapiens
gcttaaaagctttgccacattcttcacatttgtagggtttttctccagtatgaattttcttatgtatactaaggattgaagatcggttaaaagctttgccacattcttcacatttgtagggtttcttatcagtatgaattatcttgtgtttagtaagggttgagaatacactaaaggatttgccacattctttacatttgtagggtttgtgtccagtatgaattctcttat

SEQ ID NO: 193936 - DNA, 740 bp, Homo sapiens
gtccattttaaaggtgacccaagccattaacctataagttgagcccaatactaatgtaaccccagccccccacagtgctgtgaaggcacctttctctaccctggaaggcttcacaagcccaacagtacagtatttcacactgaagtaggttaggactgggcaaggaacaagaaagtaggtttttggtgggtttcccagacagcattgaggctactagctcagttcccaaacttgtgttagatagaatcagaaaaacaggtagttgtgaaggaactgcagcgagcaagactggtttatttacatttggatgagggaggtagaataagtcacatgaaaacaaaataaaatgaaacatggaagagggaaagggagacaaggatggtccaggcctgggatggacagactttacagtaaccagtttaggagctgagagagctacttcaggcacctgtaaggcagaaatattgagaaagaaagggaatgagggttttaagaagtgttcctacgggttgtgaattggactgctttgacattctttgagacccaacagtatagattcaaattctcttcaataatttttggatgcgtgtctctgtgaatgtgacctaggtgtctgagctgaaccagatgggattctggggtggttttgttttgctttgttttcaactattttatttttaattctggtaagaaatacataacataaaatgtgccatcttactcatttgtaagtgcacagt

SEQ ID NO: 193937 - DNA, 355 bp, Homo sapiens
aactccacaagcaaaccatggctcaaagtttgtagtaatctttttgaactgtaactattagaatttcccaaaaatctaataaatatgcttttctttgtataaaatgagctatatgaatatttgctgctacttgaattttctttccaaaatttgtttatagacatactccctaaagatgtttgataatcagaaataactgattctgctagacaaatatgcaccaattgattgattttctttattttgaagaaaatttttttcctcttaattatttggtggcttcctttgctggcaaatccaattttatgccccacaaataatgtgaacagtagagacttctacttgtaagtttcgg

SEQ ID NO: 193938 - DNA, 216 bp, Homo sapiens
actaagcaaaaacaacaaatctggaggcatgacattacctgatttcaaactatactataaggccatagtcgccaaaatagcatggtactgatataaaaataggcacatacaccaatggaacagaatagagaacccagaaataaactcaaatacctatagccaactgattttcaacaaagccacctaaaacataaagtgaagaaggtaaaccctatt

SEQ ID NO: 193939 - DNA, 392 bp, Homo sapiens
gcgatgatcaggcaaggtacgtgggaaggggcacagagcttccatgccctcctagggcaccaccctctaggaacctccacatgtttagccatccagaagctcatccgaacccagttactttggggtttgtggaagcttcattacataggcatgatggattaaatcactggtcattggtgatcaatttaacctttagcccctctccccttcctggaggttggggagctgaagttctctgggggcccccagccacaaccatctaagacacgtattactttggagaatccaaggaatttaggagttatagctgggaaatggggagaaaggccaaaaacatttccacaatatcacacccgtccactcagtgctttcatcagtccttacgggaactc

SEQ ID NO: 193940 - DNA, 763 bp, Homo sapiens
atttcaaaaatggtgagcctcactaaggtgatagcagtagcctgtccacaggctgatcaacaaaatcttgtctttgatccatggtttctgcttcttggagtctcccaaggtacattctgccactgctggacctagaatcatagtctcctttcctaccagccttctcaccctgccaaacttatcatatacaattgtttgacatcacagatattatcaatccctaggcctctctagctttctgctcttgcaatttcttttacattgtctttgtcacccagcacagagcccatacataagtcatcactctattttcttagaaatactttcagttcacttcttggttttcctatctcacttaccaagctgtcttagtacagatctaagatgagaattttagtacaaataatttattttggaaacaaccccatgaaacactggtaagggagaaaggatggaaggcagaaaagggaaataagatagaatgtttgcaaagataaccatcaatagttcctcaaagccttgctctagcatgctgctcttcccatcaagaggcagagtttgtttcccccactcttgaatctgcactgaccttgcaccctttttttgaacaatagattgcagcagaagtgatgctatgctagttctaagccaaggctgcaagagtcctggcagcctcttcttttgctttccttagatgcagataccatgtaaagacgctcagaactagattagtgacatgatgagaagcaatggggagagacag

SEQ ID NO: 193941 - DNA, 153 bp, Homo sapiens
cagccttggcttcccatgagaatcacctgggggtattttaaaagcctccgtttgttgaggcagcacctctgagcacttgaatgagaatctgtgggcagggcccaggcggcagcattttgaaagctttttcgaggattgcattgtgcagacggg

SEQ ID NO: 193942 - DNA, 361 bp, Homo sapiens
agtgatctaggaggagggagtaggtggtactctcacaggtagccagtgtcagcagggtcaaggcagacatatgcctggaagtaaccacctctcagcattctaaatggaatcaagtttgtaaggcagataatgacacttagctgatgaactacttctatcagaaaggccacttgggcagccctatagaaacagtccaaacattaattgcagtcagtctcttagtctatctgctcccagggggctatgaggagcagaggctcctgaattcatggcccatactcacaggctttcttggccatcatcattcacattttctgtaaatggtgcccccatgccaaccctgaccactctcttgtgtaag

SEQ ID NO: 193943 - DNA, 270 bp, Homo sapiens
acttagtcttcttgagccgccatttccttatccataaatgagaataataattgtacttgtatcttaagactatgataaaggattagagattgaggtaatacatttaaaatgtttaggacacagtgcccagaaagtgctcagtagccagtggtttcaggtggggttgggatgcgttttaattttaacggtaatcatgtggaatgctgaatctttgtggccagttgaaggcaaatgcataggtgtgctttcacaattagctcaggtgtaaga

SEQ ID NO: 193944 - DNA, 384 bp, Homo sapiens
tataatagaaatcatgttttatctggacagaaataaatgacatttgtatatttgccaagttcagtgtgaagagtgagcctgcaaaccttgtataaatatagccataatcagatgtaatgttgaccattcaatgtgcatttctggctttgcattatttttatccatgtctttgtgaaaattggacaattgagatttctaaagataaaggtgaagggcataattttttagcttattttgatgtatctttaaatcatgcctacttttgttgtgtggagaaaacaatgaaatgcattaaactgacgtgtttggcttttttttagtttacctatttgtgtattttgctacttatttattttgttgttgttactagatttccagcaacat

SEQ ID NO: 193945 - DNA, 510 bp, Homo sapiens
  misc_feature (13)..(14): n is a, c, g, or t
ctcactctagagnntcccccgaccttacagatagacttttactcctaggctacaaacctgtacagcatgtactgtactgaatactgtaggaaattgtaacatcagatatttgcgtatctaaatatatctaaacatagaaaaggtacagtaaaaatgtaaaagacttttaaaagtggtttgcctgtatggggcagttccattacaatcttataagaccatctttgtatatgtggcccattgctgactaaaagtcactgtgtggcacatgactatatacatttatgtgtatatttttgttttcttgtacagttcctgactcgtggcttctaaaacccttgtaattttctaagtgatgagagcgattggtataccttttgttaaaatatttcgccctttgtcttgggcttctgaaacaggtgcaaggtgaaagttgtgtctttggttgtacataacaagcctctttcgactacagtgaacttattttaatgatgtgatttttggaaagtccct

SEQ ID NO: 193946 - DNA, 548 bp, Homo sapiens
tttccatcgcatacaccaaacgttcctggttttggagctggagcccttctactgctgtctggagcccgttctgcaaaggaccctggccctgctccagtgctcgctctctcagccaaggaactgccctctccctctggtgttgggagatgctcacatctggtctctccgaaaccgctggctgagcctggctggtcccttgcccccaccggcccctgccccgactatgcatctcctcccggtcacgtctgacagctacagggacaaagacgggctttcgacattggttgatgctacttggtcctgagggggcagcgctcggaggaggggctgcacgaggacacgtccccatggccacgcccctcaccaggagcccgcaaccgcgttgagagggctgcgcacttgtcagcacaaccgactcgacactctcagaggctcaggtgtccaggggctgcggccgacagggacaggctgggtgggatccgggtgtcggccttcacttctctcagccgtgctggcctccccagcctgcctcccgcccagcgctctct

SEQ ID NO: 193947 - DNA, 212 bp, Homo sapiens
gtgcatcagtaacgtttaaaatacattacccaaattatcaagatatagtgcaaaatgtgtgcaatcattcacgtcttaaatgtgtcgacggtggacttggtggaaaaattatgagacatgataaagtattgtgccagaggcattggcctaagaattttagatggagttaggtatttgggacagttaggtatttgatccacatctctttctgg

SEQ ID NO: 193948 - DNA, 210 bp, Homo sapiens
tgagtataatagttaattaaaggaagtttagtattgctctagaagattacagggctttaaaacatagttaactaattctgagctttagaagtaagtcttttatagaatttggctgggattttcctatttgctagtcctgcagttctagaaatttgtgaggtaaaaaaacagtttcttttcatatttacccattgatattaatggagaatc

SEQ ID NO: 193949 - DNA, 307 bp, Homo sapiens
  misc_feature (25)..(25): n is a, c, g, or t
aaagaaaaagaaaaagaaaaagaanatctgaggacttaaggctgggtctgaagacttaaggctgggtctgaagtggagattagggagcctggaatgggaatttggggattagagtgctatcgttgggtctaggcggaagaggacggaactggggggctctgagattggtttggtcggaggagcggggagagtaataagggctgagtcggaggcgaggattaggggtgactgagggggaccaagagctagatctggtagaggttggggggtttcctttgagaggaagggttggggacatccaggggac

SEQ ID NO: 193950 - DNA, 641 bp, Homo sapiens
ctggctaatttttaaatttttttgtggagacggggactcgctttgctgcccaggctggtcttgagctcctttgctcaagtgatcctcccgcctcagtctcccagtgttgggaatacagccatgagccacggcgcccgccctcttgaacttgttctgggctctagattgacaggaatgatattgctgacagcttgaagtgctgattggcggcttgctgtgtgctcgtttgtggttggctttgcgtggcctgccaccttgcactgtggacaccacacatgggccaggcgtgctctcttcacagacagcctcatcctgtgtccacccaaggacaagcaccagcacgggccaaggccccagccttgtcacagcggtgctgttgcccctggccaggtatgggcacctgggccagtgtctcagggaaactgaggaagttcttagacatacagtttcggagttacattcatgctttttcagttctgaggggtcagttaggagtgacgcatttcataaggacgaacagtggaaagttaagaatcaagttgacatgcaaatctgtggtttattgttcgagtgtgtccaaccatgtttatttagacgcaatcttgtatctaagaagttattccaaaactaacagtaggaat

SEQ ID NO: 193951 - DNA, 617 bp, Homo sapiens
ccaaatctcagcaccaaaacaaaacaaatacctctccctttcataatcctgaaatcattaaacatgaattacaatacttatgacaatccctaccaaaagaactggcaaacaggtcaacctggtcagcttttaaagttctcaagaagtctattacctaagagcaagttcaatttcaaatttagaggaaggtaattctggccttcttcggtccaaggttaacttcttagaaagtaacttctttattatatctaataaatcttttgatatttcttttataactatgttggccaattagcacagctgattttgttggtttaaagacttcaagagacttcaaactactatgagaagtcctatacaaaacttacattatccagactgttaaaaactagtctaggtgacagagtgagaccctatctcaaaacaaagaaacaaacaaaacaaaagcttagaaatactagggataaaaggttaaaacccagcaagcttaaagaatactttatacattctttaaagagaacgtgaatgccaaagaactaagatcagtggtgccaagaggctaatcaacatagaggaagaaaaagagaagttaatcttgagcttaactgacaaaaaaa

SEQ ID NO: 193952 - DNA, 523 bp, Homo sapiens
ctgggactttggggtagggactgaggaagcttctggaactcggggcccctagaaggaagtacccaggcagtgtggagctctgttgtgtggccctaggctgccaaaagatcttcatagtacaaggaggccgcagaagtgctgctgtctccaaaatgtgtccccagcatagtgccaggagccacactgttgggtgttggcttcttctttgcctccatgaaatcttctgggaagtaaacatgagccaggggtgtcttaaaggagaccacagcatcaagccctggtcttgctgaactcagagtgacagccccgaaaggggacagtgccagcctggggctagtctgaaaaaagataccgagacgagcaccccttgagaggcaaggttgggggcctgaacgaggggctatggagggttggcacagtcctagagacctttttcttattcagaaaaaggtctgtgcctgatttcactttgttttgttttgtttgaaaccaagtctcgatctgtcgcccaggctggagtaca

SEQ ID NO: 193953 - DNA, 519 bp, Homo sapiens
catccagttcccctacctggaggcattcactcatcatttgtctgtaagttctcccaaacatattttgtgcatatacaagcaaacacacatatatatgtttttaagtgactagagctcccctttttatgcaaatagaagcatagtatacatatcgttctgcaccttgctattgcactaactatattttggagattgtttagtagcagttcatagagaactttgtcatcttggtaactgctgcatagtttttcattgaatgatacattttcatagtatgttcttggatattttcatttctgttttcataaacaatgttgcaaggaatgatagtaggttagaggatatatagtattgaggattctattcataactgaattgctgctttaaagggaatgtacatttatgattttagtagtatcctcatttgcccccaatagatgttgtaccaatttatattcctaccactagtgtattgagagcgcccgtttccccacaatctcaataaaacaagtgtgttat

SEQ ID NO: 193954 - DNA, 201 bp, Homo sapiens
tagagatgtggcttcaccatgttggccagggtggtcttgaaaactccgacctcaagtgaactgcccacctcagtgtcccaaagtgctgggcccccttttattgtattttattttattcttgttaacattttttaatagaggcggggtctcactatgttgcccaggctggtttcaaactcctggactcaagtgatccaccta

SEQ ID NO: 193955 - DNA, 376 bp, Homo sapiens
ccagggcctgggggagagggaaaggggagttcgtgtttaatgggtagggagtttcagttttgcaatgtaaaaaagctctggagatggatggcggtgatggctgcaagactatgtgaaagtactgaatgctactgaactgtgaacttaaaaatggttaagatgatacatttcatgttatgtgtgttttaccacaataacgagttgaaaaaaccacataattacaatatcagcatttcagcttccagcgaattaatagctttaggaatttcattaagttcacaaaaagagagatgaagtgacattatgtgtctcctgattaaaggacacaacacaatcaaaggtcacgccaagcagatcaaacatggattttatccag

SEQ ID NO: 193956 - DNA, 467 bp, Homo sapiens
gtaggactaggggcgggggcaataacccactgcccccacattgcctggctgcagatgctcatagaccagacaagcaccttagaagctcccaccagcatcctccaggttggaggagccgggggcagagatgggaaatgtatgcccttgcttggggcaagatggcatcagtgtggtcacagtgggagcctgcagggcaccgtctcctggctggcctggatcagaggtggggcggagcagatgcaggtcaggcagcagactgcctgctcagtagataaatctttctgcagacctttgaggaatgactcatcacttatacccaggtggggaatttgtcttccccttgcaggtctaggttaagaaaaacagagagagggtggcacatgattgagagcttttgatgttaagtttccctgtgttaccagcccaagaaaccctccggtgacgggcaggcctgctcggggacagag

SEQ ID NO: 193957 - DNA, 438 bp, Homo sapiens
tgtctcagcctcctgagtagctgggataacaagcatgcctggctaatttttgtattgttagtataaatgaggtttcgctatattggtctggttggtctcgaacaactgacctcaagtgatccacccatctcagcctcccaaagtaatgggattacaggcatgagctaccacacccggccttcgtttttcttttgacacagggttttgctctgtcacccaggctggagtgcagtggtgcagtcatagctcactgcagcctcaaagtcctgagttcaagcaatcctcttgcctcagcctcccaacgtgctagcatctcaggcgtgagccactgcacctggcccgaaaccaagctttctcatcccaagcgccaacctttatcaagtctagcctagtcctctatcgtctcctaagtgtccctcatgagtgatcacttctgag

SEQ ID NO: 193958 - DNA, 332 bp, Homo sapiens
aacttggtggttcgtaggagtgccggtcaagcaaactccctggagtctcttttatttattattattattatttttttttttggtgggggggcaggatctcactctgtcacccaggctggagtgcagtggtgcagtcatagctcactgcagcctcaaagtcctgagttcaagcaatcctcttgcctcagcctcccaacgtgctagcatctcaggcgtgagccactgcacctggcccgaaaccaagctttctcatcccaagcgccaacctttatcaagtctagcctagtcctctatcgtctcctaagtgtccctcatgagtgatcacttctgag

SEQ ID NO: 193959 - DNA, 368 bp, Homo sapiens
atgaatcatggggacctgtctttcctgtgctattcttgtgatagcaaataagtctcatggaatctgatgggtttatagagggtttccgcttttgcttcttcctcatttttctcttgccaccaccatgtaagaagtgcctttcgcctcccgccatgattctgaagcctcgccagccatgtggaactctaagtccaattaaacctctttttgttctcagtttcgggtacgtctttatcagcagcattaaaatgaactaatattagtactcttttctgtgggtatcctgtagaaatcatttaaaaagggaaaaatctgtaacttgtcctgcacagaattcattgctccaactctctgcattgtccaactct

SEQ ID NO: 193960 - DNA, 247 bp, Homo sapiens
tagttcagatgttgccacagggaaaagctgtaacacagaattaaaggtacagatttaaaggcttggatagtctttgtcaaaaggggttcttaaactcaacttggtggtttaaaactagcaattaaaaaataaatgactaggacagagtagaaaatatcagaatgcatcaaatgtcataaggctaattatgagcttgagaaacttttgtttctattatatatatgtacatacccacataagcaagcat

SEQ ID NO: 193961 - DNA, 727 bp, Homo sapiens
caaggatgtattttttatttcttttttttcggggggagagagtttcactcttgttgcctaggcttgagtgcagtggcacgatctcggctcactgcagcctctgcctcccaggttcaagtgattctctgcctgagcatcctgagtagcagggattacaggcttgtgccgccacacctggctaattttccaccacacctggctaatttttgtattttttagtggagacgggggtttcaccatgttggccaggctggtctcgaactcctggcctcaagtgatctgcccgcctcggcttcccaaagtgctaggattacaggcatgagccactgcacccggcccagtctgtgtacagctttgccctaggctttactccctgcctgcagggaggatggagaggagccacagatgaaagctcagcatcctttctcaggtctattctgagaatgtgctctgcactcagcatgtgcatggctactgaaattccatagtacacatgggcaggtctgaatttcagtacccgaatttcccatagaaactctccacaacttctcccatgctgttagcacgcctctagtttgcctcaactgtaatcttttgcctaggcatcagtggggtatgcatttgatttacagtgttttcaaggaataccctctgtgtggccacttttctgccctacgtgagttctgggttaggtgaaacaaaggcagatcagtccttttggcagccc

SEQ ID NO: 193962 - DNA, 190 bp, Homo sapiens
cctcacctgccctttcccccatcacagctgctgacccagaagacaccactcatgtccctctccctcccagtagctgccaagacggcctctacctctgcccacacctgccagaacattccattcgcttccctgcctccattcatcccaagatctgaggcgctttacaatcttgacgtttcataatcagacc

SEQ ID NO: 193963 - DNA, 146 bp, Homo sapiens
tgttcatagcagcatttttcatagtgaaacaggttaaaggttatgtagaaacaatacgaatgtccatcaagtgataaatcaataaacaaaacatgatacatccacaaaagggaccagcttgatataaaaaggaatgaagtactgat

SEQ ID NO: 193964 - DNA, 482 bp, Homo sapiens
gattgttggtgactttgggattgtggtggtgccccgggatgcagccgacacagaccgaatcatgaatcactcctcaatactccgcaaatacaaaaacaacatcatggtggtgaaggatgacatcaaccatcccatgtctgttgtcagctcaaccaagagcaggctggccctgcagcatggggacggccatgttgtggattacctgtcccagccggtcatcgactacatcctcaaaagccagctgtacatcaatgcctccggctagcagcccctcgtcctccggcaacacaatggcccctccatctttgtcagccccctgtttctctcctgcctctctgtttctccatctcctcgtcttgactgttttccctacttgctgacttaaccccccatagtgtgggggacctgcagagaaccatggcattccctattccacagtcatctttggacagactttcctctagtctccgggttgggggtgg

SEQ ID NO: 193965 - DNA, 186 bp, Homo sapiens
aactgttgttgagcccagcactctttacttctatcttgttcaaccagagttattgagggttttctgtcacattcagccttagctcctaagatattgcattatcccagttatcttcctatgtttctttccccttgtgcctctaaacataagctctactctttaaaaaaaaaattattattattattt

SEQ ID NO: 193966 - DNA, 406 bp, Homo sapiens
gcaggtgggcactcatcctatagtgagacccagacccatcctctggcagctggtgactgcggcaactttctgctgccacccacaggaacaagcatctctcctcccatccccagcccttctgccttcacctgtagaaggaggcgctgcaggtgtgtgctccttctcagtttgcaaactgagcaaatgataagacttctaggatacaatgtcatctgggtccaagcagaaccgctggttgaagctttggggaaaagacattccatctctagttgaggctctgctgcaccccttggacctgggttgaaaccttcacagccccctgaacctcggggtgatagcgaggtgacatggtggggctttcatgtagctccatgatattataagccattaaatactaaacttaaca

SEQ ID NO: 193967 - DNA, 240 bp, Homo sapiens
gagtttctaggagagtggaggaggtagatgtttaacaacaaagaactttgctagatatataattacaaattatgacaaatgccatgaaggaaagagtagaggattctgtgaagaacttgagatatggatttcattcatattagagatagagggaggtcttggagggagtatttaagctgagatctaaaagatgtgctggaattggctggtggatgatgaaagggaaataatggtctaggt

SEQ ID NO: 193968 - DNA, 370 bp, Homo sapiens
acttttggataggagatccatgggttgctggtgacctccgtgttcttgggtaaggacccctaaagctacccccttatttatgttaacagaaaggtgaaatggcttttctagggaaggcaaagctaaaacagaggcagttataagcagatgttttagctcctcaacctggtggagttcttcagaagtccagaggagagggtcaggcttttcttgggtgatttttaggtagagaggctttatgacaagggcatatgagtcaatccataagcggcaatatccagctatccctaggaattttctgagttcttgtttagtcttaagcaaaggtatggatacaatcctttcaaccctctcaggccctatccttcgt

SEQ ID NO: 193969 - DNA, 204 bp, Homo sapiens
cattgattaattttggcaagctgttagcagtggagtcccccacatttcttccatgtaaagccctgatcatcttggctgtaaccactcacttactttgaagcgtcagattcagtctctctgctttctaagaccagggatgctatttaatctgggcattagaaaattcagttggccaagtgcggtagctcatttctgtaatcccag

SEQ ID NO: 193970 - DNA, 390 bp, Homo sapiens
acgaggagacaatacatttctattgttttagctgcctagtctgtggtactttgttgcagcagccgtagccaactaatacagtccccgagaagtcacacttaagcaaggcacagccattcactaagtgccagagcagaaatatagccaagaggatgtgaaactgccagagagtgatcagagtagagtgcaagagcgaaggaaagtgagcttccaagggagactggaagtgctggatgctgtgtgggaactggacagttgccggtaaagaatccccttggcagggagagctggaagtaaagaatcgcctcggtaaggagagctgctagtaaagaatcgccttggtagggagaactcctggtctgcctatggtgtgggacttggtagagccat

SEQ ID NO: 193971 - DNA, 357 bp, Homo sapiens
atcagcacatatctgtgagctagaaacacagagaacaaaagaacaaaggccaaaataaagttgataaagattctgtgtttaaaggtgtaaactatgagctgctgtaggaaggaagaccagaattccttttaattagcatatctgtcatccaatgaccattctaaatttaaatgagcttggatcagctgaaagataagatttagaaccaagacaactacaaaacaaaagattaaagaaagtactgtcaactgctacttgggtgggacataagaacagcatctggttttctaaactctggtaacaataatagaatgatgaaatgtatttcaggaagataggaaaagcccagtctccttg

SEQ ID NO: 193972 - DNA, 458 bp, Homo sapiens
atggctctgcccctgggccgtgggcgcctgggatggggaggtgtgagcctgacttgagtcctgccgattcttcccagctgtgtggtggggcagcctccactctgaccgagctgcaggggcgcctgccctcctgctccccagggcctgctcctagaacactgaagtcaggcccagcggtgggggcctgtttgctgagcctacaccctggggagctctgggacaggccgggtgtgctgttctgaggtggctgaggactaagaggagggacccatctccagctcagcatggcaggggacaaaacgggcttttggccccgtcagcagccactttcctgtgttagcttccgggctgggaccccagaagcagggaggttgacctgcattctcctcagggtgtcacatctgccagccacagggacataaacaggaagctctgccacgcagctggctgggtgcttg

SEQ ID NO: 193973 - DNA, 1100 bp, Homo sapiens
gagtttattacagatattttgttcttgacctttgacacttgccatttagcaattgcatggttttacttttgtggttgtagagtttctgtttttctttcattagaatgatgtaagtagaggaatagaaactgttatatttgcaaaaaaagagcaaagatgctttgtgaccttgggaattatatttgaaggttactcacaagagaataccttgtttaggaaagatggttaatttttttcttgcaagcagacttttttacaaaattagttaatggcaaatgtgttctttgctgaatattaatctatagtatcatttaagatgttcttaatttatgtttctggactttgtttaaatgtcaaactctagaaagggtaaactagctcaccccactgctaggtaatagctagtattgtcttcgctgcagggcattttacagtaaaattttgaagtatattgaaaaaagttaccagttcacttactatacaatagcttggaatgtgaatgtctgaaagaagaaaaattcaataaatgactatgtagttatttggtggaattcacaacataataacaagaaaaggttttcagctttgatcataatggaaatgagtcatttaattttaccctcagtcctggtacacagtttcagcacctgctaagaagtcggcttgcatttaaatgacttaggcaattattaaaagcaagtttcaagaaataaatggcatttatataaaaaggagactgggctcaaactgctagtgctttaaatttccataaaagcaaattcaagttcagaacaggattcaggatttagtaacaattcaaaggttttcaatcccttaatctctttgtgataactatattcatcatgtagccatttttaaaaggaagagaataaaaatgttaacattgatgtctaccagcacttgtgactgaaaaattgattatatatggtaaatacttatggctccaaatagctatttgatttataattttggtattgaaatgtaatgaaatacttctattgtatttgcaatcgctggaagagtagtatgaatcatacttcaaataaaaatgcttctttttatcatttttcccaaatgtt

SEQ ID NO: 193974 - DNA, 185 bp, Homo sapiens
atccctgaagccccagaagcagtataatagtgtccttttagttttgccatccatggtgatttaagtatgaacagctcagtggagggtcagtgtgacggccttttgcgcctgcatacctggcacttgtattgtccggcgtccaggaggaatgtgatcacgaacgaattagagatggtaaatgtggg

SEQ ID NO: 193975 - DNA, 208 bp, Homo sapiens
ctcagactgcttctgggctcaacaagtttttatttatttaataagcagtttctgtgtgtcagcactattctcaatgcagatgctgtttaacactcttatgaatttatttctcgaggcagtcctatgaggcattaccattatccccattttgcagatgaggacaattgagacacagagaagttgagtaatttgcttagggtcctttaca

SEQ ID NO: 193976 - DNA, 220 bp, Homo sapiens
gtgcttattcattacagtagcaataggaaactaataaatagtaaccataatctagggtaatcctacattgtaaagctggaagaacgctagacaatatatatcagcactatgggtactgtgtagtatactaaattaaaaaagcaaattcgggcctatggagtaaaaagatagtggcatgtctacaagtataactcagcattccacatagttcagcgtctga

SEQ ID NO: 193977 - DNA, 737 bp, Homo sapiens
cttttgggcccttggagataaagatgaaatggtccaggctatgtatataacgttaatgtaaaatgccacacatgcaacatatttagggggataaagagagaggctgatatttttctttcttcttacatcgataaatcatccctatacattcaagcaagtagcatatgctttcagttcatagaattagctgtgtaagcttcctggagcaatacacagatgtaacagcataggaatatggggaaagtaactacaaagagtgatttctaagggctctctctagctttgctcaggagctggtagctattttggcaagaccagtctttgaagagacacacaaaacattgaatctgtcagggggttgaggtaaagtctaggcagtgtagatgtcgctcccaagttgaggtgaggctgtccttcaccacaggacatagtttccctagggagacagttgctgtgagatcaacatggaaatgaatatgaacatgcagaaactaagtgacaatgtggatagtgagagtatgtgtgtgtgcctgtatttatctttgtgtgtgtatcactgagtctgtaacgctcctttacaaagagtgtgacactcttgctactcgaccttagagaatctcttcgcctccagccccagactttcaatttctttatatataaaacaaggggataaattagactgagtcagcaaactatggtgtgtgaaacaaatctggcccaccacctgtttctttttt

SEQ ID NO: 193978 - DNA, 496 bp, Homo sapiens
aagacattctgtccccttatttccagagaactgtgcacacatgaccacatgtcaacagctgccactctgcactgaaatgttctgtcctatctgaggcaccagaaaccaaagagagcggcagggtggtggttgaaggagcgtgggctctaagtcgggcagagcaaggtatgagcctgatgggttctgcccttcaccgccatgtttttgttttttcttaatttatttttgagatggagtttcactcttgttgcacaggctggagtgcaatggtgcgatctcggctcactgcaaccttcaatcacctcccaggttcaagtgattctcctgcctcagcctcccaagtagctgggattacaggcaccagccaccacacccggctaattttgtgtatttttaatagaggcagggtttcaccatgttggccaggctgatctcgaacccctgacctcaggtgatccacctgcctcggactcccaaagtgctgggactacaggcg

SEQ ID NO: 193979 - DNA, 353 bp, Homo sapiens
taacccaaatttctaccatgtgcatataggataaagagaaggaaggaaggaaggaaggaaggaaggaagtaattaaggaattccctcagtaagtagcagcaaaagcacaaagaaacaagtcatttgctcccatgttctagtttgtgtaaaagcacaaaaaaattgatgtaaaaaaacttacatattccacctagtaaagcaaatatcctactttctcttttcaagaagcagcaggaaaagatcacttatgtaagtgataaccatcaacaatttgtaatatagagtataaattcttcagatggatgttgctgagaggtgtaaccttttgtgggttaaggatggaggaactgagg

SEQ ID NO: 193980 - DNA, 706 bp, Homo sapiens
tctgagaggccgcccgtccaccctgctttgcacggacagttcttgtgtctgcctttcgtaccagggaaagcttacaggtgcccactgccctggaggaagctcccagcacaaatgctaagtgtctcctcaccctgggtgcagctctatggagacagaaactgggagggcctggcgatttggtcacaacgtgtaaaggaccaagaacaaagagtggtttcaagttcctaaacttttggaggaaaaaattagaatagtggctacagcgaacaagtgcaggcccctgaccgcagcagcaggcttggggctctcaatgtgtggcgtgggccagcagatccccagtgaggaggagagagcaaccacaggcagcacagagctggccacaaacgataagggcagaggtatgtgaaagagggagccattcccaacccaacactggggagaaaagaatccctcttatttgaaataactgtaagagataaactgcacaagagcctccagttatcttccgtatttgccataggtcatacagtgtcgcttctgctgaaagaggaccacaaaaaggattctgctgcaactgaaaactcaagatgcaaagggacctgccccaacactctgcgtaacagcctgggcaacatgtcaggactccatctctaaaaaagtaaaacaccttcgctggcctacagcacatgtctgcagtctcagctac

SEQ ID NO: 193981 - DNA, 576 bp, Homo sapiens
gtagagacagggtttctccatgttggtcaggctggtcttgaactcccaacctcagatgatccacctgcctcggcctcccaaagtactgggattacaggcatgagccaccgcacccggcttgtattttttttatagagatgggctctccctatgttgcccaggctgatctcgaactcctggactgaaacgatcctcctgccttggcctcccaaagtgctgggaatacaagtgtgagcagccacatctggcccaacttgcataaaaccttctaagtaggcggccacatttttttcaattactttccattgctaaaatttctctggtcaatttcagacacaatgactgacaggccagcctgctactcatagaaggtctggctacagaacatgagaagaacaggtaggtgccagcaggcttccaagtgaaaggaacaccattttcacttcaattatttatccctgcttgaatgtaacatcatcaaaaatcaccatgatagataaaaagaatgtaacggtagaagtaaatcttgtcattggaagtgataatattgcttttctgagaaactaaacataactg

SEQ ID NO: 193982 - DNA, 393 bp, Homo sapiens
ggggcttacagaatcccaagacagacaagcattaaaagtgcctgcggatccggcaggaagccaatccccagatgttacttttggctgggaagggtgaggaggaagcggtggccttgctctggcttaatctgcagtgacaaccgtggcgagcatgagtcactctgggcctcatctgaaccctatcttggcatcttgcttgtggagaggcagtgctgtataatggttcagagcaggctttggaacagactgcctggacaagctacttaattgctctgttccttagtttcctcatctgcaaagtagggggaaatagcagcacctacctcgctgggttgttgtgaagtttaaataaattaatacatgtgaagtacttagaacattgcctggcacatt

SEQ ID NO: 193983 - DNA, 102 bp, Homo sapiens
atcaataaagaccttgggaagactcaattgggataccttggcaccatcagttctggttgcctatttgactgaatccatttcctgcttctgcatccttacact

SEQ ID NO: 193984 - DNA, 522 bp, Homo sapiens
gtgacaatgatatgtttgcagactaacacattcgtaagaacagcagaataatgagctaatttgtaacgtaccagatggaatgtactgaaagctagtggcctaagctatcataattgtcctttataatccaagaagtcatttctagtaatcttgctacccacaacattgtttttatataaacaggtcacagtagaactaatcctcttcccgtgaaggcaggcctctgttatttcagtgtgcttgcaactggggagctgctgcagtgtgtggttctggtttgcttttttttttttaactcctatgtctgaatggcaccctataatgagggatcattaatcttaactgttctgtagcccatgtcattgttgttattttcttttgaagttgtttcttccgtaatttacacacatttaggtatattcaaatttatacttgaactgtctttctttttcctctatgtttgtgtgttccagctcactgaaataggaactgaatcctcagcactttgagactgcccatccc

SEQ ID NO: 193985 - DNA, 538 bp, Homo sapiens
cagtctgtctagcctggacaagagagcaagactctgtctcagtaaataagtaaataaataaataacatacaaatatatgccaaagatttatttaactcatcagtgagggagctaacaggatgacagagcggcttaaaggagacagtgagagactgaagccagtaaaacaaggagggctggaataagattgctggctgcaaactgcttctacagagcaataaacttgtaaccttcctctggggactgtcttttctaccaatgagaagtcatcagccatttctcagcctcctccaagtgaacatccatccaaccgagcaaagcctgggccctagccagtagcgtgaagtcaaaagacgtcacatgccccagaataagatgactcttaagatgggcttatttgataatgctctacggtggctttgaaaggatacacagtcactttttttgccttatttccaagttttggataatttttcttaggtgtgtctggagcttagaatgtgaaggatggagagaacagagggtcaccaatttctcc

SEQ ID NO: 193986 - DNA, 331 bp, Homo sapiens
atacttagttatgtatgcatcgataacctagtgatgatttggcagtgatttattcttctgcactctgcaacctggtctcacaaaggggaacacatatttatagacttggagttagaaaacatggtaagagttgctagtttcaggagaaaaatattaaataataagatgaactcatataaaaatgaaataaatagtttttttaaatgaaaaacctctcatataggagagagataacttgatcaatacacattaacaactagaaatagacttatattggattacaatcatcgtattcacagtatgaattgcaatgttttctgtttcttgtcct

SEQ ID NO: 193987 - DNA, 370 bp, Homo sapiens
tgaggctagcactcaggacactgttcagcctgtcatatggaaggaattgcctttcagaggagattataattgtgtatatagccacacaaatgcacattctgcctggaggaaattgcacagaagaggatgccttatgctgccactcaggtctctttgtggaaggctgcgtaagaagtgcttacatggcatagtcacctcttttggacttaatgagtcatctttttgtgtgatggctacataaaaaaaaaggaaagaagaaatgtactcttccccaagtgagctgcttttattggccctgctgctttgtctaagagttttatacactcctcatgacatcatttacaatgctggtgcacagacagtaaacaaa

SEQ ID NO: 193988 - DNA, 488 bp, Homo sapiens
ggaggagacaggagagggctggagaggcagcaggaacaggcagaagactcggggtctcgattttattatatgtgccatgggcaggaaaggcagagatgagactcaatggacaccttaagatcactgaagctgccaggtgggaaatggattgctgagcatggagagcaggtgcagaggaccagttaagaccagttaggaggctgctgctgtaacccagctgggatagctgtgtcctaggcaaagataacaacaatgaggatagagagagtggacacgttggataaagtttagaatcacggaacttgctgactggagaagagggcaaaagcagagttagcacaacacatgagttatgaccagcttgagcagctcagcagggggtggtgccatttacagaacagagatggcatggacagagcccatggagaaggaggaggaaaaagagagtttggctttgggttttttttttaagacagggtctctggctc

SEQ ID NO: 193989 - DNA, 258 bp, Homo sapiens
gagtcgtgttagggggagcctcttgtccaaaagtgacagagatatttctctgaggctgagagctgtttttgactctggagattttcacagggcataatgaggcaagcactaaaggaaatagtttggggtgagcccaacctagttacattaataacgagaggattagcaatagaaggggaaaaggagaaggagtaacagaacagatggaagataggtaaattttcttagctttagtttggaagggttctcccctggaac

SEQ ID NO: 193990 - DNA, 1030 bp, Homo sapiens
tagattaggcaaatctgaagagaaaattaatcaagtggaagataggtcacaagaaactaccaagtatttagataagaaaacaaaaagacaagcaatacaagagacagggtaagaggcagagaaaacacaatgagaaggtctagtatatgtttagcatgccagagaagacagaataagacagaagcaatatatgacaagataacggctgagaatattctgtaactggccgggtgtgatggcccacgcctgtaatcccaacacttttggaggccaaggcaggtggatcacttgaggtcaggagttcaagaccagcctggccaacatggtgaaacccatctctactaaaaatacaaaaatcagccgggcgtggtggtgggcgcctgtaattccagctactcaggaggctgacacagggagaattgcttgaacctggaaggcagaggttgcagtgagatgagatcgcgccaccacactccaacctgggcaagttgactccatctcaaaaaaataaaaataaaaataaataaagagcctaatggaagccagtagacaactgtgaacaatggactttagttaataatgtatcatcaattgtaacaaagacactaataatgcaaaatgtgaataatgagaaagtagggtaaggagtatatgggaactctgtattagctgctcaattttctataaacctaaaagtgctctagaaaatatacagcctgggcatggtagctcacacctgtaataatgcaaaatgtgaataatgagaaagtagggtgaggaagtatatgggaactctgcattagctgctcaattttctataaacctaaaagtgctctagaaaatatacagactgggcatggtagctcacacctgtaatcccagcactttgggaggccaaggctggcagatcgcctgaggttaggagttcgagatcagcctggccaacatggtgaaaccccatctctactaaaaacacaaaaaaacaaaaattagccgggcatggtggcacgtgcctttagtcccagatact

SEQ ID NO: 193991 - DNA, 355 bp, Homo sapiens
tagattaggcaaatctgaagagaaaattaatcaagtggaagataggtcacaagaaactaccaagtatttagataagaaaacaaaaagacaagcaatacaagagacagggtaagaggcagagaaaacacaatgagaaggtctagtatatgtttagcatgccagagaagacagaataagacagaagcaatatatgacaagataacggctgagaatattctgtaactggccgggtgtgatggcccacgcctgtaatcccaacacttttggaggccaaggcaggtggatcacttgaggtcaggagttcaagaccagcctggctaatttttgtatttttagtagagacggggtttcacca

SEQ ID NO: 193992 - DNA, 560 bp, Homo sapiens
attgaggtataatttgagtatcataaaatttactcattttaactgtagagtttgataaatagtaactttatatagctatgaaagcatggctacaagccagtttttattttaaatttgcatggtacttagatatttctttttaaaatccagttttagaatatttccttgttccagaaggttccctcttgcccatttgtaggtaataactgctcccggccttagtctggtcctagccccctctctatctctattgttttaccttttttagaaattattttttattttcataaaaactctttgaaataatatttttataacaaatttgcagataaggaaaataagccataaagagcctatgtgatctgcccaaggtcaccgagctataagtgatggagctagtatctatgtccgagatgacctgagagctttggccattatgctatgctgctgtaataagtactatgaaaagtctgaggaattaagaaatgggagagttcacatttggctataggatttggggaacatttgatgcggggggtaggattctttgataggaaaca

SEQ ID NO: 193993 - DNA, 159 bp, Homo sapiens
gtgcttatgatttgtcacatcaaggcaggtacacacacacagatgaacatggcctgctagtggctacagaatccccacaagatatgtatcgagatgacagtgggtatagagattgcttttccagattggccctcaagatccaaatggattaggaataaa

SEQ ID NO: 193994 - DNA, 279 bp, Homo sapiens
gcctctgtggcctttgcagcatcccacacccagccttccctgtttctgttctgtgccatttcccaaccttgccttaccaagagccactgctgtggcaggctgctcttgttgctgggcgcctcacctgccacaccgatttctaaagcctgccttgtcctcgttctccccagtcccacctgtggggtcctccccaccagattgtccactccttccgttctagggcgcaaccggaaatcccaggcaccagcctcatcttgctaaggtgaaatctgttcaatc

SEQ ID NO: 193995 - DNA, 308 bp, Homo sapiens
attgcgcattcagggaacagggtcatggttagaagaggaagcagagattagcagcaggagagagtgagtgagctactcgaagttcatcaggagagactgacatggcccattgggaggctgggctcctagaggcagaggtggcccagccctgtcccctccctgttccctgaactgcaggacaatcctacatgtcctgtgaagcaggatattactagagcacagccaaatatgaaaatagaatttcagaccagccatatctattcttgaaggagaaaagtcatagtgcacaggatttgcaaaaagcgcac

SEQ ID NO: 193996 - DNA, 382 bp, Homo sapiens
aaaaaattcagacaatacaaaagtaaaaagttatagttccaccccctccccctttattccccaagcccatttacttcctcagaagtatttactggtaacagtttggagtgcatacttccagatttttctgtatatttgcatatggatagataggtagaatgatataattacagactttttatttgctattcatattatttgccatctttttatgctaatttggagggtttcttttaacattagtttatagggatctaagtcttatctcgaaattttcattccttttgtttacgatgtctctccctcctgattctccctttactcctttgacaatttcttcttgtcctatttcactactccttgtgttctgtccctttcttta

SEQ ID NO: 193997 - DNA, 283 bp, Homo sapiens
gaattggcaggccataactgaatctcctgtgcctggttctcaaatcccagtcatactctctgggaccatggagcccacagaacctgagaccttatgggcttcagggtctttgtatttctctagaaaagtggaaatgcttgagtctttacagtaaagatactgggaagtttctgtgtgcatttcagagttaaagtcaggacagctctcttactgtcctcttccaaacttctttaacttgtttgtatacatacatacagtttcttctagagatggcacagagtta

SEQ ID NO: 193998 - DNA, 340 bp, Homo sapiens
ttatttagaaggagctgggaaggtactggaaggtttgcagctgaggcgagacagaaatatgacatttaaaatgattagctctggctgctgtagggagaagaaactaaggaaataccagcagaagcagggaccctggccaagaggctaatgaaatcatccaagtgagagatgacaggggcttggacaagcagaggtgacctggatagactctgaagttacggttacctgaaagactggtacggggtttgacagaaaaagaagagtcaaggaagatcccaaagttattggccctgggcaagcagaaacatgaagctgggtttaactgaacaaaggaagaagt

SEQ ID NO: 193999 - DNA, 741 bp, Homo sapiens
cccaggacctttgcattcactctacctgtaaattgtgtacacccatctccctcagctcctatagatatctgctcgaatgttcccttctcagtgagacccaatggctccatttaaaactggaccctgatgcttcctccctacctttcctacttttcctcatagcacgtgccacttaccaactcccaacatactgttttattactgtatttgtttgtctcccccactagaatataggttcaacaaaggcagaagggtttttttcatggcagaaaaggcagaattttttccccaatgtacataaaagtgtctggtacatagtaggtgcttaaaaatatttgttgcatccagtaaaatcatcattcaaatgcgaaggagaaatactttctaaggtaaacaaaacttgagggaatgtgttaccaatggaatcaccttgcaagaaatgcccaaagaagttcttcagagagaagggaaatgatatagttcagaaactcagatctatgtaaagaaaagtgcattagaggagaaataaatgaaggcactaatttaggagctgtgactatagcaaaacaaaaacaggttttaccaagtacatggcttgattgaagccactaactttccataatcatgtcctgctgattacctactagatacagctactttatagaataattaagactgcaggatcaggccgggcgccgtggctcacgcctgtaatcccagcactttgggaggctgaggcgg

SEQ ID NO: 194000 - DNA, 422 bp, Homo sapiens
aaaagaacctccctcattcaaataccctcagaatcccatagcatttacactttgcccctcccatttttatctatcctttgtcctgtatctccaaccaattaagccttttggggctgtggtcaacatgttcggtaactgttaataatgtattcactgggaaataagagtatatagtcttggctgggcattgtggctcacacttgtaatcttatcactttgggagaccagcctggccaacatcataaaaccctgtctctactaacaatataaaaaattggctgggcggtggggcgcgcctgtaatcccagctacttggtaggctgaggcaggagaaccgcttgacctgggaggtggtggctgcagtgagcttggatcatgctactggactccagccagggtgacacagtgagattccatctggg

SEQ ID NO: 194001 - DNA, 350 bp, Homo sapiens
aaaagaacctccctcattcaaataccctcagaatcccatagcatttacactttgcccctcccatttttatctatcctttgtcctgtatctccaaccaattaagccttttggggctgtggtcaacatgttcggtaactgttaataatgtattcactgggaaataagagtatatagtcttggctgggcattgtggctcacacttgtaatcttatcactttgggagaccagcctggccaacatcataaaaccctgtctctataaaaatacaaaaattagctgggcgtggtggcgggcacctgtaatcccagctactcaggaggctaaggcggcagaatctctagaacctggga

SEQ ID NO: 194002 - DNA, 529 bp, Homo sapiens
tgataactttaataatgaacttttattctgtgtactatgtttaaggaagtaagaaattggtgtcttttgagattgctataaaagtaaccattttcaaaactctgttaattaaatgttaagtttcaattttctggaaaatttacgtgtagatctctccttatcagatgacaccaaataaaaatggtgctactgtgtatggaacttcctttgttttattattttaacctatttatctttctacttaatatttcaaggaattactcccaaacaaggctctattacatttaatatttgatatcagtaatgaacaaccaattgcctaaagattagcacatttgctaatggagaagatagtaaagcagataattagaattagtaaatgacctatgcatatgattcagttgtatagttttgaatcctggtattgagtctattagcccaagtgtcctaaggtgccaggtttttgtagtgagtttttttcattgcattgctggcctcctctgtctcatttactatgttaatttaaacc

SEQ ID NO: 194003 - DNA, 1491 bp, Homo sapiens
caagctgatctgcaagtaacataaactgtctgccagagcaaagtccaacagtatttaaagaagaatgacgaattctaggacttagcaatgtaaaattcatatgcctggcatccaaagagaaattacctagtatgtgcccaggagttcaagactatcctgggcaacatagggagactccatctctacaaaaaaatttaaaattgaaccaggcatgatggcacatgcctgtggtcccagctacacaggaggctgaggtgggagaatcgcttgagcccaggaggtcgaggctgcagtgagccatgatcacaacactgctcttcagcttggcaacagagtgaggccctgtctctaaaaaagaaaaaaagaaattacctaatatataaagaaacaaggccaggcacagtggctcacacctataatcccagctctttgggaggccaaggcgggtggaccacctgaggtcaggagttcaagaccagcctggccaacatagcgaaacgccgtctctactaaaaatacaaaaattagccgggtgtgatggcacgtgcctgtaatccccactactcaggaggctgaggcaggagaatcacttgaacccaggaggtggaggttgcagtgagccgagattgtgacactgtactccagcctgagtgacagagcaagactccgtctcaaaaaacaaacaaacaaacaaacagaaaacccaaaatatggcccaaaactaagagaaaaaatagtcaatggaaatagacacaggaattacgaaatgatggggttaaaagacaaggataataaaacagctattatacatattcttggatgggctcagtggctcacacctgtaatcccagcactttggaaggacaaggtgggtggatcacttgaggtcaggagttcgagaccagcctggccaacatggtgaaatctcatctctactgaaaatacaaaaattagctggatttggtggctcttgcctgtaatcccagctatttgagaggctgaggcaggaggatcgcttgaacccagaaggtggaggttgcggtgagccgagatcatgccactgcactccagcctgggtggcagagtaagactccatctcaaataaataaataaataaatattcttaatatagtaaagtaaaagtaggaagtacagtaaaaggaaatatgaattgaatgaaaatataaatggataatacaaaaaaagaaccaggccgggcatgggggctcacacctgtaaccccaagactttgagaggctgaggcaggcagaacacttaaggtcaggagtttgagaccagcctggccaacatggaaacctggtctctaggaaaatacaaaaattagctgggcttggtagcacacacctgtaatctcagctactggggaggctgaggcatgaaaattgcttgaacctgggaggcagaggttgtacagagccaagatcacgccactgtactccagcctgggtgacagagtgagactctgtctca

SEQ ID NO: 194004 - DNA, 280 bp, Homo sapiens
ctgcaacatctcataacttcaacacactcatgtaactctggtggatttcatcagacctctcctctgtgacaactgtttaattaccacacattggtgatctcatataatcctcaacaaccccatgaagtaggcattatttacaaattacttattttacaaagaaggaaactgaggttgagagaggattatatgcttgcggggtctcatagagaccaaccgaacccccttcgaccttgcccgaagggggagtccgaactagtctcaggcttcaacatcgaat

SEQ ID NO: 194005 - DNA, 305 bp, Homo sapiens
tacccatctcaaacttctcattttatcctcatttcaattttagaaatgctatgttaatcatccacatcagaaacctaaggatcatttgtgaccaaccctaaaacagaaggacatggaactccaaccagaaaaaactttccagcagagtaaacaaaaaggcacacaccaagcaatccctaagttctatgttttcacgccaacagagagaacatgaaatgcttctcagagaaaaaaaaaaaacaacagatcaaacacaaggaaatgtcaataagaatgtagttagactttttttttttttttgagat

SEQ ID NO: 194006 - DNA, 171 bp, Homo sapiens
gagaaagagtagagtttaaatggaaatagattctgtgtaaaagctgcctacagattctggagctgcaagtggtgtgtgggtgagactatttttttgccttgcctgatttacaggaatatttttagtcatttctggttttaaagcctaaaaatgccatgggaggtcaccagt

SEQ ID NO: 194007 - DNA, 605 bp, Homo sapiens
atgaaataaagcgatagtttttgagaggcttctctccaaatgaaatccgaatatgtaagatttcttctggatgtatcactgatgaccacaaaaccggaatgtcaaaaccctcctcaggacagatgaataaaatcccaaagaaactagggtctcagcaaagtattctccctcggccgtcaggcagcaatcagtagctggtgaagcagggaaggaacaacgctgcagacaacacccagggggcctcgttaggggcgacagaagggacaattctgatgggcccatctgaaatgaagcaaaagcatagcatttattatagaaagtatgaggctgggggtcaagtcagctggatctatgagaccttcctatctaggggtgtggtccttcttgagcttaccttaacaagtacaccaaagtgcttcaaaggtgacggtgctaattctgtaagtgatgtgcccgaaataaatcttgccaaaagtcagatctcgctggtgttggctaggacagtgctctggaggagactatcatttttagaatgggataggatgccctgaaatgtgtgccacttacccactcacaactgggcacctctgggtgcctgccatgtt

SEQ ID NO: 194008 - DNA, 406 bp, Homo sapiens
tccaagaagcaccgtcttctgtcagacacacctcctgccccgccataggccttcccactgtggcagcagaatctgtgctaggccttccttcgtgaaagaggacaagatcagggctcacgtgactggggccgctgtgactctgagcctctgcgttctgtcagatgagggtagtggtgcttcccctgcgtcctgctgggagaaaaaaggaggcagtaaatgaaaggtgtctcatcacctgcttcctaaatagaagggacaaagaggctgaaaaacagtaatagtcttgttttatgaaaatgccacccctaatctaggagctgggactgccatgccaggacccctcagataatgacatccctgaagaggattagcagctagtctgttatcagtcacaggcagttcaacc

SEQ ID NO: 194009 - DNA, 386 bp, Homo sapiens
tcaatgatgcaaattagattttggttgaatattagaaaaggggaaaaaatagtttctaaaccagttgcttttttttcccctggcagaaaagctgtgagttttaaggttacatcatcagagctggcgtgaaacatgctctacctttccctcttccccagactgttggcagttgttgtagtgaacccaaaggttaaatgggcatgagagtctgcatagcactcttccacgaaaggtgtgggcccttttcttggcttgagccactttgtgggagtggtttaaagacaaccagcttcctcattccctgtgctgttcccactctgtgcataaaaagaggacttcagccctgaggcagaccaggtggcatctttcacaagtacagaatttgt

SEQ ID NO: 194010 - DNA, 220 bp, Homo sapiens
ccaaaagaacagttataatttatttattttgagacgtagtttggctgtttgattgcctagttgatggagtagcagggagtttatctttgggtccgatatatagaaataatgacttggattgccttgaaagatacatgatgggaggtattcagcaaaggatagactattgttaggcactattactaacgcagccttcttctacatcttgtctttttatttt

SEQ ID NO: 194011 - DNA, 625 bp, Homo sapiens
  misc_feature (508)..(508): n is a, c, g, or t
  misc_feature (574)..(574): n is a, c, g, or t
tcagaggattgaaacctgggcttaatcctagctctgccacttaatagctggaccatgaccatggcaccctatttaacccttctgagcttcacttatctcatctaaaagccttcctctttgagtagttatgaggattatcagataatgtgctggtgcctggcaaatagtaacaatttcacttgatacatgaaagtgtttatcttatatccagggccaggtacaggaaggcactcaagaaatgtgctgatggccggcgcggtggctcacacctgtaaatcccagcaatttgataggctgaggtgggtggatcacctgaagtctggagtttgagaccagcctggcgaacatagcaaaaccctgtctctactaaaaatacaaaaattagcccagcaaggtggtgggcacctgtagtcccagctacttgggaggctgaggcaggagaatcacttgaacccgggaggtggaggttgcagtgagccaagattgcaccattgcagaccagcctgancaacatggagaaacccgtctctactaaaaatacaaaattagccaggcttggtggcacatgcctgtnatctcagctactcaggaggctgaggcaggagatcacttgaactgggaggcg

SEQ ID NO: 194012 - DNA, 370 bp, Homo sapiens
tacaaaatactcaggtacaaagctcccaacaagatacattaatttataaattataacagagataccactgcactcatatcttatgtaaatttaaaacttacacagccttaaaactttaaataattcgatcaaagaaacaacataaataaactattttacttaggaacaatgcagttcacatttttgctttcactagaaaaatgttatgaataagagagtattttaagtgagatcaatgaaactgaatatttcatttgtatttgtattgttactaaattgttttatccttgtaacatgactgacaaagaactcccaggagcagaaatctgagctctttcattatcctcttgttgggagcttgcatttttaa

SEQ ID NO: 194013 - DNA, 400 bp, Homo sapiens
tatcttgctcatgattttatgagtcagtaatttgggaaggatttatctgggcagttggcaccggctgggcctgtaagatctgcttctatgataacttcttcacttgcatttctggttcctccgtgctccttgacctccgcacatggatctgtcatcctccagggcttctccatagttgtcttacagtagtcatattttatactacgtggtagttggcttctaagagaaatacctcaagagcaagtgttctgagaaagtggaagctagacatgggtaggtaagggttatgcctagaactggcacaggatcacttcagtattgtattcgtcagagccatgataggacccacctgagttgaagggaatggggaaataggctgtacctaaacttgatactgacg

SEQ ID NO: 194014 - DNA, 628 bp, Homo sapiens
atcctcgcagatgaggaagtgagactccacatagccatgtctcatggccagtaaggggcagagctgggatttgaaccaggtcctcgaggctccaactatagcacttaagggctctgctttactgagcagaggccatctcagcttagtggcacagcagagtgggtgtgacataagctataaagcctgccaagaggagcgcctcccaatcccagacagtgaggctgcagctcccatgtcacccccacagacacactgtgcttccttaaagcacagtctgccattcatttatttgcaagtcactaattctgaatttcagtggttaatactccttagggacaggggcctttaatttggtccacatgataatcttatcaagcaacagatgagacacaataggtctgaaaatcaggaacccaagttccagcctcagcctggccaacacctggctgtgtgaccctgcttaagttccttgctatctctgggcctcaattcttcccacctgccatgttagaaggctgggctggggccgggcgtggtggctcacgcctgtaatcccagcactttgggaggacgaggtgggcggatcatgaggtcaggagttccagaccagcctggccaatatggggaa

SEQ ID NO: 194015 - DNA, 399 bp, Homo sapiens
tgagctcggcaccgtttacatgccacaggcaacccgcatttttattcatttatttatttacttattgatatggggtttcaccatgttggccaggctggtctcaaactcttgaccttgtgatccacccgcctcggcccccaaagtgctgggattacaggcgtgagccactgcgcctggcccatttccttgttttatctggtgttttactacctatatatttattcttaatctaattttaaaattatctgtttttgagacttcattgtaaatggaatcattgtatgcaaattttgtgtgtgtttcttagctcagcaatgtgtttataagagcatctacattgttgtgtgtaggtctagttcattttcattactgtatggtagaaccgactggggatcctct

SEQ ID NO: 194016 - DNA, 566 bp, Homo sapiens
cctggatggcccaaatgtcactcctgccacctccttcctggagaactgcgtaggatgggcagatgccacttctcttcttcctgtatagccaggacctaacacagtgtccggcataaagtcgtctttctataagtatttaaataagtatctactgggtgtacctctccatcacaagaagtctccagcttcccaaccctacagcttccaaagcatcatcttttctttttcttcctaggagccacagtcagaataaaaccaaagcaggccaggcacggtggctcacgcctgtaatcccagcactttgggaggccgaggcaggcagattgtctgaatccaggagtttgagaccagcctgggacacatggcgaaaccccatctctattaaaaatatttaaaaaagtagccgggcatggtggcacacgcctgttgtcccagctacttgggaggctgagtcaggaggatagcttgagcccaggagcttaaggctgcagtgagccgagatcgtgccactgcactccagcctgggcagagtgtttcaaaaaaagaaagaaagaaaaccaaagtag

SEQ ID NO: 194017 - DNA, 401 bp, Homo sapiens
tttaccagaggcctctgtgcccaccttcatctgtctgttgagactgtaaaatgaagggaaataagacttctaagattttattttctcccaatccccaagcctctgccttttgggagcctcttcttaggctcagtatggcactggcattctctgcagggtagtcagatgggtgtccctctttcctttttgaagctgcaggaactgtatgcatagcccttgcatcttgatgactaagtttttttttttttggagacaaggtcttgctctgctgcccaggctggagcgcagtggtgccatcacaactcactgcaactttgaactcctagactcaagcaatcctcctgcctcagcctcctgagtagctgggactataggcatgtgctaccactcctggctaattt

SEQ ID NO: 194018 - DNA, 161 bp, Homo sapiens
tcagtgtacctgtgaacatactggtgcccacaaagagatgagatggaccttgagtaatgacattgcctgagtggataagaaattagaagctgcctcatctggccaactgttagaaaaagtacagtggctgcaaatgtgaccccgtgatcttttgtaactgc

SEQ ID NO: 194019 - DNA, 191 bp, Homo sapiens
gaactgctgcataaaatgagaaatactacactggagaaaaataattaaatttgttattttcaagatatagaatttgttaaatttgttattttcaagatagaggacataattaaatgttttattttcaagatatagaaaaagaggaactaaaatgagatttgagcaaaatactgaaagaggaagaacacttt

SEQ ID NO: 194020 - DNA, 613 bp, Homo sapiens
ggggctgggggcggtggctcatgcctgtaatcccagcagtttggggggccgaggcgagcagatcacttgaggtcaggagtttgagaccagcctagccaacatgacgaaaccccctttctcctaaaaatacaaaaattagtcgggcatggtggtgcatgcctgtagtcccagctactcgggaggctgaggcaggagaatcgcttaaacctggtaggtggaggttacagtgagccgagattgcaccactgcactccagctctggggacagagctgagactctgtctcaaaaagaaaaaaaataaaggaagtagcaacaatgggccattggcagaagttcaagggagagatgatagtaacttggactgtggtgatgttggtggaggtagaatgaagtggatggaggtcagatcttttcagaaataagagtcaaaaggactttgctaatgggttgactattttggtttggaactcaggaaggctttcaattggactagagatgtaagtttgggaggtctcagtagatcattaaagccaggacagagatgagattgcctactatagtaatcattaaccttatcattacaacagaactcacttgtggtactttgttgaa

SEQ ID NO: 194021 - DNA, 344 bp, Homo sapiens
ccagatgtgaggttgggtgtgtgctgagttcctgctgctgggttgagaaaaggtgatgagtgacacctgtcttccgcctttaaggagaaagggtatgaccaccgcctctctttcccacttcttgctggctggagtggagatctcattggccacgcaggttacagtaacactttcatggacctaacaggtcaagaataaggtgaattcttgaggtccttagtataacatcagatgaagctcctctagcaaatccaccgagcgagagtggtcaattccattcacaagatgaagacagagctgcccaacaggtgccattttagcttctacaaaggacccaagcccgg

SEQ ID NO: 194022 - DNA, 150 bp, Homo sapiens
caatgcaagcttaatattttcatatttattttttgccttatgcaatatttttcaacattttcatgagttgttggtcatcactatctctattaactttcaacaacttgctcttgtaagtcacaaatagtgatgctgctgaaactgtttctc

SEQ ID NO: 194023 - DNA, 383 bp, Homo sapiens
gtgatctacaggatctacgtgacacttcaggcttaagtaaactaacggcttttctatttattaaagcaacatttaaaaatacttacaaagttattaagagagctatacaatttcctttattgacacattttataaaaaaagagaaatcccttctctttcttatttctctaaaacaaatttagaaactattcttttcgtgagctcctttttctgtcacctgaattcaaattggaatatttttgctcaccgttggttctggagttttctccatcattcaagccaggtttgaaatcctgtgtcccttggtaaaatcatctattttctaatagacggctaactgcctaggtgttttctttactcaccacttctctctgaagtgtcaa

SEQ ID NO: 194024 - DNA, 1077 bp, Homo sapiens
ggggaagcaaggcatgtcgtacttggtggcaggagagagtgcagaggaaactgccacttataaaccgtcagatctcatgagaattccctcactatcatgagaacagcatgggggagaccacccctacaatccagtcacctcccaccaagtccctccctccacacatgggaattacaattcagattacaattcaaaatgagatttgggtggggacatagagccaaaccatatcagttagtcagtgaagactgaggtatctgtagaagtgagggaggagcacagtggtctggatgaaccagtggggtgatagtcaggggactggcattcagtgaggctgggggagaagcttcctaaaagcattgcccttgaaaagcagggcatacctatctgatactgaggatgtagaatgcagtttggagatgcttcctagctacctaatcttccaaggcaaaccatgcactcttcatcctgatatttgtgatgcctccctgggctacatgacagagggtgcactgcaaaggatgtgaaggaaagtcaccacagggcaaaggtggaaacccaggggcctttccccagtgagactttctggctgttcctttggaacttccacctgctagttgcagatgtttgccactggatggggccccatgctacgtgggaactgttcaggactgtgggtacttagttccagcagagctggctccaccagggcaccaggactgcaggcttctcaactcctggcctggagaggcagcttcagcaaccagtgcctgggaatccactagccctttctctgtgagtcacgtgagggcagaatctgctcaaagtcagagggctggagcaacctggattgtgccagagtgagggcccagctcactggaggtcagagtaagagagtcaaggatgggaagaaacagggttttgctcagtcttgcagatactgaggcactcaggaggctcaggatggcagcaacagggcatgtgctaaacttaccctagcctcttccttttaggcagccaccacagaggacatctgtttgcctctgtaccctaccccatctccatgctggtagatat

SEQ ID NO: 194025 - DNA, 539 bp, Homo sapiens
ctctcataattgtattatgtacagcagcatcagcatcacctgggaacatgttagaagttcgaactatagacctccaacccaaacctctggaatcaaaactcaggagataggccttagcaatttgtgttttattatatcctccagctgtctggagaaccacataagttttgagaaagaaggcaatgcaccttatcattcttcaaggcaaagttcacttcacttagcttggtattcttcactgcacctagcaccctcaacataacaagcacttaatacatatttgtgacataaaatagattaaaatattctaaagacagaactcattttagagaacaatcctttccagccactatttggagattttgatactagagatgtatttggctgagaagtttcctttccttaacctattgctaggttctgtgaacttgccatgaattgaaaccaaggatggactacagtcagaatgaaggaagatgaggaagaaaaaagcaaagaagaaaacaaaaccactctattccttctgaatttggcacaaa

SEQ ID NO: 194026 - DNA, 846 bp, Homo sapiens
ctctgcttctattcttgtactcttcagttcttattcttacaaagcaacgaaaatgatcattagagcatttggattttggatttttggattagggctgctgaagtggtacagtgcatatattcaaaaattaaaaaaaaaacctgaaatacttctggtaccaagcattttggattaggaatactttcccttcttcccacctaatctttcaagccataaacttaaaatccatccctgatatccataatctatcactttcaagtatactatataatttatttaagtattatggctgttagtatttcagctagaccataaactccaggaatgcagggattttagtctcttttactgatgtattccatgcacctagtacaatgcttggtataaagttctcaataaatatatgttaaatgaatgaatgaatcaatcagtctacattcctttctgttccacctgctcaaacaaagtatcttgttactaccgtgttctaagccaccattagttgtggccaagatgattgcagtagctttgttttttttttttttttttttttcttaagagacaggatcttgctgtgttgaccaggctgtgatgcagtggcttttcacaggcatgatcatggtgccttacagcgccgaactgttgggcctcttgccttacgctcccaagtagctgggactgcagatgtgagccactgtggcctggcatgatagcttttaactaatctctgcttctattcttgtactcttcagttcttattcttacaaagcaaccaaaatgatctttggataacattcgatcttttcacactcctgcttttaaaacttccagtgaaatcccccagtg

SEQ ID NO: 194027 - DNA, 347 bp, Homo sapiens
tgcatgttgtcccagcacagtttattgaagactattctttctctcagcgaatagttggcaccctcattgattaactataaatctaagagtttatttctggactctcaactctattccattgatctattatatatttccgtccattccagtaccacactatcctgattactttagtttcataataaattttgaaattaggaagtgttcctcaactttgttcttcttttgcaagattattttggctgttctgaatgctttgcatttccatatgaattttaggaccagcttgtcagtttctgcaaaaagggctgctgggattctgattgtgattgtgttgaatctgcaga

SEQ ID NO: 194028 - DNA, 144 bp, Homo sapiens
agaagggcacttgtcctaaagaacttacttattataaagccttaatacttaaagtgtgtagtactcatgataatggtacagaacagaaggcccagaaatagacacataaatttagcatatgataaaggtagcaaatgagttaaa

SEQ ID NO: 194029 - DNA, 469 bp, Homo sapiens
tatgttctttccgtgcctactatctgtgcggattaaattctaaatgccgcacctggaccacaggccctcactccccatctcttcctccccgcctcccgtttgcgtccactgcgcattccgctgacagggactcatcttcctaagacagtactttggttttcttcccctgctcagaaacaatcactggctcccgactgccactaagaccaagttcaacctccttaggcttcacggaaggtcctctacaatgaggcctcaagcaacctttcccctccctctctctgcacccccgcagctgatctgcttctctcccaaaaaaagccttcctgcacctagccccccagatctctggagacccagaaaccccctttgcctctgtctattccctctgtgtctactaacatccctcccttgctgttctccaagcatttattttctgcactacctcaaatacttgtctgcacctttt

SEQ ID NO: 194030 - DNA, 202 bp, Homo sapiens
atttcctgactcagattgagtgaatgggtcaacctgtttggtttaaaaacaaaacaacaacaaaactacctgtaaataataccaggtttgggggcacatgggagtcaaatgatagtaaaacgtatttacttgaacagcattcttgactaacacccaagactggaccctgtttaaggctcaaccaagaatctgtctgttctcg

SEQ ID NO: 194031 - DNA, 164 bp, Homo sapiens
ctgtagcggttcatcagtaacacaaagagcaaaacaggttttcctaatataactggcctgaactccagccagttttaaattgtaagtggagctaaagacaacactacagattaagtatccctaatgcaaaaatacaaaatctgaaatgctcctcccaaatccaa

SEQ ID NO: 194032 - DNA, 355 bp, Homo sapiens
gagaacataactttgaaaaagaaggtaaaagcactgatataactccactgaccaccataaagaaatttctttaaaccaaaataagtaattctactagactaaaccataagaaattgccaatattcaccaggtgtggtggcttacgcctgtaatcccagagctttgggagatcgaggcatgcgcatcacttgaggttgggagttcaagaccagtctggccaacatgatgaaactccatctcttgcttggaaaaaaagggggggaaaaaaaaaaagggcacagaaattacctgggtgtggtgggggggcgcctgtagtcccagctacttgggaggctgaggcaggaaaatcacttta

SEQ ID NO: 194033 - DNA, 336 bp, Homo sapiens
ggtgacggggcctccagtgctgcccggggagaagccttgagctctccagacaggaaatggagaactgggccatgagcagaaaagagaatcagtaccaaatcacttttgggggcaaagaagtgtcagggaagaagggatgaggaggaagacaggaccgtgtgaagaggaccttctcggaagggaccaaaggcagttagtggagtcccaagacctggggtgctcagaggactttgcatgaatgaacaaataagatgaatgaggctttatcacgtggccatgatcgtcaagcatcagctgaggatgcagtgcccacttaccgcgactgaaacgtgaaca

SEQ ID NO: 194034 - DNA, 647 bp, Homo sapiens
tctcaccgaaagagacattcctgagacattttttacatggcttcattgaagataactctgtgatatcaaacaatccgttgtccttagtggtagccagttcaatacacttccttgtacctgtattggttttatctccttttctgtctcacgttatttatccttctctcccgatccttaatgtatgctccctaacaaaatcgtggcacgtaaacccttgcctcagactctactttctgaagaaaccagctaaggaaaaaatgtctctaaagaaagaaaaatagagtaatgtaaaaaatgaaaatatgggattacaggcgtgagccaccatgcctggcccactctccccttttgtgttaaaaatacattagcatgctatactttacttcataatatattgtttttaaatagaaaattattcaaatcagcaattaagtcacttgatatgtctcaacccccagatctttgagataaaagttgtattgcaggaaaatgggcttgtttgtcccttggctaccagtacctgacacatgactatgtattgtcaagggggcagtactgtgctttggtttgagaaacagcctcatggaaacgagtagtgattccaacagaaatgtggtcttgtgtctgtggggagaaggatgcaatcg

SEQ ID NO: 194035 - DNA, 356 bp, Homo sapiens
taggcgtggtggcgggcacctgtaatcccagctactcgggaggctgaggcaggagaaactcttgaacccggtgggggaagttgcagtgagccgagatcacaccattgcgctccagcctgagcgacaagagcaaaactccatctacaaaaaaaaaaaaaagaaatttcttattgggttaaagtttggagaagtaatgttactaatgcatttcactgagctaccatgaggtggtactgtgtcttagtcaatttttatatttatccccaaaggatatattttacatcttcatatgaaatttagtaagtagtcaaaagaattgtatgaagattacatttttgttcttacctgatgactta

SEQ ID NO: 194036 - DNA, 835 bp, Homo sapiens
attgcttatgcctgcatagaaggggatataatagtctggagcatatgtacacaaactgccaaaatatggtgtgaaggttggcctgacaaatgatgctgcagcatattgtactagcctgctgttggcctgcaggcttctcaataggtttggcatggacaagatctatgaaggccaagtggaggtgactggagatgaatacaatgtggaaagcactgatggacagccaggcaccttaacctgctatttggatgcaggccttgccagaactaccactggcaataaagttttcggcaccctgaagggagctgtggatggaggcttgtctgtccctcacagtaccaaatgattccctggttatgattctgaaagcaaggaatttaatgcagaaatacaccggaagcacatcaagggccagaatgttgcagtacatgtgctacttaatggaggaagatgaagatgcttacaagaaacagctctctcaatacataaagaacagcgtaacttcagacatgatggaggagatgtataagaaaggtcatgctactatacgaaagaatccggtctatgagaagaagcccaagaaagaagttaaaaagaagaggtggaaccgtcccaaaatgtcccttgcttggaagaaagggtagctcaaaagagggcaagattcctcagagctcaggagtgggctgctgagagctaaatcaaacaactttctgtgaggatttttcagataaagacaataaacttattgacagcaaaaaacaaaaaccccctcaaatttgaattttgttaataaaaatttcctaaattaaaaaaataagatgttgtatgtattttg

SEQ ID NO: 194037 - DNA, 414 bp, Homo sapiens
ctgtcccccacataaaactcccccacatatctcaagaaactttcagcattttgaaagacatactctggggtcctgttgtgacagccttgtgccacattaacttctctgtcttgttcccagcaaagaagcctttgctaatttcacaacaggaaagcatgcaagaaattcgagaacaaaacaaatctacacgcagagcccagcatcttcaagcaaacaccctgaggtacagacccgaggctagatgagtccggactgcagatgaggcagctgcctcttaaactgcaaggggactgaaaaagtcatttgcctctaaaaaaccaactctgaatacaaattgataatgaatattcatgagcccctccagcttgctctagagccacccttgactgcaaccctggactctgcttcctaaaa

SEQ ID NO: 194038 - DNA, 431 bp, Homo sapiens
acccttggatggtggagagtgatgaattgttagtgatggatggtggaaaatggcaccattgagttgtgaaggatggaagatggcagagaatgatgtggttggatggcaccactgggtggtaggaaaggagactgcaaagaggaatggttgagtagtggggaatgaagacagtcagtggaagatgccatcactgaatggttaaggatgagttaccaagaggggatggtggtggatgatggaagatgatggtgttgggtggaactcgggacggcagaaggtagtgagttaccagcagtgggtggtagcagtggcactgttattggatggtggaagatgatggtgttggatggtggacgatgaaagatgatggcaccattgggttgtagaagatgagtcatcattgatgagctatggacagtgatggagttgag

SEQ ID NO: 194039 - DNA, 579 bp, Homo sapiens
gagggtatgttctgagaaatgtgtcatcagatgattccaatgtgtgaacatcacagagtgcacttacacaaacccacatggtatagtctactatacacctagactatatggtatatggcttattgctcctagcctgcaaacctgtaatggtaagtattcgtatgtctgaacataggtaaaatagaaaaagtacagtaaaaatacggcattatactattataggaccaccatcatatatgtggtccatcgatgactaaaatgtcattatatggtacatatctctattcatttatctaacccagctcctactgtgtgacacattctgagtaacataagttcagccccctcaaaacttacagaaccacaagtagaaacagactagtaagcaaacagctataacagaaaatgcaattgatacatgtcagaaatatggcagtttttattgagaaaaggagatccaagaaaacttctcagtaaataatatatatttgaatgggggccatctgaacagtcttaaaagacaagttgaaggtatcccataaggaagaacatatgaggcaattaacaacaaagtgctat

SEQ ID NO: 194040 - DNA, 324 bp, Homo sapiens
agcaaaacaaaacacttgagtctgatggaatccccgggtctagtaaccagtttacaggaatgacaagggggagggacacagtgaatggatgctggcagaatccaatctgtaaaggcaggtgtggggaactacacaggacaagtgactccatgagaaaaaagcagagggtgccgggcgtgggggctgcaatctcaacactttgagaggctgaggcgggcagatcactggagacaggacttcgagaccagcctggccaacatggtgaaaccatatctctactaaaaattagccaggtgtcgtggcgagcgcctgtaatcccagcta

SEQ ID NO: 194041 - DNA, 551 bp, Homo sapiens
gttttcatctgtgtgctaattgactttttagctctgtgtctatcctggctccagttccttaaaggcacaagcagggattgcataccctcaacatgcccagggcctggagaaaatgctgggaaatgacagaacttcagtgaatgtgcttttacctagggagggtcatctggaaatacctatcaaaatgacaaatctgtttacccttttatccaataacccaattactgggaataactgaattcactcatatttaaaagattatttgtggccagacgtggtggctcatgcccgtaattccagcacattgggagtccgaggtgggtagatcacgatgtcaggagttcaagcccagcatggccaagatgatgaaaccccatctctactaaaaatacaaaatttagccatgcgtggtggcgggcgtctgtaatcccagctactcgggagactgaggcacaagaattgtttaaacccgggaggcagaggttgcagtgagctgcaatcacaccactgcactccagtatgggtgagagagcaagaccctgtctcacaaa

SEQ ID NO: 194042 - DNA, 1067 bp, Homo sapiens
agaccataatggatccttaccttagaaaaaaagcacatacatcaaaatttggcatgcaatttcaggagtttgttaacctcctaaggacctccacaaacctgctagaagtacaaagaacctaggttaaaaaaatccctgttttagagtgacatatgcaaaaatggtgcagaatggaactccaggtgcttgtccctcccaggaacaccaagaaacttgcaaacactgtcagaatcaagtttattagaactctgaagatagtcaaaagtttatggcaactaagataacttttaaccaggaaagggctgaaatgtagtaggaaagctttgcggcattttaacctactcttacgcaaccccctccccagcctggcagcaacctttaagacagcagcctgagttctcactgtgggttcctggttctggaaggagtagagcagaacttgtttccaagaaattgtgtttgtctgttttgacctgtttggaggttccctgaaaaactgatgcaaagggcttgcctttgttttgcataactgggaattctctcagggtggaaaagtagctttgtaaataaagaatggtcctcaaaaacattaaaaggcaaatgaatgagatgttgaaacctcaacaaaagatacagttgaggcaaacaagacacatgttgaaaacctggctggaaaggtggggagtaagatacttgggctatgagggatgtgaaaagctcccacatgtatcagacagtctgaaggcccatgcacatgtccagggcagagtccacaatcagaaaaaacatgaagagacctacgcttttacttctagttttcctttaggcttagcacaagcagggagtaaagtagtgctaagtcatagctgtaatcagcctgactaagaattgaagaggtggctcaatgcagggccaatctgtaaaaacctggagacttttctttttgtttatttttggctccagatatttaaagcactctctgctgtcaaaccactagctacccactgagttaagggaaaagagatttcagagaccacgcatgacaaggaatagaggctttataaaat

SEQ ID NO: 194043 - DNA, 504 bp, Homo sapiens
cctcggcctcccaaagtgctgagattacaggcgtgagctactgcacctggcctctcttcctcattttcaatcctgactccatcccaccttttacccctcagcatataaaccctcagctccctcccatattacacatgcacatctgcactctgcagcccccggtatagccttcctccatccttcttttcccagttaaccttcagcaaatggctaatctatgtctgttgccttccttgtcttccaactgtttccttaatcatctgcaatctggcttttgcccccccaccattccactaaagtcgctctcactaaagtcaccaatggcttctttgcccatccagttggcccttctgagcccttatgtattagtccgttttcacactgctgataaagacacacccaagactgggtaatttataaagaaaaagaggattaatggactcacagtttaagtgcctggggaggcctcacaatcatggcagaaggcagaaggcagaaggcacg

SEQ ID NO: 194044 - DNA, 275 bp, Homo sapiens
tgtattgggggggctggctattgttcttcagattattaaaataatattcctaaataatcaattgtaaagagctatgataaagtcttgcttgtatccaaagctctctcaatagctcctcacaagctcaagttcttcctccttactaagctttgaaatgcatagattgtattcaaccatattattattattacttttttttttttttttttttttttaaaagggagcctggttctgcccccttggttgaactgaaggggcgcaatttgggttaattg

SEQ ID NO: 194045 - DNA, 186 bp, Homo sapiens
actagacttagggacgggaaacccaaaccgtgccacttttaggtagaccaatggaaaaaaacattaacaattctacttaaaaatgctagaacagtttttaaaaagatgttttgaattcataataaagaaatgcttctgaaaatgtaaaagagcaaggtagcttgatggggagggtgtaaggaaggg

SEQ ID NO: 194046 - DNA, 403 bp, Homo sapiens
cccaaccactcaccttcctcaagaccccaccttcaattcctgcttaaaatatgtaacatggattctccttgtctttttaagataaagacccaaatccttatcactgactgaaagcccttttgtggctacactatgcctagtctagccctatctgccctcaggtgggcctcatctgatcacatgctctcaggtattctctccactacagctgcattggtctttcgttcctggaatacaacatgcctcctgccaccaagggctgctgtcctttctgctataaaatattgtcattcctctcttcatctacttcaagtatattctactttcagatctcagttcaaatgccactttatcaggtaaaccacttttctggtcaggcgcagtggctcatgcctgtaattcc

SEQ ID NO: 194047 - DNA, 267 bp, Homo sapiens
aaagagagtaggacagcacaaatacaaataagcaagtgggtaagtctggataacggatatccagatgttctttatactatatttttgtaacttttgtaaatgtatacttccaaataaaaggtatttaaaaaagaaaaaattggccgagcacagtggttcacacctgtaaccccagcactttgggaggccgaggcaggtagatcacctaaggtcaggagttcaagaccagcctggccaacatggtgaaaccccgtctctactaaaaat

SEQ ID NO: 194048 - DNA, 466 bp, Homo sapiens
aaaattgtacaaagcaggaccaaggcattaggtttcagtcacagccaagcaagtgtggacagtgagtaatgtctgaagattccatagcttgatcacagctacttttgtcctgctgtctgaactccattgtcaattctcaaacaggccacactctcatgataggggccattcatatgctgttccttctaccttgaattcccttctctactttgatatttcctattcttcaggtttcaggtgaaacatagctttgtttagaaagctttcctatcctcccagcctatgttagctcagcctattgtgtaatttcttagtaacctatacttctttgtagtcttcatcatactggtaattatttgtattatgtctgagttccacacgtgagggcaggatcttggtctgccctgtccgccactgtttcccaagaacctagcatagggtctgtctggcacatttgtgttcatta

SEQ ID NO: 194049 - DNA, 523 bp, Homo sapiens
atcccagcactttgggaggccgaggcgggcggatcacaaggtcaggagatcaagaccatcctggctagcaaggtgtccgctctgctcctgatccagcgaggcatccattgccactcccgatcgggctaaaggcttgccattgttcctgcacagctaagcgcctgggttcatcctaatcaagctgaacactagtcactgggttccacggttctcttccgtgacccacagcttctaatagagctataacactcaccgcatggctcaagattccattccttggaatccgtgaggccaagagccccaggtcagagaacaggaggcttgccaccatcttggaagtggtctgccaaaattatggaagtggcccgccaccatcttgggcgctctgggagcaaagaccgccccatggtaacagcaccttaactgtgtgtccccaaggacctacagatcacagggcaacaggggctgtgagggagttgtctggatttcccaaggtggaggaggcgaaagaggagatggatcc

SEQ ID NO: 194050 - DNA, 227 bp, Homo sapiens
aaacttccttagcccctcaaacaaaaacagtcactgttaaaagcagtgttgctatccgatacaacaataggagggtatagaattttgaacaggaagaacatgttttcttcttctttttgatttctattgtacaacatgttgaatatttctagttaataatagtgttgcctatttcaaaattgctaagtaaatttcaaatgttctcatcacaagtaatgctaactatt

SEQ ID NO: 194051 - DNA, 267 bp, Homo sapiens
tgcggtcgtctctagcaggatcccctagggtctaggcgtatatactgaagtatttggcagtaaaggtgcatggtcttcaacttctcgactggaacaggggaaaaatacatatacgcatctgtgtgtatgtatgttaagaaaatgataaagcatacagggctaaaaaaaggaaattaatgagtaggtaaaggatatatgagagttcccctaactgctttttttcttttttctttttctttttttttaagacaaggccttgctctattg

SEQ ID NO: 194052 - DNA, 369 bp, Homo sapiens
gaggttgcagtgagccgagattgtaccaatgcactccagcctgggaaacagagcaaaactctgtctcaaaaaaacaaaaaaaaaattattgagtttaacacaagattttccaaagagtatttgtgtctcatttcattttatgtaaatgttcaatattttaacttctttttcacacacctaaagtttttgaaagttgtgaaacttaaatgtgtttagatgtggactttagaggtcaactgaaacatgcctgggacttggtgactttctgggaggacttacccacgtggccatggttgtaaccatgacaacactttgagctcgagtcccccagattcaattcgggtgtttagtctgtagtcctccggccta

SEQ ID NO: 194053 - DNA, 386 bp, Homo sapiens
tcttccccagagctgtattacctgatcgctaggttcttgcagtctggaccctgcaacaaatccgctcaggtgctagtgcaggagctcgaggagcatcagctgattccgcgccgcttagattgggaggggaaagagcaccgaagaagcttcgaggatctggtggcagcaaatgcacacattcctccagactacctccttaaaatttgtgagagaattggtcctttactagataaagagatccctcagagtgttcctggggtacagacattattaggtgttggtcggcagtctctgctacgggatgccaaagactgtaagagtacactatggaatgggtctgcttttgcggctctgcatagaggcagacctccagaactacctgtaaa

SEQ ID NO: 194054 - DNA, 714 bp, Homo sapiens
gaatagacttacttgcccagtgggtgacttttgacatcacagccaaaatttccactgcatatttcataccaactcaccctgaatttgcgtgtgtgactcatgaagaagcttgaagacacaactatacacgttcaagggcctttccaaaattcctctcctttgctgccaatcactaaccaccccaaagctcctcctcagaatctctcccttaaatatactgcttcaaggctggtcttgcaatgtacctttctctacagaaatatctgcaaaaatgctccagggtgtggctttccattgtgcatgagcaaacagactcagtttggttcagcaacaccccttgctactcttgttcccctcttcatgtagaacacatctctttattacatttatcccatttccccttaccctactgccaccagcaacgaaggagacatggacttgaagctctttagctttctgtgctgcgaaatctcaaaggcaagcaattctaaagggtctggctacccacttaaaatcagagcagggacgaatctatgggagagcaagaccaaactataatctcaaatgattgtgctgcaaatggattcataaaatgttaaagagggcggtaatgcctcagaaaagagaatcctcattgtggtgattgagctggctttaggatgcccacggtagtgatacatctcaccgtggagaagggagaggtggggctctttg

SEQ ID NO: 194055 - DNA, 140 bp, Homo sapiens
agcaatttttaccccacgcccgaatctagcacctattcaaggatcatgcgttttgttttgttctagagtcatctccctaccttttgcatcttttattaatacatcaacatatcagcgctctgggccactgttgtcttata

SEQ ID NO: 194056 - DNA, 383 bp, Homo sapiens
  misc_feature (330)..(330): n is a, c, g, or t
ttttgagagttatacgggccgcgtgtgctttattaaactcaggaggaggagtgattcagatggaaatggccaacagggatgagcgtcccacagagatgggactggatttagaagaatccttgagaaagcttattcagtatccatatttgcaggctttctttgagactaagcaacacggaaggtgtttttatatttttgttaaatcttggagtggtgatcctttccttaaagatggttctttcaattcccgcatttgcagccttagttcttcattatactgtagatctggcacctctgtgcttcacatgaattcaagacaggcattgtatncttagttttttttttttttgtgtggtgtatggaacgttataaaatgattataa

SEQ ID NO: 194057 - DNA, 326 bp, Homo sapiens
agatggaaatggccaacagggatgagcgtcccacagagatgggactggatttagaagaatccttgagaaagcttattcagtatccatatttgcaggctttctttgagactaagcaacacggaaggtgtttttatatttttgttaaatcttggagtggtgatcctttccttaaagatggttctttcaattcccgcatttgcagccttagttcttcattatactgtagatctggcacctctgtgcttcacatgaattcaagacaggcattcgatttcctgaagaccaaggaaagacagtccaaatataatctgattaatgaagggtct

SEQ ID NO: 194058 - DNA, 306 bp, Homo sapiens
caagctgcgcgtcacaccctcgccgctgccacaaaggatcctgggcagttcagacctccaagctgtgcgtccacaccctcgcctgccttgtcttctggacacttttgtgtgacataagaatgggtttgagggaaaaattattatttttctctgggtgatgaatatatttggttattgtctaaagcacttattaggcacctagttgcacagagtatggtgcagtgtagatataatccttaatttccagttgcttacagtattaagagtttaggacagagagagaatggaaagcaatactaacctctc

SEQ ID NO: 194059 - DNA, 476 bp, Homo sapiens
tggcagcagcctgctgaggctgaaaacccctgattagatgttctttgtgccctacaaagtagcttaaagtacatcttattttacctttatacaatcttacaactaggttatcggatgaaattatagctgtttaacagacgaagaacttagatctgatgatgtttagtggtttttccagaatcatatagccaggaccccaacccagatcttctgactccaagtcacatccattttttgttcttttgtttaagtcagagaagctagagtaatttcttcttgctttctcttagtgttcacattaaggagagctcttcagccagggagatcctcttttatgacattgggcctttatggaatcaggtaaccttaattctcttaattgccagagcagcagtgctattcatatgaaaatattattcagtaataccttttattaaatattctttttaggcttttcccccctcagatatcaaaca

SEQ ID NO: 194060 - DNA, 527 bp, Homo sapiens
catctgttaggcaaatataaagcaggcagaaaaacatgaaaagcgagactggcctagcctcccagcctacatctttttcccgtgctggatgtttcctgccctcaaatatcgaaccccaagttcttcggttttggaactcaagactggctctccttgctcctcagcctgcagacagcctattgtgggacctcgtgatcatgtgaattaatacttaacaaactctcctttatatatatataaagattgccaatatatatatattaagattgccaccaagacactttgggttggaatatatatacatacatatatattccattagttccatccctctagagaaccctaatacaatgaaaaattaatataacagtattctacactaactgatccagtatagtctcctgagtacatttttcacttttttgcttattgcatttatagaactcttggtttagtgcttaaagcaggagaaaaaatgaagaatgttcctccttttctcatctaatttaataaacacttttgaataa

SEQ ID NO: 194061 - DNA, 284 bp, Homo sapiens
ccaagtagacacacaaggaggagggcagtgctgagagacgggggaaggattagaacacaggctttgatgaccttggcagtgtgacatgaggcaagccattttacctctctgaacatcaattttctatgcatgaaataaataataataattcatggaggctgggcatggtttttttgtatttttagtagagatggggtttcaccatgttggccaggatggtcttgaactcctgacctcatgatccgcccgccccggcctcccggcataatttttaaaatgctcat

SEQ ID NO: 194062 - DNA, 334 bp, Homo sapiens
gcatacacctgtaatcccagctactcaggaggctgaggcaggagaatcacttgaacccaggaggtggaggttgcagtgagccaagatcgtaccactgcactacagcctgggtgacagagtgaaagtctctctcaaaaagaaaaaaaaaaaaaacggaagcttgggagtcagcttcccaagtttggatcctagctctgccactttagaagctatgtgatgtctttgtgtttctgtttcagcatgcataatgtgggaataagaataacctctaatgttattgtgagaattaaacgaattaatgcaaataaagatcttagaacaataaatatagtaa

SEQ ID NO: 194063 - DNA, 629 bp, Homo sapiens
aacagctggaatcagcagcactgaccaggttatatgtgtctggaggaaagagaaataaaatgagtgtgtgggagatggaggaagagggttaaatggggcagagaaaggggattctggaagccattcccagacagacaggagaaaatggccaggtcatcagaattgatgcaaaagagctattagagaggccaaagcatgtaactgaagaaagtccaggaggagaaatttcaaggatttcagaacagggcactagcaaacagtctcacaaaaggacgtaaaagtttgcaagtttgggtgtcaatgtgcagtgccccggggcttcatgtctgaaaggccagatcaacattatcctaaggtcttacatcaagcatattacatgagctgctggtaaacagtacagacaatcatggcctacagctgagcagatgctgatgctgatgctgatgctgatgctgatgctggattcttggttcgctaaatgcaaaagaggtgatcagggagaatggcaaggagaacctaggagcaggcttaggagaaactggcaagggtctcaatccataagatggcttgcttagagacagggctggtccagaagtaggggaaaatggttggtttgttctcagtgcatg

SEQ ID NO: 194064 - DNA, 634 bp, Homo sapiens
aaaaatcctctaccccacgtaaaaagagtatctggcatttaaggaaaataaaattatgatcagacttcaacagcttctccacattgtcagaaacaatccaaggacggtggggtgtactaggcatttcacatgcaggagaggctcccctcacgccttggggctcaaaaggacatttctttaaggcaaaatgcaggtggtggagaagacatctttctgtgatactttcagaaaaataaaataaaaatgttttttcttggctgggtgaaatgtgatttcactttttatgataaaagataaattataatcaaggatgtttaatggctgcaaatagatgtgatcctctgggctaagaaatattttaaagtgataaatagttgtaattagcatttctaaaaccaatcaactgtcattttctatgtaactaatgctattctaagctcagtgagtacagaatgaccctactttcttaaaccaaaaaccacgatacatggactggagacagagaaaaatagagcttactatgtgccaggcagtatcctcattgctttatgtatattaattactttaattcctacaaccctataattattgccattttacagatgaggaaattgaggcacagagagattaattg

SEQ ID NO: 194065 - DNA, 176 bp, Homo sapiens
aggtcgatggcgagaggtcaggatgcagtttgtgccataagtggaacaaagcaaagagaatagtccctgtaattagtcctgtgtttgaacttaacagcactactaagcagagagcttgggttccatctgaaagctagacctttagggattttccaatttagtgaaaaaagataaga

SEQ ID NO: 194066 - DNA, 445 bp, Homo sapiens
tcagctcggtaccttctttaggcaattcaaattaaggggcattccacaaaaatgtcgaggacataaaagacaaagaaagggccaggcatggtggctcacacctgtaatcccagctactggggaggctgaggcaaggagaattgcttgaacccaggaggcggaggttgcagtgagccgagatcgcccccactgtactccagtctgggtgacagagctagactccatcttaaaaaataaaaataaataaataaatccaacatctagttcatctagttgtactcacaggcagtttctgttacctgcttggttttttttccccgtttggtgtattggttgtatttttctgtttctttgcacatctcataatttttttattggaaactggacattttagagaaatgtattttagcaacctggggtactaaggtccccttcacctgttgtt

SEQ ID NO: 194067 - DNA, 401 bp, Homo sapiens
cctggtgctaaagccatagagggccttcaatggaaaaatggaattaaagcaggggatagagaccaagggcatgcccacaggggacaagaagttgttaggagcctggacaaacaggtgccccttaagttattgggtgtccccaaataacagctaataagtaccctgtactggggtggtggtggcatgccatgtcatcagtaaggcatcaggagtgagagaagagccaagatgccccctactgatagtccatggcagctggtggtgaaataagtcacttgggagacagacccataaagggcagccccagaatattttttaaatccccaaagggccaggaaataaggtacgagatatccattatagacaaagtaagggacccaggcacctggggggtaaggtcc

SEQ ID NO: 194068 - DNA, 415 bp, Homo sapiens
ctctatccatgaagcctaccatctgaggttgggaggaggcaaaggatataaaataaacaagtgtataatttcacatcctgctaagtgttatgaaaactaacaatagagtgctatgagagaaaataacagggaaagcctgtggtggcttacacctgtactcctagcacttcaggtggctgaggtaggaggattgcctgagcccaggagtttgagattgcagtgagctatgactgcaccattgcactccagccttggtgacagtttgaaaccctgtctcagaaaggaagggaggaaggaaggaagaggaggaaaggaagggagaaaatgaaagaaaggaagggagaaaaaaagaaagagggagggagagagaaagagagggaaggaaggaaggaaaggggagggaagaaaggatgga

SEQ ID NO: 194069 - DNA, 462 bp, Homo sapiens
ttagccggctgaggtggcgcatgcctatggtcccagctactcaggacgctgaggtgggaggactgcttgagcctaggaggtcaagcctgcaatgaactatgattgtgccactgtactccagcctgagcaagacagcaagaccctgtctcaatgggtgtgtatctcgtcccctctacatatgatcagctgctctgcagcagccatcacctcatctccatgagcagacctcatctactggacaaacgccatcagcccaaacggctccagcacactgtatgttaatgaccaactggtgtcagtaaaggtacgtaatgtatttattatgtaattctgaattatgtaacctatgtaatatgtactataatgtatgtttacagccaacttaatgtcctaccttctggtttttttccaggcccaagagcttatccagaaggcttcattttagtttgtatagttgcagct

SEQ ID NO: 194070 - DNA, 440 bp, Homo sapiens
ttgctccagcctgagcaacaagagtgaaactctgtctcaaaaaaagagaatgcaggacagaaatctggtgtgggttcctgctgcagttgtgtaaataggtttatgtcctactaggcctgaaagtaggatgggatatgttgtgaaaagtaggacggaacaagttgattggcagggctgcctttccagagcaggtagagagctggcacttggtcagcaggcctccagtgacagggctcagataccagtacccacgatagaggtcttgattctcccatgtgataggtaccatttccttagcaaagttccttctgacttttttctggaaaggggctggggtaggatagtggggagtagggatgtcctggctggtatagccattataagtttttcattagtctcctggattcagatccacttgttactgccaccctctcttacca

SEQ ID NO: 194071 - DNA, 375 bp, Homo sapiens
ctggaagctgcaagagatgtgatcttcttagactaggataaatacagtcagaacttgtagttgaaaggtttaagtgaagctattttttcaatgtctatacatgaatatgcttctagtttgacatagttaaagataacaaagtcaacaaaagtgaggaataatttggaaatattaaaaataatgcagcaacaaacacaattcagaacactaaggtaaaaaatggaaaaataaatcaaattctagatctgtttcccaaaaagatttgaggtccctttgaaggagaaactagaatagccccccaaaatacatcagcaagtaatttaaacctttattgtgtattgtatactgcacgtatgtaatatgtaatttttgtaa

SEQ ID NO: 194072 - DNA, 545 bp, Homo sapiens
gagtttcgtttacatgtcctcataggacccatttcctaacattttaatcattttagtcactctcctttggacgctatccaacccctgcttgctgtgcttgggttcaggtccagaagagctcttagtgtggtgataaagttctgaatggggcttcaagttgtggaagggctgtcatgggaccctcctgctccttgtttttacatcctcatgttatgtacctttaaaaataactcactacgttgctggttcatgctttgcctagatctcagattttctcttttccttagataaattcagtttcccccatctctcgagtggttagtttttactaccctccggattaaacttgtttctgtaatctttacgatagtgtcagcaattggccactatcaacaggaattgaaaaatgccaatccaaaatgcaattgctttaatacatatttgtgatcatatggatacctgatcttaaacacatatataccttgtttattacatttattttgaatattctctggccccatttggtattgttctctaattaattg

SEQ ID NO: 194073 - DNA, 267 bp, Homo sapiens
tagggggattaaatgatactccagttgtacactgtccccatctattcagtaaagaaagtttaccaggagtccaggataataaaaatcaaaacattttgtaacaagaagaaacttcaaaaattaatcagttcaccttgctctctgaataagatagcttaagccagaaaaaaataaccactttggacaagacagtgacagacgggttgaaaatcttaaccagtatgctaaatactgcacttttaacctgaagattttgtttgtttgttt

SEQ ID NO: 194074 - DNA, 305 bp, Homo sapiens
gattttatgacattaccagtaatataaatgaagataaaaaagagaagagtcttaacaaagactgagcccaacattaagaagtcagcgaaataaagagttaaaaagaatacaaaagaccggccgggcgcggtggctcacgcctgtaatcccagcactttgggaggccgaggcgggcagatgacaaggtcaggagatcgagaccacggtgaaatcccgtctctgctaattttggtatttttagtagagatggggtttcaccatctgggccaggctggtcttgaactcttaacctcgtgatccacctg

SEQ ID NO: 194075 - DNA, 462 bp, Homo sapiens
ggggagagtggatgctgcgtgggagatgagaccaggaaatttgccactgcatcattggtttttggacctttggcagatctgatataatggaaggcatttagagcatctgaatctattgactgtccaattcagtcgattgattgttcagtgttgccaacattttgactttagttcacagcatttctcttgaaatgggttggctatattcccaatcaaatactgattgacacattggcatcaagcattcttatgtgcccagctcagtggtggtcacttggtggaagaatatgatctatcaccaaggagttactacttagtttgggaggaatcttaagtaacatggaataatttggtctatcttagccccccaaaagattgctttcatttatttatttagccacgctttggcataattctttaacttgctattgggagatattttggttacccattgtcaataat

SEQ ID NO: 194076 - DNA, 579 bp, Homo sapiens
cctggtacagtacctgcagctcagtcaccaggaaacagtgcctgcagctcagtcggggcctggtatagtacctacagctcagacaccaggaaacagtgcctgcagctcagtcggagcctggtccagaaccgtcctcagcagtttcaactttctgggacgtggagtactcagaaggatcttatctcagcagtggaaatatttgggcctgaactaaatactgctctgatcctccctaataaacgttaaaagcaagtcctaaaaggagcaaaatgtttcagagtgacttcacaaacacaaaataatattcagaggaatacaaaaacaccctcattaagaaacaccagaaatgcaaagaatagggggaaaacccataacgaggaaaagaaaatagaaaaccacccagaaatgacagtgttagaatcagccagccaaggacagaaaaacaggtatttaactgtattgtctatggccaaaagcagaaagactgaacatgttaagaactgaaaatacagaagatactaattcagagtgaacttctagggaagaaaacaacatctaaaatgaaaatgatattagatg

SEQ ID NO: 194077 - DNA, 488 bp, Homo sapiens
gttggccaggctggtcttgaactcctgacctcaggtgatccacctgcctcggcctcccaaagtgctgggattacaggcgtgagccagcacgcctggcctggaatcttatcctggaagaaaaaagcattgttgaaggtctgttatccttcagagatttaaaggggaaaggaggtaaaacatttttgagcatacactatgtgacaggtattactaggtactttttaagtgtttgttttactttgtgaataaagtgttacacgtaagaaagagtaagagaggccgggcgccgtggcttacgcctgtaatccaacactttaggaggccgaggctgtcggatgacaaggtcaggagatcaagaccatcctgtctacagtgaaaccccgtctctactaaaaatacaaaaaatcagccaggcgtggtggcaggcgcctgtagtcccagctactcaggaggctgaggcaggagaatggcctgaacccgggaggcgg

SEQ ID NO: 194078 - DNA, 780 bp, Homo sapiens
gagttatttcaatttgagatacaaagtgataccttatttttcttaatgaagcaagaaatttttctattttaaaaactgtcttggcagggcgcggtggctcatgcctgtaatcccagcactttgggaggctgaggcgggtggatcacttgaggtcaggagttcaagaccagcttggccaacatggcgaaaccccgtctctactaaaaatacaaaaattagctgggcgtggtggtgcatgcactgaggcaggagaatcgcttgaactcaggaggcggaggttgcagtgagccgagatcgtgccattgcactccaacctgggcaacagagtgagactccatctcaaaaacaaaaacaaaaaacaaaacagaaaactgtcttgtattttggctttgtggtcagtttctgaatccaaagttaagtattttttctatatttcacagtccatgagctgtttttaagtcttacttttccttttcttagaaatgttagtaacaactagggccgggcgtggtggctcacgcctgtagtcccagcactttgggaggccaaggtgggtggatcgcttgagaccaggagttagagaccagcctggccaacatggtaaaacctcgtctctactaaaaatacaaaaattagcagggtgtggtggcgtgtgtctgtaaccccagccacttgggaggttaaggtaccaggatcgcttgaacccaggaagtggaagtttcagtgagccaagatcgcacccctgcactccagcttgggtgacagagtgagactctgctt

SEQ ID NO: 194079 - DNA, 233 bp, Homo sapiens
  misc_feature (4)..(4): n is a, c, g, or t
tagncggacctgctgctgattatttgttgcatgtgtgcttttttttaatcataattaagaaatcactgccaagactaatgttatgaagcttttttcctatattttcttctaggagtattttacagtttcttgtctttaattctttaatccaccttgaattaattttggagtatgatgtaagatattagtccagttctgttattttgcatatagatatccaacaatttccaaca

SEQ ID NO: 194080 - DNA, 222 bp, Homo sapiens
atttgttgaactgaattcttttctctatgctgctgaaaaatttacaaatgtgtcttcgaacaaatctacagtcaaaaagtgcactcccgatggggtcgtaggagtattttacagtttcttgtctttaattctttaatccaccttgaattaattttggagtatgatgtaagatattagtccagttctgttattttgcatatagatatccaacaatttccaaca

SEQ ID NO: 194081 - DNA, 742 bp, Homo sapiens
gaagttattacaaatgttatttttccttctttcctccctcctccattgttttaaacccatcccattttgtttttgttctaatctataaaggatataaatccctgactttgttcacagatatgattttcttatttataaagtcatatgtaaacgtttatgtgtatatataaactatgtatataaatgcagactgacttttgtacatgtaagaaagacatatacagaacactcagattttctttttttaatgacatgacataactttttagcttcttcatatatattctcatatataatgtagttttataaatatcagagctgttaagaaccatgcttacaattttttttctctattacaaacacttcctcaaaaattggtttaaggaaaatctcagtgccactactaattaataataaagcttgtgtggtccacatatttctaaaatcatacattatctgaaaagtaaaattatctttaacttagttttaaaatgtaagatagaaaattttatagtaacatagctgttatattaagaaagcccaactgatgaagtttccttacagtgtagtattgtttttctgtgataagattttctatgattaaaaggcaatttcatgcctgtgatcacagcactttaggaggccaaagcaggaagattgcttgcatccaggagttagagactagcctgggcagcatagtgagactagcctgggtaacatagtgagaccgtgtctctacaga

SEQ ID NO: 194082 - DNA, 186 bp, Homo sapiens
tattattcttcatagcaactgagactatgtggtacatttgttcatatatatatacatatattgagtgcctctccacgctggaatgtaatccccacgaaggtagaaatcttgtctttttcactggtgtattcccagtacctggaggagtactcattcaataaatctttgaagaagggtaccgagctc

SEQ ID NO: 194083 - DNA, 147 bp, Homo sapiens
gtcaagctaagccttttcccaaacacaggaacacaacactggttgaataataaatgaacacaaaagaataccaaattctctttgacattggccttggtgagcaacaccagctgaactgtctgcggcagcgggggaccaggaaaacat

SEQ ID NO: 194084 - DNA, 415 bp, Homo sapiens
ccaaggtcatctgtcagcaaagtaaactgattacagtaattttatcttttaactaagttgcacatcatagtatattgatcctagttgagtaatctgattcaatttgtgtgaaattgtttgaaatactactcagtaaaacttgatctggaaaagagataaagttgtgtttgggtaccggagacatgatcagaagcactgagtagattaacctaatttacctttaatctttagtgttatgagtagtctaaggtcctgtaaatacagaagggtcttcttaaaagtgtactttttttggtttaactttacaagggataaattagcaacctttcttgatctcatataacatatcatgttggttctccaaaaacagttatcgatgaattatttttctcatataatttattctttgttgaca

SEQ ID NO: 194085 - DNA, 490 bp, Homo sapiens
gctgacccttgttggcttttgtgtatacccccctcctctggcccctgtggaaatggcaggttcaaggaggctgcgtcctgcatctttgagtaattgtggacatcgcgtgggagcccaggtctgggacagtctcctcctgacaggtttgggtcttccctgctgaagggctgacatgggagagagctgctgaggcgtcctgagaagacacagtgcccgtgctaagctccatcacttgtttcctcccacgatgggtgtcgtgcttgccatgggtacaaaggcacagccacccactggccaggctgaaggttctgtgctgttggtttgcccagggtgataggcagctatgaccctgtccccaggtgtgtctgtttgtgaactactgtctgggatgagggccatgacctttattcagcctcaaaatggagatgttcttgtctctggtattaatttctgcctggataggcgaccgtgcaacaaagagaagccagcc

SEQ ID NO: 194086 - DNA, 491 bp, Homo sapiens
atcatcacaagagttattaagtgttcggcaggagtcagtggaaccccagcccaggggtgtacccaagaaagagagggcaagaagcccagacctgggaccacaggagcagatgaacccaaaggagaagctcaaaccttttcaaaggagcggtgaggagtagattcatatgggaagatagactgccattccaagttgggaagtagggttgggaatagtgagtgggaaagggatttcaggagtaagtggaaattgcagaatatgtggttgttgacatgtagtttagcctctggtattcatattacctcttgataagtccacaagagaatggctccctagtttttatcggaacttggaattattttatttcctcttggtaatgatgatagtataggtcattattttctagataaaaattcttttctatacttgaaggcacatcttccttttggttgttttccatcttcaaattaaactatatttgttaccttaag

SEQ ID NO: 194087 - DNA, 388 bp, Homo sapiens
tgctttctctttacacagaaaacctaatttgcttcctcctgcctcaagacctttgcacattcctgctcctggaatgttcttctcctgttattaactccatgtcactttctcacaaaactgttcttcatcctccagaagatcccaggccccgtttgggctttcatacccccggcacattctggtggggtgctaaactcagattatagtgatacacattggttgaataatatatttatcagactataagctccatgaggccagagacttgtctactttgcttaccacagtattcccagtaactagcacagacctaccaaagactggctgctcaataatttaaagaataagtagagtgcagtgcaaggatgacatgcgcaaggtgtatatg

SEQ ID NO: 194088 - DNA, 568 bp, Homo sapiens
ccaccttagatttcccttcaggtccttttggccagacttggattacatggccatcccctagctgcaaaggaggctggtaaatgagtatctagcatttctagccttcagagaggaaggcagccctaccaccaaggaaaatacattgagaatggctcttaggttggcaatcagcactgccacctgaggcaggaggtaaccagacaggtctgtctgccaacagaacctacgcctttaacctctgctccatgatgtcacctttaagattcatccagctcttaaattacctttccatcacaaacactgtaatgtaaccacacccccaaactcactctacaccttcttctctcccatccgtgtacatgaagttccctcaacctgaaattctgcctcttccacatctgcttttagacataaagtctactcttaatagatgctactcaaacaccactttcccaataaagtcttccaaacaactgtggataggctttgcaactcctctctggtctcctgtagcataagggaacaccctgtggactccacaagtttggtgattgaattggactgtttt

SEQ ID NO: 194089 - DNA, 435 bp, Homo sapiens
  misc_feature (13)..(13): n is a, c, g, or t
  misc_feature (115)..(115): n is a, c, g, or t
  misc_feature (117)..(117): n is a, c, g, or t
gactacggcggcntcgtggtcttctgcatcttctttggcatctctacggcatggtgggggccctgcagttcgaggtgctcatggccatcgtgggcacccacaagttcttccaagntncattggcctggtgctgctgatggaggcggtggccgtgctcgtcggggcccttcgggaggggtcctgctgtcacccaggctggagggcagtggcaccatcacagctccctgcagccttaacctcccgaactctagccatcctcctgcctcagcctccagagtagctgagactacagatgtaagccactgcacctggcctgtttctttttcctccctaccccccaaatgtctcagcagaaatcaccccttttgttagctgtaagtaacaatgtaccccgtcatccatggcattagagaatgaataaaatacagtaaaagc

SEQ ID NO: 194090 - DNA, 579 bp, Homo sapiens
tggtgtactgagtgatgtgactgatggtgtactgagtgatgggactgatggtgtagtgactgatggtgtactgactgatgtgactgatggtgtactgactgatgtgactgatggtgtactgactgatgtgactgatggtgtactgactgacggtgtaccgactgatgtgactgatggtatactgactgatgtgactgatggtgtactgagtgatgagactgatggtctactgagtgatgtgactgatggtgtactgactgatggtgtaccgactgatgtgactgatgatgtatttactgacaccatctttctttaacaggggtcctgctgtcacccaggctggagggcagtggcaccatcacagctccctgcagccttaacctcccgaactctagccatcctcctgcctcagcctccagagtagctgagactacagatgtaagccactgcacctggcctgtttctttttcctccctaccccccaaatgtctcagcagaaatcaccccttttgttagctgtaagtaacaatgtaccccgtcatccatggcattagagaatgaataaaatacagtaaaagc

SEQ ID NO: 194091 - DNA, 232 bp, Homo sapiens
aggatacaatagtgattaagacagttcaatctttcttgtcttgaagcatatattctagcactactgtgaaaacattattcagtcaagttgaatattgacacattcatgcttcatttatgtttcaaggaataaggtgcttttatattttattttttaagtagataacaagtacaagcaccaaaactgtttttatgtcaagccatttttttgatacacatttttttttttttga

SEQ ID NO: 194092 - DNA, 424 bp, Homo sapiens
tgcccacctcggcctcccaaagtgctgtccacaaatggacaggtgtgagctaccacacctggccggggcacgatttttaatagaaggtgcgatggtgactgttcttgtctagcccttgatcttaagggggagtctgatgtcttgtcatcttaacccttagcattatctcctctaccttttccatgttaaagaaatatcctcatgaaagagttttaatctgggagtggtgtgctgaggtgtgcatttgaattgcttgggcctcagtgtgcagaggggatcagagtgggcaagggcaggtatagggaaaggagtgggaaactctttcagtattgaggcaaggcatggttgcagtccctggggcaagttctcctctgtgggaggcaggagtgctgggtggatttcataggtttttgggagatggaat

SEQ ID NO: 194093 - DNA, 265 bp, Homo sapiens
gaggaacatcgaggccggggttggcggaggaaaacgggggatgctgtgagtggggttccgggcgaaggcagaatggataggagagatggcagcgaggtggggcatgaagcctccaggaaaaagctccaaaggaccagaacacgggttccggagcctggggttgggggctttaggaatagacgggaagtgggaaacgggaaaggggtgtggtaggtggaaagagggattgtggctgatgaacctgggggagacggaggcttgggca

SEQ ID NO: 194094 - DNA, 195 bp, Homo sapiens
tcaactggctgggagtctgaacatgaaacacttttagttttccaatacgtactctcaccgcttctgtcaaatgctcctctctagctggctttcagttttccttaataatatgtgtctgagtccatctctttaagtcacttcaatttatcaaaactattttgtattagctcttaaagtatactttagtgctgtttt

SEQ ID NO: 194095 - DNA, 578 bp, Homo sapiens
ctctgaggatcctcaacgacccgaagacgaaaaagaaaaaaaaaaacaactattgctaaaaaaccaggaaggtgtggggaagaaacaatcttgatgaagataaagtagcttcaggcatcaacgccctttaaaaggcataacttttgctagaaaaattggcaatatttacattaatatgtggcatttaagtattcagaataattatctttcttaatgtactatttctaaaatcacctcccataaattgtcttagggttcgtttaaacgacccgaagacaagaacccagacttttagacagacgcacctgttgcattgtcttgagccagagcctgggagagaagagagagcgtgcaagagagagctcagagcaggcaggcagcccaccccctgcagcagtgctgggcttcactggagcccctgcaggaagtccagcagccctgtatgccactcctctggtttgtccaggtaacaggggtgccccgcccccttcatgatcagcacccggtggttgggcagctgcttcaggtgctcaaagctggtctgacccatggggtcctggtctccatatacaatcaga

SEQ ID NO: 194096 - DNA, 823 bp, Homo sapiens
gtctctatgaatctgactgctccaggggccacataagagtggaatcacacaggactagtccttttttttttttgagacaaagtctcgcgctgtcacccaggctggagtgcaggggcacaatctcggctcactgcaacctccgcctcctgggttcaagcgattctcctgcttctgcctcctgagtagctgggattacaggtgtgtgtcaccacgcctggctcatttttgtatttgtagtagagacggggtttcaccatgttggccaggctagtcttgaactcctgacttcaggggatcacctgcctcagcctcccaaagtgctgggattacaggcgtaagccaccgcgcccggccacgatttattatttttagaatggatagtcctaaccactaagcattttagggcgctaccctgtttctgtagggcatattgacatcctgaatgcaaggaagtctggttaatgctattctctcaaatacagggttttggtggattttttcacacatattctataaacatctaagatctgttcactgtttgactctggttgattgggtaatttattcaacaaatactacttgagagcctgtcatttaccagcttctgttgtgggcctgtgaatatattagggtgtgatgacagatgaggtcttgtcttttggaaacttaacaggattgttgggggcggggaacacaaaaggtaagcaaataaactacaaattgagaaaagtaacatagaggtgtccagttcaggactctgatagacactgaaaagggggagacctaagggtggtcagtgaagttctttttggggagagtgagg

SEQ ID NO: 194097 - DNA, 444 bp, Homo sapiens
acaggtttgagtcactgcgcctggccttgaagcaacatctttgacgctgtcatgccatgtagtaatgtcactcaatatagtaatgtcactcaataacaggtacaccttctgagcaatgtggtgttaggcaagtgcattgtcacgcgaagatcagagtgtatttacacaaacatagatggtacggcctattacacgcctgggctatgtggtaaggcctattgctcctaggctgcaaacctgcacagcatgatactgtactgagtcctgtaggcagttgtgacacaatgttaagtatttgtgtatctacacatagaaaaggtacagtgaaaatacaatataaaagataaaaaacagtacagtatagggcacttaccatgattggagcctgcaggactggaggttgctctgggtgagtcagtgagtgagtggtgagtgaatgtgaag

SEQ ID NO: 194098 - DNA, 299 bp, Homo sapiens
gagggcctcctggaggcatatggaattgtgtaggggcatttttggttcttccaatgtcttgagatgtgcattcctgaaaaatattaggggtagccaggtatggtaaatgtcctgttcagaataccaatattaacttaatacctcattaatacagttaattatgttcttttttgggcatcaattctgcttttaagtatagttaatcctttagttatggagtcattcatttttctagattatgtctttcaagattcctgagagaaactgacttatcccttttaaaatctttgattaatata

SEQ ID NO: 194099 - DNA, 451 bp, Homo sapiens
cctacaaagtgcaatgccaagtctgaggacacaccaagaagtataagttgtctggacacaagaagtttgtactccagtatagaatgtgtgccacatgagtacatgtgaaaagtgaataatataaatgtaccctatactacctgctaagtggattacatgagcattacaggcagaatgttaagccatgcaccaaagacacttttgacaggtttgggatgattgtaaaccatttcctaggaattgttcataaagcttaagacactagaagtgagtgttaactttgcaggaatagatcattaggggctgtttggtactaggatatttcataaagaaggtagaaattgagccaggcttcaaatatcccaggactgagtgtttggttcccttgtccactccatctgcattcctcttattaataaataatatcaccatccaccaagctgctcaccaa

SEQ ID NO: 194100 - DNA, 139 bp, Homo sapiens
ataaattagcaaatgtgagaaagaacaaatctttcttatagaaaattcttctcaaaatgtagaaagactagaaaatcatcttcagaaatctactgcaatgcttgttatattcaagatgcttatttattaatgactgtga

SEQ ID NO: 194101 - DNA, 285 bp, Homo sapiens
tattcttacaatattagtataatatgtttcttctaagataagaaaacaactagaaaatttgtcattaaaattgctccaacctctaaaaattcttacacttaaaacattttgcagcctaattgacaaggttagcattttatacaggtctatgtcttctaaactattattgtgtttttgcaatatacttatcaattaattgtgataacaattaaattgggtattgtggtaccagaattacaatattaccatttatgatttcttatatttagtaattaagatattaaa

SEQ ID NO: 194102 - DNA, 315 bp, Homo sapiens
tggtccctcctccttttccctacaacttgttaaagaaaactaagttatttatcctgtagaatcgcctgttcagaattttgttggctgcgcccccatggtgttctttaatgtgttcctttgtgctgttcactctccatttacagataggtgtaggagcttgattcgattcagggtttttgtcttttggccgaacacttcataggtagtgctgggtacctgctgagtcttatcagaaggctctctactgtaagattgaccagtgggttccggtgttgccattctcatctatccttacaaggttttttatcagttttt

SEQ ID NO: 194103 - DNA, 189 bp, Homo sapiens
tcaccagtcagtgccccctttccatagccaccacaagcacacacacatgcatacacactctctattaagtacctataaaacactaaacttataagaattacataatatacatattaaaaatttccagtcatacaacattcaacacccaattatctctatttcatcatttccaagagagccaaaattgca

SEQ ID NO: 194104 - DNA, 533 bp, Homo sapiens
ctgctctagactgagagcagggcccccgatcagtatggggcaggcgggggcagggtacagcaggtcccaggcttggaggatgtggggaacacgggctggcaccaaatgtcgagggataaacttggccagtgggggtcagggtcccatgccacaaaggccatcatctgtgagcactccccacgtgcggggcgctagaccacagcttcactcagacttgctcgttgactcctcacagatatttgatgaaggaggaaggctctattactgttattatactgtgtgcacagatagggaaaccgagtttcagagaggtcaagcaactgctcccaaggcccaggcaaataaatattcctctgagcaaaggtgaaggcacagcatgacctggtgctgagcccttcagcactggctcagtgacagccctgagtgaggctgtggggttgcaggagagggagcagtgggaacagggcctggggtcaggcatcagcctcaaagcatggcaattggttcccaccacaaaatcacagttcaccctg

SEQ ID NO: 194105 - DNA, 335 bp, Homo sapiens
tcccttaagcataatgactgcttctttggtccatttagtttgggtcttttgcaatttatcagagatgagttccctggagtctgggatcccattcaaagcagtgtgggcgcacgcataagtgtgttgattgcatttccacaatcctcagattctgcccttgagaggggctgtccctccactgattcctggaatggatgggcaaacagagccccagtgtctccaaaagcacttcagaatccccctcaccaccaccgccacgccgccaggaaatgaattaacctggacacccagacagctgccattaactcgacctcccctccataaagaagcacctt

SEQ ID NO: 194106 - DNA, 569 bp, Homo sapiens
ttcaccccacacaaagaagctatttagaaattactagaaatagaaaattaataaagttttacattaaaagaaagcccagagggtacataaaggaaaaggacaactgatatcagaagagcagaacaaagggagggaacagaaaatgtcacaatcaccgtttataaggtttctgtcaataagaaaatggttaacacattttagaaagatttcaaatcatcagaaacagttaaaataaaagctggtgcttaaaagtttcagttacttcatcacctcattcactgacactgccaggtaaatgaggcatgactattgactattacaatccgtccatataaaaatattcctaacaaaaaacttcacactaaaaaaatccatatataatatttctttcaatgcagcttcttgatggttttattcagccagtaaccttcattattcaattaatacaaaccatatttcatgctgctccagttggtggcatcattttcaaatttactaaaaataacaggaacaatctactgaagaaactcatcggccaggcgcagtggctcacgtctttaatcccagca

SEQ ID NO: 194107 - DNA, 318 bp, Homo sapiens
aaaagaaaaaaaattagccgtgcctgtgattccagctactcaggaggctgaggcaggaggactgcttgagcccaggagtttaagactgctgtgaactatgatcatgtcaatatattccagcctgggggacggaatgggaacccggtctctaaacaaaacaaaaatttgaaaaggagccctacttaaacgtttacaaagcgcaatagaaggtgaccctcgtgagcagaccttcctaatggaaggctttgcttttagcgaggacctgaggtaacaagactacatttaaaggagaatgtgaactaagtgtattagaaatgg

SEQ ID NO: 194108 - DNA, 612 bp, Homo sapiens
tgcctgcctcagcctcccaaagtgctgggattacaggtgtgagccaccccgcccagcctggaaattgaatttcatagcattttcatgtgtcttgaaatactggtcatctgactttctttccccccaatcattaaaaaatgtaaaaatcacgcttagccacagggagccacagccctagcagtaaggtgttagggaacgcttggggcggggatctaactgctctttatatggacttctgagtttctcttgtgggaattcctttctaaaggacttaggttttggctcttctcaccttattactaataagcctggttaaaactttgaaatctgtctcctctacttattctctttgtgtttttatatcctttcatttctttactgtcattttaggagaattttggaaagtagaatgatgcatatatgcagtcttgcatgttcctacttttatgctgcattttttaaaagtcacatctaccttcattttaatagctttgtttctctaagagtaagaaatatcttctgcaggattggagatcaagaaatttttttgctttcttccttcgctagaataataaatcattctgctattctttttggtctttttatgggagg

SEQ ID NO: 194109 - DNA, 587 bp, Homo sapiens
caatgttttttcccctcaaacattttcaatccacagttggttgaatccatagatccagaacccatgtatatggagggctgactatatctgagtttgaactatatctttttgctgtgaaggagataactgaaaacactcaatagagtctgctaagtagatggcagtaatgaatcgacattaatttcctggtatagatggcttaattttgcttatacagacaaatatccttgtttgtagggaaagtatttggtgggcgatgggactacaaaaaccagtaaattactctcaagtgttcttgaattatacttctaatttttctgtaagattgtaagtatttccaaaaaatacatttaaaaaatttttaggttgtataggcttgaatgatctgccaaaactctactttttccccaaaagccctactatttttagtgcataattttgccgaacattaggttttaaaggaacacacatatattagaacataaatgcaagaatgtgttagtgaaaaacaaaatcctgtatatggaaaaggatcactaaggagacaaaggtcttgaaattttaacactagaatatttggaggggaa

SEQ ID NO: 194110 - DNA, 549 bp, Homo sapiens
agaaggcagcagatgcaaaggccatggggcaaaaacatcttactgggcctttagagctgtgtaaaagctaatgagtgcccagaacacagtgagaacagaggagaattgcataagctgagcttgaaaaggcagcagaagagatgccacatgacacaaaggagtttggatttgaagccgattggtaggttttaaccaaagggacgaaatcatatgatttgtatttggaaaatatcaattcggttgccaggtaaagaatggatgggcaggccaggcatggtggctcacgcctgtaatcccagcactttgggaggccaagacgggtggatcacttgaagtcaggagttcaagaccagcctggccaacatggtgaaaccctgtctctactaaaaaacacaaaaattagctgggtgtggtggtgcatgcttgtaatcccaactacttgggaggctgaggtgggaggatcacttgaacccgggaggtggaggttgcagtgagccgagatcgtgccactgcactccagcctgggcaacagagcgagactctgtctca

SEQ ID NO: 194111 - DNA, 132 bp, Homo sapiens
gttacactcacagtactgttgtttgctgccatggtgctttaggaagtgtgagagttcccgggaggcagagtcaataatgcagactacacgtagtgaaaacatggccaggagagctgtagttcaggctctcag

SEQ ID NO: 194112 - DNA, 518 bp, Homo sapiens
atgcgcgacgcttccatcaatctgtgttttttgccttctagtatgctttgtaattttctcgatagcgagataatagaatactgggtaaaagtaactgctgtaaataagcccttagtgatatgatggcaaggtgtgaggggaggggaaatgattttcaatggtttgtagtcctataattatgtctcagtcttttagtgagcctgtgtctctgtactacaaactttatcagtgcttctccgtatttttaccctttcttgggtggcacaggatggctagagtaggctggagttggatattttctttctcccccatggaaagttagatttggctggacctaggtattttccttccctcaggtgagttaggctctgacaaaacactagcaggttaagttctgattatagtttcttctgagaaactattcataagaaagtattcagaagagtagaatgctctggcgtatttaaaaaatgtttattttttcctccccttgatggaagcgtcgcgcattttttttt

SEQ ID NO: 194113 - DNA, 436 bp, Homo sapiens
acttcaggggacagggccaaagcctcctcatgtccccacacttctgtggagtcattagagggcagacttctagttagttattgattataagtctcatttcaaaacatggaattaaatagtcccagagaagtgcaggaaaaagtgatactgacattgatcacccttgggttgtaactatcgcagatacaggcaatagttaatcaaagtcttgttccttcactctttctttctgggaatctctctctctctattcatggtcaggcaatgaacttgggtatttcagaaagctgtggcaagatgtagttagtccagaatggttcaggaggtaaggagggggtgcctgccatctacatttggttttgtccagttctgatttgtgttcacagttttcagacccatagaaggtgaagggttttaaatcttaccatatctcatc

SEQ ID NO: 194114 - DNA, 260 bp, Homo sapiens
tggacttgacactctgaagctcctgtgggttccagactgccctgctggctgcgatgctggccctgcctgctcatgaatgctatccagcccatcccctgccattcccaatctgaacatccaacaaattgccatcaatggagaaccagccatctggaaagatttcttcaaatgcagagagccaggatcaccaccactgagccctctcagttctctttgtccttttatggtctttgtcccatctctccttgcagtcccacagg

SEQ ID NO: 194115 - DNA, 1027 bp, Homo sapiens
agagacagttgcttgctatgttgcctaggctggtctcgaattcctggcctcaagcaatacccccaccttggcctcccaaagtattgagattacaggtgtgtaccacccagactagccaatggcaatacttccacactgcttcctgccagagagtcgtcaaggaaaacatagcaaactgaatcgattgcattctagttatgagttgtagtggactgaatagtgtctccctccaaaattctacacggaacttcagaatgtgacttaacttggaaatctttttagatgtaattaaggtaaggattgagatgagatcgtcctggattaagacaaaccctaaatccaatgaaagtatccttacaagagccagaaaagaaaacataggagacacacgggagaacgccacgttacgatagagacagagattgcagttacgctgccagagccaaaaatccacgggagccaccagaagctgaaagagtcaaggaaggatcgtcctccagagctttggagggaatgtggctcctggcctccaaaactatgcaagagtacatttgtgttgttttaaggcactaagtttacggtaatttatcatggcagccctaggaaactaatcccctagctttaatggacaaaaatactgcacgctgcttctgctgctaataaatggccagctgacaaactccaggaaaaggagaaagcagttatagacagggtttcaccatgttggccaggctgctcttgaactgctgacctcaagtgatccatccgcctcggcctcccaaagtgatgggattacaggtgtgagccaccatgcccagccttcaacaataatttttgatgtactctctctgccagcaataactgatacgatggagtagaaagatcaaggacagagatggagacaccaaagaagaaataaattaaatggcatctccaaatcaatggtaaaccagggaaatgaactgaatcagttccgtctgtctcctcatgtttaaggaatgaataatttgtactctgggagatatat

SEQ ID NO: 194116 - DNA, 431 bp, Homo sapiens
tgctagaggatcccctcatgggtttcctgaacagccactaggtctgaagaaattaaaagaaaaaaattttttttacttcctgaaacaaatgaaaacagaaacacaacataccaaaactatggacaatcaaaagcagtgttgagagagaaatgcacagcaataaatgcttatataaaaagtggttatttcaaataaaaagtggttacaatgaacctcaatggactagaaaagcaagaacaaacataacgagaattagtaggaggaaagaaatggtaaagatcagagtagaaataaacaaaatgaagacttaaaaaaaatcaaacataaagttgacattgtgcaaaaataaaactgatataccactagctagaccaaccaagaaaaaaagacccaagtaagatcgaaaacaaaaagtgagacataaaaattga

SEQ ID NO: 194117 - DNA, 163 bp, Homo sapiens
acaaacagaccaaacagcatgatgaaaatgattaccttttctttttctggcttctcttcttgttgacaaacaaaaattaacaggaaaaaacttcccacttaaaaagttgtactgattgttattggtatgttgataacatctttaaattgggtatttgtggtaa

SEQ ID NO: 194118 - DNA, 271 bp, Homo sapiens
ctgtgtaagaatgcgagactctgtctcaaaaagaaaacaagtctttctacgggtgtataggattagaggttgactttctccactcagctgcttgagtgacagagggcttctgttcgcctcagttgtctggtacaatcagattctcaataaatatgttgaatgagtgaatgaagtagtgtcagcatatacagaggcaagaaaaacctggtattggacgaatcgtgtagggcgcatggtagagaaatgagggagtaagatagacagggatgtg

SEQ ID NO: 194119 - DNA, 211 bp, Homo sapiens
taggattacacgtgtcaccatcgtggccaaccagcaagctctcttttaatgattcagagtctcaggccatagcagtataagtatcaaaacatctattcccaacttggagttgagatttctaatacgaattctattttctccataatcataaaatagcatcaggaaaagtctcttgacatcttaaaatacatatcactggaaagtagatctt

SEQ ID NO: 194120 - DNA, 631 bp, Homo sapiens
atattttttgttgttgatatttgttctcttttatttatttactaacaaaatagtaataaaggcgttacatttaggctacactagatttaatatttatttaataagatcatttctcttatttctcttcctcctccttttctttttctcctcttcctcttcctcttactcctacctctcctccctgtccttctttttctcccaatgctcaagtagatccaagccccccacttttggaaggagagttgcagtgttttaccccaacagggtgactgcttaataaaagaagaaaaatctgcttactcttttacaactaaatggttacattgattacatttagttacaacttttatttttttacttgggctatgaataaaccatttttgtccagagtaaaatataaaatttctgtaggatatcttctgtctttatgtccttctcttgttgcatttttataaattatttcttaggctgaaatgacctaagctttcaagtacatgctgtaggagcaatactgacatttgttccatcccagtctttcctcggagaaagtgtcacaatgtaaatatcctagaagacctcaggctgcaaaggaaaaaccttcaagtgtgccttgaaaagtcttttttatgtg

SEQ ID NO: 194121 - DNA, 314 bp, Homo sapiens
  misc_feature (10)..(10): n is a, c, g, or t
  misc_feature (12)..(12): n is a, c, g, or t
gttacactgntnggatgacagtttcactggaagttctgcctatatcccttgccgcacctggtgggccctcttctccacaaagccttggtgtgtgcgagtctggcactgttcccgctgtttgtgccagcatctgctgtcaggtggctcaggtcttcaacggggcctcttccacctcctggtgcagaaatccaaaaagtcttccacattcaagttctataggagacacaagatgccagcacctgctcagaggaagctgctgcctcgtcgtcacctgtctgagaagagccatcacatttccatcccctccccagaca

SEQ ID NO: 194122 - DNA, 290 bp, Homo sapiens
  misc_feature (10)..(10): n is a, c, g, or t
  misc_feature (12)..(12): n is a, c, g, or t
gttacactgntnggatgacagtttcactggaagttctgcctatatcccttgccgcacctggtgggccctcttctccacaaagccttggtgtgtgcgagtctggcactgttcccgctgtttgtgccagcatctgctgtcaggtggctcaggtatgagaaacagccccttgggccattctcagtgaagagaacattttgagggaccacctaggctgagcaagtgggacttactagaacagatatttgtcttgttttaacctcaactgggacttggattatcctaaaatagca

SEQ ID NO: 194123 - DNA, 220 bp, Homo sapiens
agggcaccacggtgcgctctttttccaaggtgcctctcagccagggtccattcacctccctgggtagaggttggaccagaacagctggcgagaagggttgggctggggagagcagcagagacaaatcctgtgccagtttcacttcattcgggagccatggaagccttttgagctggggagagaatcaatcaatcagactgatacttaaaaaatgtcattc

SEQ ID NO: 194124 - DNA, 676 bp, Homo sapiens
tcgactctagtagtatcccggctagattctttgcccttcttggcactttcctttcgaatcatccttctggacaaactttgatggagaatttcacaccacgctggaaaaatgccggttatgaaaggattactggcgccgcaaaacaccttcctggacaccatcgccacccgttttgacggaacacatagcaacttcatccttgccaatgcccaggtggctaagggtttccccatagtctactgttccgatggcttctgcgagcttgctggatttgcccgaactgaagtcatgcagaagagttgtagctgcaagttcttatttggggttgaaaccaatgagcaactgatgcttcaaatagaaaagtcactggaggagaaaacagaattcaaaggagaaattatgttctacaagaaaaacgggtctccattttggtgcctactggatattgttcccataaagaatgacaaaggagatgtagtactttttctggcctcgttcaaagatataacagatacaaaagtgaagattactccagaagatacaacagaagacaaagtcaaaggaagatcaagagcagggacccactttgactcagcccggagacggagtcgagcagtcctttatcacatctctgggcacctgcaaagaagagaaaagaacaaattgaaaataaata

SEQ ID NO: 194125 - DNA, 447 bp, Homo sapiens
tcgactctagtagtatcccggctagattctttgcccttcttggcactttcctttcgaatcatccttctggacaaactttgatggagaatttcacaccacgctggaaaaatgccggttatgaaaggattactggcgccgcaaaacaccttcctggacaccatcgccacccgttttgacggaacacatagcaacttcatccttgccaatgcccaggtggctaagggtttccccatagtctactgttccgatggcttctgcgagcttgctggatttgcccgaactgaagtcatgcagaagagttgtagctgcaagttcttatttggggttgaaaccaatgagcaactgatgcttcaaatagaaaagtcactggaggagaaaacagaattcaaaggagaaattatgttctacaagaaaaacggggtctctttctttcgtgctcactggaga

SEQ ID NO: 194126 - DNA, 607 bp, Homo sapiens
  misc_feature (57)..(57): n is a, c, g, or t
  misc_feature (61)..(61): n is a, c, g, or t
  misc_feature (67)..(68): n is a, c, g, or t
  misc_feature (85)..(85): n is a, c, g, or t
  misc_feature (100)..(100): n is a, c, g, or t
  misc_feature (135)..(135): n is a, c, g, or t
taccccaccactcctatagatcagtagaatgaaaaagaaaaaaaacacttaactganagcnaacaanngaacctaattatactgnatacaaataccctanccatgctgtagagaaaaaaagcaagaacgaactantccaaggaactaaaaaacacaaagtctaagcctttagactttggcagggtaaggtaagaaagtggaagaatggcaaataaatcctgaactttttaggtttgtttgttatgagacagagttcgctctgttgcccagagtctttttaaaattatcaaagaattaatcattagcccatccttatagcaaccaggattctttttcttttctcctcttctgggtttactgactgttggaagtggtgaacaaaaagcaaacatgaagtccataaagcacgtttcacatttttagccactcagataatgattctctagaagagaagattgaatttaaggaagaatatgagattgagaataaagtatagatttcaattattcgggctgatgccaatctccatttccatggataatcaaaggctgagtgagttagacataatttttgcacctaactgggaagacagcagacttaaaacact

SEQ ID NO: 194127 - DNA, 597 bp, Homo sapiens
agtgtgctgagttatctagaggatcccgtgtggcagacggggtctcattttggggcttcagtgatcttcccacctcagtctcctgagaagctgggactacaggtgtgtgccaccacacccagttaatttttttaaatttttttgttgagatggggtctcgctatgttacccagctggtctcaagctcctggcctcaactgatcctctagccttggcttcccaaagtgttgggattacaggcatgaaccactgttgcccagagtctttttaaaattatcaaagaattaatcattagcccatccttatagcaaccaggattctttttcttttctcctcttctgggtttactgactgttggaagtggtgaacaaaaagcaaacatgaagtccataaagcacgtttcacatttttagccactcagataatgattctctagaagagaagattgaatttaaggaagaatatgagattgagaataaagtatagatttcaattattcgggctgatgccaatctccatttccatggataatcaaaggctgagtgagttagacataatttttgcacctaactgggaagacagcagacttaaaacact

SEQ ID NO: 194128 - DNA, 520 bp, Homo sapiens
ctggaatgttgtggctggtatgggcttgatacattatccagcactaactccattcacactttattctgaagcgagaaagagccccggcaaggtgatctgacgtgcccacaccagacggaaggcagttcagcaccaggacaagaacttggctttcctagcattttcccagtttcagtagctaggccaaacgtgctctctattctgcaatgctggctcatgttttaccattttcacaggaaacctgatttgggaattttaaatggaaaaactgtcatttagtgttctttttcttttctaataacaatagttaatattgaccacacacatgtgccaggaagcactctaaatactttatacccatgaaccatctaatctcctcagcaggcagatatctccatttcaaagatgaagagactgagcctttagaaactttcaagggtgtttccaaggatatacagtttaggaggacaaagatttcacccaggctaatctgattctaagatattattttacattttat

SEQ ID NO: 194129 - DNA, 326 bp, Homo sapiens
gatgtatccccaacactgcatgaacttctcaagttccttcattcacaatttctctcctctcttctcacaatagtaattttactctcaacacttcgtgttattaaccatgtcaaatatgtgagtgtgtgcctacctcctaacaagcctgagagtccatggaattaaatgcaagattccaaggaatatgcctagcacagtgctttaggtttgtagctacccaataagtactgaatttttgtacttacaaaaactccctatggtgaaattcattccctcaatcaaaacatatgagaggacaattctatcaagtactgtgttgggcgata

SEQ ID NO: 194130 - DNA, 407 bp, Homo sapiens
aggttgcgatatgtgttcagtgagtaattatatctgtttgtgtgttttctcaaatgttgtgctgtgtttagcacattttaaaagagtaatttgagtcgctgtgtttattttaaattagagtaatcatccattaacctattctgtcagtgtttctcaaagttaaccagctgtatcagaaatcgcctcaggttttttatttgaaaatgcaaatatttgggcccttttcagtcatatctaaatctcttggaatgaggccttataaagagcagtaggtaaatcatatacactaaagtttcttactttagaagtgtgtaaataagaaccactgacaatagtgattacaggtgagactttggggaccagatgagttccttggcacaagttgattcatgaacaccacagtttta

SEQ ID NO: 194131 - DNA, 238 bp, Homo sapiens
aagatttctagattggatgctgagctagtgaagtataaggaccagatcaagatgagagggggtcctacaaagaatatgattacgcagaaagccttgcgagttttaaaacaaaagcggatgtatgagcagcagcaggaatcgcacccaagagtcattcaacatgaaacaagttaattacaccatccagtcattgaaggataccaagaacacggttgatgctatgaaactgggagcaaag

SEQ ID NO: 194132 - DNA, 439 bp, Homo sapiens
agtcccgaggtgacaaaaaaattagggaccagtgctctataggaaattgtgaggaactgaccgtagaatgatcctcttctcaccttgcaaccctcctctccagtcccagaggccaggacagttggcatttgtacccagtggtgtgggtttccaccagccctgctgcacctgtctggtagtccagtggaggagatgacaaaaagggacaatgtggctaacatctgcatgactgttcataagaaccataaacacgaggctgttcccactaccgcgtgaaaggatagaggggcttggtgtgtgtagggcacagcttttctgaaaggcagaaggattctttttatgattttaccacgtatcatttcctttttttttttttggtatgggaagtccacttcctatctggcttggctttttaaatgggctttttggtcacctcttt

SEQ ID NO: 194133 - DNA, 1065 bp, Homo sapiens
tgcccagcacagggcccagagcacagcaggtgcccaccacagctttgtccattggacagaagaaatgaacaagagggctggcctcatttctgcccccttcctggccctggtgcatgctacaaaaggccaggggtcactgcggctctgaaatctactcattttcttgaaacacacagaaaagatgtttctgggatggatgtgtcaaggaaaaaaaaaaaaggctgaagttgagaattccagctcagcacatgtcctccagccctcacagacatgacgagggattaaaacgccttttctcctcatttgcccaacatctcaggagaaagccaagtggcgtccccatcagggctgtcctgggcacccgctggctacgaagacaacctcctcattagcctggctttcctctgaaaatgagctcacacagactgcattgtgcgtgcctgtgtgaacgtgtgtggtgtcaggtaccccttaccgtgctccagacccattcccatatggaataaagctgacttccgagtacttacaatgggctaggcattgcacggagcaccatggactcgttcactcacaaccccatgaggtccatgttcttatcccattttctagatgatttgcctacatgtatgaaagcatgcccacatgcatgcatgtctactcgtgcataaaatgtgcttacatgtgcaacccagtctttatatatccatatgcaaacatatgtgcatgtctgtgtgtctctgtacacatatgtgtgtatgtgtgtacacatcttcctgttatgtcctctttcaaaatgggtactcttttttctttgagatggggtcttgctctgtcacccaggctggagggtagtggtgtgatcatggctcactgtagcattgatctcccaggctcaagcgaccctctggccttagcctcctgagtagctgggactacaggcacatgccaccatgcccggcctcatttaagagatttttgaaatagtaggtggaacaaaaatacagccataaaatagaagctgggaggaataggattggaattacaacatactaaaattgtttggga

SEQ ID NO: 194134 - DNA, 495 bp, Homo sapiens
ggtgagtttctcaatcttgctattgtgaaggaaaagactgaaaattgctctccgccgcccacactggccatgcagggaagggctcacgcttcatgctctggaggcacagtggttaggaacacaggtcccatggctgggctgcctgggttctcaccccacctctgccatttaccagcggtgaggctcagcttgctcaccatatagatgagggacaatgacagcacttaaccatagtgggagttttgcagcattaaagaagagaattcgagtcaagtgcctagtacagagcctggcacatggtaagtctaccataaatggtaacaattcacttgatttttattttattttagtgatagagttttgctctttttgcccaggctggagtgcaatagcacaacctgagctcactctcgtctgggcgacaggtgggaccctgtccctaaacaaagcgagcctatttggcacagctttgatgcggggtggaatctgatggcg

SEQ ID NO: 194135 - DNA, 207 bp, Homo sapiens
atagaaggttgtggcagggcggcagaggttgccagtgcagttgcagcatcatgctcatgctattccaacctgggtgagagtgagacgccatctcaaaataaataaataaataaataaataaagtaataacaatgtcagtgatgacttcatgttgagcagggcattcgttcacagcggtattgtcactgtccatctccacgcccgcac

SEQ ID NO: 194136 - DNA, 370 bp, Homo sapiens
tacctgatcatcgtgtcccaccccccaaatgttacagtgacacaagcaaggtgttcacaataattacatggggggaattttttaaaccaccaacaataacgaagaataaaatccactcactctgctgctgtttcaaaatttcaatgttagtttttgcacgcccttcccccccccaaccctgtttgtaaggaactaaaacattacatctggtgaacagcaaagatttcactacacctcaaatgcagaacacctatgaagcagaggaatggacacgaatgttcatgaacattcgtgtccctcaccagcccgacccgttcttctgccagcgcccggcctcgccccgcgcccggagctccctttcccttcctta

SEQ ID NO: 194137 - DNA, 523 bp, Homo sapiens
ctagacactgatacttaaactttttttctataaatgaattacatattaaattctaatccctatttttcccatcggaccaaggtaaatagatattctcaatatcagcttcttaagatcagacacacaaacaattagatatgatttacaaggcaatgttacatgacaaatgtatttttaaaattatttaactgaatgactttgcctttaaataaagacagtatcttcaaatatatattttccaaagtaatattactaatatgaatggaaacatatgagttcaaataaatctagcatagtaaactgcaattttctaacattaggtaaatgctcagttataggctgaaaatagctatggtactagtgagcttaaatccttgtgtggcaatataacataaatgttaaaagcataggctttggaactaaataaaatgaatttggtttcctaatctgcaaaatagatatgatagcatttgcacctcacagagttattgtgatgaaatgttattgcctggcaagtgtttag

SEQ ID NO: 194138 - DNA, 262 bp, Homo sapiens
tgcgctgagcatacgtgacaggggcagtgagcacctgggctaaggatagctattctactcctccggcattgttcttcttacagagttgagagctcctctgcactttgtgtatgccatcggccagctgatagtactttgcaactctgatcaatcaacatgcttgcagattgttacaatcttgccgttttcccatccacgataatcgcatggctgtatcttaatgccagtttactgagttgtattgccagcgctggctttctaa

SEQ ID NO: 194139 - DNA, 368 bp, Homo sapiens
agagctggtggagttcggcctcagcacagaacctgagtgaagaagctgtccaaatgggtttctcctttccctacctgcaggcttacccttcatctgacccatcctgtaaactgatactaagacagcaattcttaaatacctcttccaatgtgtcaggtacctaccaggacttcccagatcctacccgactccgtcacttcttcctctgtcccagctcctcatagccaaagtcacttcccctaccccggtcatctaccctctgtttgctcagtccatggggaatggcctcctacacctcatcctagactttggctctgcacccttcccacatctctgcccttccaaaccctcctcctccccacggcatg

SEQ ID NO: 194140 - DNA, 308 bp, Homo sapiens
taataaatgagggtgatactgacacaagataatcaggctgaacaatagtccaggtgagagttatgtaggtttaaactagggcactagcaatgggtagagagtacaggatagattccaaagggattaggaataaaagttgacagaatttatggtgtggttggttggggtgggggagcagggggctgtgtggtgagagaaaggactttctctttttctccatgaacacaaagtagttaagacatgaaacctgagatgtcatattgtaagaattatgcagaaatgggggtttgtaaaatgtgtgtatatga

SEQ ID NO: 194141 - DNA, 320 bp, Homo sapiens
aaataaacctattgtacaggatggaccaatcatgaggcattttcactctgatgttggcagtggatgtgttgacattgagaggatattcatggtggcaggctgcccccagttccaggttttggatatttggaataaggtaggctatgacaggccgggtgcaatagcttatgcctgtaatcccagcactttgggaggccaaggcaggcggatcacgaggtcaggagatcgagaccatcctggctaacatgaaaccccgtctctactaaaaatacaaaaaattagctgggcgtggtggcgggcacctgtagtcccagctactc

SEQ ID NO: 194142 - DNA, 398 bp, Homo sapiens
taaggaccagcctgagtggccagtgacaggagctgacctctgacccccagggctgggaagcagtccacgtcaaactcttacagcgcgacccttttagcacgcatagtaactcggggcatcgccagctgaagctcattaaagctgtctctttggtgcgagggccattaacctcactgctcaaaacccacgcctccccttccccgcctctcccagcccaattaatgccctgcatcctccctcccttccaagcaccctcacccacacctcagagccagcctggaggtggcagggcagccctcttcattcaaagactacaaagaccaagtgtcaagaagcccagtgtcctggggagccgctggtgctggcaacagagtagggagccccttcagccccatggt

SEQ ID NO: 194143 - DNA, 335 bp, Homo sapiens
gccttttctaaccatttctttcacatatcaaagattccttttgatatcactgttgttcttgaagcttgtcattgacaagtttctttcatgagaagatttttgacaatgaagtctctttatgtgtctgaaggaaacttatttatagaagatagttttgttgaaaatgattgtaggtttatactttttcctggaacttgaaagatggtatttgattgacagttggcttctgactgttgaggagtcaactctcattataaccatgtcagctctttgtatgcagtctctcttcctaaatcctttcaagtcttcttctctgtctttggtgtggtgtcatc

SEQ ID NO: 194144 - DNA, 475 bp, Homo sapiens
cccacccaacgtaggaaattgtccttaataacatctacagatcaacctaaagactctagatgaactccagttgaataatagcagaacattgtttttgagagatttcattcagttgctggatttcccatcaaactaaagctccatgagcagagaagccatgaccacctgtgatcatcttacccagttcctaagcacagagcaaaatcacaataaataaaggtattaaatgagtgatgaaattctaacaatatggctgaaagagaggataccatagtggttaagactatggatttggatgcccatcctgttacttactctgcaatgtcagtaccattatataacctccatatgcctcagcttcctcctctctaaagtaagcatgctaataccttcaagtcatgacattgctgtgggaattaagaatcaatacatgaaaattacttagaaccatgaccggaaattgctcagtaagtgt

SEQ ID NO: 194145 - DNA, 170 bp, Homo sapiens
gatacccaagacaaaaatcaactgtactacgggacacatcccaatttagacatttctaacaagaaacataaaaattccccaacatttatgttatagagcgttcacttcagtgaccaaagtttaattatctttccaatcacacaaggcactaccccaattctacatctgac

SEQ ID NO: 194146 - DNA, 267 bp, Homo sapiens
gtaatccatgtagaggtttttacagctttccctcccctacctctacttaaaggtcttcatgcgatcaaattaattgtaagcagctgttaaaggattgcaagcaactgttaaaggagaaaataagtttaagggtgagttctataaaataatcacttttgattcgccaaagtctatctcattggtagaaataaacagcaaaatcaaattattttttacataaaaaaattaatttcaatttcttcacaagcatgtttgacatcagttcct

SEQ ID NO: 194147 - DNA, 329 bp, Homo sapiens
cagagagtaacccaagggcctcttggaaggttcccttccttctacagtgcagagagggggaatgtggaaggtgaacgtgcaagtattagcagccacactataaacaaggaaactgaggccagggagggtgggggaaggaaataaatgttttttctgtgcttattctgtgccagccactgagctgggagatacttatttcttagtcctccccacacccttttaagggataaaacattttcccccagcctggccaaattggtgaaagcctctctctactaaaaatacaaaaattagctgggcatggtagtgtgtgcctgtaatcccagcta

SEQ ID NO: 194148 - DNA, 480 bp, Homo sapiens
tttagagacgggatcttgctatgtggacctagcttgagtgcaatggctggctattcacaggtcctatcatcgcgcattacagcctggaacccctgagctcaagtggtcctcctgcctcagcctactgagtagctggagctacagcatacaacaccatacccagctagaaagtgttttaaactgaatgaaaatgaaacttcggccaggcacagtggctcaagcccgtaatcccagcacgctgggagaccgaggccggtggatcacttgagatcaggagtttgacaacagcctgaccaacatggcaaaaccctgactccactaaaatacaaaaaattaactgagcatggtggcgggcgcctgtaatcccagctacttaagagactgaggcaagagaattgcttgaggctgggaggcagaggttgcagtgagccaagactgcaccactgcactccagcctggacgatggaacaagactgtctc

SEQ ID NO: 194149 - DNA, 513 bp, Homo sapiens
atctctttcctcaagtttgctgtgtgctggctgcattctaaagtgagttttccttatgaggggtatgaagatggaacctagcaactgtagactttgatagtccttcatgcttttaatctcagaaagaaagaaacacaccaaaccccttttccagcacccctatcaatcctcaagaagggactcttgctgccttgcttggctgatgtcaccactcctctggtgagaggcaggaacatgagaggaacagtcccacccaaaccacattgagaactgcagaaatagttcgtcagtggctataggtaccatgcttccaaaagaaggcgtaacaatgtctgggtaaggaaaacaaacaaaactgatagcaaaaaatgttattctcagagtcttattatccccattctacagatgagaaaacagaagccccacaaatcatgggttatggagaaaaaaaagcttgggagaacaaggaagtttttagcaccaggcatgacctcctcctgcctttatttacct

SEQ ID NO: 194150 - DNA, 467 bp, Homo sapiens
tcaagctcggtcccccagggtcttttcccctcaaatttgaattctattcattctttctgtcccgatcaagcctgcacactactctaacatctacaaatcagcactttcaccactgagttgtaatgattaagttctacagctttattccccaataaaactatcagttctttgggagtacagacggtgtgtgtctgtcttatccactgataatattcaacaaatatttaagtgcccactatgtaacatgcttaaatgtatgctctatattgggaggtgctcaataaatatatgagaaatgaatgccatataccaaggagtattttcctattcataatgtaatgctggcatttttcttgtttataatcactaatcacgggtagtcttgtactgttatttgaattttcttatgtgtatgtattctcgctaatgcaacagtggtgtttgaggggaaaaggcctacatatttc

SEQ ID NO: 194151 - DNA, 382 bp, Homo sapiens
actcagcttgtagtgttttatttctgcactaaacaatataattctaaaggcttctaagaacaaagaactttattacattgaactaaaagccagctgaattgtttgtgataataacaacaaaatctaaagacccttgatatgggaaatggctataaagtatacccttagtatgcagctattaaaaagaaagaggtagacctattagtactacatgggactcagtgaaaagagatgaatgaaaaaagaacggcacaatagtatggtgctattatatttatataaaacacacatacccagcatatatatgcaaatatacagaaaaaaaatcaagaaaggagacacaaaaccagtaacaacagaagatggaaaaggatttggaaaa

SEQ ID NO: 194152 - DNA, 517 bp, Homo sapiens
tcctaaattaagaacttctacttatagctccctgaacacacaaggctattttaagcctctgcaccctcatgttccttcagccttgaatgcaactttttgtaacgcaacttcgtggaaagaattcctattcatcctacaaaaccctattcaggtgttcccatctgataaagcccctcaataatgatgactttctctcactcctgaaaagaattaatctcttttcttggatatttagtaagaacttagatttaccgagctcttactatgtgccaggcactatgctaagcattttatccacattatcttattgaatcgtcaacagtacctacaagataagcactgttataatcttcttttacagataagaaaatagaggctcagattctgaccctcctgagtagctgggactacaggcgtctgccaccacgctgggctaattttttgtatttttagtagaggcggagtttcaccgtgttagccaggatggtctcgatctcctgacctcgtgatccgccca

SEQ ID NO: 194153 - DNA, 312 bp, Homo sapiens
tagatgattgtatctaattggtcaggtaaagaatcctcctgagatttagatcacataaaatgctaaaatcatagatgttcggaaggcaccttttgaggtcatccagtctcacctggcaccctggcctagcatccttgccaggaagccagtccgtccctgtctgaagcatgatggtgtcagtcctctgcaggggagttggccaatgctgaagagcagaaagagctacttccttgccccttcctctactcagtcctcctagcctctgccactcagtcctttgcatgagagacattaaaaactctccgactttcc

SEQ ID NO: 194154 - DNA, 516 bp, Homo sapiens
gctgtaggaacagtgagctctggttccaaagtaaagaccaagactggtggtgctaaaaaggcttttcatgctgtttgtatgtgtgtctggaataggcagtatggaatttgggacatttgatgttttactgagaagactattgtaatccaagcagctttctctcttgttatgctaatcattccctggaacctcttcccttctccaggttcaggcctcatctccagtggcactgggtgtaaggattcccactgtggctcttcacatgatggaactgtttgacacaactgtagagcagctgtatagcatcttcactgtaaaggaggtaagtaactccctaagctagcatgttaagtgctgacattgggagaaaatacattacaaagaacaggagctggtttttggttttccttgtggctgtgtttttgattgaagggatgtgggatggtggtgacagaagtctgagcatagtttctgaataattggaggggagatgggcattctttgggactatgtccg

SEQ ID NO: 194155 - DNA, 484 bp, Homo sapiens
gcaaatgtccatttgagtttattagaaacaattctccaaaatgattggcattttaccttgtactagcagagtctaggagtgtggctgctcccagattctcatcaaactacagtgctgacatctttagttctaggccttctagtgtggatgcactggtatcttgttaaatgcttttaactgttttggtagagatggggccttgctgtattgcatagtctggtcttgaacacctggcctcaagtgatctccagcctcaccctcccgaagtgctgggattacaggtgtgagccactgctctgggcctcattcagtgttttgcttctccctgacaactaatggagttaagctcgttttcatgtttattggccattaagtcatcttgcttttggaagtgccaattgttaactggcttgtcctcttctttttgccttacacagttaatacatgctggagattacatgtactgcaaagattttctcctagc

SEQ ID NO: 194156 - DNA, 393 bp, Homo sapiens
ttccccgcctgtgggctaatttcccacgtttccacactgtctccccttgaaggacacagaagtgaatctctgcagaagggaaaagacctctgagtgacttccatcctctcccctatgctctggcacaatggcttgtacataagccatacaaagtagcagtggcctcacagtgactagcagacacagaagagctaggagaaagctggagctgccgactccttgtgcctctggctgacctccagaggccagcaaacctctcatcttacctcctattgccttccccagccctgggctgtatgtcacactgtgtgcaccgtattaaaacgtactgaatgggccgggcacagtggctcacgcctgtaaatcccatcacttttgagaggctgaggcagg

SEQ ID NO: 194157 - DNA, 203 bp, Homo sapiens
attgcctcattcatatgaattggtttctcaatgcttaattttgctgctttggggctagaaaacaaaaaaccaggatggtctatagtccctaattctgtcttcctagaattttaaaacccagtcaatcctaaaggaactcttctatgcatgaccagtttttaaatcttggatgtaggaagatagcaatcagaacatcaaaggtt

SEQ ID NO: 194158 - DNA, 130 bp, Homo sapiens
atctcgaagtatctcaaaaagtcgctcccgttccaggtcgcggagcaaaggtcgatcacgttctcgatcaaaaggcaggaaatctagatcaaagagcaaatctaagcccaagtctgatcggggctcccat

SEQ ID NO: 194159 - DNA, 671 bp, Homo sapiens
tgtccataacccatggtgcctgctctggcacacagcgggacctggaggctgggcgggcagggcagtgtgccgttccttctcttgctgcataaccagccatgggtcatgctctatcctcaccctggccctgcagcaaggctgtgcagcacctgctcatgctcttatctcacagagagatgccatcaaactgtccccatcatcaccaggatgtgtcactacctcacaccatcctggagccaggagccaccgccagctcagtggcttctgtcagcatggtccatcactcctcacgatgctgtcgtctgcgctaggctcatccagacggttctgctccgtggcgtgtgctggggctggagtgttcacaggggctgctgagcaggtccccacgctgcctctgtgatgccttgagctcctccaggttgtctgagtttctacagccacggccacgtccaagaggggagaggcaggacccccagtcctcctaagagtttggcttggaactggtgcagagtgacttctgccctttgtgttggtcagagcagggcacaaggacagcccagcttcagaggaaggagaaatagagtccacctcttcccatgaggccagaatacatcatacaggcaggaaaggcatttagaatcctttctggagacttctatagccagcaggtt

SEQ ID NO: 194160 - DNA, 493 bp, Homo sapiens
tggcaataattatcccacagactctgtctaaaaatgcatttgccatgaaaataaatgagagcacatgtaaaaaaggaaatgcagcaatgcatgcaacggaagttagaaagattacagttttaagataaagatgttttgtctacagcaaacaaagtgttcaaatcctctattaaccaatttaacaaagagttatctttcctttgtttctgtccaaacacactaaatggattttggaaaaatctcttctcacgttcttgttgtcatttaatcaccaggtttttaacgctacttccaaaccaatttttcatgggctttgcttccaaaaagaaaacattttagcattccatattgtggataggtcattgtcactggctaagctatcagagtatctaaataaaactttatccactcatttctgtattgtctatagcaggctgaaagctgctataaaaaggaatctgaacttaaagtttcttttttttttttttttgag

SEQ ID NO: 194161 - DNA, 154 bp, Homo sapiens
agtaccattgatggccaattgatttgatggtaaaggagggatcgttgacctcgtctgttatgtaaaggatgcgtagggatgggagggcgataaggactactgattgagttggctgtgtagaggtacctgagctacgaattctgtacatcattgg

SEQ ID NO: 194162 - DNA, 491 bp, Homo sapiens
tagccccccaccccccaaaaaaatgttgtgaagagttttatactctccatacaaagttactgtaaaaacataaaatttatataggctgagtgtggtggctcatgcctgtcatcccaacactttaggaggccgaggtgggcagatctatgagttttgaccaaatgtacactgtaatgtaaccatcaccacaatcaagatgcagaacgtttccatcgctccaaaaaattcaaaaacaaatcctggtcaaatcttaagttacccttataacagattagagagtacattgattaattaagtctaacgatatcctataaactacaatctagcccaaactatattacagcttcagtctcatttcctggcacatctttccccaccatattcaaagccggttagagaaatggttaccaaatcacagttctagagccataatgtaccactcttatatttcatatgtggattctgaatatctgaatggaacagaacttgtt

SEQ ID NO: 194163 - DNA, 434 bp, Homo sapiens
aacgctgctgtgtgcaaacctaaatgtcagtcatatcgtggagtagaaaaagagaaagttgaagttctagacccagctttgccccttactagccttgggttctggagcaagccacctggtctgaaagtggctttcctgggctatgacagtgcatagtacagtctgccctgtggggctcaccaacctgcagataggagcaaacaaagccatgcacaggaagatgcaggcaatgcacggtgttagtaaaagaccatctcagaaataggagccactgttttcctaagcccaaatggactaattagcccagacagccccctcactcatacccatgttgaatcagtcccagaaacactgtcaattccaactaagcaatgtcccttgattctgcactctcctctccagctgcaggaccaatgtcttgggtttcttttacg

SEQ ID NO: 194164 - DNA, 426 bp, Homo sapiens
ctatctcccaccttgtatctcaaagtttccttcttggaagcctttcttgactccccttaaaaaaaaaaatggtgattttttccatgggtgctcccaaaacaccaaaatacacaatacatttctgtatgtatgtaggtatgtatgtatgtctttattttggaggcagggtcttgctatgttgcccaggctgcagtgcagtggctattcacaggtgtgatcatagcacactgcagccttaaactcctgggctcaagcagtcctcactccatggcctccctctccagtagctggaattacagacactacggtatcacccagccctgcaatacctttattattgttttccctgctgcaagttctttgagctcggacagtcttgttgacctgtgcagcacctaagcttagcacctaggagtttctcaaaaa

SEQ ID NO: 194165 - DNA, 773 bp, Homo sapiens
gctcactgcaagctccgcctcctgggttcacgccattctcctgcttcagcctcccgagtagctgggactacaggcaaccaccaccacacccggctaattttttgtattattattattatttttagtagagacggggtttcaccgtgttagccaagatggtctcgatctcctgacctcgtgatctgcccacctcagcctcccaaaatgctgggattacaggtgtgagccaccatgctggccttttttttttttttaaatacagacacagtctcattatgttgcccaggctggtctcaaactcttgagctcgagcaatcctcccgtcttggcctcccaaagtgttaggattacaggtgtgagctaccactccttgaccccaagacaatatcttaactgtaaaaattaaactctaccatattttaaaaagctgagatagtataaatgtttataataaaacataaaaccaacatttctcacaagtctttgtaactagtagagactgtagttgttctgtccagatataagtgtggtatatcaacttggcacttagcaacattgatatttaatttgttaaatttttgttaggaagaggtgttttcagatctcaggtgtcttgggaaggaatatttttatatttatatctccagcttcattcctagcttttctttggaacactaaaattgtccagctggacttgttgggcctgggtgggattgggagaattcaggagagcacagttcttgggccagaacagttggtcagctgattgactc

SEQ ID NO: 194166 - DNA, 471 bp, Homo sapiens
taggtgacagagttgccttgtctcaaaaagcaaataaagaaattaaaataaataaaaaataaaataagcaagccagagaggagtagtctaccttattatgaattctttcaggacaacccccaagtcagtcaaaccttcctatccctgctctttttttgtctgcttgtgccttttcaatgtacttaacatgccaggtgtggtagctcatgcctgtaatcctagcactttgggaggctgaggtgggcagattgcttgagctcaggagttcgagaccatcctggacaacatggcaaaaccccatctctactaaaaatacaaaaactagctgggcgtggtggtgggtgcctgtagtcccagctactcgggaggctgaggtggaagtatcacctgagcccgggaggttgaggctgcagtgagccgtgttcaggccactgcactccagcctgggtgacagagggaggccctgtttca

SEQ ID NO: 194167 - DNA, 369 bp, Homo sapiens
ttggaggtagattctagcaggatccccggtcagacaaatggtcatgcaccaattttaggaagccttttatgactctcccaagtagactgagtcactgttattcagtgctcccagcctatgctcacctccattatagacagtaattaccactctgtaattgcttgtttatataattacagggcttttgatccctgacacaagcaaaatgtctggcaccaaaagttggcactaaatgaatcacagaaaacaaagacgtgataggaatggggcagtaagtgggaatgaggaaaagggaagaagactggcagcctagaagggaacactgcaaaagtctgaaaaagtctcaagtccagactcacatctctatgt

SEQ ID NO: 194168 - DNA, 251 bp, Homo sapiens
tctcaattcatctgagttattaataaagaattcacaaagtttcccagagacattcacattttttcaattatgaaaacggaaaaaaatacaaccaccttagaaacttttgggtgcatttagctaaagaaaattttggaagccaatattatacatctaaagtgtcataagtagctttattctagggctgcagtctagtcactttaaaaatgtgtccagccaggcaccgtggctcacgtctgtaatcccagtat

SEQ ID NO: 194169 - DNA, 348 bp, Homo sapiens
atcccagctacctgggaggctgaggcagagaattgcttaaacctgggaggcggaggttgcagtgagccaagactgcgccactgcactccagcctgggtgacagagtgagactccatcttcaaaaaaaaaaaacaaaaatgaaccccagattaagtgacttgtctcaatggcacattactaggcactagcatagctaatactagaatatacattatctgactcttagtctgaatctgtgtacactgtactatgatataacagaagggtttttcatagcttgacattttgatcaatctatgtattataattaggaataattggatatgataatgctttacatacatttgt

SEQ ID NO: 194170 - DNA, 774 bp, Homo sapiens
catgtaggcttagaaaacttaatttttaatgccccttctatctttcatcaggctaaagcttttggatttatggttattcattctagctataaatatattaatagtattttgggctggtcagatatggggcatgacctttgacatcctgcttggctatgcctgggaatttgacatccttcaatttaggtggaattcccttgttttgtttcctgtgatagtgtggggaaatacacattttggctccttcggcagaggaagacaggaaaaaagtaaaattggaatgcactaagaaagtattaatgattttatttctgctgtgtatagttgaatgcacatgctttttatggaagcctgagcctatgaaaatagtgcacaataataagaaaatgctaacaatcatatttagtttttgcattttttaatttggatttattttttgactagtttgacatttttgggtttttgaactgtttgcatctaagtatacatggtggaaagaactttttgtgatgcctttactagtattatcagtacagagtatcaacagttgggaagagctacaaaagggaactcttagccggtgtgtattttgacctgaggaagggagtgttctgttgctaccaactaaaagtttatgagtgtgcttctgtttcctgaatgtaatcagcacctccatcaataattatccctgtaggggaacacaatatggctttcctctactgtaggttctttgactgagccaataattaaattgacataaggcagactaacaag

SEQ ID NO: 194171 - DNA, 462 bp, Homo sapiens
gccctaagcccactgtgtgggcgtcccatctcgtacagtggccgtctccagcctccactgggcccaaataggtaaaaagaaagcctggggaaggaagagccaggaaacctcgggagagtggaatttcaggaatggcaggtcagaactggttccagcatgggtccctttgccttgtgcttagctgagggatttttgttattaattttttttttcctgttcaacactcctaacctcttttgaatttcagttctctttttttatcctgaaggattattttattgtacttttgagggttttttttttttttttgccttgcacaaagtactgactcatgttgctaatggctgtggctgtatgctagttatatgtctcattatcctaccccttaagattgatcatttctgtgttggtttctatttcaaaccagaataggccaggtgggtcaattcatgtatttctgaa

SEQ ID NO: 194172 - DNA, 472 bp, Homo sapiens
ttttttttcccatgccccctgaggctctgttctttatatacaactttaatatacaattaagttgcagttgttacttacaacctacttgttgaatgttgacccaaatatgtttctttggtatctttaacacttggcttataatggctgtgttacaacttactcagataactgctaataaacattactggaatgtactggaggaagcttttcccactatatagtcagctgttgcttttttcttaaaagatgaaacaaaagactaattaacagacaaacataacaggccaggcgtggtggctcacacctgtaatcccagcactttggaggccgaggtgggtggactgcctgaggtcaggagtttgaggccagcctggctaacattctgaaacccatctctactaaaaatacaaaaagtagctgggagtggtggcgcatgcctatagtcctagctactcaggaggctgaggcagga

SEQ ID NO: 194173 - DNA, 637 bp, Homo sapiens
gtaatgtgttgccttaggacgatgttaggtgttatgactgctaggacatcactaggtgacaggaattttccagctccaatgtaatcttatgggatcaccatcatacatgcagtccatcattgaccaaaatgacatgactgcagttggatgcaatattggcatccaattatttggccagctttggtgattgttatggactgaatgtttgtcttcccacaaaattcatatgttgaagccctaacgacacccagagaggcctctaaggaagtatagtagttaagattaaatgatggcataagggtgggccctaatccaacaggattgatgtctttctaagaagagaggaccagagcctcttgctgtctgtggacaggcactgaggaaaggccatggagagaaggcacccacatgcaagccaggaagaacgtcctcaccagaaactgagttggccaaaaccttgatcttggatgtcaaagccttgaattgcgagaaaataaatttctgttgtttaggtcaccagtctatgctattttctaatgacagcctgtgcagacgacaatgattaataggatgaggtgaatgcaaaggaaagctttctagtctgggagactaaagggacaagtggtgccacttactg

SEQ ID NO: 194174 - DNA, 249 bp, Homo sapiens
taatgcacagggtggaatgaagagtgaagaggttggagaaaagactagttagaacctttaactaagctgcatgtggaaaggaaggaacaaattaaattacaagagatttttttttcccaaaggagcatgtacctgaacttggtttccaactgaagagatgtggggaggctatgaagaaggagttgacaaacatacctttaagattttgagtggtagtagtacctgcagcagtgtaataggtttaggagg

SEQ ID NO: 194175 - DNA, 548 bp, Homo sapiens
tctctctaaccagcaaaccatcttaattatgggcagtatttttctacttccttagcaattaaatggcatttggcaaacagttggtaacacacgattgcagtggattaagcaggaattgagcagggaagtgggatttttgtatgttcttcctattaaaatttatttaaaataaaaatcacatcaaggtacctacattgcctattgctagataagtggagtagaaagacaatatgcagtggagagaatcagtaaaactaagagttggtccttcaaaaagacgtgaccaaaaatatactagagataaagtggatcaggaaaaggagataatacacataagcaattttaggaaagagaaaagagacttaggtatagataaagcagacatttaaaaaataataggatattatagacaacttgatgccaataaatttgaacatacaggtgaagcaggtacagtactagaaaaaagacatgttgctaaagctgtctcaagaaaaagtgaaaaacggagataatctcataataaatttagggtagatggggtaccg

SEQ ID NO: 194176 - DNA, 532 bp, Homo sapiens
ggtctcaagtgatccttccacctaggcctcccaaagcactgggattacagtgttagccactgtgcccagcctaaaatatgttagttttttgttgctgcaaaatacattagcacaaacttcagggtctcaaaacaacatacgtttattatctcaggataataaatgatcaggagtctggcatgacttagttaggtcttttgcttagggtctcacaagactaattgaagtgtcccaccaggatgcattctcatctagacacttgactggggaagaatccatgtccaagctcactcaggttgttggcggaattcatttccttgcagccttaggtatgaggacacccgcttcttgctggttgctggctggaagacgcctttaattctgagaggctgcccgcacttcctagaggagcttgaagctcctggccatgtggactttccccacacgaccacttacatcatgaaaccagcaaggactgctgagtaaataattatgctgagtaaaagaaactgatcaaaatacagtacatact

SEQ ID NO: 194177 - DNA, 638 bp, Homo sapiens
ataatggggcaaaaatgacacagaattaaagaaatggtttgatgatcttttccctcttcccacattccttggcaaagccatcctgcatcacagaaatagccccaaagcttcatttataaactaaatgtaagtatatgctacttcttcctgctccattaccagctggtctctgtggtagttatgctgtttggtttagatgacagtcatcacttctctgggaaggagaagaaaagtgggccaggatgaatatttgttgaagactaggtgccatcttctctctgaagtgtcaacgtacgttgacacttcaggtcaggagtttgagaccagcctggccaacatggtgaaaccccgtctctaccaaaaatacaaaattagccaggcgtggtggcgcgtgcctgtaatcccagctactcaggagactgaggcacaagagttgcttgaacccggtgggtggaggttgcagtgagccgacatcatgccactgcactccagcaggagcaacagagtgtgactctatctcaaaaaaataagaaataacacaatcaaataaaaataaacttcagaacaaatattatctgagctacagaaggacattccatatggataaggggtcattcatcatgactctgaagaatggt

SEQ ID NO: 194178 - DNA, 546 bp, Homo sapiens
taatttggagacagagtcttgctcttatagcccaggctggagtgcaatggcgcaatctcagctcactgcaacctccgcctccccgttcaagcaattctcctgggaggtggaggttgcagtgagcccagatcataccactgcacttcagcctgggcgatagagtgagacttcatctcaaaaataaaaaaataaagagttttgggaatagttcaaggacttgcttatggcaccgtggagtactagagttccaggtaacccagggtgagaagcacttatgtgtacttggtcccccaaaactaaacattgagaatatataaaatcctccttcccatgggaacatgcagaaattcccagaaagacatctcagcagcatctgggagaatgaggagatgcctccctggggtggattatatgggcgccttaattgggcttccggaccagagacgagatggtgtcagtacaaggacatattctggagcctgtgtagtactatctggctgtgggcaagtcaggctaaccttttagtcaagggatcccaagtgtgtc

SEQ ID NO: 194179 - DNA, 238 bp, Homo sapiens
cattcaggtcctgaaatatgcatttgtattctcaaaatatttataatttcttaatatgtaaaattttcattttagtaaattcagatgtcaagacaatgttagaaaaaaatggcaaattatattcagtcattctcagagcatttttatataacttcaaaggttgaacttcttcagttgatggccacaggtaatttctagccataagtaaatttccctagtgttttccaggtaagaatca

SEQ ID NO: 194180 - DNA, 448 bp, Homo sapiens
ctgtgattggcacctgtcatgaagtcctcagttaatctctaggtttcttcttcctaccttttttttttttttcagtccttgagatttatctgttgaagacactgtattgtttgtcccacagagttttccttcctaggttctaaattttacttgattttagccctgtcatgtcatttaaaatgttcctttgttgcctggatttcctataaattggcagttagatctagaggtttgatcagattcaagcttggttatttttggtaagactttatagatgcaatggtgcacctcttttgggaggcaaccagccatacccatgtgtgtgtgtgtgtgtgtgtgtgcacgtatgtgtgcatgtatataacagccgtattttaaaacatttatttaattactttctttttttttgaggcaggtttttgctcttttgcccaggctggagtgcagt

SEQ ID NO: 194181 - DNA, 150 bp, Homo sapiens
ctcaaaaaataaaaaaacaaaacttaactttggagcaaattaaaccaaattaagaaggaatggggttggcatgagctcctacttgtgtttacttgcgagtcgcaggaaaatccgggtccttggtcttgttgtttgtctgtaagacagcgt

SEQ ID NO: 194182 - DNA, 143 bp, Homo sapiens
taaccacacaaggaaagtgaatttattttcaacagttagtggactgtaaaatagggtgctaccaaattaaagagtgaacgaggaaatcaagcagaactggttcactaatagggcaataaacacataaaaataattctcaaggg

SEQ ID NO: 194183 - DNA, 415 bp, Homo sapiens
accatgcagaacctcaacgacagcctggtctcctacctggacaaggcgcgtgccctggaggaggccaacgctgacctggaggtgaagatccatgactggtaccagtggcagcggcctgctgagatcaaagactacagtccctacttcaagaccatcgaggatctgaggaacaagaacataatgggatggtgagtgcagacgacacacacggcctcagtctatgggaacatctcaaaggagttcgtctgcaaattctagtgcatctaggcagaacacaggaaggaagagaggtgcagacttacgtatggccctggggcacctgccatcccctcgagcctgtatggtccttacccgcccatccccagcttgagttctgggccttctcgccagcacatcgttgggacctggtcaactt

SEQ ID NO: 194184 - DNA, 297 bp, Homo sapiens
agaccacccaatattagaactctgtctgcttaaaagtaatagatttttccttagtatggatctgagttcaccacaaaattcatttattctggccatgtggtggctcatacttgtaatcccagtgctttgggagtctgggaagtgggggatcacttgaggtcaggagtttgagtccagcctggccaacatggtgaaaccctgtctctactaaaaactaaaaatacaaaaattagccgggcttggtggcaggcacctgtaatcccagctacttggaaggctgaggcaggagactcactt

SEQ ID NO: 194185 - DNA, 239 bp, Homo sapiens
tattgaattgtacattatctgaaaactgatttccaagcaataccgtgtaacaacctttcaagcaataatttaagccatggtgatgatgccatatgaagcttgcacttctttgcatttcatagagcctttgtgaaaacagaaacatgttttatacaagcaataatatagctggtgtggactttttaaagatactcattattctgtagcaaatgagcagcaagtaatgactcagattaaaa

SEQ ID NO: 194186 - DNA, 555 bp, Homo sapiens
taatatcacctcccaccccacgaccatgatttgtactttatttgaggagtttctgcatatttacttatttttttgccattttgatgtgcaggggtgtgagggtccaagagtagtctgcccattcttcctgtggctgtatcatcaattatatgacaattttaggttgtttctagaaaacagcgcatgaacgcttttgtacctaagtcattgcgtgcctatctgattatttcctgaggagtaaaatttcccgggagtggaaatgttggatcacaaagtttgcagattcttatttggattatttggcagtggaagtttcatgagaggtgtcagtgcagctggcagctgcgcagctgagataccctgtcatgatgtatttatgaccccggggattttgtaactccttactagaagcttaaggaaatacattgattagcggaggaagttagctcatgatactagattttcatttccatttttaggtcttctgtgaaccaggagaaggccatcttttctgttaattgcaaacaaggctcttgattcacatgctccattcat

SEQ ID NO: 194187 - DNA, 313 bp, Homo sapiens
acctaaatatttctgtggagaaaatggagtttttatcagcttgtttaggaatcatgagcaggaaagccctatggggaaaataatataggactctgtaactaatgtacagaactaactggaaaaatcagtttcagagaaaaataatttgagggcactgtgtccaggactgttttggtagcaattcagccatgaaacaaagcatatacctgcagggactctcctcttccctgccttgtctgcacagctgtttccaggttgcccatagccaaaatgtaagatttaaaattgatgccatatcaaagaaaataaagta

SEQ ID NO: 194188 - DNA, 241 bp, Homo sapiens
tacaagtatgtgccacccaacctggctaatcttttgtatttttagtggagacaggatttcaccatgttggccaggctggtctcgaactcctgacctcaggtgatcctcctgcctcggcccccccaaaatgctgggattacaggtgtgagccaccatgcccggcctctatgtagtcttttctaatcagaacataatatcatttgctcaagagtaggctttggaagtctgtcactctggtttc

SEQ ID NO: 194189 - DNA, 338 bp, Homo sapiens
tagtatcttccagtaaactcccttttctacacacaattcaggtcatctatgattatgccatctaagagatactgtgtcagtggcaccttcccgcatgggaagagatcttgcttcttgagcaggatatgacatcctcagaggcaattggacatcccttccacttcccctgtggcagcatgaacttcctctgtttctcaaggaggtagagggagaggggagcagcctgccacttctggaaattcacccacagctcttgcctggcgtgctgagcagaggccacccagtcgggctttgcaaatagaatttgactcccatgccagaccaagtgaaacagatcc

SEQ ID NO: 194190 - DNA, 476 bp, Homo sapiens
acttgggaggctgaggtggatggattgcttgagcccaggacgtcaaggatgcagtgagccatgatcatgccactgcactccagcctgggtgacagagtgagaagttgtttcaaactaattaattataaaaaaacaaaccaaaaacgcagagccaaatacaaaatcacccctgtgcggctccgtgggtgggcgtgtggggcagggagagttggggggcgtcatgagcctctaggagctgaggctggaatgtggagcaggagtttctgtggaagctcaatataacgtgatcctgaatatggggcaaccctcccccattttcccaattagtggttgagaatgaaaggtgagccaggcatgggaggctgaggcaggagaatcgcttgaacccaggaggcggaggttgcagtgagccgagatcgtgccactacactccagcctggggacagagcaagactccgtctcaaaaaaaagaaaag

SEQ ID NO: 194191 - DNA, 328 bp, Homo sapiens
aagacgggagggtttctgcagtaactccagattatattatttaattcatttcattaccataaagcaacaactcgaatatttatcgaatacagctgagacaacacacggccaactaaggagctgcaaattaatacgcgtgcgtgttagcacatacacacactcacccacgtgctcacacgcggccttctgaatttcacttctgcatgcaaaaccaccaccaccgaggtctgcacagcaccggcactttgcatattgaaaacgcggctccagcgggccccacggaacagatccttcccaggaacagaccctaggcccggctccctgggaa

SEQ ID NO: 194192 - DNA, 151 bp, Homo sapiens
tgaggaactttggcaagaagacccttacgaatatatatgcatgaagtttgatgtgtttgaagatttcatttctcctaccactgctgcccagacacttttgtttacagcctgtagtaagaggaaagaggtactgcaaaagactataggattt

SEQ ID NO: 194193 - DNA, 236 bp, Homo sapiens
gtcacctgggttctgacgattaggaaagaaatatgttaaatatctggcatagagtaagcgctccatgggcccagcatggtggcttatacctgaaatccctgctccttgggaagctgacacaggaagaccatttgagcccaggattttgagacccgcctggcccacatagtgagaacccacatctctacaaaacatacaaaaattagccaggtgtggttggcatgtgcctgtagtcc

SEQ ID NO: 194194 - DNA, 459 bp, Homo sapiens
tcttatgcagatagggtattatgtactggcaaccaaaggttccctatattccaaagctcaagtaaacaatcattacctgttcatcactctctagggttgtaatcagaatttatatatgtgcaaacatttttaataaaagaaaagacagctaaaagccctgttctattctttacttaacaaatcacattttctcaagttgaacaattcttaaaattttttcttctcacgtttctatgtcattataacactttgtgttactgttccttcttcagttaatgactactcccaatttagaaatatccatgaatttaattaatgtgtaatttagctttacatattactaattgggatggtagataaggaagtgagatgtgacagaataacttaaaaaatgcttaaatttatcatcctaattcattaagaacttaaaaaggagggtatggaccaatacggcctaaa

SEQ ID NO: 194195 - DNA, 354 bp, Homo sapiens
aaatgaacttctttctccattagcttgtcattgccattttcaaatggcttgcccataaattccaatatttttctcaaaaaaaagtggtaaactcttcagtcttttattttcttacctacttcctttgtgttccagaaagcaagtagtatattaccttcatcttcatcaagtaaagaggtacattgaggcctagatgctaagtgatttccttaatttcacataatttatcagtattgacccatccactacatctgatgatgcaacaaatatttagtgattgccaccttggtgccaggctctgttttagctgcagggaatataagataggtaatgtctctattttaatggagctca

SEQ ID NO: 194196 - DNA, 189 bp, Homo sapiens
tccagctccaatcctctaggagctacactaccaataggtcacagacctcacagacctgggctctgtcccaactgcccttatgagcttagctgagctagtaagcctatgttctcatctgtggttgtggaaagtattccctgcctggcctttgtcacagagccatgggtgtgaaaggctgagaacctgccg

SEQ ID NO: 194197 - DNA, 368 bp, Homo sapiens
tgctgctttgtcaatagagttatttaaagttatcattatgtaggcaacagttccttagtttgtaaggcaaaatgctgaatctaagaaacatgtaccacatatgtgtctgttatatctgtaagaatttacttatttaaaatcctgtttgcgttaagggtaataaaagtgaagtgatatatagatgacagatttcatgagagaaaaattttgaagtcagaatggggatgagtatcatactgaattcagtaatgtattatatataatgcttaagtaatgattaacgtatacattattgcagtaccggttaactagtgatcacataattctcatcgaaattgtttagagacataaaatattggcacagggta

SEQ ID NO: 194198 - DNA, 576 bp, Homo sapiens
cgaatcggtaccgactgcatctgtgcctcccaaagtgctgggattacaggcatgagccaccatgcccggctatttctgctcttgtagttttcttacccataagccccactagaaaataagcaacctgaaggccaggcccaggttttacttggttatgtaaattagtactcgacatatgcttggcacaaacgtagttgcttcttataggtatttatttaataaacagaaaaagagagtaggaaagtatcaatagtatatcttaacagtaggtcatggattttttgaaatgtctatttcaattccattccacagccactggttggaggggataaaaatcacgaaataggctgggcgcaatggctcacgcctgtaatcccagcactgtgggaggccaaggcaggaggattgtttgtgcccagaattcgagaccaacctggacaatatgagactctgtctctaaacaaacaaacaaacaaacaaaaattagctgggcatggtggcacacgcatgtggtcccagccacttaggaggctgaggtgagaggactgcttgagcctgggaggctgatgctgcagt

SEQ ID NO: 194199 - DNA, 246 bp, Homo sapiens
ttaagcgctgaaatataagtaatggaatataaggttgaatatatacaaatacacacacacatttaaaaacagatcaagatcaggggagctgaaaaagctagtatttgactacaacggaaatttacaatctctcagccagtgttccaagcagaaacagtagtagattcaaaacctattaactaggaaagctaggtccccttgtagaagaatcctgcaacaccatagcaaatgtgtagagtatcaatt

SEQ ID NO: 194200 - DNA, 282 bp, Homo sapiens
caaattaggaatattaataaaacactctgagccagatggatggtcaaaataaaacttcaggcctgtacttggcagcatgtgaaatataaacaagccatctgaatgccaacaaagtaccatgccagtctacctgaaacttcagcttcagttcaccatacaacatttaactaaaagaaaagtctatttttaacctccacaatggtgttctatgggatatttatccaagccctcaattctttttttttttttttttgagaaggagtctcgctctgttgcccaggc

SEQ ID NO: 194201 - DNA, 254 bp, Homo sapiens
ttgtctgtaggtgttgattatatccaattgactgatgatatgttgagttcaactatgtccttattgatttttttgtgtgctagatatgtccatttctgataaagggttattgagtctcaaactgtaatagtggattcatctgtttctccttgcatttctcttagtttgggcctcacatagtttgacactcagttgttttgtttttaagaaatagggtttcactctgttgcactccagcaagaccctatctctaa

SEQ ID NO: 194202 - DNA, 437 bp, Homo sapiens
agtaacactgacttaatcagatcatcataatccatcgatctttccaacaacagattatgatttagatattctttccctgctcaggaacattaagacacatcaagtattctatgtacaaagtgaagctcacatgctgatttgaagacagagttacttgcaaatacttcatggaagagtttacgtatcaatcattaaatattatatattaaacaaaaagaaaaaattacgctcatagtagaagggattagtttgtgacaatactatgaaataataatacgaaacttaatataattaaaactggaaaaattattcaaaacagagattaaaataaaactaggattgaaaatgatattaaaattagaatttaaaatatttcaaaaaatagttaatgtcattgtatttttacaaaactattttagataagataaatagtacag

SEQ ID NO: 194203 - DNA, 378 bp, Homo sapiens
taaggtattacggatactacctcataagcatgtagttccccttcggagcatagtagacgccataacttttccttgtgggcaaactcagagtttacctgggtgttcaggaccagttagtggtcagctgtctttagctttcattataaatgctctataagagctgggtttgattcccgggaaaagcattgatcaaaaggggagaaataatctggattgtacttcagaggctgctgtttgaaaaagacaggtgatttatgggagccaaacttcaaggaaatgttaaatctaagttcggcccaaattcattaagttaacctgattttgactgtagcactgtgtactttttttttactatttgtttaatgcttagcatgtttt

SEQ ID NO: 194204 - DNA, 511 bp, Homo sapiens
taaattccccttaaacactgctttcatggcatccctcaaattttgatgttttcattttttatttagtacaaaaggtttaaattcctcttgagatttcttctttcatccatgtgtttagaagtgtgttgcttaatcttcacatattttgggattttccaattatctttctgttattgattttttatttaattccattgtagtctgagagcagacattgtaggatttctattcttttaaatttgctaaggtgtgttttatggttcagaatgtgatctatcttggtgaatgtttcacataagcttgagataaagcttacatgcttggatattctgctgttgtggaatgaaatagtcaatagatatccattatattcagctgattaatggtgtttttgagttcaaacatgtccctattgattctctgcctcctgggttgaggggggttgaagtcttcaactataagagtggatttctactgcagttctgttagtttttgcctcacagagttttgt

SEQ ID NO: 194205 - DNA, 494 bp, Homo sapiens
gtattttctgtacttatcttgtacctacccaatttgttgattgctcttattcgttataatagtctttcagttgactcttcctaatttttttgtgccgagaatcattgatgacaaataaggataatttggtctccatttttctggtacataatacgtctttacttaccatcagttgtgtgtcacttaggaatataaatggctgaaaataactgaaagcctgcctaataagggagtaggccgacaggggctgacttttctcaagttcaggcagtctggagggaaggagtctgtggctgctgtgaggtgctcaaagagggtgtgaggactgggctcctggcttctgtttgttcatccttagcctgtggcttttgtcctcgtgaacacaagatgacctccaggaattatgtctgtttcaggcaggaagaagttgagaaggaatgaagacaaaaggcaaaaaaggcagaatgacaggtcagcaagcgctgctcagccag

SEQ ID NO: 194206 - DNA, 621 bp, Homo sapiens
cttgagttgttctcagagaacactgaaaattcctccctgaacattattagctcaggttttatttctagaattttaagaacttacaaagttgccctgccccaatcctgattcaatagctctgagtcagggaaccaggattctgtgtttttataaagctccccaggtaacaaagcttaagaactcaagactgagagctcttttcctactgaggagttaagagggcataatttgtctaaaattcagttataactggtcaattctttggtgcaaagaagactctctccacttacactttctgcttttggaaataaatcaaaacactgaataagaattataggtagggttgggtgcagtggcccatgcctgtaattcccactcagcgctttgggaggctggggctagcagatcacgaggtcaggagttcgagaccagcctggccaacatggtgaaaccccatctctattaaaaatacaaaaataagtcaggcacctgtaatcccagccactcaagaggctaaggcaggagaatcactgcaacctctgcctcgcaggtttgagcgattctcctgtctcagcctccccagtagctgggtttacaggcgcttgccaccacacctggcta

SEQ ID NO: 194207 - DNA, 395 bp, Homo sapiens
gcttgcccagtgtcactcactggggtagtggtggattcagagctaggtcacagatctcctggcttctccagatcccagttccttcccctgcaccacagcaatatttcccaaaggaacagccataatgataaccatcccatccaatctgctttgtttgggttaaaaaatgtaaaatgcatgaatccttctattagaaaaggtattcaatcatcatgtgatctcctgctttaaaaacttctcatggttctggatgctgaaagaacagagaataacagtgtctgcctggaagtcaagaccctggggactcaacctacctgcctttctggtctactccctctgtctccaatgcacaacatatactggacaactcaaggggtcctctctacaccccatgc

SEQ ID NO: 194208 - DNA, 359 bp, Homo sapiens
tgttaggccaccaacctaggaactgtggatccgggctttgtcaaacctttgagtttttcatgtttttcagtaggagacgtgaaaaaaatctgctgagggtggcttgtgtgagctaccatgagggcacattttaaagttgggaggctcctttacatcaactaactggtccaatttttagtacccactttatgtttcattgcttttgccttgagttttaaagagagtctgcatcttctaggaaagtaagaataaatcaaaattaaataagtatatatgtatgtgacgtatgtgtgcatgaatatatgtgtatagtaggcattttatgcacatcacccaatttaattctcattttaatgagg

SEQ ID NO: 194209 - DNA, 203 bp, Homo sapiens
gtgcttccaaatgacgacagcagatggacctacagaggcacgacgtgatctagccaatgccaacatgtctagcattatctagtaccatctcttccttggactctctggtttctagtcactgctgaaattcagtctttagttcaatctaaactttcacttcaacagagaaacttttcctaatcatcctactaacactagcaccc

SEQ ID NO: 194210 - DNA, 335 bp, Homo sapiens
tctgtgaaataaggcattcagatagcactatgacctattgatgaaaatttcaaaactgtatgtatgacatgtacatccagattataaagggccaccaactgcctagcacaatgggtgccaggcacccacctcagcctcccaaggcacaaagtcaggtgaaactgatgagacttcagaaccctgggaagaggaggaggatgcacttagggagcgctttctgtctgccaatgactaggctaaaggtgctacatttcttcttcgattgattttatatttaatgtaggaattcccaattatagaagacaaaactgaatcacaatggcgaagcacactta

SEQ ID NO: 194211 - DNA, 249 bp, Homo sapiens
atgggatcactgacatactcaattttagcttaagttaaaaagaaaaggtgataaaattatatttttgtttaagtacctaggtatctactatgattttagaatgccacatggtggttatcaattcattagacagaggcttgaaatgtatttgtatacatatgtagatgcatataattttaatgaattatctttttgccattaaattctatgtatagcttatctcagcagtattggtttttggtaatatat

SEQ ID NO: 194212 - DNA, 464 bp, Homo sapiens
tcttctaaaaatttctatgttttattttattatttttaatatttagtattttttacatctggaatttttttatataaaagtggaaggctcaactgcatctctttttatataaagaacgaattgtttaaacatcacatgttaaataatcttttctccaataaattaaattatattagcatcaatttaaagattttttttctctaaaccactaatctatttatttgttgccaggcctgagacgtattgctttgattataatagctgtatagtctcttttaacatttggcaagtttgatgctccctactcattaatattatttataatgttagcctggttttcctttttttttttcagtccaaataggatttagtcagaagaaagatacgtggattacatttttaaaatactgatcaaaatgaagatgctccaaccgtataaatggcagatgaaatagactttaaag

SEQ ID NO: 194213 - DNA, 428 bp, Homo sapiens
actgttatggtctaaatgtttgtgtccctccaaaatttatattttgaaacctgatccccaatgcaatagtattcagacgtggggcctttaggagatggttaggtcataacagctttgccctcatgaatgggagttagtgcccctattaaggagagtcgagagagtgtttgtcctttccatcacgtgaggacagagcaagaagtagctgtcagcagacaccagatctgctggcaccttgatcttgggtttcccaacttccagaactgtaaacaacaaatttctattgtttacaaattacccagtcttaggtattttgttgtagcagcacaaatggagtaagataagacagagaggtaacggatgttgggtaagttacaaaagcgtctcctgtgaccactttctctccacctacagtaatggttcttcta

SEQ ID NO: 194214 - DNA, 265 bp, Homo sapiens
ctggtcttgaactcctgacctcaagtgatctgcctgccttggcctcccaaagtgctgggattacaggtgtgtgccactgtgccctgcctagttgtgattttgtatccattaacaaacttttggctattccccctgctccttccccttccccaactctggtaatcactattgtactgtctacttgtgtgagctcaactcttttgctgctatatatgagtgagagcatgcggtatttatatttctgtgccaggcttatttcacctaa

SEQ ID NO: 194215 - DNA, 217 bp, Homo sapiens
gctgacctgggcttctgtctagcttgaaaaacttctagctattgactttttgcaagctccttcacatctccaagcctcattcgtgtatttattcattcgttcagtctataatgtattagcttgatgcccagttaccaactccaggcatggtgctgggcacaggagatgcagctgtgaacaaaacagacacaagtccctgcccttggcagacaatgag

SEQ ID NO: 194216 - DNA, 300 bp, Homo sapiens
ggtgatgatgatgataatgatgatgaatgatgaggatgatagatagttcttattgtgtattttctgtaagtaaatcaccatgcaaaacacttaaccaagtcactaatttagtccttgcaataacctcaacatataggttttactagcattatctccattttacaagtggctatggactgtttgtgtccccctaaaaggtttatgctgaagctctaatatccaatgtgagagaattaggaggtgaagcctttgggaggtgattaggtcatcaatgtagaattatcaagaatggaatagtgc

SEQ ID NO: 194217 - DNA, 339 bp, Homo sapiens
aaaaatgaagtagtataatttttggaaccatgattgtatattcagtatgtttttgactgaaatgttgttacataccacatgactgcaattagtaaaaataatattgaatcacaccagaagtaaaataagtcctctctaaagaaatataacatgatacagaataccttgaattcagtgtgaattaattgtcttagtgtgtgtatgtgtatgtgtgtgtgagagagagtacatgtaggcaacgaaagcagaatagacagtctcttcaaaagtcattggaacatttacaaatgactactgtatatggctataaaggtgacccataaggcaagtatcaacaaa

SEQ ID NO: 194218 - DNA, 450 bp, Homo sapiens
catttgccctgggatatgccaccatcagcagagaaaccatgcgttaactcttgaaatgccaaaatgagtaggcattaaataccttgccctatctgaccacactatttaatgtttttatcttaaatttaaaaaactgaaatctgaaactgtatgatagtcagtaggcctaaaactcccccttgactttgagaatttgaagggattcccttccatcctgaagtctactttcttgtcatttaagggtgagagaagggaagcttctgtgcctttctagaaattaacaaagaacctgttgggtcctagaccagaaatccagcacgttatcctagcatgaaactcccttttaaaaagtgaacacccaaagagatgttacaaatgaagatatagccccttcagcatctctggagaccaataccacaataaggaataataacaacctaggaataaagg

SEQ ID NO: 194219 - DNA, 254 bp, Homo sapiens
cacactcctgtccatttgtgtggacagccaatttcccatcttgccaggcagaaaaggtcaaagggagaagcctctggacctttgttacttaggcgtggaaagttagggtgttcctttcaatttagttctaagaagtaggcgtgaaacagccttaggttccctacctcctgaccctattctcctgcctcaaagggtgaacagataaaagaatagaaactgttcagtctgacaacaaataatcagcagctgaaaaa

SEQ ID NO: 194220 - DNA, 192 bp, Homo sapiens
tgatgtggccttacctgctccttgtatcttattggattgaatgagaacagatgcaaaacaagtatgtacagaaatgccaggaaaactactgtcttccaatggggttcaacagttcaaagccctccattgatggagccacttaggaggtttcagtgtcttaattcttttagattttgacagttttagaaaact

SEQ ID NO: 194221 - DNA, 314 bp, Homo sapiens
atcagctcggtaccgccagacgctgaactatgtgcaaaatacacccaactctgagataatttttaatttttttgtagagatggggtctccccatgttgcaggctggtctcaaactcctaggctcaagcagtcctcctgctgcagcctcccaaactgcaaggattataggcatgagccacaacgctcagtcttaatgttataagaaactgccaaacagttcctcaagatggttgtaccattttatattttgccagtgatgtatgagggttctacttggtccatacgtatccttgttcacatgtgatgttgtcagt

SEQ ID NO: 194222 - DNA, 331 bp, Homo sapiens
agactctactccttctgcttcagctgctgtgtgttgggcacacaggtgttgatattcgtagcagtactactgttcattcaaacagacacacatgaactgttacatgaaggatccatttcacaaatagaaccattagaggaccttttaagaaacccatctcccttatcccctttctgtagtggaacgtggagcaatgttaagattgctggacactctggaacctttaatcctcacgcctggaatcccagcactttgggaggctgaggtgggaggatcacttgagcccaggagtttgagaccagcctgggcaacttatgaagaccctgttgcc

SEQ ID NO: 194223 - DNA, 455 bp, Homo sapiens
gacgggagagaacaaggtgtggaaagtcagtagccctggctccaggactcttacacacttgaaaaggccacttaacttctgcaaccccagtatccttcctataaaatcacgttaccaacaccatatctactttttagaggactgaatgaggacacgtcagaaagaaatttctgagatgtacgaacgtacagttgtctaaatcagtaacatcatgcatcaataaaatcagtcatcaatgacaatgacaaaaaactaatcaagatcgtacagtctcttcacttacctatacctttatcaatataccagtagggcctgctattccttttctaggacaatctgggtccagacaaccgcccagtgtgtctccaagaaaatctggagtagctctaacatgggcctcatttctctctagtttgtctctgttctataaagcaggcttctctagcttggctgca

SEQ ID NO: 194224 - DNA, 954 bp, Homo sapiens
tgccaactgggttccagcaattctcctgcctcagcctccggagtagctgggattacaggcacacaccacgatgcccggctaatttttgtatttttagtagagacggggtttcaccatgttgaccaggctagtctcgaaattctgacctcaggtgatccacctgcctcagcctcccaaagtgctaggattacaggcgtgagccaccacgcctggccttgctgttcttttagtttggttttcctctgggctgttgaatgacaggaatgacccaagtgagagttgaccctaaaacagaccacgtgtctaaattctctcccacccttcctaaggcatatctgtctttctctcaagataatatggctttgtccctttcaaaggggaagaatgcaaccaccaaagcctattgaggttcctgcactttgactttcccagaaagggtcaggaaacctgccactgcttttcttcagctaatggaaaacatttgtgtccactctgcttggtgttttcttgggattcttctcagaatctttttccttaatatagttcaggcaactttgctgccaagaaataagaggattttatagaaccattgaggagtaagaaaactgggaggaaaatgaaaattcgactctatgaagaacaacagcaacttcattcctacctgataatgataacgtgattttgaacttttcaaaatgctttcagtttcattatctcacctgggtttcacaacaaacaagtattaccaggtttgcttattttacagatgaggaaactgaagcctggaggaggttaaataatttttgcccaaaattacatgctggcaaaaggtggctgtttgctttatgtcaggattcaaacacagatttggggaaatccaaagcttgtattgtttctacactactttgccaagcttattttatcttctaaaggctctatttaggaatctaattt

SEQ ID NO: 194225 - DNA, 845 bp, Homo sapiens
tgccaactgggttccagcaattctcctgcctcagcctccggagtagctgggattacaggcacacaccacgatgcccggctaatttttgtatttttagtagagacggggtttcaccatgttgaccaggctagtctcgaaattctgacctcaggtgatccacctgcctcagcctcccaaagtgctaggattacaggcgtgagccaccacgcctggccttgctgttcttttagtttggttttcctctgggctgttgaatgacaggaatgacccaagtgagagttgaccctaaaacagaccacgtgtctaaattctctcccacccttcctaaggcatatctgtctttctctcaagataatatggctttgtccctttcaaaggggaagaatgcaaccaccaaagcctattgaggttcctgcactttgactttcccagaaagggtcaggaaacctgccactgcttttcttcagctaatggaaaacatttgtgtccactctgcttggtgttttcttgggattcttctcagaatctttttccttaatatagttcaggcaactttgctgccaagaaataagaggattttatagaaccattgaggagtaagaaaactgggaggaaaatgaaaattcgactctatgaagaacaacagcaacttcattcctacctgataatgataacgtgattttgaacttttcaaaatgctttcagtttcattatctcacctgggtttcacaacaaacaagtattaccaggtttgcttattttacagatgaggaaactgaagcctggaggaggttaaataatttgtcgacgcggccgcgaatttagtagtagtagtaggcggccgc

SEQ ID NO: 194226 - DNA, 449 bp, Homo sapiens
aaagaagaatgggtctgggtcagaaccttcttctgtctcccaggccttgcaaatctagtccagtccattgtacttatcccaggagcctgattctgtcttttacattcaactctggcaagcaggaaatggctgaaaattaagcaatttccctgtgaaaactttcagtctgtttgtggagggagctaaataaaccctacaaataaagaagcaggcagagccccttgtgaagaccactgatctaacacgacttcagcctcttctctcttaaccctgtgtcccctggctagacctgcagtctttgctgagcgtctgtggctttctcaagaccagtggaaaacaaaacagcagaagtgcttctactttcatttccaaataaagtggaagccctgcatgagctcggctgtctcccatttggatgaagcccaaggatgccttaatctcagggctag

SEQ ID NO: 194227 - DNA, 545 bp, Homo sapiens
tgtaaatgctggaagctatcctccaagcctttcctttttttatagcacttgctgctaaggataattatatggtttcttatcaacagaatgtaaattctcccagtgcccatgaatacatactggcccagaggaaaacaggtgagaaatatgtcaaaagaacttgtaatacaagccttcatatacatggcaggggaaggcctggtgcctccttttcttacaaaataggaaaaatagcacctaaacctgcaggtttgttgaggctcacactgtttagaatggcattgaacaaacatctggcacaggaaatgcccattataagtcacctgtttccatttatgtctcaatctcaaatgtggtgagacgtgccacagcgattagtatggcagattacaggggctgatccccatcttttactcacaaccctgtaactgtttcttcttgataaagtaatggtgatagatagggacactacacacaaaccattcatggattctcccctaagtctgtgcaatcgtccgtatatgtattaaatctaaaagcaaaaa

SEQ ID NO: 194228 - DNA, 370 bp, Homo sapiens
gtgaggttaaacgatgtgagcaggttcagttttgccaaattgttctctaaagttacaatcccgtgagtatcacatgagagttcccagctatttctctatatctttgtgaagaattactccatgtttgtccacttaatgagtaggcaattgtacctcactgctgctttattttcattttcgcagagggcatcttttcatatatttaactgccatcagtttttttacttttgtaaatagtccattcatttgtaccaatcatctttctttggggttatctgtattttccttgggttggagcatttctctagtgttttcttttttttttttttttttttttttggaaaagggccaccagcccttgcagaatctt

SEQ ID NO: 194229 - DNA, 215 bp, Homo sapiens
acagcacatgctcaattcatgtctgtgtgtcacattttgcaagacattgcaatactgatgtgtcaatattgcaagactttcaatttttttcattattatactaatatgatctttgatgttgctattgcaatcattttggggccacaaactgcacccatataagatggaaaacctaatcaatgaatgttgtgtgctctgactgctccactgaccgg

SEQ ID NO: 194230 - DNA, 390 bp, Homo sapiens
cctccgcctcctgggtagctgggactacaggtgtgcaccactacacccagctgattttctgtattttctgtagagataggattttgccatgttgcccaggctggtctcaaacacctggactcaagtgaaccacctgccattgcttcccaagatgctgggattacaggcatgagccactgtacctgaccattttatcttgtttttaaaatttttattaattttttccctagcttcattaaggtataattggcaaataataattgcatgtacttatagtatgcaatgtgatgtatacacacacacacacacacacacacacatatacattgtgaaatgattaagtcaagccagctaacagatctatcacctcacattcttcttatatttttt

SEQ ID NO: 194231 - DNA, 122 bp, Homo sapiens
tgatgacatactggcaagtcccaggggctgctgtgtgattagagcttctcaccaggatagcttccttctaagatggcctcccactacttgctgagagaggaagacaaagtgggtttttaaaa

SEQ ID NO: 194232 - DNA, 747 bp, Homo sapiens
tttcctttgattcccttttaaccttctattgtataccttaattgtgtggtaaaggaaaggaagagtttaagtggattcaaagtttgtcgtgttaaagtgaattaaatatggtctgagaaggactttgtactctatatttgagtcctagtggacgaactgtaacctaacttaataggtagacaagatcgaaaacctgacttaggagtatgcgcctgtaacaatagctgagtcttgcccaatcccagcagccatatttcaaccattcacacactgctgagcattcagactgtgttcaaataaggcaaatgctgagctgtaaccaatctagttgtttctgtacctcacttctgatttctgtatatcactcccccttttttgtctataaatcttcttccaccatgtggctgcactggagtctttctgaatctgctgtgattctgggtgctgctggattcgtgaatcgttcattgctcaattaaactcctttaaatttaatttggctgaagtttttattttaacagtaactgtcagtaatctttttcaatgactgatataatgaacctgttaggagaaagaccaggatgggatttaggtaggttgaacttgatgtgcttgctgaacctatccaaaagaaagttggaaagtgagtctagaactcaggaaaaaagcccaggtgagagagaaatatgactttgggaatcatgcacatagcagtgattgccagaaaatgtgtggcacaaagtaaaa

SEQ ID NO: 194233 - DNA, 427 bp, Homo sapiens
tccacgtggctctgccagcccttcctttgcagctttgcgcatgttaaatgtcatgtttcgtggatttgtgttgatgataagctcccgatgcagagatggtagggaccatctctgctcacgtgtctgtccccaggcccagaagacagcctggcacacggcaggtgcctgatgagcacttgtggactggatggcattggccagtgtgcatctcccaggaactctgctgtgaactccgcttgggcagggacatgtctgttttgttcaccattgtgtccccaaaattcaaagtcttgcacctagaacactcttgttggatatttgataatgagtgagtttgctgcaaaaggaaaaaaagcaagaacaataacaattaccaccataaaataagaaaacggacccagaatagaatttgaggcaagagaccctc

SEQ ID NO: 194234 - DNA, 361 bp, Homo sapiens
tacctttaagattgttctcctgctgcgaaaacactgcgattgaacattttccttaactaaatcactaaatgcaaaaactgagacttcttttgcctacttttataggtctgaggttctactgaggcagctgagacacttcattctaatatctagtcatctggtctggtccaaccccacagaccgatggtggagggtgggagaggggtgctatttacataatcatggcagtaccactgatttcagaaccaggtttgggagacaggatggttggaatagcaacttgcctttccatttgctctcctacaagccccctaaaatgctgtgtgtatatgtggaagggagtgttgtgtgtatgtaccag

SEQ ID NO: 194235 - DNA, 409 bp, Homo sapiens
tattgtcctggttgacgagagtcaccttgcccaagatcacaccgcctcctgggtggaacctacaccccatgcctactcccttgtggcagctggaacaatgacaaaggggcatctccacccaagagattccctgtgaaatcagttgaggcctttgttatgagtgttccacaggccagctttttcttttactcaatcttgctcccctgtttaatctcactttgtctccccttatcccccaccaagttgatccttaggaacaaaatccaatcaatgtcctatcaatttcctgaacacaaatctttgtttcagagtctgcttactgggaaaccaatgagcattaaaaagctatacaacgtaatttaaaaaaaaaaaaaagcaaaaacaccttcaagaaagaaagtgagaggat

SEQ ID NO: 194236 - DNA, 370 bp, Homo sapiens
ttctagcttttaggacgatggtgtgtggggcaagttgtggcaactctagagggtgccatttatgtcagtgtccatgtgaatggccgtgcagtggacaacctgtgcagctgtacatggtggctctgcgtatgtgtgggtgagcttagtcttgcaggagaaggcactcgcttgctggggagctgtgtacattggtgaaaagtgcctgaactatggcatcagatctgggcttataccctggtgctgttacttgctgtagactttagacgaagggcctaatttctccctgccacggttgtctcatctgtgctcatctgagctcagccatggagaggattaaatgaagcaacttacgtgaagtgtaatgatcatg

SEQ ID NO: 194237 - DNA, 314 bp, Homo sapiens
atgctggaaaggaagaggaaacagtaatagttgatctttataaatatcaataggaatactctctaggaggccctgtactaagcatatatgcatcctccattgtagtttttattcccacctaatagatgaggaaattgaagctcagagagtttaagtaacttgatcagggacacaaagctgggatttgcgccaggtgtccaactccaaaggccacatttggaacactctgctgtactctaggatctgtagcatcttcaattctatagcccatatttttggactggaagccagaatttccacattgttttcccttg

SEQ ID NO: 194238 - DNA, 437 bp, Homo sapiens
atttactacaataaatgacacaatcctagcccctgcggaatgttgcccagataccaaaactgccacgtttttgtcaacgcttccttatagtataacataaatagcttggtcaacaaatgccatagatgtttggaagcagcaatgatcactgtggcctaagtctgtcaacgactccttggaggaagtgatgtttcatccaggtcttgaaggtaggtaggacttaggtaagagtgaatgccgtatctcccatctggtgcttttattccctctcagaattaccttttctcaattacacttaattactgtatgccaatatatgccgatagcacattctaagagaagctaatttttttttctagttgaagggtgttatcgagcacatcatctagtaaatctctgtcacattgcatctgccttcttcattctttttttttttt

SEQ ID NO: 194239 - DNA, 415 bp, Homo sapiens
gtgaatgagtcagtttaagttaacctagtcctatgagagcaagaaaatgattaaacattgctgtttggaagaaaatcaaagggcagcaaggtgtaagcgtagtccacataaattaaaattcttgggtgggcgtggtgactcacgcctgtaatcccagcactttgggaggccgaggcagttggatcacctgaggtcaggtgttcgagaccagcctggccaacatggcagaaccctgtctccactaaaaatacaaaaaaaatttgctgggcatggtggcacatgcctgtaatcccagctactcaggaggctgaggcaggaaaatcgcttgaacccgagaggcataggttgcagtgagccgagatcacaccactgcactccaggctgggcaacaagagcaaaactctacctcaaaaaa

SEQ ID NO: 194240 - DNA, 729 bp, Homo sapiens
gttgcccaggctggagtgcaatggcgcaatctcggctcaccgcaaccttcgcctcccgggttcaagcaattctcctgccgcagcctcctgagtagctgggattacaagcatgaaccaccataccgggctaattttttgtatttttagtagagacagtgtttctccctgttggtcaggctggtctcgaactcctgacctcaggtgatctgcctgccgcggccttccaaagtgctgggattacaggtatgtgagccacctcgccaggccagaagatagatttttatttttagtttataggttgaagcctcagcttttataaggtacatgaggagacaaaccagataaatgcttgattggttgcagagatgcagtcgccttatttggacttgccagcccgaaataattcaaaggttcagatttcagtttgaagagtttattcaagcagaaagatagcaatggcccattcaggaaaaaaaacagactccagagaaatggactcagtactctaaaattagaagttaagttctttcttatattaccaggaaaagaggtcctgatcagaccccaagagagttcttggatctcacacaggaaagaattcaagacgagtcacaaagtgcagtgagaagggagtttgttgaaagctactctgggccagcatgatggcttagatctgttttctaagcacattgggaggccgaggcaggaggatcacttctagtcagcagt

SEQ ID NO: 194241 - DNA, 267 bp, Homo sapiens
agcaaaccttagtcacatctctcattaattaaatccagtgattctgacagattgggaagcaagtttgaaaaaagctacccataggaatgcatagtgagtaagatgattcagaccattcccacatcaaacaattctatatcttcctctcttctttaaaatttctgtattgagccatcgtttcttgctcaccttcagtttgagaaaagcctttttttttttctatttgtacttctgctttctgccatctctgcctgcttcaggatcgtc

SEQ ID NO: 194242 - DNA, 606 bp, Homo sapiens
aaatttaaaactatttctggaaaggtgtttggtatttctctaatataaataaatacaaatatgtgtgtttatttctttagtctgttaaatattgaacaactcatggaactttacttttggagcatttaaaaaatatatgaattattgtgccagtctcgttttatgtcctggtgttttcagtgaagagaatagcctccatatacatcatatatatgtttgaagatggtcattcttcttattaccaattatattttctcacatgatttgtactatattaaataaagcattcataaataaatgacaaattcactccttacaaacatcctgtgtatattttagcttactatttaaatgaagaagattagagaaactaagatctgcataagggttatgaaatctaactcatgattccattgcagcatgccagatgtcacttgttcttgttctcattaaatatttattattcctgtaagctctgcctaggtcttattttttcattctaatgcatgttgaagaactaactgaagttatttttcaaaagtattttgagcatctcgttgtgagaagttttgtagactttctttaatgaatacattaatattttgg

SEQ ID NO: 194243 - DNA, 400 bp, Homo sapiens
gcatattggtggacgaggaggaaagcattatccccatttaccaatgaggaaactgaatctccaacaagctcaatcaaatttcacagaaaaaagagagaaaataaaagcagcaaatataacaaaaacataaaaaaattatatgtcatataaagaactctgcaagaaccatgctctggatgtaagaaatgagagggcaaagcattgtgacaaatgttatgttggctactgacccgagggacagaaacactggggcaaagcattttcctttcacttttattttggagtgcagagcagaagaaagctgtttcaacactaagcggataggaaaaaacgcacttaccactaagaacatgctccctaagttacctgtcacagtggcacatgtgctgtgcacatgaag

SEQ ID NO: 194244 - DNA, 438 bp, Homo sapiens
atattaaagtgataacacatatgaaaaacaaattctcttttcctgaatattaatgtgcacctggagggccaaagaaggtcaaaatcctcacgtacaaacctgcccaggtaagatctttgctccacaacctgtgatccattaaagtctgaacgtctgcatccactctttaccagggatggattcttccaaagacttttctgtattacaaagtgactaccggtgatgaaccttcctgccttttctgcttatcatttccaggttaattctctaaggtagaaaacttcttatttaaaactttaaatatccaatgaactggaatcctgaagctggtaaaactttggatttttacagatgtgatttgaagtactcgactgtgggaaacatctcaaaccacccacaatttccttctctatcagctccagttccacaaacactgac

SEQ ID NO: 194245 - DNA, 593 bp, Homo sapiens
tgcgtctttcaactgcggtttacagagctgagagcctagcctgacccgcatcctctccgtcccctttccacttgggagtctacaattgcctctttgctttgtcctgttcatggttgtatccaggatccataatgcctaatgctgtgctcggcagagtgatctagacactgcagtttctttagaaacctagtatcaaatgcccatctttcttgaataccctggaatcctctccataacgggaggtgaaatgtatacgttttatttttacaagtctcttaaactcaacctcaagaaacaaataacatacgctattcaatatgaatgtaaagtacatccttacaataaatacacccgtttggtttggattcaacaatcaattcatgctcaagtaaacaatacgtcatgcttttctaaccaggagtttgttattgcggatgctggctctgttccccacaagcatattctactaatgcacaactatatatatttaaactgcgggaaagggtcgcttaaacaagggtaacactataattacacttagaaaaatctcagaattcctttaggacactttaaactggatttaaatggatttg

SEQ ID NO: 194246 - DNA, 403 bp, Homo sapiens
acagcgctaacagacttcccaaagaaaaaggaatcaagatcttaggagagcaaacaaacgagctgtttacatgctcagcttgcatgaaaagtagaaaaatattaataccacgaaactgtattttaatacggcttaagcaaaacaagaaagcctcaaagcaggttgaactctattttctaatagaaatctatacagctattttaaaagataaacctgaaatttagaagtatttacaactcagaacacaaaaatcacaagaaaacgctatatgaagacaaaataaaaacacaaagtcccaattttcctgttttggctgcgttttaggtgtgggccattctacaagcaaagcacctgtgtggtaaacaaagcagttatccgaaattggccatgccctacacagagg

SEQ ID NO: 194247 - DNA, 125 bp, Homo sapiens
tgggctggcctcttcccccactgctggggggtgacggctccccaggcgaagaggggttggttctggccccctcacccccctcccacctcagagaggcctctcctctccagaccgcagcggggggt

SEQ ID NO: 194248 - DNA, 313 bp, Homo sapiens
gctttaccgtcaagttccgtgatctctattctatgacaccccctccaattcagtctctgctgtaccagagggtgtaattaatgtgcattactactatcattacattctctcccataacagttttgcagcccactagtcaccttaatctccctctctttaacactaactagagtgttggatcacagagatggagtttctgatggctcgactatggtttaaccccagaatgctctatcagtactaccactagtaataagagctgggctaggcgcagtggctcaagtctctaacctcaacactttgggaggctaag

SEQ ID NO: 194249 - DNA, 218 bp, Homo sapiens
  misc_feature (209)..(209): n is a, c, g, or t
tagacaggaggatatgtagatggaggggaggttgtggtatagacaggctggtgaagctctggatgggaggacggggaacggcagtggttcagggagagacagaggttctgtgacagatagaaactcagtgagggcatgggggtggggagtgaagggagttaaccctgtggctagaagagcacctgcctagccggggtaccggagctcgnaattcggta

SEQ ID NO: 194250 - DNA, 215 bp, Homo sapiens
agctagaggttcccagtagagaagggagttgtggagatggccagtggaggcacatcattcagggccctgaaagtcatggtcaggagtctggaagccactgggggccttaagatcatccacttccacaatgatgatccaccatacccatttcaactgtgcacctggcatggtctttagattctcccctaccctgctctctttattttcccttagta

SEQ ID NO: 194251 - DNA, 366 bp, Homo sapiens
catccccgttagatgctaagcagtagtgttcaggtattttgctctcccaaaaatattctggatcaccatatacaaacagtgaagattctgtctgctctggagttatatttttgggagagcaaaatacctgaacactactgcttagccatacaaaccaaagcaactatggcgtagacaatgagctttctatttcactcagttaaattctgcttatccttcaaaactcaactccgcatcccctcatctaggaggtgaaatactggatttcacatattctgaatgctgcttctctacgcccactgcacttggcgtataagcgtggcactggaagtggacctgctcccctagccttcatcatactgcgct

SEQ ID NO: 194252 - DNA, 481 bp, Homo sapiens
cacaggtcccagtcagccagtggcgagccaggactctcggggttcagcagggggtagtggacagcccaagctgcttctcttagaatggctgtggcttcacaagtgatgagaagagcatgcgcttgatttcagatccccattacaagctcataatgaatgagtcacaggagaaaggtgagacttgggccctttcgtgcctgatgggaagctcctgccaccccggggagcccctccagactgtccttgcccacctggctgcactggcctctgtatgccaacccagtgaggacaggttctgagggacctggacagatgctgctgcccctagccatggctggacgatgttatacagccaagcacagcacgtgctgctctcaggaagcccaagggctgtggtcagtgcagtggtgatggtgggcacagggtgcttcccagaccttccctcctccaagcagagctcctgaaatgggaggggactctg

SEQ ID NO: 194253 - DNA, 364 bp, Homo sapiens
ctgacgtgccatttcctgccctgacagcatctccgcttccgtcctgaaacctttatcaagaaacaactgtgcagcccacgaatccattcagtcaagatgtattgagtttctgctatgtgtactgactgcggggaaaacaggattcttgtcctcgaggaactagctggggactcgggacagagtcaaacacatgcaacatgaggcctggtatgttagatgggcagagagccgggacactgctggctgcgcagggagatgggggccggaacgtttttgaggaggatgaggctttgatttctctggtccaatcctctcagtgtcaaggtgggtaggtggggagattaaagtctagagagtggtaggt

SEQ ID NO: 194254 - DNA, 510 bp, Homo sapiens
ctttcctttctttcaactggcttttttctatgttggatttccttttcatctctcttcctatatttatattaaagaatatattatttctttatttttaaatattttgctgatctgtatcataattacactgtaaaacattgattatgttatcaatttgactgtgcagccttcacctctcctcactctatatcatttgacttttttcagctgacattaaatgatcaaataaatcatattatctgtgcatatagaaatgatctctgaggaagtgatgcttcacttgagcaatcagaaacacaagttgaattttaagtgggcttacatttttcgtgcttttccatgcttattaatgttttaagtaccaagctccttttcctaggacgtttttgaatcctttattttattcaaatataaccattttctagacttcagcaccacaaattgggttgaaagtttcagagactaatcagaaatgtcgtatcactgttgtgcactagaaaacaaagatgg

SEQ ID NO: 194255 - DNA, 288 bp, Homo sapiens
agtgttgcgtgagcaaccatctatcaggatcaaaaatggaaataaggagatttgaattatagaaaaatattatagggatccccagtggatgtttttagagtgattaggtgggatcaattttatatggttgaaattgatcacatttttcaattgctagaaacagcaaaaatgtttataagctgagtatgttttactgtatagacaagtaacctagttagatgaatataatataatgttattttatgtaaaattttagaaagaaagaaagaaaatgggactctagcagtg

SEQ ID NO: 194256 - DNA, 554 bp, Homo sapiens
gtaaatgcttggattgtttgaaaatttaaataatgggccaggcacagtggctcatgcctgtaatcccaagaatttgggatgctgagacaggcagatcacttgagtccaggagttcaagaccagcctgagcaacgtggctaaactccctctctacgaaacatactaaaaattagcccggcttgatggtgcacacctatagttccagctattcaggaggctgaggtgggaggatcgctggagcccaggaggtcaagactgcagtgaggcatgatcacaccactgcacttcagcctcgtcaacagagtgagaccttatctcaaaagaaaggaaaaaaaagaaaatctaaataataacggaaaataaattattggaaaatgtgttccttttttgctgctttgatgtctacaaagagatggcaataaactaatataatgaggacctagccatcaaattagttaaaatgtcaatagttcagagtacttaggatcaatcactgcacaaggaaaattttaatatgaaagtatctgaaagatgtttttgcaagtttaacaatg

SEQ ID NO: 194257 - DNA, 741 bp, Homo sapiens
ggcatatggaatacatcaaaaacgacagtggggaaatagcaaaaaactggaaaaaatttaaatgtctaacagaaggatggataaattgtagtgtattcattttttaaaaaatgacagtgagtaccctgataattaagaaattcacataaaagtatgaatagtgtataaacgtgacctaaaaatagcatttgtgggaacatttagtttagaagtaatttttttttactcaactgtctggcccttaatactgctattaacattaccaaagaacaccatttaggaaggtaaagaaaccatgtactttagcaaagattttattttaaaatgtagggattttatttttaaaaaagtttcaggattagtttcatttaaccgaaagatatagctacatctttagaacatctttacagaagaaccagtaaatattttctcatctgaattgtgagtttcttaaggttagggtaaatagagaaaagaagagattattacttggaaaaacagaaaaggcaagagatagtagtaatgtatagtaaagtttcagaaggaaattggacagttaaggatcactcaagctttagtgacttctgtcatttgtgctttattgcagaaatgttatacagaccatttttgggcatttgtctcattttgtttttgcgtaatcactgaagcaattaggaaaaaaaacaaaaacgcctgctttagatgaagaacccgagggaaaaaaaattaaagagcttgccc

SEQ ID NO: 194258 - DNA, 772 bp, Homo sapiens
ccacctgtctccacctcccaaagtgctggcattgtaggcatgagcgaccgtgcctggcccaggtttagcacatttaaagagatacgagggataaaggtgtagaagtggaatctccttggaattcacttagcatgtttcgtcataaatcctgaaatcaattctgctccctgctatctttgccatctcctttgctgtgcccttgcctaaggtgactgtggagaaactgtgtttccctcagtgagtgatgaatattctttggcacctattcatagtacaggtacatgttcagactaagttggtcgcttcacccttcacttgagggctgcacttaatcagacctttctccttcccggattcctgctgtccttgtaaccattcattaaatactgacctggtttgtttatacctactgtcccaagtgcaagtagacttggtctttggtgtaatacatatttgttaaataaattgattctcgtttgaatctgttattaactcatttcttattccacattttatcagtgacttacatcatgtgcaaattatccgggtgaaatttaatcattactgaaaacgttattttttttaacttgagttttaacaagctaacttgttgtcttatgtatgttcatgagaataaggaagatttaacttatggtagcttgcttggatcaagaccattaagtttcagttggccttaagttagtgtgagccagtacagtactgtgttgttcctgtcacactgatgtgagctggctgggctcagtggcttacg

SEQ ID NO: 194259 - DNA, 321 bp, Homo sapiens
cttcagaccttgtgggactcagatgatagtaggaaggggacatttggatacagtctcaaagactggaatgaggagatgggttgatgtcctgtgtcccctgcaaaatttctccgctgtgatgatacgggaagtcagagggtaaaaacaatggaaaagagagactgaggttaaggcttgggatttcacgaaaggcattaggaaaccaccagagattttaaagttgagagtagtatacacatgagaggtaaagacatagttggcagctaactagggtagtggttcccaaacctggctgtacgtttatggagctttctgttttgc

SEQ ID NO: 194260 - DNA, 155 bp, Homo sapiens
ccaagataccagccgagcctcagagggtcaagggtcagcaatggcccaatgccaggcagttggccaaagtctgaacaagtgagtagatggaaggagaaaaacccagcaggagttggcagggaccctgcagcaggaaaggactccagcccctgggg

SEQ ID NO: 194261 - DNA, 395 bp, Homo sapiens
tcctttaacggtgtgttcctggaggtcaggcttccatcctcccgttctgataatgcttagctccaggatttgttgcattatgggggttctttgatggaaagttttatttgacaatgtaattttcttggatgcttttaatgacttaaaagctggaagaacaggaaaactagttctcttgagctctttcatgtccagtaattcccagaaattataactttatgctggaaattaaacctgctatttgaaaccttattacagggtgaattaagagtttaggtttcagaggcttttctgtgtgactttccccttagtgggagggggtttggtatgcccattaagttttatcttaaaatttaatgtgaattttacattgtactcagtaacgtggctgattg

SEQ ID NO: 194262 - DNA, 599 bp, Homo sapiens
aggagaaatagtgacgaatctcagccactgacttagagaaatattttaatgatgtgctatttgtgaaatttactgtcaaatacccaggggactgagaattaaatgattattaattatcttcatattccctgcttgctggtaaacatttaaagtcttgtcaagaggaaaaaaaaaaaactgccgcttggattaatgaaaaccaatgtaaatgctttaaatacttttgctcagcacactggagctttctgtttttcagagctcctagggagtgtgagtgatgtgtgttttcaggactgcgtttctgtggactgtgcacatcagccccaagggtgtgtttctgataagatacagtgcagtttttctgatacggccggaatttttgctaagaaactttttgtgttttgtttttctggttcgaagggcagtgaattctcagaatgttgtcggccatgggtttgacattcctcttttcctagattaaaactctgtgctctgttaccttctaggaaggcgtgtgtgtgtgtatggatgtctgtgtagagtttggggtacacttatggccagctactaggcctgggctcagtaagtgctggcgcgcc

SEQ ID NO: 194263 - DNA, 579 bp, Homo sapiens
gtcagtctcaagctcaaggcatgatgggaaactctgagggagaaatgtgggccccatgggaccctaccctttgccctccgcaatccagttccccctccacccccagcccagtccagcaagcccagctacgcctacgctcctctccccaggagctggagcgccaggccttagccaaacacgtcagggcagaggccctgagctccacccttcggctggcccaagacgaggccctgcgggccaagaacctactgctgacagacaagatgaagccagagtgaggaaggaggctgagggcatgggaggagggtgagatcttggggaaagggcctgatctccccttccactccaacaccccagcacctagccatgccgccatcaactccccgctgcctcatgacagggagaagatggccactctggaccatctacacttgaagatgtgctccctccacgatcatctcagcaacctgccacttgaggggtccacgggaacaatggggggaggcagcagtgcaggaacccccccaaaacaggggggctcagcccctgaacaataaatggcctctcatgctagcatga

SEQ ID NO: 194264 - DNA, 1857 bp, Homo sapiens
gtaggtaggaagtctcagaggaaggagcccctccctgggagccagacccccacaccatggcgagcgtggtggtgaagacgatctggcagtccaaagagatccatgaggccggggacacccccacgggggtggagagctgctcccagctagtcccagaggctccccggagggtgaccagccgggccaaggggatcccgaagaaaaagaaggccgtgtcgttccacggggtggagccccagatgtcccatcagcccatgcactggtgcctgaacctcaaacggtcctcggcctgcaccaacgtgtcactgctcaacctggccgccatggagcccactgactccacggggacagactccacagtggaagacctcagcggccaactcacactggctgggccccctgcctcccctaccctaccctgggatccggatgacgcagacatcacggaaatcctgagtggggtcaacagtggattggtccgcgccaaagactccatcaccagcttgaaggaaaagaccaaccgggttaaccagcacgtgcagtctctgcagagcgagtgttctgtgctgagcgagaatctggagagaaggcggcaagaggcagaagagttggaggggtactgcattcaactcaaggagaactgctggaaggtgacccggtctgtggaagatgctgaaatcaaaaccaacgtcttgaagcagaattctgccctgctggaggagaagctgcgctacctccagcagcagctgcaggatgagacgccgcgacggcaggaggccgagctgcaggagccggaggagaagcaggagccggaggagaagcaggagccggaggagaagcagaagccggaggctggcctctcctggaacagcctgggccccgccgccacgtcccagggctgccccggcccgccagggagtcccgacaaaccctcgcggccacacggcctggtccccgcaggctggggaatggggcctcgggctggcgagggcccctacgtgagcgagcaggaattgcagaagctgttcaccggcatcgaagagctgaggagagaggtgtcctcactgaccgcccggtggcatcaggaggagggggcggtgcaggaagccctgcggctgctcgggggcctgggcggcagggtcgacggcttcctaggccagtgggagcgggcacagcgcgaacaggcacagacggcgcgggacttgcaggagctgcgaggtcgggcggatgagctgtgcaccatggtggagcggtcagcagtgtctgtggcttcactgaggagcgaactggaggggctgggcccactgaaacccattctggaggagttcgggcggcaatttcagaactctcgaagagggcctgacctctccatgaacctggatcggtcccaccaaggcaactgtgcccgctgtgccagccaggggtcgcagttgtctacggagtccctgcagcagctgctggaccgagcactgacctcactagtggacgaggtgaagcagaggggcctgactcctgcctgtcccagctgtcagaggctacacaagaagattctggagctggagcgccaggccttagccaaacacgtcagggcagaggccctgagctccacccttcggctggcccaagacgaggccctgcgggccaagaacctactgctgacagacaagatgaagccagaggagaagatggccactctggaccatctacacttgaagatgtgctccctccacgatcatctcagcaacctgccacttgaggggtccacgggaacaatggggggaggcagcagtgcaggaacccccccaaaacaggggggctcagcccctgaacaataaatggcctctcatgctagcatga

SEQ ID NO: 194265 - DNA, 1983 bp, Homo sapiens
gtaggtaggaagtctcagaggaaggagcccctccctgggagccagacccccacaccatggcgagcgtggtggtgaagacgatctggcagtccaaagagatccatgaggccggggacacccccacgggggtggagagctgctcccagctagtcccagaggctccccggagggtgaccagccgggccaaggggatcccgaagaaaaagaaggccgtgtcgttccacggggtggagccccagatgtcccatcagcccatgcactggtgcctgaacctcaaacggtcctcggcctgcaccaacgtgtcactgctcaacctggccgccatggagcccactgactccacggggacagactccacagtggaagacctcagcggccaactcacactggctgggccccctgcctcccctaccctaccctgggatccggatgacgcagacatcacggaaatcctgagtggggtcaacagtggattggtccgcgccaaagactccatcaccagcttgaaggaaaagaccaaccgggttaaccagcacgtgcagtctctgcagagcgagtgttctgtgctgagcgagaatctggagagaaggcggcaagaggcagaagagttggaggggtactgcattcaactcaaggagaactgctggaaggtgacccggtctgtggaagatgctgaaatcaaaaccaacgtcttgaagcagaattctgccctgctggaggagaagctgcgctacctccagcagcagctgcaggatgagacgccgcgacggcaggaggccgagctgcaggagccggaggagaagcaggagccggaggagaagcaggagccggaggagaagcagaagccggaggctggcctctcctggaacagcctgggccccgccgccacgtcccagggctgccccggcccgccagggagtcccgacaaaccctcgcggccacacggcctggtccccgcaggctggggaatggggcctcgggctggcgagggcccctacgtgagcgagcaggaattgcagaagctgttcaccggcatcgaagagctgaggagagaggtgtcctcactgaccgcccggtggcatcaggaggagggggcggtgcaggaagccctgcggctgctcgggggcctgggcggcagggtcgacggcttcctaggccagtgggagcgggcacagcgcgaacaggcacagacggcgcgggacttgcaggagctgcgaggtcgggcggatgagctgtgcaccatggtggagcggtcagcagtgtctgtggcttcactgaggagcgaactggaggggctgggcccactgaaacccattctggaggagttcgggcggcaatttcagaactctcgaagagggcctgacctctccatgaacctggatcggtcccaccaaggcaactgtgcccgctgtgccagccaggggtcgcagttgtctacggagtccctgcagcagctgctggaccgagcactgacctcactagtggacgaggtgaagcagaggggcctgactcctgcctgtcccagctgtcagaggctacacaagaagattctggagctggagcgccaggccttagccaaacacgtcagggcagaggccctgagctccacccttcggctggcccaagacgaggccctgcgggccaagaacctactgctgacagacaagatgaagccagagtgaggaaggaggctgagggcatgggaggagggtgagatcttggggaaagggcctgatctccccttccactccaacaccccagcacctagccatgccgccatcaactccccgctgcctcatgacagggagaagatggccactctggaccatctacacttgaagatgtgctccctccacgatcatctcagcaacctgccacttgaggggtccacgggaacaatggggggaggcagcagtgcaggaacccccccaaaacaggggggctcagcccctgaacaataaatggcctctcatgctagcatga

SEQ ID NO: 194266 - DNA, 376 bp, Homo sapiens
cagaaaccccccaaaaaaaaacgaaataaatgctgtcttccccatcggcaaaatggcatttctgtagtcctacctctccagctaactatggactagggtaaacaatcaactatgcagtctaggaacaaatttgcttaaggaaccattgtagcccagccaaaaaaaaaaaaaaaccaaatcccccaaaaaggaaggattcaagccagggcttgtttaacatatgagactattcaggacaaatggagaagggtacaatggcaagctatctcttgttcacacccctgaaagaacaagagttaggaaaattatctaagacaggggagaatgggaaaagctgtggaacaagtaaaatattaaaaacctttataaaaacccc

SEQ ID NO: 194267 - DNA, 722 bp, Homo sapiens
tacccccactcccatatatgcaacatgcacacagctacatgaatactcaatactcagggatatgcttcagcacaaacatccatacatgaatggaccacataactgctctcaaggaagataattataaccaacatattgaatgctgtgggccagtcactctgctaagcctttactagtattttacaatgattccaggacactagtaacatcaatatctatgcattaccattgatggaagtgagtcctagagagatgatgctattgtgttcaaatcacaattagtgaatagcaaacaaataatcctcacaaaaatctatatgacttagaaaaccaagtgcataactctgtgctgcattgccacttcacatacatgggtgccacacttacccatcctcccatattattaccaggcttagggatacacagcctcagacatacagatatatatatatatttgtttatatagctatacattatgacatttgtcataatgtccacacactgacaaatatacattcaaccattaatttgtttacttattcaacatatctttaatactcctctgctatgtgtcagattctggctatatagagacagaaatggctgagaatggtggctggcacctttaatctcagcactttgggaggccgaggtgggaagatcacttgagactaggagttcaaggccagcctggacaacataatgaaaccctgtctctctca

SEQ ID NO: 194268 - DNA, 391 bp, Homo sapiens
tatactcagtaacatgttaaataagtgagaactcagaattgtggaatttttcctttactaaagagttcctttcatacaacagtctctcaaggtgacaatgtgctaggttacaatgtgtaggtaacaacgttggagggttttttatgttgaaatgtctgagtggcactgaatgtcaactccattaaaaaaaattaacacagacacacccggttatttaacaggaagtgccttgcagtaacacaattcagaagccacctggctcaatttatgggctgtgaagtctttaaaacatagtttcacgcttccataggctagaattgctgagcagcttaataagaaggattttgaacatgctgttatcttagaaaaggcaagtaaagcctctcgaaat

SEQ ID NO: 194269 - DNA, 460 bp, Homo sapiens
cattctgaagaattgccaggacagctctgggttaaacagtctcatattgtgaatcagtgttcctaaatagctagccaaggatcagcctgccagcactgaatgtacggccagccctctagggcagtgctgtgtctgtgggttccaagtcagtattcactgaattaaggtaccatttagctctccctgttgactctttctagttctaaactgtgttcaacaacatcatttaaataatgacggcatttttaatagaagctgttgaaactgaggtgaaaggaaaggtgccacttaggattttaagtactctaaattttgccacattctcctaaaattataataggattgacttaaatccattagtctgtccttcactggcccttaactaacatttcagggttgaggaagtattaattaccctgttggtaggccttgtttcattataaggtttctgtgagcttgt

SEQ ID NO: 194270 - DNA, 640 bp, Homo sapiens
ctaaaattattttaggtgtcaccaatgccttcaacaatgcaaaacctgacagaccctttttcctgacctctcatttcctgacatatagcatttggtgtgttaaccatcctttccttgggaacacatttttctcttagcttctgtgataccttttttgttttttagatttgacagacatgtgctctttttcccctgaccatttctaaaattttgatggtttccatttggttattactctttacttctcatattctccttgagtgatgtccactatccatggcttcaactactacctatatgcaagcaactgttaaaacaacctgttttgctttttggtggtgatggcggtatatctctgtaaatttacaaaaatatcattgaattgtaggttttaaatattttcagcctaggcctttgcctacaaccgagataacatttgtccattacccatgtccattcagattttgcttgaatacttcaaacagcatgctgaataatctcatttttcaacccaacactgctgctttattccccaaggttccatattagaccactttcaccactctatggagagtactctgcatgagcttatcactccaattactatgtgaaggcttacaaatccaaaattttattccca

SEQ ID NO: 194271 - DNA, 257 bp, Homo sapiens
agtacacttaaaaaaacaacacacacatgttgaaagacaacctgaagatatgagaaaatgaagaagagagggacacaggtaagcagcaagcctcgtaatacacttagttaggtatttcttaaccttggcataatggatcagataattacttattagggaagagaaggggtgggctgtctattgtggggtgtttagcagcatctctgccttctattcactagatttcagtagcatctcccctttccagttgtgaaaat

SEQ ID NO: 194272 - DNA, 322 bp, Homo sapiens
aaagttgttaagatgattgtcatatgctgtggggattgagaatcaccactcccacagttgccaatgcctcccatagttgggatgctgttttgaggtttgcagccacatttaagctgcatctggggaaacatctgctatttggtctttgctattttcatggtagatatggacagtggttcgcatgtaaacttgaaaagtatgtgaagttgtggaatggggtgtctaacataatccacattcttgggttgggtaaaaacagtttgttttatgggaaaatacaaatggccttagttcaaataaacatgcttattacagtaaagtc

SEQ ID NO: 194273 - DNA, 478 bp, Homo sapiens
gtaatctcaataggcaacatgtgatgtggcttccaaaaccagatttcagttgtgttttcagaaatgagacacttaggatatgggagactatatagtccttctctgattctatttgtggtttgataagtacattctcagggttgcaatctgatgacctcaatgataagtgctgttttttttccaagagtcatgctctaagaggaacactgacccatggagctggtccagggacggaggggcaaggatgggaaggaaccctgtgtggggtgaggggcaggaaacgggctcactgtcaacaattctagggctgactcctttgcgaaggatcggtcacaatggcaccagagggtaagatgtgggccagcggagagaagaaagaacaagataatctgaccctacacagaactaggctgtagcctcctgaacgccccctcaaagcacaggtggctttaccaggtgctgcctcatagagcactaa

SEQ ID NO: 194274 - DNA, 422 bp, Homo sapiens
cattgaatttttacagcagccctatctgagtagctgctgttattatcatctgttctttactggaggaggaatctaaagctctgactcagctagactgctgactttccagtggaccttagtcaagggacttttaggcaagtcttctctgggtccaatatctaggactacagaagtaattccttccctgcctagagcattggattataaaagtgaaaacaatttacaagctgttatccatttgtttaaatggtgtctattgagaacttaaagcaaggaagaggccctggcactacagagaaaaataaagcgtaatcctgcccatggaaaaatgcaagataaatgttaggtaaacaaggctttccatttccagtaattatggactagaagactgctccccaacttcactgggaattttttttttg

SEQ ID NO: 194275 - DNA, 530 bp, Homo sapiens
atttacattttatgctggataattctgttgtgagggactgtcatgtgcattgtgagatattgagcagcatccttgtcctcgtacagttatcaggtaaaatacagagtgtgtcagttcaatttgaatttcaaataagcaacaaataattgtcattgtctgtgtatccaattatcaatgctgcaggtctgtaattggtcctccatagcacacttacattatgatgtaaactcatattatggttatcacaagtaatacttatttataaatttattcttgttgttttttcttttgtctgaaatgtaaatttaactaggcctcctatatttttatttgcttaatctgttaacattacaatagatgccagcagcatccgtccaattttaactgaaatgtctccaggcattattaaatgtcccctaggggggcaaaattgccctgtgtggagaaccactgtcctaaagggatttcatcctttgcacatggaaatctcgtggtctattctctggatattttaattttattcacacatt

SEQ ID NO: 194276 - DNA, 214 bp, Homo sapiens
gtgctctgtgttttggccaagctggtttacccactctctccccaaaaagaccccccttctaaatcagcctcccttacaagaggtggtccggcctgatgattaggatcccaactgtggtgccagaatgcacataattggaattcaaatccagcagcatcactttacacactgtgtgaactcaaacaacttacctaactcctctgtgccccagctt

SEQ ID NO: 194277 - DNA, 228 bp, Homo sapiens
ggttctaccattaaataactccagttcctccccatggaatgggattcagtggcccccggggagggcttgtgcaggctgtttccccagggagatgagtgagttgaactgttgggttattaactgaagttacttcacattttcattaaaccttggctcagcatctacctgataattttagtgttggtgcatcagtaatacctttcctggttcattgtatagaactgtcat

SEQ ID NO: 194278 - DNA, 255 bp, Homo sapiens
aaaggtggagaacttttaaacaaaattatcggatgccattgtattggactgagcttgtgcactagaccagacaaaacaaaaatgtcatcactcatgccaaatgcaacataatcaagttgaaactacgaggcagcatacagatcccaaagcaaaccattttttttcttcctgagaacaggggattccagcataataaagaagtaccttttgctctaattcttaccaaaaaaactaacctaaagtccttgtagccct

SEQ ID NO: 194279 - DNA, 231 bp, Homo sapiens
gagctacaggcatggttttgtgccctttcagagtcaatgggctatatgcataacatggaacaaaaatgccatgttagatatcgtactgattttcatcttttagtttatatgttggtttctttgtgaaaataaatttaatatcaattcaacagacattttgccattgatatattcaataaaagttttgcaacctggcatgattctttatatgttattaccaattcaacattc

SEQ ID NO: 194280 - DNA, 462 bp, Homo sapiens
taggtactaaaaaataattgtgtttgatagttggcagtcacccaaaaatatccaaaaagccatgaaacagtaaaggtaaacaagtaggaagtgaaaataatattcgtcctttgttttctttctggagtgctcaaaacaccctctcaaaccatttttctcagcatagaaccaagtgtggtcaggttaacagctaatatttacaagggaagaaacgaaccctgagatatttagtcacttgttccggtgatcacagaaaatcggcgaagaaacacatgaaactgccaacgatctctctattgataacaaggataccgtgatttttatgtaatattaatctgagaagccaggattattttgtaggtattagctttacgaagatgcccttacatacaaagaaaaggataattttaaaactttcccagaaaaatggatggcttatttttgttctttaccaaaaaaaaa

SEQ ID NO: 194281 - DNA, 406 bp, Homo sapiens
actacgtcgcatatgttaagaggaactaagtatagaagataagacttctagagtttccttaaatctctaatatgtttcacactgaattttatctaaatagttactacatgccctttaagagaaactgataaatgattcacactaaggggaaaaaaatcaggaaatattcagactttagtttctggcagagtagaaatgatacattttcacattgctttaatctctaatcaacatttaattagaaaatgaaacaaatgttctgaaacaaagaaaaatcaatgaaaagacacaaagagcattaatatgtggaatgtaatcaaaattgtagctaattgttatgctgaaaaaattagctacatgtggactgaataaaataaactctatgaaattgccgacatttgtagtt

SEQ ID NO: 194282 - DNA, 215 bp, Homo sapiens
acttaattatcatacccaacaaaattaataattccttatttattatttaatatctagtcctacatttctagggaactttataaccttttttttctctttttcttcttgagacagggtcttgctgtcactcaggtggtggcacaatcacactcactgcagcctcgacctccagggctcaagcgatcttcccttctcagcatcccaagtagctggaa

SEQ ID NO: 194283 - DNA, 430 bp, Homo sapiens
aagatatttaaatggctaataaatatctataacatataagtatatacatctgtttattcattttcttcaataatcaaacagattacaatgaagtatatttcatctatcagatcactgacaaatattaaaggcttaatactaaagtggtagacactgctggctgcagtgtgaattgatacaaccaatctgatatgtatcacagttgtgaatgtgcatagcttctaaccaagctttccatgtctagaaattaatcataaggaaacaactgaatgagctgaagaaaacatatgaagatattcactaaaagcctaaaagtaaatctaaatgttcaatgggagattcatgaatgggaagcccttcaatggaatattaggcagtcgacatataagaatatatgttggaggccgggtgcggtggctcacgcctgtca

SEQ ID NO: 194284 - DNA, 632 bp, Homo sapiens
aagatacactatttctctgtgtctcttgatattttctgctacaatagggagagctgtgtggatcgcttaatggccagtgtggttgccatatcagtttccttggactgctgtaacaaattacaacaaactgggtggattaatacaacagaaatgtattttctcacagtcctggagtctagaagcctacatcaaggtgccagcagggccatgttccttctaagaactctaagggagaatctttcctcgccccatccaggtgtggtagctcccagtggtccttggtgttcattggcttgtagcttcatcactccaatctctgactcttttgtcacgtgtgtgtctagtatgtcttggcccgtttcaacccaggccagaagtgtttctgctgttcaaaaacctcgtcagttgtccatgtaattcacaggggtctaagccatcagacaagcaggtcctttacaaaactttcctggataaccctatttctgtttctggcttctgttgagatggttgattggatccattacacacaggcctattctcttcaataaaaagtagttcagccgcacgctgcgaggttgagaattcaatttgtattgtaatttaggcactcataggatgagtctctggctttg

SEQ ID NO: 194285 - DNA, 801 bp, Homo sapiens
tgcgtgttctgaggatccctctctccacactggagtttgacagaaactaaagagaaagagttgagaagatacatgcagagtaaataagttggggcctcatcatatccggaaagtttgacaggaggttcatctggaaataatatgtggggaatattttgcatgtaaggacccagaaataagtacattagaataattcaaataaaaaataatgaaagcccaaattgaggtactgaaattaataagggaaaagaggatttttgtaagatatatttcactagtcatccagaaaggatttagcaatggatagaatttgagacaatggggagttgtgagttaaggctactttgagattttaagcccagagggcaataaaaatgatggtcctgttcacagaaatagtagtggcaatgagagagggaagaggattcgctcaattttgaaaacattgagtttgaggagccaatgagagagtgtgtggatggcatacccatcaaggagggagatccattactggagcttgacaaaaacaagagaaagagttgagaagatacatgcagaagacatgtaggcatgaatgagggaaagaatgagagtagaaaagacttggaggatggaactgtgcgctgaaatgcagagggaggcaaagcaactggctggggctgaaaaagtaagacactcgaaacaaaccttcatcaaaaccaagcaaacaattttagaaagcaagggatggtcctaaagccagtcgccagctagagcagatgaggccactgattttagaagtcaggaagtcattggtgagag

SEQ ID NO: 194286 - DNA, 500 bp, Homo sapiens
ctcctcctcccgggttcaagcgattctactgcctcagcctcccgagtagctgggactacaggcatgcaccaccacatccagcgaatttttgtatttttagcagagacgggatttcaccatgttgaccaagatggtctcgatctcttgacttcatgatccacctgccttggcctcccaaagtgctgggattacagccatgagcaaccacacctggccctggctctggcccactttttaccagtatttatttctgctaatcaatgtgacacatccctatggtgaaaacttgggagaggaaattgtggaaaacacacacacgagaaatcactcatagtcccaccttccacaggcaaacactgctactgttagcatctttcttcttcttctgtgaactctgtcctttacacagtggagactgacctctatgtttgatttcctaacatttccatgtgtcctcagtacacctggataaacatcacgtgcagaagccagataacatt

SEQ ID NO: 194287 - DNA, 339 bp, Homo sapiens
atcagtagctactatttgtgtagcactttacagttttaaaatactttccatgatttatatcatgtgagatgatgatcctattttacaccaggcaattaataatatttttcaacaatataattggcatctcaaatacatagttgttttcctgaaatatcaataaataaaaccaattttatgaggcatttatataaagtagcccccaaatgtttcataataattgatttttacatatgaagcctattatctctgtcattatattttcttcaagtgatttgttgctaatttatgtttggaatgatggggaggtctatagacagcattgaagtgggcatttta

SEQ ID NO: 194288 - DNA, 167 bp, Homo sapiens
atagcatgaggaattacaactactggatctgatattcaagtatacacacacagccagggacccatagtgcccatttcccacagaagaagaaaaaagaaggcgtgtaactgttcattccaaagctatcatctacttttagctcacatttccattgggaaattcagttt

SEQ ID NO: 194289 - DNA, 277 bp, Homo sapiens
tcttccttttctcttaggtctggtgttctctgaactaattcactccaaagtgttgctgtcaaggaagactcaaattataaggaaccactaggaccatctttattagagactggcctttactttcttaggtcttaaatagggtgtggatgggagaggttttccagttcctgtttcacaggcattaggaccaatctttgtgggcagccacccactcatgagtgtatgtctctctgtctctctctctctttctctctctctctcagtatggtgtgtgtgt

SEQ ID NO: 194290 - DNA, 311 bp, Homo sapiens
cttcttttagatgaagaagcaggtctgctcctcttggaatcagacactggaatgtaaattatttttggccgggagcagtggctcacgcctataatcccagcactttgggaggtcaaggtgggcagatcacttgaggtctggagttcgagaccagcctggccaacatggtgaaacctcatcgccactaaaaatacaaaaatcagccaggcatggtggtgtgcgcctataatcccagctactcggggggctgaagcaggagaattgccgttgcactccagcctaggcaacagagtgagactctgtctcctcaa

SEQ ID NO: 194291 - DNA, 353 bp, Homo sapiens
tttgggaggccaaagcaggagaatttcttgaggccaggagttcaggaccagcctgggcaacatagggagacttcatttccaacaacgatgacaacaaattatattagctgggcgtggtggcgtgtgtccatagtcccagctgcttgggaggctgaggtagaaagattgcttgagcccaggaagtcaggctgttagtgagctgtgattgtgttactgcactgtagcctaggtgacagaacaagacgctgtctcaaaaaaaaataatatggaaatgcttgccattctctgtacacgccatgatcttttatgcttctgtgttgtgtacatgccattctcctggccttgaatacctt

SEQ ID NO: 194292 - DNA, 441 bp, Homo sapiens
tatagcagcgtaaggactgactaatacactctgtaatagaaaagatgtttatttgggagtatagtagtgcgctgagaatagatgtgccatattaaactgtgttcatattcagggaggtaaaggggaaaaaaggattttaaaggaaataatgaagaggattccataattcttttcaaatgattatccttggctaaaaagatcaataacatggtgacaccagtctgagtttggacagccagtttttgggcagatgtcctcgtggaagtatttttctttgcaagggtgagatttttgcagtctcttacgatagtttttgttatcaggcatataagcataaaaaccattaatatacactagagatgcattgaagagcttataaaattgttaaggttttcttctttggtcagtgtctaaaatatgagtcagatatttccttggtta

SEQ ID NO: 194293 - DNA, 465 bp, Homo sapiens
cgggttgtccttttactttaatagtgtcctttgaagcaaaaagtttccagttttgaaacagtctgatttatctatttttcttcggttgtgtttctgctgtcatatctaataaccattgcctaacccaaggtcatgagatttacacttgtgttttcttctaagagttttacagttttagctcttacatttaggtatctgatccgtttggagttaatttttgtatatggtgtgaggtaaaggttcaacttcattctttgcagatgggtatctattaatagttgttcctgcactatttgttgaaaacactattctttcccccattgaatggtcctgcacccttgttgaaaatcaattgacaatagatgtatgggacctgggagctttttaaaaatacctgaatttcaccacaggcaaaatgagacagattccctcaaggtgggccctgggcaatgacatttgacaaag

SEQ ID NO: 194294 - DNA, 229 bp, Homo sapiens
tggggagcttgaggtgttgggctgctgttctttaaatctcttgtgtttgagatcaggattgattacagaggcaaaatcagggtggagactgctgtagggtcacatggaccctgctctgaggagcaatgggaaacagaggctggaaactaggaagagcctcacagattggagaagcagagcttagtcatagcagggcagcaaaagaagacagagagaaaacaaaacaaag

SEQ ID NO: 194295 - DNA, 441 bp, Homo sapiens
gactgagtctcactctgtctcccaggttggacttcagtggcacaatctcagctcactgcaaacttcacctcctgggttcaagcgattctcctgcctcagcttcccgagtaactgggattacaggcgcctgccaccacgcctggctaatttttgtatttttagtagagacgaggttttaccgtgttggccaggctggtctggaactcctgacctcaggtgatccgcccaccttggcctcccaaagagctgggattgcaggcgtgagccaccgtgtctggccatacacatccctgctgaagcccgcattacccttcccctatgctatagaagccctgggtcgggggggtgggggtaatggcacagggatccaccatcttatcttggtgccatccctgacttgccttctgttcataaacgcctattaaatgtttctttctgaga

SEQ ID NO: 194296 - DNA, 319 bp, Homo sapiens
ctcccctcccccacagctcagtatttataaggacatttaagaaaaaatacacactacacacaatggataaattaacagaagagttaaaacaaaagttcagaataactagaaatgttaaagacaaaaatatgtaaaggcttttaaaatacattaggatcaaaaagatgaggaaagaagaacaagaatcactagagtccatgattccagcaccaataggtcattaaaagcagaactattcaactcaatttttatttctaattgttctagttgaaaataaaatgaggccaaggcatggtggctcacgcctgtaatcctagca

SEQ ID NO: 194297 - DNA, 293 bp, Homo sapiens
tccttgccctccaggctgagtgccagtgtgggagcgtgctcatgagagccctgcacaagcgggttttgagcacatgctacgctctagccccgtggaagcctggactagttagaggcagagaacagctcaggacagacacctccctgcagagccaaacagagtgcagcgcctgcctcgctgggccatcctgagagctggggccttcccaggaaagagggagctcggggggcaccaccccatcctcagctcaagcccctggaagagcgggagaaactagcagcgtggaagatgtt

SEQ ID NO: 194298 - DNA, 654 bp, Homo sapiens
aacttttcatgttaaccacctataagtaacatttccttttttcttccccactggaaactcaacctatccctgcactttcccctttttttgagaatacacttcagagtcacagtaacaacactactttaaaaacaaagcaaacatacatattttagaataaagaaggcaaaacaactatttgcaaacacccaagttgaagatacttctttactgcagcttaaggttttactcaaatactatacatttaaaaatgatttatgataaaatgttattacccttaaatgtgagctctagagtagtgagtttgatcatgacttctgagggggaaatagggatgtatgatgtacctataaaactagctatgaagcaagccaagcttctagcaaagaaataaatcagcatattcctggtgcggaggggctcacatctgtaatctcagcactttgggaggccgaggcaggtggatcacgaggtaaggagttcgataccagcctggccaacatggtgaaaccccgtctctactaaaaatacaaaaattagtaacgcatggtggtgcacgcctgtaatcccagctactgagcaggctaaggcaggagaatcacttgaaccccgtagacggaggttgcagtgagccgagatcgtgccactgcaccc

SEQ ID NO: 194299 - DNA, 375 bp, Homo sapiens
tcggcggtaccgatgtatcccaacacagccaacacattgacagtgagataatggtacaatcctaacggaagggaatccagcaatacccatcaacatttaaaatgcgcagaaccttggatcctacaattccatttctagcaatgcatcctatgcacatattcacgcaaatatgcaagaattacatacaactcagcattgattaatccaaacagttgggaacaacctaaatacttagcaatggggaactggtggagaacagtgtttatcttatgccaacatctgtgtttttaaaaagaagacacataggccgaccctatgaggacaggcagagttgactttctcagagctgctgtggcaagggagtcggtgtcgtca

SEQ ID NO: 194300 - DNA, 875 bp, Homo sapiens
aagttaagaactatgtagtacagttaggcagttacaatttttacatcatctgacatccaccgaaatggaacttctgaccagccacagttcagcagccaggctaagctggctgcataactgaactcatatttataaaaagaggggaactgagatgtagcaaaaattgtttgttgttattccttgcttaataacaataatcattaggagagctaaggagataaactacactcacaataactggaatattcaatgataattatccccattttgaggctaaatagtgattcaccaaggccaaataggtaacaaataatagggtcaaaacttacttgaatcccacacgcttttctgtatatcaccctgcttcttttttacctttatggaaatttacttggaacttactatgcaaaaatatatgtggccaggcgcagtggctcatgcctgtaatcctagcactttgggaggccgaggcaggcaggttacctgagctcaggagttcgagaccagcctgggcaacacagtgaaaccctgtctctactaaaatacaaaaaattagccgggcgtggtggcgtgcacctgtagtcccagctacttgggagtctgaggcaggataattgcttgaacccgggaggcagaggttgcagcgagctgagatcatgccactgcactccagcccaggtgacagagtgagactccatctcaaaaacaaacaaacaaacaaaaaacctcatgaagagccagtttttttcaaattacaggaacttttaagtcagatcatatgtaaaatgcctgaaaaaatattaaaatgatatcagatctaataaactcagaagtgaactaaaacaataaaatgtagtggggttattcatcaagtg

SEQ ID NO: 194301 - DNA, 112 bp, Homo sapiens
agatatagttaattacactgccatgcctactattttataagaaataggatcatctcattgaagagtaagataatcaaaggaggaggagtagcactgaacaactgattcattg

SEQ ID NO: 194302 - DNA, 230 bp, Homo sapiens
ccaagcccctacaacaaaacacagcacaaaagagatcttctagtattagctacacaaataataaataccacgaagaataggaaagaaaggcttcctcaaatacaaagctctttatcactgggaagatcactcatcaagagtaagagtttgacattataaatccattccagaaacacatgggccaggcatggtgtctcatgtctgtaatcccagcactttgggaggccaag

SEQ ID NO: 194303 - DNA, 366 bp, Homo sapiens
taaaattggatcgcccaactccaaaatctgggcacttaatcactatgccacattaagtctttgtactccttttttggcaactcccaaaatctgctttctattagttacttgagggcacgtgcgtgcgcacacacacacacacacacacacctcttaactactgtagaattgaaacagtcatattcatttaatttggcccagggttttgtacatatctggtatttaataagtaggtgttgaactaaatttgagtctttaaaaaaattcctagaaaaaaataactcagtcaatttcattttcagcttttttttttttttttttttttttttgggaaaggattttgtggctgtgtccccagggtggggg

SEQ ID NO: 194304 - DNA, 315 bp, Homo sapiens
tttcattagtcagggagagatgcacactactcagctgtgattccttaccccctcatattggaagcagaatatattttactacacttgtgttgtttccagtgaaaatagacaacatgctggcatatgattatgtcagtttctccctgtggaagcccaaatgaggagagaatgcgataatgagctcctactgaatttacctgaatcctctgcaaatacccaagttttggaccccagcaattaaatgggctgtatgtcctctaaaccaaaggagcacagtccattccccatgatggtgggtgatggtgatgatggtgg

SEQ ID NO: 194305 - DNA, 331 bp, Homo sapiens
gatgggggcgccgcagggaagctgggggttctgcacctggacggcagcactggtcagggcaccacccaatgagtttgtcaaaacgtatagaactgtaccctgcaaccagcgaactacgccctaggtgaactgaaagaggaagatatacgaataaatgtgaggccaggtgcggtggctcacccctgtaatcccggcactttgggaagccaaggcaggcggatcacctgaggttaggagttcgagaccagcctagccaacatgaagaaacctggtatctactaaaaatacaaaattagccggacgtggtggctcatgccagtaatcccagcta

SEQ ID NO: 194306 - DNA, 260 bp, Homo sapiens
tgaagctctgtctcaaaaaaaaagactttttattcatacctaagttgtaagagattcacagtttaccctacattaactcaatgagaatgatgtactttcttggcacaaataaatttgaaaatacatcggctttatcctgctttctgattttgttatatgtggaggatacatttatgagaagttgagagccagcttttctaactgtgtttccaattgcattccaacttcataataggaaataattttattgttatattttg

SEQ ID NO: 194307 - DNA, 280 bp, Homo sapiens
gaatagacatattacaggagaaggaatatgttgtagataagcccaatggggaaattagtctgaaggcatggacttacagctctacaactaccacgtggaaatggctcagaagcagttggaaacctgactctgaagcttctgaagtcattagcatattggtagcactaaagaccacagacattcatgagctgggaagagtatgtaacataaaaagatatgggctaaggagaggaccccgggggacatggacacttttccatggtgcggagagcgagaagag

SEQ ID NO: 194308 - DNA, 568 bp, Homo sapiens
gcgatattttcagggtcttttcccctcaaatattttctgtccatagttggttgaatccatggatgtggaacctggacagagggctgactgcaagttatatctaagaagttatacacataacttattagttatacatccattgtaacttttcttattaaatataaacaggaagcgaaagactgtcaaagtgggtattatttaaatatacaagttaccactagcttcatcagcaaaaacttctccttgcgctccaccagtgacacacatatgctctcagcatgcatcttaagctcctacccctgaataatatgttctgtagtgttaacttgagtttctgtaattatgtcactataatacagcacattgcatatacatgaaatatcatacctttataactatgtccactttattactggatctaaatatcttttacacagaatacacacaatttttctagaactttcattttcctgcccagaagatatcaaacaaatatagcttaagtgaacccttgtttgaaaataaaccctcaactattttgaggggaaaagatcctggggtcctctag

SEQ ID NO: 194309 - DNA, 311 bp, Homo sapiens
  misc_feature (41)..(41): n is a, c, g, or t
aaatagtctgtatatctatcaattctggcttcatcccaaanatgtgggacaagggaaaagacaattttactttatcttcagcatccagttttcccctaacgtaacctttatagggttaagaaagttatcgacatagttacctaggttgctttaagttattttttttcatcaggaatagatattagattttgtcaaaaggtttttctttgtctattgagataattatatggagttttcttagactgttatgttagtttcttactatagtgaattactctaattacatttcttttttttttttttttttttga

SEQ ID NO: 194310 - DNA, 291 bp, Homo sapiens
gtttgatggagaagattttaggaaactgagtgccgagcaaagtttttaggtgttgcctaacatcagtagatagagtattgcattttgacacactttgcaaattctaattcaaggattggcaattgttttctgtaaaggaccagatggcaaatatttttggctttgcagggtgtatagttgcagcttctcaactctgctagtggagtacgaaagcagccacagacaatcaaatgggcctggctggttccgataacattttctttacaaaaacagtgggtggcatcaccagcc

SEQ ID NO: 194311 - DNA, 246 bp, Homo sapiens
tgactctgaggatcctccagtgcgatatctaggagaagatagaaatttagagggttgggtctggcatttggagctacttttttcctggaagaatatgacaattctagaaaatgtggctgaaaggctgaggagtatttttaaaagctttgcaaaacaagggggacaaaaaacttgagtcaaggttggggccctggtaaaccttcttcatttgggtagggactctaaaagtctatgccctagtggtaa

SEQ ID NO: 194312 - DNA, 343 bp, Homo sapiens
ttcagaaaaataaatttaagaaaactggaatccttgctatttttcccttcttgggcacttgttactatccccttccaaaaacaaatcagttggtgagtggatttgtagaaacctaatcaaagcttagaaggtatgtcagattacgaaacccagctgaaaccttttgagcctctaaaccatgaagcaactaaccatttgtacttgccttagaatagcagtgtcatgccagctctggattacctacctgctactaccaaacagaaaaaaaaaaaaaaaattcttatttaagccactgttcatttggctttctattaaaacagtagatctgtatctgaatacatcg

SEQ ID NO: 194313 - DNA, 315 bp, Homo sapiens
ataggggggagagaatatgagcacgtctctcacctccactgcgcccatcccagtccaggctaccattgtctcctgcccggaccctggccgagctctccgcatctacttctccacttgttcacccctcctgctcccccacctagtctccatatgaggatcaaagagatctcattaaagcctgtaatcccagcactttgggagtccgaggcaggagaatcacttgaattcaggagtttgagactagcctgggcaacatagtgagacccttgtttctatcaaaaaattttaagaattagcctggtgtggtggcatgca

SEQ ID NO: 194314 - DNA, 466 bp, Homo sapiens
gcctatcaggacaacatgcagacagcacagcaaacaggagttgtgaacttattttacattgtactacttagtgctatggcacttacaaggtgctacatccataactatggaaaacagagtagcaaacacaaagaaacagaaactgtagaactagagatctatggaaagagaaagcaagcattgtgatacttagcttacaggaaagaaagcagaaggtacccacagagaggcttagatataatactggcagaacaatttacagactaacattatgaaaaagaaaattttcaagggaggatacaagatctcctcctcaggacacattttctaaaaggacctctgaatgcggagggctagtctttgatacttaaattttactataaacaaggcagacttatttggattatagactcagtcttaaaaattctttttaggaggtgggcgtcatggttcatgcttgtaattc

SEQ ID NO: 194315 - DNA, 341 bp, Homo sapiens
tagttgggattacttacaagcatgtgccaccacacccagctaatttttgtatttcctgtagaaatggggtttcatcatgttggccaggctggtcttgaactcctgaccccaagtgatctgcccgtctcgtcctcacaaaatgctgggattacaggtgtgagccactgcgcctggcctttctggggtatatttggcttaagttagttggaagggctctctttattttttattctgcctcccactgaagagacagagttcgctcttgtcacccaggctggagtgctttggcgtgatcccagttcactgcacctccatctcctggattcaagtgattctcctgc

SEQ ID NO: 194316 - DNA, 553 bp, Homo sapiens
gtccttgtttctgtttgacaaaggcctcctcaaagccctagtttcaccatctccaaaatgaggacacaacaccagcttgacataattgttgagacgattaataaaatcaattcattcattcactgacgagcagctctactagatactggggccagggtgcctatcctcacgaaagtgccttgcatacatatggacaaaaaataataaaatagcagcagcagcatgctttctgaataccttttaatgccaggcaaggtgtcaaacacacattatcttctttaacagtcactcaacaagtgtcccatacaagcattctagattgcaccattttgtaatacacagtacaagaatttctcagggcatctcaaaggtattttgccaactcaatctctcctgagctccttccagtcaagccccaccaccacaagtcaccacaagtcaccacaagtgctcttagaatcaccggtggcctcacttttgcagatccaagagtgaatccctagacctcatctcattcctcctctcagcagcatttgacacaatgatggtgtcc

SEQ ID NO: 194317 - DNA, 507 bp, Homo sapiens
aggcgtgaaccaccacatgtggccgaactaaattggtgtttctaatttagttttcctgaagaataacagctatgcatcaatgtggaattgtgttatttggaatctcaccttattggaattggctggtaattgacagtaaaccagaagtgctcctgagcagctaatatctgcagacaaatggagtgtaaactttgctcataggttagttttcaggcttttattaacggttccttgttattatttaacatatagttgtaattcattgagttgtctgggtttttttgaaatcacagatcaggggaatggataggtactgattaagcattatgctactgaaaagaatggatgattaggggaaacaagcatattgggattacttagtgtatgtagggtatgtaggttcatatagttccagggtaaatcattctgataattgttgaaaatgttcacccagagaaatttttttttttttttggagacagggtctcgctgtgttgcctatgccta

SEQ ID NO: 194318 - DNA, 402 bp, Homo sapiens
aagatctctgagcctcagtctcctaactgtaaattaggaatcataaggcctacctcataggattactgtgaggattaaatgagactgactaatgacacaaagtgactaacgcagtgcccaacacaaagcaagctctcagtcctctaattctcccctccccacacacttttgctactctgggaacacagggaggtcaggaacggcatggtgaacttgtgtttcttgccccagaccacttgttctggggctgcctagctgtgagtggggcatccctccagctgcatgcagcctcgaagtggcctgggctggcacacacccagtctccctccctccatccaggcctcttgaatgccctgacctcacccagcactttgctctgaagatctctgagggcttcaaagg

SEQ ID NO: 194319 - DNA, 518 bp, Homo sapiens
cctcctcctacagtcaaacttttaagacataaataaaagtatatagatataaaaaaagtttaagatataaataaaagctccttgataattttaatttccctgcatcatcctaagaagcatattgtcccccaactcatcagtgaaattaaaatcatcaataatcactgtattattaatccaatggacatttctcagcctcattcaagttgacctctcagcagctccaacactactttcttgaaacattcacttttcttgagaagcaattcaacgagcagtaaaattccacagttttacaaaattccctcaattttttacagttgtctcattcacacctatttggcagcttttttgttcgcaaactcacctcttttgtctttctaaagcattcaatttagttttagtttgcttcctttacttttttagaattgttttcacaaaacttttacttcatataaaatactataaagatagcaacaaaaggccgggcgctgtggctcatgcctgtaatctcagca

SEQ ID NO: 194320 - DNA, 681 bp, Homo sapiens
aggagactgccaaggggtgagaatgatgctgcctgagtcatgtcggcaaagggagtagccgaggtcagcacaagtgccacgcaccaagcacccattgcgtgtcagatgctgtgctgggtccctggtgcaccctcttctcatttgctcccataaccatcctgagggggtggacaaggaaactggctcagagaggctaagtgctgtcttacacagctgagtaagtcacacaggtggggaacaaacccagctgtgctttgcccttgccacccagacgagctgccacttggccttcaatttctgtgactcctgagaactaggctgctgaaatattaccaaaatgcccaggccacgtgaggagtgctgtttcctcaacaccaaatgttctctcgtacttttaagcctttgcgcctgctgttcctcctgcctaaacacctttccctagtttgcctggataacagctattgaactagacacatgctttttaatccaataagcgttaaagtagactgaaatcttgataaaatacagattctgactcagcaggtccagagtggagcccaggaacgtgcattttaacaagctcccaggtgatgctgatgccgttggcctgggaacttcacagtcagcaatcagattataatagaaaatccaggttttgctcagggctcacctcctccagga

SEQ ID NO: 194321 - DNA, 625 bp, Homo sapiens
tcgtcacctaattgagttgactgcggtgaacagctgtcataaccagctttctccgctgttacctctgctggacctcaaagcacagggaagcaattgcttcaggaggcacaaaccatccactgcagagagcacctgaaggataaatgacgcagaactctggcccaccgttgcttcatgccaagtggtgtcaaaattctaattacacacaggaaaggagatccagtgagtccagattttgacaacctcatctcagaaagctagaggtgagagctgtctctttttctggtaatcccacagcacagctaaggccctaggacaaatgttctagtctaatggttggcaaagcatgcaggctgatgcctgctttgtaaataaagttttattggaacacagcgatgctcattcattctatggctgctttcatttacaatggcagagttgaatactttgagagactgtgtaacccccaaggctgaaaatatttattatctggccctttatagaaataagtttgcagaccgttgttctattccacggctgggtccagtctgggccaccctcagctgttcatctagatctgttctgcccaggaccaaagctatttgctatgtgtggccactgagcc

SEQ ID NO: 194322 - DNA, 321 bp, Homo sapiens
cctcaagcctcagtccaacgcgaagaagaaacaaactattagttattatgcttctgtcagcttctatttttcaaactaaggtatttaagtatggacttggaaatactcaaactttctgtttgtactaatctgagttagaactggtgaaaggcttaccttaaatgcttgagtggaaatggaatctaatcccaacccagaagcagctgaaaactggcggtctgcccaggctgtcagacaggctctggacacctgccaacactaaggaccctgcagttctctaagattatgtgttaattttcaattactctgcttttctgtctt

SEQ ID NO: 194323 - DNA, 154 bp, Homo sapiens
tgaatgctgtagtcagacaaagcacatctaccttctagttgcttgccagcaaagatcagtctttattggtcaggaggaattcctttcttatcctggatgttggcctttatattttctgttttatccaaggattcaacctcaagagtgatggcct

SEQ ID NO: 194324 - DNA, 150 bp, Homo sapiens
ttacacagcttccttgcctgaaatgctctctagtccctttctcctccgaacacatatattccaaatccagcttagccttcaagttatttctgagaaagacctatcctgaccttttaatataaactatatccttttgtttgcctacatata

SEQ ID NO: 194325 - DNA, 216 bp, Homo sapiens
ccttacacaatttcccttgatcttttaaaggcaggagtgattaccaaagtgagcacgtgaaagatggagattttctggtgacaatccattcatttctctctattactgctactgattttcactgactctagctaacatctaagaacttctgtctactttcagattatggcccattttcaactgtaattcccacatatcttgctcagtaaaatgttc

SEQ ID NO: 194326 - DNA, 399 bp, Homo sapiens
tgtgtaaaatatgcatcagattctgaagacttagtatgaatgaaataatgtaaaacatctcattaataattcttggctcagtgcagtggctcatgccaaatgatgttgcataacttttcacatgcttatttagatattcttctgtcagaagtctctgttgaagtcttttgcccatacttttattgtattattagcccttttgtcattgatttgtaatctgtatagattctggatataagtcctttgttagatataagaactttgagaggctagtcttgaactcttgagctcaagtgatcctcctgccttggcttcccaaagtgctgggattataggtgtgagccaccaagcccagctagaataagtcttgaaaacaggtagggaaagtcttacaacttt

SEQ ID NO: 194327 - DNA, 406 bp, Homo sapiens
ctgccctcagacttctcagtaaataggaaatttctgaagtcccaatgaattgaagacttaaaaggaatggaaaaggtttgaaatgactgctttgggaaattgaatggaaagagtggtaaaactgttgaagagcagggagaggccggtcacacttagatcatgtccatctggagtgggccctgatggttgtggactgtttatccctgagtgaggaaagatacagagtcatagagaacccagagttggagatgttcaagaaggcatcgtagaaggccaggaagggtagcagatatgctaggaagttctctcggaggtctgaagtaaggaagccggcaatgctgaaagacagctcctggtccaggaggtggaggaggaggagttgaagggttggcagttgatgttcaat

SEQ ID NO: 194328 - DNA, 296 bp, Homo sapiens
aatatgtggagtttgaggggtcattgaggatacccagagaaagacgttcagtaggagttgaagatgggggtgagacactgagaaaaccaagctgagctaaaggaatggaactgggagtcctccatgtgggagtggagcctgtgagtgaaatatcccagagaagtatactggtaaggaagagaaaattggaaagggcatgcaggcagagtgccattcaccaagggagagtggaagcattggctgttaaaggtcagactcgacccaagagagcagtgtcagatgccaatggaaaaggg

SEQ ID NO: 194329 - DNA, 334 bp, Homo sapiens
tctctatgtaggaatacattcctgtcctcattatttactaaaaacattgtttctcagtaaggtggtgtcaagataacctgaataagaatcaactgaggtgatttttttttaaatacaaatactctgaaccccatgtcagatacataatcagaatgtcatgggggtgggtcaaagaaatagtggtatctcagaagtcttaaattaaatttgtgaatgaccataagtggcagaagataagattggagataaaggtagaggttcagttcttgcagggccttaaaagacataataaagagttcaaatcctgttctaaggcagcgaaaccattggtgga

SEQ ID NO: 194330 - DNA, 567 bp, Homo sapiens
actctagagtatccccacctcctaccccacgtcctaccccacgagtctcaaaaaaaaagcatttcactgcatgtaaattttacctcaatataaaattaaaattaatcttcggaaaataaaagtacattagagaggatggctaatcaaaatttttgtagccttcaaggagaataaatttgaagcatatctgttgatttgtggaatttttacaaagacttaattgaggaagacttgaaagcattagaaagggtcccgttcctctgttccctctgtgagcccagcttgcctgaagggaacgtgggtctaatccgtgtctggaggagtgagccgaaccacaggaagaagaggtaagaaagacaaaggagaaccagggccacactcaaatccacgctcttcaaaactgtgttttacaaatttgacaaaatatttatactggaaatttttaagcggtggaacctatagacagccttttctttcagcttattttgttagttttaattttatttaatttttttacaaaatgaccaccgttgatataaacaccaatgccgtggggtaggaggttct

SEQ ID NO: 194331 - DNA, 449 bp, Homo sapiens
ttagacgctgaactatgggtgctgacttatgtcttcatagagctcaggttgaaggggcctgcaggtgtataggtcaaatattagtgacttgtttggttgcattgttagtgacaaacatgctgtgtggggaccagcatcctggaatttacaaaatagaaactggcagatgaccggcaggccttccagcatcctgagctctccctaaaaccctctctggatataaccgggactctcgcacggcatctgtcatcccccagctggaaggctgacaagagcagattcccacatggctaacagttgctccacctcagcttcctggggaaacacaaagcctggagcccactccatgagaagtgagagcaacaattcactgcggggccttccagcctcccagccttcagagaaactccattggagagtagcttgagtagatttgccgtgaatatcaa

SEQ ID NO: 194332 - DNA, 173 bp, Homo sapiens
taatgattcatactttctttttatttttctggcttctttatctgttatacatggctctcttttctctaggactgtgccctgcattctcagctgcctcagcattccctaactcctctattcatttgagggctcctacctcctggactgttcaggaaaaggccctgcagaaaaaa

SEQ ID NO: 194333 - DNA, 167 bp, Homo sapiens
caaccgctgttgagttttaattaattaaaattaaataaatttttaaaaattcagttccacaatttcaccagccacatttcaaatgcttcacagccacacatggcttctgtgttggaaagagcggccatagaacattgccatcactgtagaaagttctgttggactca

SEQ ID NO: 194334 - DNA, 409 bp, Homo sapiens
aacatcagcgcacattgatatataaaattgcaggtgatgaaaggctctgaaagaactctatgagtctctggtcttaacgctctcttagattttgatggtacattgtctttttcatttcaactctgttttaaattttttattatgtaaatttttagacatacccagaattagagagaatagcataataaaacttgatggtaccattaattcagtctcaataattgtcaatattttgtcaattgtgttttagtcagtccccactcttggtttccttgtggcctgatctctatctggcagctattaactccaatttgtttcttaccaccatttctcagctcgtctccacgtatgtagaccttcatccaagtggaattgtgtgaagcctcccctggctgtgggaactacattt

SEQ ID NO: 194335 - DNA, 585 bp, Homo sapiens
cccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactggccactctagtcaacaaagacaccagaaaaaaccccaccaaagccacctccaaggacagctccataaggccacctccaaggacaccctccatagccacctccaaagccactaccagcccctccaccaaaagcacagatcaagccgcctccatagccccaactggactagagt

SEQ ID NO: 194336 - DNA, 222 bp, Homo sapiens
cttatataatagccaactgcttcaaatcttaaaatcttcataatcctcatccactacttactagctgtgagaacccagacacacacattagttaactttccagtggctcagttttctcatctataaagtaggaatgataataatagcatccatcttgtaggaacattatgagggctatgtgaaataatactgtaaagtacttagtccctggaactctgttag

SEQ ID NO: 194337 - DNA, 311 bp, Homo sapiens
caggtgctaaaccataaatgtaataatcatcaaagaatggccttaggaatgcttcctgacgttgtgtcctttgtcctcagttcattctaatgagattagtgaagagagagtagaatcctgattttaaggttgagcaaagaaaagcaaagagaaggtggggatgctcaccagccctgcagccccgtgactgacctgggtgccctgactccggagccagtgttctctctaggagctgttcctccgttttgtcattctcatcaaatttgaggattgttgtgaaagagagatatttgaatggctggagcacacca

SEQ ID NO: 194338 - DNA, 381 bp, Homo sapiens
gcaatgtagtggggcgatcttggctcactgcaacctccgcctcctgggttcaagcgattctcttgcttcagcctcccgagtagctgggtttacaggtgcccaccaccacacccagctaatttatttttgtatttttagtagagacagggttttgccatgttggtcaggctggtctcgaactactgacctcaagtgatccacctgccttggccccccaaagtgctgggattacaggcatgagccaccgcgcccggcctgttagagaaattctaatagcattgaacttcagaagtaaggggagtcaaagtttcagtctctccctaggagagctttagaccctatgcatatttgttttcattttcttcagctttgcataccaag

SEQ ID NO: 194339 - DNA, 583 bp, Homo sapiens
caggcctcaggatattggtttaaggaaaaatgaaaactcaaaaatcttctttcccatctggctgcttgggcattttccacctgacgctctgtgttttagctggttctgaatcaccttggaatcatgaaggagcccctagctaggaattcctggggtacaaccaggggtgggacaaagattgttggaagagatggggtgcagtctgagttggggtttctcttaccctgaaagttgtgtgtgctctttcaaatgtgtgagaaagggagttaagtcaactttctttagaaataccccccgaattgtcagatacttccttccctccgctgtggttgaagtgaggtgcaggctgactttcaagtgctcagtgacccgccagcctgggaccacgtgatcgtcctctttcctgtcttcagaaccatcttgaacccttgctctcaagcaagatctttggtgactcattctcccaacctcttcctaaattgcagactcacacaagggaagttaacatttacagcacacctactctgtgttgggcattgtgggtgctattatcctcattttatgagagagggcacaggctggt

SEQ ID NO: 194340 - DNA, 447 bp, Homo sapiens
tttgcaaaaccaaatgttcccatgttcataacatcacagtattaggtattgaagagagcctattacattaccaagtaaggcctcataaaattgttctttagtacatcacaagcattgttaaaaattttttttttccactctttaaagttttatttcactaacttcaggccaaattcccacaactgtgttctgatcaatttactatccttgcttggcttccccaaatggtagtaccaaaagatgtgtggggtagggagaagaaaccactttaagaagcactgcatttactcatcttccacaaggcaacagagttgggcatctgattgttcaacaaaacaaagctttaatagcatccaggagggcagacaggcaaaccacgctgtagacactcttctatttgtcaaaatcagaccagagaaaacctactccacacagatataatagata

SEQ ID NO: 194341 - DNA, 619 bp, Homo sapiens
  misc_feature (567)..(567): n is a, c, g, or t
cctgtcatgcagttaacatctgctatagatgctggtaaaaacaagtgaaagataattgtaggcatgtaactggaaacaagaaaatacaaggctaatctaataaattaagttcttaagtttaatttttcaaaagggccaagcagtcgtcgcaaccacatgatctcgacaagaatcccctagcaactctcaggtggaggcagcacagggatgcggttcctggtgaggagggtcctcactcggtgaccacgctgcctgggctcacagctggagggctcacccatgagggacacgggtggacacccactgcttcacatgcctaattcacattagaaacatgtaaagccattcagtctgtgcaataaagagatcctgtatgaaatccactcattccttggagggaagctggcccggaggcacgctctggttgacgggtgacgcacagtcctccagggcctgcattgcatccatgacacagacacacgtgaacacccagcccgccggtcctagcagccagctgtgaaagctgtgtcaagtcacgggggttcctttctaacagctaaagctcanaggcatactggaccctgagggaaacaggagagctgagatgggacgggaagaa

SEQ ID NO: 194342 - DNA, 1062 bp, Homo sapiens
cagtgagactgaagggtatccacgtggaagcacctgatcaccatcacccagtttgggtgacagacctgagttctctttttttgagtctttcagctgctgttttctaacagctctttggtaattgagggcaactggacagggccactctccagtgttacctgaaggccaaggaatgaatcgggatagcttccctgcccggaagggagaaagactcttttatctttcctggttatagtctctgagttctacacgtgacaccattggcactggtagctcattcagggcgaattcacactcaggcctcttaaaccctcctttcttaggccaaattctcttacagagttagccagtgagggcaaaagatagtatctcctagatattttgacccttctactggatccatttggctggctgatgacctttgggacccacaagctttagaatacattctacatcttggacctccactgaggggaccttgtttcctttgtcttcaccatattatttcaatagaatggcctgcccttacacaggacccattgccatggtggtggatttttaaacattccctctcttgcccagggccagaatggaatagccagccctattttatctttcatgcctaaaatcaacctttttccctgaaattacccataatccacatgacaaaagaaatctaccagcctcctgttcctcttattagggttcacagctatcactctagtggaacaggaagtgtgggaaaccatggccttaccaaattataaggatgctagaggccaggtgctgtggcccacacctgtaatcccagcactttgggaggctgaggcggatagatcacctgaggtcaggagttcgagacctgcctggccaacatggtgaaaccccgtctctactaaaaatacaaaatgagcctggcatggtgatgcagacctgcaaccctagctatttgggaggctgaaataggagaattacttgaacccaggaggtggaggtttcagtgagccaagatcatgtccactgctctccagcctgggcaacaagagtgaaactccatctcca

SEQ ID NO: 194343 - DNA, 613 bp, Homo sapiens
tagtgccagtatgtattgtgggtagtctggagaaaatactgtaatattgagatctagaaaatcggtgtaaaagttgccttgttcgttttttggaccaagttttgctcttgtttcccaggctggagtgcaatggtgtaatctcagtttactgcaacctccgcctcccaagttcaagcgattctcctgcctcagcctcccaagtagctgggattacaggcatgagtcactgcgcccagcctggtctactgttcttttccacctgcagtggacagtgctggtggcgcacccaggtgccttcagattcctcttgccagttctgtgcacccagcccccagcttgtgtgcttggtgtattaatcatgcctttgtattttctgaacttctgctgctttgacaagtgcgggcctcgatgactctggagggactgaccctcccagggatagccaaatgctagagatagttaactactcacctttcctatgtaaaccagccaatccagagcccacaccccatccacacctttatgagcacaggctccctgagccaggcaccaaaaactcaggacagcctctatgctccagagcctgctgaaattcaaactaggtaatctcaaa

SEQ ID NO: 194344 - DNA, 299 bp, Homo sapiens
aatcatagctgacatttgttgagtggtgcttcccatgtgctaggcactgttgtgtgtgtttatatatattaacccaattaatctcaacaatactgtgggttaggtactattatcatccctgttttacagatgagacttctgaggcacagaaacgttaagtaacttgtccaaggtcctatacctaataaagatagggctgggatttaagactagattctggttccagagcctgtacacttataataccatatccaaactttctcttctatccccataaaccatcctcatcccatagtcac

SEQ ID NO: 194345 - DNA, 512 bp, Homo sapiens
cccgcctcagccgccccaaagcatctggcacatattagggcttgtaagttccattaatgagtgagtaaattattcaggaagatttgggaatacaaaaatgaatcaaacgtgctccatgccctgagttgcttcatatagcagcaaagaccaatttatatgaaaataattttaagtctgtgagaaacgcagcagtagaattatatggagggtagagaggtgacagtaataaggaggtgattaattctctgggggtggtggtagacacataagcatttaaataatgtaaatgttttgaaaatgtgacagtttttaacccattaactgttgtggtaggcttactttcgcttgtccagagaaaatggaaatgaagattatttgaatacagtgtgcttgtgactctgtagaaacttgtctttgatagacatctatgtaagctgaattaagcagagggcaaatctctgtcatttgttcctctatgtttatgttgtataatttggtgtcatttcaatcat

SEQ ID NO: 194346 - DNA, 342 bp, Homo sapiens
tgaataattttgtgccttcatttcctcactgaaatcctaagtttatgtgcatgggagtgggggtgggcacagccactgcagcccaggcagaggggactgcgagtgcaaaggcccaggggcagtgctgagcaaggcacgttccaggaacagaacccagcctgtctcagaagctgctgacccagatgagctgacgtctgagtctgattggtgaagtggtaagtgcagggcacatactgggagttatcttgaccaggtggtctacactctgcaggggtgagacctggctgaagcttcaccacaggggtcagagcctgccctgtgacaaagcaagtaaaggccagg

SEQ ID NO: 194347 - DNA, 316 bp, Homo sapiens
ttacccatcatttactgctgctgagaagagcagatggcagcagacgatatgtaaatggcaaggggcagtgaattattcgatttttttagattaatcgtcgatgacaaaggaagtgattacaggctgtgacatttatacaaatgtataaagtacatcacacaaaaaaatagagcttaatattattatgaggatgtcaggcatatgaacactattgtcacaatacaaagcaataaattttacaataacccaaaaatctgctatctctttaccttaaaactttagtgagccccagaatctgaaaaaaggatgaacctag

SEQ ID NO: 194348 - DNA, 440 bp, Homo sapiens
ctcctaccccacgtggatggctataatcaaagagacaaacaatagtgttagggtctggagaaattggaacatttatacattgctggtgggaatgtaaaatggcacagccactctagaaaacaatttaatagtgcctgaaaatgttagttagttagcatatgacccaacaattccatgcctaggtttagacctaagacaggtgaaactgtatgttcactcaaaaacttgtacatgaatgttcatggcagcattattcacaatagccccaaagtggaaacaatgtaaatgtccatcagctaatgaagatataaacaagatgtggcatatccatacaatggaatgaagtactgatacaggctacaacatagatgaaccctgaaatcatgttaagtgaaagaagccaatcacaaaaagaccacacactgtattgtatgattctg

SEQ ID NO: 194349 - DNA, 299 bp, Homo sapiens
aatgtgctgtaggccagcgcggttaaaagatattaccaaggttaatctcttaattttgataaattctatggttaaggggaaacagggtaaagggtatataggaactatatgtactattttccaacccttccttaagtctaaactatataaaaaattatttgatagatcttaaccatatccaaaacaggtccaacctgtcaaatgcatgagccccttgaaccttctagttaaatattaatattttaaaaaattccttcctttcgctggcctacagcacatgcctgtaattccagcacttt

SEQ ID NO: 194350 - DNA, 244 bp, Homo sapiens
cagtgagagcctctcctctaccagttggctcctgagttcttttgaccatgatcccagtagttttttttatagcttctttccttctaatgttttgtacctttcgtggcccagatctacaataagacatttctccacagactcttagtttcttttgtgggaaatagaaaccacagtctgagtgcctggatgtctgggtcctagggatgcacattgcttctgggttggtcattctatctagtgaaca

SEQ ID NO: 194351 - DNA, 352 bp, Homo sapiens
ctacacttctgtaatctaatcagcggcttatgtgacaacacgcttcccaggctgaaatatatttcagtctatctctgtatccatcagacaagctcctaaacccattcccactctggcactccaaccaagtctcatccagccattccagttccccatagtgtatgagtgaagactttgcacttgtgaaaacgtgcatgggtatgtatgtgtaacctaattaaagtgtcttctgagtatctgcacctcccaaaaatgatctgccaatctgccttgagaaacgttggaagtagctcatgagatctcccagaatcctaaggaaagagatgtgttccttctccacatagctaatttg

SEQ ID NO: 194352 - DNA, 325 bp, Homo sapiens
tctcctattcccttgcttccactaccagactgtgacatctttgagaatgaccatcatatctcacatctatttcactacagtgccaaatgcaatgcccttccgagcagtcatccacacaagagatggctgaaaatgaatgggaaaatcccctaagaccacatgtccttctggataaggaatcaaaggtgtggtgctcttcacaatgaggacattacaaaaaagtcaattattcaatatatatttattgagcatcgtttatgtgctccaaagcatcttagtttgttaaattgagtcttgaaccactgtagtatcatatagtaaaaat

SEQ ID NO: 194353 - DNA, 432 bp, Homo sapiens
ctatgctctgcttcccttttaaatccaaattccaatttcaaaccatctctttgtgaatgcataagattgaatgctttcaaaatcaaccaggtcacctcttgaatgctttgctgcttagaaatttcttttgccagttaccctaaataatctctctcaagttcaaagttgcacagatctctagggcaggggcaaaatgccaccagtctctttgctaaagcatagcaaatgtgacctttgctccagttcccaagactttccttatcttcatctgagaccacctcagcctgtacttcattgtccacatcattaactgcattttggtcaaaaccattcaacaagtctctagaaagttccaaactttcccacaacttcctgtcctcttctgggccctccaatctgttccaacctctgcctgttacccagttccaaagt

SEQ ID NO: 194354 - DNA, 447 bp, Homo sapiens
aggatacgactagtcaacatacccctagtctaaccatccttccattgcttctccccttccctgtggttcaggaatgaaatagaaaggcttttttttgaataaatttctcggtcattgtcttccccaattaacttcaggccagcagatgttaaattaagtcctgactgtgtgccagatcctcttggaacggagccagctagagggtgtggagtatgtgggaacatctctgtgctttgccctcggatgacaggggctccagatgctgcctcagaatggaagggtggtgtgggtgtggagctgggctcctcacttgctctgagagattgtatattcccagagtcccccaactattcatatgtccagattgaaagactgacgaaggctaatcagctgggtttatactgtttgttgcctggaagttcattgtatttgcatgattcctgtatg

SEQ ID NO: 194355 - DNA, 475 bp, Homo sapiens
acattttagttaaattctctctgagatactcgaagtgctttaatcttttggctccatcatacccaaatacgtgcacagcagattcatatactccctgtgtttttatgtttggagtttatgatgaacaaaagttggtgttttaattatatccaaagacctctgtgttttgaccaagtccccaaactaaaaattggcaaggatttaggtagagtgaatttagagaacataggacatgtttttgtactgactttgaaaaatttgagtttgtttcattttttgccctcttccccaagggggaaaatgtatttaaaattgttgatgcttctttcccatcattgacaagacagtgtgtagaagaagagatgtagaatgatctgaatgtgtgcctgtattaatcaccaggagtttccgcaggttggggtgaaacctgaaagtgggtgtttctaactaatcctaggttatgttgatgctgggg

SEQ ID NO: 194356 - DNA, 473 bp, Homo sapiens
attgcaacgaattagtatgatcttactatgtttgcaccatttacaggtcaaggattaatgtacgttaaggaaaaaaaatcagaaacactacccatgggaattccaggataatgaggaaaaataaatgtgtgtgtatgtatgtgagcaagcacatactactcgaccatggtgtattgtcctgggatgtactggtgggcttgaactccagaagttatttaaagcaatttagagtgtttcattgctgtttatttccctaggaatatgtgtttatgtcctttatcgaattttcagtcatctatcacctacaagaagttaaaaatccctaacataaggcttggatttctatggatctctgaatgtttgtgtatgatcacaaacacatctagaatcatcaggagagtgagagcaagagagagagagagcaagagagagagagagagagagagagtcaaaagagtaagattaggaaatag

SEQ ID NO: 194357 - DNA, 355 bp, Homo sapiens
ctcggtacccttcagcagacaacagcagaagctttagattttcctgtctttttttcccagtattttccctctatcatgaaggaaatcacaggtttttctctccttcattccccacactcaactgccaagtcctgttcattttacttcttaaatatgccaaacccaaatacatacatgattttcaactacacacaaatctcatggcctttcatggtgcaatcctgtttttggcacaaaactgaaggtgtcgcgtggccctgtctccctctccagccacatctcctgaccccacctagagaagggttcatcagcaaagccctgttcacatgtggagcagggtcactcttggggaggg

SEQ ID NO: 194358 - DNA, 456 bp, Homo sapiens
gctatcttgttccttcctcaaaatatagttagtcattaaagtaatttacttttactcttggagctgattttggcttgggaagctagttaaaccacaaaattgtttacctggactagattaagatgatgacttatgacttgtcttcactagcttgaagtaaaccagatgtcctcatcatttggcttttattattgtcctaataagtctgtgtgtgggatggctaattggctcatcatagtgttaaccttctgtacatgtctgttaatatcaacatcaaacagaagcatcgggggaaagaacattaaaggcaggtacaggggaagagactgaaggttgctctgcaccagacaagcaacaggaatagaaaatgcaccagaacgcaaagccagccatggcgcatggctcagaatactagaaattaggcttttccccagtctaactgtctctactggtgtg

SEQ ID NO: 194359 - DNA, 469 bp, Homo sapiens
aatccaactttagtgggggggtgtttgccacttacagtaccttgacatcacattaagttctgtttatttccctctttctctttagatgcaaaaaataatcaataagtataaaattttgctgatatgtgtttgtgtgttcttaagctcaaaaagagttgaaagagaactgttcagcctattttttttgtcatgagtaaaagtaaagttgaagtgacttaagacagtacatcttatgttccctgtgggttttacaaggaaattctgctattagataagctttggaaaagttacaggaggtatctgaatatacagcacactgagagctgtcataaagttctggggtggggtttcttatatatgccctcataacttcagagacggcacagctctaatgaacactcacttctagttcactcacaggcattttctggatacaaacaagtcctcaaaaagaattttggtcgtctta

SEQ ID NO: 194360 - DNA, 375 bp, Homo sapiens
acccttgctggctgtgcagatgctctaatcctcttccatattctccatccaattctggcctggaatgtccattctgtggtctctgctacggatcactttcacactagccttgccagccatatggcagttctcttggccctcagtggtcaactagcttctgtgtcactcagtgggagagcccactggaccatctgaatccccttcattctacaaaggaactgggagagacgtggaacactttgtgtcacatcttgacaaaggaataccctgtgagatggtcttgttccacagtttcagagaagtggcacaagccccattcactttcagcttctctcttattttggattatgttcttctggccagtgtaaggcccaa

SEQ ID NO: 194361 - DNA, 276 bp, Homo sapiens
tttttccaggcagcaaagtgatgcggtctgctaatcactttggctattatgaaaagggtggaagcagagagaccagtcaggaggcctctgcaatactccaggtgagagatgtgggccagaatggtagcagtgaaggtggtgagaaatgtcagcattctggatatattctttctttcttttttttttttttttgagacagagtctctctctgttgcccaggttggagtgcagtggcttgatctcggctcactgcaacctccatctcaaaaaaaaaag

SEQ ID NO: 194362 - DNA, 389 bp, Homo sapiens
  misc_feature (376)..(376): n is a, c, g, or t
tgtattggtggtgctgacacatacctgtaatcccagctacttgggaggctgaggcaggagaatcgcttgaacgtgggaggtggaggttgcagtgagccgagatcgcgccattgcactctagcctgggcgacaagaacaaaactccatctcaaaaaagaaaaagaaaaagaaaaagaaatagtagcaccaagaagaaaggagcccccaccccagcaggagggagagcaggagcaggctgggtggggcacctggtggcttcctccaagttggctgtacctcaggctggagggagggggcgtgtcccttcagatgtgcatgtgggagtgctaacttcggtaccactcttctgtcctgcagtgagcaccaccaatacagngtaccgagctcga

SEQ ID NO: 194363 - DNA, 179 bp, Homo sapiens
cttacacataggatcccgcacttcaatagaagaatgctaatgcattcaggattacaaatattattttgtaattttcttaagtatggtacctaaggaaattttcttcttccaggggaaaaaaagagtatgttttaaaagtagctttaaaacataactgaaaacttactgaagtgtcaacg

SEQ ID NO: 194364 - DNA, 125 bp, Homo sapiens
ctatatagtgattggtaaacaagtatgtgaattcaagcaaacttcacttgaaagcccactcaaaagaaaagtatagacattacactaccttcattcaaaagtataaacattatactaccccttcc

SEQ ID NO: 194365 - DNA, 573 bp, Homo sapiens
gtgccacttctatctgagctaatcctgctacttatactttgaatcatatcttctcctccctactcaaataattcttatcctgtaacacatcttcaacttctttccctctctgtactacctactttttttcagggataaacttggtggtggtttatgcagtcttcctttctcccacctcttctcagtcggctccagtggaaacctactttgttattcaccaaagctattctgacaaaggcaccagcgatacccaggtcactaaactcagaggatgattttttactcctcattttaattaatctcttcactgcttggtcatagttgaccactcttttttaaaacaccttcctcttatcttggctgacactataaatgcctgttatttctccttttctggctactctatatttcctttgctagactgacccttttatccagtccttaaaggttgaagctcctttatagtcatagtggctgtgtggtttctcccctttggcaaccttgtccattctactggcttcagttatcatttgcatggtggtcatcaagttaaatttccatctcagagttgtg

SEQ ID NO: 194366 - DNA, 492 bp, Homo sapiens
attttatttttctagcttttcctttcttgctggcctcccccacagagtgagatgtgggtgagtaaaattcaggcacacttttactcttctttgctttactccaaaattacactaccaaaatatttattatatgatcctgattggctattagctagtaaccaagagccaggagagacaaaatgatgtttccgtatctgaaatcaacatttaatggatgaggttatatacattcaaattatgtgtgtgtgtatgtatattttttctttgttttctccattctataaagaaaaagtgttctggaaaagatttaaaaaccttcataacactggaaataagtaattttattgtgtgacattctgttttttataagtcagttccatagatagaagttcgccttatctgaacatatatctttggttctaatccaaaatgaaaaaaaaatgaaaatttacatctggcacaattgaaacaggagactaaatactgaactat

SEQ ID NO: 194367 - DNA, 414 bp, Homo sapiens
taggtgaaaatcattgaatagttcttctgcacttctttgaatggctgatctggctaggagacatgccctttctatttctgttttattttagagtttctgcatattttagagttctgtggtttcctttttttaaaaaaataaaaaaaactattttttgcccagattttatatttttttcatttgtttcaagagaatgtgtaattgattgttgaagcatttctgtctcctttaaaatccttgttaggcaattccagcatctgattcatctgagcatggctgtcagttgatggtcttttttagttcacttgtgttttgcttggttctcagtgtcatggctttttactgtatactgaacattttggctattatattaggagactctggatcctgttttaatcttttattttagcaggc

SEQ ID NO: 194368 - DNA, 677 bp, Homo sapiens
cagtgtgtgaaagcactaacacaatacttaggcttattaggtgttgaataatcttagcgtccttggtccttgcctgtgacttaaatgtaatgctcagtaatcataaaattacccaacgagtttgaccagttctctcccacacccccagtctggtctcagtttccttggtcaggtgcttgtttgaactgactgtgactagaactgacagattggcagacttcacaaggacctctttatatagggaatgtgtgattatgtaaacagcagattttaagtccaaatgccccaggtcactgccctggactgcaagactttgctaagaacacaggaagtagattaccaattttgaactctgaggtggttctacgctgccggcttgttttcttgtccattcccaactattcccacccctgctgccaagcaaccaacccacaaagaaagttggtagtgtcgtagaaaacacaaaacaggctagaatcaagtctcagcctcacacagtaaatattgttaaagaaatatgtttagttctgaatctaagcagagtgtttaggaatccgtgcacttaggcagtatctatctgcagagctacctctacattttaacttaggttagttgtttcccttggaatgtcttctccgtgttttcaatgttttcacctatgttgtaccattaaggtc

SEQ ID NO: 194369 - DNA, 199 bp, Homo sapiens
tcagctcggtaccctttcggcgcgagcactaacatgacacaacaagtggaaaattccacccctgaccttatttgaaaggtcacagacaagagggcagtcaaaacttttagtccaggcaacatacttagcccagcctggctctacaaaaaataaattagctgggtgtggtggcatgcacctgccagctactgaagtaaaa

SEQ ID NO: 194370 - DNA, 250 bp, Homo sapiens
gaagttgtgattttttataaaattgcagaatctattgttataggaggagctttgctttaatggtttttcagtttgtccctttacttaccatagggattccttctgttgccagtcccttgggggcagggactgtgtcttcctccctgtattctgagccctgcatagggcctggcccttgcataggtgttcaatcaatgtgtcaaatacatgagtgaatggacaagcacaccttttcttttctttctttttt

SEQ ID NO: 194371 - DNA, 287 bp, Homo sapiens
ctctgcaagccttcagtcaagttgtcagccaggtctgggtttgcatctgagagctcaactggggaaaaatccacttccaagttcacgtgatgattggtaggattcaggtcctagtgggtgaccagactgaaagcctcagtttcttgctgcctgtgggccaaaggctgccctccattccttgccacatgactctctccactgagcagctcacaacatgacagccagcttcaacgaagccagcaagggacagaatctccttgcaagagatgggcgttacaatcttctta

SEQ ID NO: 194372 - DNA, 655 bp, Homo sapiens
tatctactggtggaaatttggtgggtcagatcattactttaaaaaaaacgaattaggctgggcacagtggctcacacctataatcctaacactttggagggctgaggcgggtggatcacctgaggtcaggagttcaagaccaacctggccaatgtggtgaaaccccgtctctactaaaaatacaaaaaaaaaaaaaaaaaaaaattaactgggcatggttgcacatgcctgtaatcccagctactctggaggctgaggcaggagaattgcttgaacccaagaggtgtaggttgcagtgagccgagatcatgccactgcactctagcttggaaaacagcgagacttcaccttaaaaaaaaaaaaaagagttaaatctagtttatactactgttatgaacaaaatcgcatttttaaaatgatattcgtagagttgcaaatgtgaagaattttgtatcacttagtaaactttgcattgcatgtgatagaaaatccagctcaaaccagcctaaacaataagtgatttattatgtcacataagagagcagtccagggattggctaggctttgtttaaatttccagtgatataattagagcccagtttgttcatgtacatttcatttccttatctgagtttcattttagggcacttctctc

SEQ ID NO: 194373 - DNA, 648 bp, Homo sapiens
tctgtagctttgaaaaggtgatgtgatcccattaagatgtcatgaactacggaattctttcccccatctcttcagacatccagttctacaattttgccttgtttttttgtctgatgtccctcacatccaacctggccccccacaaggtacttctttccactcggatcacaccaattagccactgaactctacatccaactattcacactgagatgtaatcaaaggttaacttttacatgcttgattttacaaggtcaagaagaattcttaacctagtgatggctcgagtacctgaagtatttttgaaaaagtaggagggaacttacaaactcttccgttgtctgccatatccattcactcacttaaattgtttataagacaataaaacacataaaagcaacattttcaccaggccaatcacctctctccagcctcataatgattagcctacatccctgtatccagatttccctaaaattaataatggtgcatttttacattcacttcttgattttactcagctccatcctggaacattaaatctgccttggcttagctatgctagtttgcacttggcccttcctgatggccatggtccaggcttgtaaattatgtccaagttcctcagttgctgttcccgggcctggg

SEQ ID NO: 194374 - DNA, 128 bp, Homo sapiens
agcagtcatctgctggtgcaaccagtcatagccctgagtgataaaacgtgagagatttagtactcaggctctgaggtgttgttttgaccactaccatctacagattcccaactctactggatagtcag

SEQ ID NO: 194375 - DNA, 483 bp, Homo sapiens
gcatatggcaaggcaaggagaatcgtagcccagagctgccaagttcactgggctccacccccagctccaggaggggaggagaggacctgacatctgtaggtggccctgatgccccatctacagcaggaggtcaggaccacgcccctggcctctccccactcccccatcctcctccctgggtggctgcctgattatccctcaggcagggcctctcagtccttgcttgcatatggcaaggcaaagcataagctgaatgggataaatttatgactgaacccccacatttttcatgagtgaaatgcatctattacagcagattttatgcaaatacagaaaactgactcaatagtcatgttaaaattgcattcagtgttctgtgtatcttactgagctatcacaacaatattgtacttgaacttttccaaaccattttttacccagacttaaaatattgctctagtctgcctttattcttctgaagtg

SEQ ID NO: 194376 - DNA, 520 bp, Homo sapiens
tctggtaacatcgtatgggctgggttacagcacatgccgactgctaagccagtcactggggaaaaccatgtgattgctgtgatgagcttagaatgatcattcctccttcaggagctggggtgggttgagggaacgataaagatcctgataaccttgcatttctccagcgagaaagaagaaattccgtggatagggagccagccaggtttcctgcagagattcacgggaagcttttgagcaggggagtcagaagatgagcggtgagtattaggactttccagtcacggcgtgacgcagggtttggccagttcttcctgtaaaggggcaggtgggaaacgcttgtaggcccggtggtctctgtcatgtctgctgaagcctgctgtagcagtgtggaagcagtcagagatgacacgtaagcaaatggtcctgactggcctctggtaaagcgtcgattccagaagcatttaacagacctaataacctttcaaaccgcacagggtttctttcccaggtcctgttt

SEQ ID NO: 194377 - DNA, 694 bp, Homo sapiens
tgtgggcagtgtttacttcatgtctgctttgctggcgggccaagtagcaacagctgcagtcggcgtgttctctgaagcgagaaagaagaaattccgtggatagggagccagccaggtttcctgcagagattcacgggaagcttttgagcaggggagtcagaagatgagcgggctctgggatgtcttggtcttactgtttccctgccaaacccggtgccatctcgtcatgatcacccactggagaagagaggagattctcacagtagacgaggagcctgtttttcagctagctgctgcaaggagctggacatttctcccttcaaataggacctggaaggcctggaagcatctggagaagggcatggctgtgagtagagaaacagaggatacaggctaaagcaggaggaagcgagaggactcacggaaagccttgctgcactctccaaaagagctgcccttttcacgtggtatgctgtccacattggctgtgtcctgttgacagctgggaggggccgtaggcatggcgtttttcctgcagttgcaggcactctcacttgaggcgtgtctttttcggcagtaggatgttgcccggggaaggtcatagggtagtgaaacctggccggtatgcctgtgaggaggtgtgtgtgagccccctcgcctgcctcctgataccttcttggggagctgctcatca

SEQ ID NO: 194378 - DNA, 653 bp, Homo sapiens
ggaaagtttttggcggcttacaaggactgtgtccatcatgcttgggctctcttatctttcccaggatcctgaatagggcatcccccgttcatccatagggctctgggatgtcttggtcttactgtttccctgccaaacccggtgccatctcgtcatgatcacccactggagaagagaggaggtgctggagtgaaccggttcggggaagccccattcatccctggggtcccagaatgaaccgttgttaccatgtgcccctgttcttgccttcctccctgctctaatggacgtgtgttagcctgggatcagccttggtctgggtgctatcgttctgttgcacctgtggcctttgtccggactctgtccttgtctgcgtgacgtgagagtgactgtgggtgagagcgttccagcaagacaatgatgatctctgctgtctgattcccacttcccagattctcacagtagacgaggagcctgtttttcagctagctgctgcaaggagctggacatttctcccttcaaataggacctggaaggcctggaagcatctggagaagggcatggctgtgagtagagaaacagaggatacaggctaaagcaggaggaagcgagaggactcacggaaagccttgctgcactctccaaaagagctg

SEQ ID NO: 194379 - DNA, 181 bp, Homo sapiens
cttctatgtgccgctccggctccccagtgctgatggagactcaggcaggctgcgctggaccaaataggacacgtggtggtgatgacatttttggtccaatccagtagcagcctgtgaagtgctcattgcaggcagagctgagtaagctgtgaccccactctcaggcagcttctcttcgggg

SEQ ID NO: 194380 - DNA, 251 bp, Homo sapiens
ccagtgtgccctggttctgtgtgtgccttgcaaggagagaagcaggagctatttggcaccctagtaatgggaaatggagctccactgacagcagctccccagactgggtctagcctgcaggcctctgctcaaaacccatgtgcaatgcctcaggagacacagtgcagccctccagcacatgccactgtgggaagggagaattactacgaagccctgtgccttctcatttagcctcagcaatgccatgaggt

SEQ ID NO: 194381 - DNA, 539 bp, Homo sapiens
cttttcagtgaacttgaaacattaaaatgtttactgccttcacacttatggcttaaaaagttgtttggtttgtgttttctttgagatggagtctcgctttgtcacccagtctggaatcgcaccactgcactccagcctgagtgacagagtgagaccctgtctcaaaaaaaaaaaataacaaaaaaaaaacaaaacccaaaatccctaaggtgtttataattttatactgtttcctaagggattctcttgcattaaaaatgccctgctgggtgcagtagctcacacctgtaattccagcaccttgtggggctgaggtgggaggattgcttgagagcaggaggtcgagaccagcctgggcatcagagaccctatctctattaaaaaaaaaaaaaagccaggcatggggcatgcctgtggccccagttacttgggaggctgaggtgggaggatcacttgaggccaggaggttgaggctgcagtgagtcattatcacaccactgcactccagcctggacaacagagcaagaccctgtctcaaa

SEQ ID NO: 194382 - DNA, 233 bp, Homo sapiens
actggtcttaagatgcctcacaagaaaatagttccatggaactctggtgagcactgcccactactcacacccatcaagattcacaaagctcattagttttgaagaaggtcatttaactttaatccaatgctttccaaacgcacttaggcatagacccatcctctgacccaggtccccactgtattagtggtgtagggagctgtgttccagggaacacactttgagaactcctg

SEQ ID NO: 194383 - DNA, 260 bp, Homo sapiens
tgcttagtatggttttggctctgaaggctctttatgggttccaaatgaaatttagaagtttttttttccagttctgtgaagaataatgatggtattttgataaaaattacattgaatctatagattgagcagtatggtcattttcacaacaattttttttatatctgtattagcgtattttcatactgctgtaaagaagtgcccaagactggaaatatatgtgtaaatatatatatttatataatatataacatgttata

SEQ ID NO: 194384 - DNA, 529 bp, Homo sapiens
gtttgagtctattgtttctttgttggctttctgtcttgatgacctgtccagtgctgtcagtggagtattgaagtccccacttatgttgtattgctgtctatctcattttttaggtctagtagtaattgttttataaatttggtagctccagtgttaggtgcatgtataattaggattgtggcattctcccgttggactgatccttttatcattatataatgttcctccatcttttttaactgttgttgctttaaagtctgttttgtctgatataagaatactactgtactcgcttttggtgtccatttgcatggagtatctttttccacccctttaccttaagtttgtgtgagtccttatgtgttaggtcagtctcttgaagacttttgcctcacagctttcaggtggatttttttccattctgccattctgtttctcttaagtggagtctctaagccatttacattcaactttggtattgaggtgtgaggtactgtattctattcatcatactagttgctgcctgaat

SEQ ID NO: 194385 - DNA, 270 bp, Homo sapiens
tttttcctgagaagaaatacataaactttaaatagaacctcaagaacggattgccttgcagtaataaataaattaggaggaaaacactttcaagaatacattaaagacaattagagaacttacagtataaaaacttaattactggccaggcgcagtggctcacgcctgtaatcccaccactctgggaggctgaggcaggtgggttcctgaggtcaggagtttgagaccagcctggccaacatggtgaaacccccgtctcaactaaaaata

SEQ ID NO: 194386 - DNA, 299 bp, Homo sapiens
gcccacatacaattttacatacaatttcatggggttatgaaacccccagcacctacccatgaatcacaagttaagaatcctggtgtaaaaataaccaaaggtataaagttaggaaaggtgggaaaatgaaacataggaccaaaagaaaagttggaagaggatggaggagaggacaggagatgccgtagcagtgagtaactctggaagtgggtataggactacgtggctctgtacttcaaagtgctctcacttcttacatttcatttgatctttacagtaactcattcaacaaaatggat

SEQ ID NO: 194387 - DNA, 218 bp, Homo sapiens
ctcctgacctcaggtgatctttttgcctcggccttccaaagtgctgggattacaggcatgagccactgcgcccggcccaaagatattttaaagcaaatataattctaactcaaaacctccaagcccaagccccttacatttagcccttcttcctagatttcaaacaaatttaattaaatttgtccttctaacttgtctaatgtgagtactaggtgaat

SEQ ID NO: 194388 - DNA, 239 bp, Homo sapiens
ataaagggagaaagaacctagtgacatagctatactattttgtagtagagggaccattattgaaaatgtgcatcccattttaagctgtaaaccaacctgtaatagagagtgaaatatttttccctccaaaggcagaatcattaaaacctatactcttaatattccacctaatttctgaattttcctctgtgcgaagacactctttgattcttttaatatttcattgattgtgccagttt

SEQ ID NO: 194389 - DNA, 170 bp, Homo sapiens
catgctgcggtcgatctctagcaggatccccctagtgccatgtgattctgaaagtgttatttcaatgaatgtgttaatcactcttaactccatgtaaaacacttagtaacactaatatgtaaaggactttactaggagtgttgcatgtatgattgagaacagcgttgctt

SEQ ID NO: 194390 - DNA, 344 bp, Homo sapiens
tttttgtatttttttgtagttagggtctcaccacgttgcccaggttggtcttgaactcctaggctcaagtgatctgcccaccctggcctcccaaagtgttgggattacaggcatgagccattatgcctggctcttactgtatattcttatacttaatcttttgcaatttttgctggtgtttctgtagactgtattctttgcattgggatcattgggtcaagacctatatttaattataatttttatagatatgctcaagtgaaccttcaagataatcctgtcggtggggtatgagttgaacactggcattaaaaaaaataaaaataaataaataacagtaaaaa

SEQ ID NO: 194391 - DNA, 307 bp, Homo sapiens
tcccggatgcacgagctgcgagagggcgggacaggcagtgggacgaagaggtaagcggttactcactccatggctgcagcaaggagaggcggcggcggcctcggctgaagaaagaaggtgggagcggagagcgcaggcgtgaaatcttcccaaggctggcctcgaactcctgacctcaggtgatccgcccaccatggcctcccaaagtgctaggattacaggtgtgagccaccgcacctggctctagatgaatcttaaatattatgttaggtgaaggaaaccagattcaaaagggtataaactgtat

SEQ ID NO: 194392 - DNA, 422 bp, Homo sapiens
gaaactgccatttttaaaaccgtgagatctcatgagactcattcagtaccatgagaacagtgaaggaaagacctgaccccatatttcagtcacctcccactgggttcttctcatgacatgtgggaattgtgggagttacaattgaaaatgagatttgggtagggacatagccaaaccatattaactactatacaaattaactatttaaatttatttttttaatgtacattaaaaactgtaaatttcttaaggaggaaagaagaaactgtttttcattttctaggtgataagttaggaaacattaagaaacaagcttgtgatcttatcctgatctcaaatgacataaatttagaccatatttcatctgctgcctaaagtttcagcatcctagggaaagaaaagaacagatattttaaaaagaa

SEQ ID NO: 194393 - DNA, 542 bp, Homo sapiens
cccatcttggcctcccaaagtgctgggattacaggcgtgagccaccgcgcctggcctatatttgattttttaacatgtaactgagtcagtgggcttcccaacatgtgggctgcagatatcagagcaggctgtggagttaccataaggccacagattcatgtctgagaacgagtgtgtgtgtgtgtgtgtgtgtgtgtttgttacacacacatatactgagatctttcaagtttatacagttgctgctgtaattaataaggtagaaatttattctgggcctcagtttatctgtaaaatggaggggttagattagaatctagtgattagatgatctctggaaaactttcctgttctaagaaaatattagttaaaataactaggaaaatttccatcaatgacacatgattacagtgtcataactcatgtccatattgtccaacaccctaagagagtaacagtttctcacactggtacagacgtctgggtcctcacactggtacagacgtctgggcttcactaagcactactcccttgacttgatc

SEQ ID NO: 194394 - DNA, 384 bp, Homo sapiens
tagaagtgggggggcggtgtaggggggttgggggagaaacctgatgggagcgtctatggatattcctaagacgatatcctcaggtaaaatcctttaggatgggagaacctactaactttattgctgtttatactcaccaaaatgaggggaagattccaaaactccaattctgagctaagaaggaactccaacaatggcagagaccttaatgaaatgtgctattaagtttccagcgatgcaccctagtgagtcacatgactttatatctcttatccgcaccctgaagttctatttcataaataaggagtgctttaaaatgatctgaactgcctgtagagactcaattgacctctagatacagttatgttaaattttaaaagttgt

SEQ ID NO: 194395 - DNA, 306 bp, Homo sapiens
gtaaagttttctaaaatccaataataaaatatagctatggtagattattggtattatttgctttttaagctgctaatctgagacctattataatgttggcattaacctctaaatattatggtaattaagttttcctaggttttagaaacttaaaaaaaagtttgctaccaagcttcagaacaaaatttaaaagacaggaaaaaaaaaaacaaaaccaaacaaaaaacaacaactaaattatttccaggcgtaatgaatgctcaattatactgtgtgttatgccaactcatagtgctcccggtcgaa

SEQ ID NO: 194396 - DNA, 435 bp, Homo sapiens
agtattaccactggcataattttcctttggcctaaagaccttcttttacttttattttagagcagaacttccgccaacacattctcttagattttcttcatccaaaatgtctttcttctttttctttttgccttaattgttaaagggtatttttgctggatatagaattctggattgacatttctctcagtactttaaagatgttctgtagttacttgaatcgctgaaaggcttaaagttggggactggctctatcacatatacgttttatagaaaggttcattactttcatatcttcattgtggaccatagcctttatcatcacaaaattttgtctcatttatgagtttttaaattttgctttgaacctaaacttttataactcctttctatttcctacaatgtggagtttatcgcggacagcacagcctgtgg

SEQ ID NO: 194397 - DNA, 298 bp, Homo sapiens
ttagtagagacagtgttttgtcatgttggccaggctggtctcaaaactcctgacctcaggtgatccaccctccttggcctcccaaagtgctaggattacaggtgtgagccactgtgcccagccatgtatttctttttttaggataaattcctaagacgggttagagtataaacattttatagtccttggtacctgctgccaaactgccactcagaaaggctgtgtctgcccatgcttctgccgcacaggcgccaccctggaggtggggggctctattccgttggtggagatagagtat

SEQ ID NO: 194398 - DNA, 354 bp, Homo sapiens
acgccacatcaagggaccatctttagttccattttttgagaagactttttgtttggcttgaagagggtccccctgaagctgaccctcagtgctgccgtcactgctgcaacctcagcacctccatggcctgcatgtgcagacaggagaaccggacccagtcaaggtcccaccagttctgcagacaagggtctggagtccaagtaaccacacagcacaccctgctcaaattctcagggtgactcttcacatgggatataatctgtcttgaatggatcacatttgccacccagaggaagagacaatgtcaaaactgattcaggccgggtgtggtggctgacgcttgtaatcccagca

SEQ ID NO: 194399 - DNA, 589 bp, Homo sapiens
ctccatagcgggcactggaagttcctctctctctgcacgtgcggcaagagctgaaaaaggagaaagggtcactgagcaggttttctgtgtctgagccccagagttcaatctctgctgaccagacccccactgaccagaccgctgagcggtggtgctcagagtcccctaccaatggctcttctcagtccacagacctctccctcccctcatcagcacccacaggtgactgagagtcttctcgggactggaccccaactccaggacacagggaggggcagtttgtcccaggctccgggtgctgagcttcacgcttgtgccacaaggtcctctgggccatctcaaacggggcagtgatgtggcctcgcacatctggatgcactgtctgggcctattcctgggccacatagccagaggaacaggaagatgtttgtcaacccaggcaccccactctgctgggtctcccagggtccttaccatggagaccagatccagagacagcacagaggccgcagggtgaccggcccagaacccttgagactaggctggggatgacaggaggactgtccccagacaaccagaagaccctttg

SEQ ID NO: 194400 - DNA, 698 bp, Homo sapiens
atcaaaatgatagaaagatctcaaatttacaacctaacattgcaccttaagaaactagaaaaacaagaaaaaatcaaacccaaagctagcagaaacatgaaacagcaaaggtcacggaagaaatgcatgaaactgagaccaaaaaatcatacaaagaattaatgaaataaaaagttaattatttgaaaggttaaacaaaggtgatagatggctagctagattaactaagaaaaaagagcagattcaagtaagaacagtcagaaatgaaataggtgacattgcaactgataccacacaaataaaagaaatactcaaagaccactatgaacatctctatgcatacaaactaggaaccttagaggaaatgtataaattcctggaaacacacaaccttccaagaatgaaccaggaagaaatagaaactctgaacagaacaataacaagttacaaacttgaatcagtaataaataatccaccaaccacaggaagcccacgaccagacagattcacagccacattctaccagatgtacaaagcagagctagtactaatcttattgaatatgtttctaaaaatcagggagaaggggtttcttcctaactcattctattaaaccagtattaccctgataccaaaatctgacaagaacacacacacaccaaagagaaaactacaggctaatatccctgatgaatata

SEQ ID NO: 194401 - DNA, 380 bp, Homo sapiens
ggaactgtgtctcctgcagtccagccggctccactttactcccctactttgtatgcctagactaacctaccctgtcctttgaccttgttttcactgctcttgacctgttgccagttaatacaatcttactccaacaagccaccagggactagttggtttaactggctccttgccccattggctagttggacagataattctctaagcagtttgtcttcctcactgtctacaccccacgcttatgctgcatcatgccttcatttatgtctttcttctatatctttgtcctttttgacctctccaaatcccagctcaggttccactctgtcctctgagaaattggccctcctcattgtaccactactaacctttccagacct

SEQ ID NO: 194402 - DNA, 408 bp, Homo sapiens
tgaccttcagcagacacagcacgttcagcccagtgccctatttcccgcctgggattgctgtcagtcacttagtagccctctgggttatcagaccccctgatactgcagtgcttgtgttcaggcaactctcatttcacttaataatggcccaaaacacaactgttgtgaggtactattttctgattgtggaaccaccggtaactgaaaccatggaaagtgaaaacaaggataaggacggactaccataatatgttgccatcgtaacaatattaagtcttctgatccatgagcataggatgttttcccatttatttaggtctttaatttctttcaacaacgttttgtagttttcagagtatgtgttttgcacttctgttattaaatttataactaatttattctttttga

SEQ ID NO: 194403 - DNA, 100 bp, Homo sapiens
ctcaccaccacatcactaaaggttcatgtactacagttcctttcacccagtgtgccatgtccagccctcaagaaaacaattacagcacactaaatggcaa

SEQ ID NO: 194404 - DNA, 200 bp, Homo sapiens
gatgagtttggagatactgagtaaggaaggacttaaagacaagttttttaatgttgaggactacagaagtattgcctcattgtcagaaataagaaagttggaaaaataatcagaaacgccatcaaagatttgtgttagtttggcagagaagatggtgcattattgagtaggtttaggtggcactgagttataggttgtga

SEQ ID NO: 194405 - DNA, 444 bp, Homo sapiens
accgagctggtaactgggagacacaaacagcttcgtggccagcgacagaggagcatgtagtggtctgcgttggttcctggacccttcacatccactgccaaccaagttcagcccacgagtgaactcctgctgcttctctgggaaggtaggagtggatgaagttgaaaagcagcccattggaggctctagttactccagcccaggcgtcttgctgagccccaagaggtctccaaatgagaggaagaggtcctcacaatcccaagatcaagatgcccccagagagcttccctggggggaagaggtgttcccccaaacactccttcctcccaagttttaacaagcgggtgcaggggcacggctcctcaaatccaagcccaatccctcttcctcttcagaatgttaaggctcagacaacttcagtgacttctaacacagctttcctcc

SEQ ID NO: 194406 - DNA, 403 bp, Homo sapiens
tgctaccatattgacagactgagtttctctctggttaatatatttataggttgagagacttaagagccagcaatgatatggttgagaaacttgcaaaacttttatcatttattaagtttccagaagcaaatgcacacttcactgagggactggcctgagcataaatgcatttcagagccttcagtctggctgtttacccatcctattctccccttatgtaccactcaagtctatacatatttacctcctttcttttctccctttcttctttcctctggttggtgtctccttccttcattcattcaccatttcccccaccatttattcattctgtttaatgaaatgtctttttaagggagcatctgctatagcccaggccctgtgtgtgtggtgggggggatgc

SEQ ID NO: 194407 - DNA, 374 bp, Homo sapiens
gaaatagtaatacttcacggggttcttgggcttcaacatggtaataaacacctaagaaaatgcctgaaataaagggcttagaaaaacattgcctaaacttcaaagcattatgaacattttccaaatattagtatctgctacatttattcacataaattcaggaattcagtctatttataatgcattaccattacagcatctctgtagagctagcattatatccaagttagttggacgttagctaattagctaacatcatatccaagagcaaactggctggtatccttttaaaataccaatatttaaaaaataagtaatattgatatagtcactgtcatataaagattcccctaggacatcagctttttaatatg

SEQ ID NO: 194408 - DNA, 441 bp, Homo sapiens
tcaagttgtctcctcgccaaagagaaaaacataccaagaaatgccataattttatattgctccacatggccaggttgaatttttgtggtatttgtgagatactcattaataaagccactagctcaggatgaattaatgatttagtactttactccttaaagtattcttaaggccttaggctcagcaggcagaggggaaagggaaggacagcctgcatagacattaatctttaaaatacatttgagtgatccaaaatgtattttacacacacacaccacaaagagccaacgtaaaaatacaataaaaatattcataatatgaatggagtgatggtgttcttggacttgtaaaaatttctctgaatttaaaataatcttcaattagtgtatataatttttctaatcagaaagaatactttattaattgcctatagtcccagca

SEQ ID NO: 194409 - DNA, 539 bp, Homo sapiens
ttaggtgcaatatcattaagttgaatcatgcgccattcctctctacacctccaaaaaaaaagagagaaagtagttttccattcaaagatgtcttagaacactcagacccatgtataagacactgaaaagcagtggtgcccagggagctctccgttcttcccgttttctcaagaaattgagctaggaagccatgtataaagttacgtcgaagttcagtgtgaggccaggagtggtacaggcttatgtctgtaatcccaacattttgggaagccaaggcagaagggttgcttgtggtcaagaattggagaccagcctgcgcaatatgtccagactcttgtctctacaaaaaaatagaagagtaataattttaaaaaatcagacgagcttggtgtaatcccggctactactcaggaggctgaatcgagaggatggctggagcccaggagtaggaggttacagtgacctatgatgtcaccactgcacttcagtctgggtgagagagtgagactgtttctataataaaatgaattcaatgtggg

SEQ ID NO: 194410 - DNA, 365 bp, Homo sapiens
tcgccgctggccccttctgttgactgccctgaccttccttgatgactggggacagggtcttcctggatattttcgtgtgtcttcccgggccagtccagtgatgcacttgtggatagggctggtcaatgtggctgtggccagagagtggacaacagacatgtccacagcaggagcaacatggtggcttgtcttgggctgctggttcctggagctgctcagaggaccggtgggtcctttcgaggtgggcagccagcccttgccgttcaggttcccgcaggggtgcgtgaggaaccgtcggacctgctcattagtttattgactgtgtttctggtaatggcctaaaaggttaagagaagaaatggtta

SEQ ID NO: 194411 - DNA, 464 bp, Homo sapiens
accgtagaaataggtaaatttttctggagagagactggagaccgaggaacattgagaatctaaattctgacttttagagactaagggaaggaatagccgctggcaagtggaagtgagagagagtgacaagaaaagtgaagggaaaattatgacagtgaaaagtcatggaatccaaggaatgagattcaagctcagtggtgttcagagtttctgagaggacgagaaagatgaggatctaaaaccacacaatggattagaccacagaaacgttgctggtgacctttgcaagtgcccttttggtggagtagagggggcagaagccaaactcgagaaaacagaaaatgcagtcagtgaatttagagacttcttgggaggaaaggctgtaacttcccttcagctccctttccaattgcaatacgtccctcatacaataacaacaccaagtgatgaagagctgacgttga

SEQ ID NO: 194412 - DNA, 167 bp, Homo sapiens
gtagatgtattgagatctatccaggttgagaacagtagttctaacctgtgttgagagggctgtcctctaggcacaatttctgcagggcagacggagatgatgtctgattccccattgtagacctggcaccaggcaaaacatctgacacttggtatatgctcattaaa

SEQ ID NO: 194413 - DNA, 663 bp, Homo sapiens
tctcatcttctcctccatcctcactattccctcttcgctgtcacctgtctgtcactgtctcaggtggttcttactgatttgcatctgggatgcaggcactccgtgtcacctgtctgtcactgtctcgggtggttcttactgatttgcatctaggatgcaggcactccgtgtcacctgtctgtcgctgtctggggtggttcttactgatttgcagtctgggatgcaggcactccgtgtcacctgtctgtcgctgtctcgggtggttcttactgatttgcatccacataggctttgggctctatcccacctgtcgtcttcggattctctaatacgcaggagtgctcttctgttagtttactcatagtttattaaagtacagagaaaagacatccaggatgataaattttacagtccttgccggggactgccagcttccagtggtgttgcctggcaccagtgtgacccccggtgcctgccccgctgaaccttctgtaaactgtttaactgtgctggtggtttcccattctctaggcgctgagatgcgtctggagagccagagggcctgcctgaaggaatcacctgagcctgtccgtccaccaggagtggggagatgcccccatccagtcctggaggacccgcttgctccttgctgctccctgggat

SEQ ID NO: 194414 - DNA, 421 bp, Homo sapiens
  misc_feature (408)..(408): n is a, c, g, or t
accaagaatcccccaattcctgacacagcgcccctccactccagcctgggcaacggagcgaaacttacctctcaaagaaaaataaaagatatttatttgaggctagcgtcggcagtggctcacacttgtgatctcagcactctgggaggctgaggcaggcacgtggatcacttgagctcaggggttaaagaccagcctggtcaacatggctaaacctcatctctactaaaaatacgaaagttagtccagcatagtggcgcacgcctgtaatcccagctacgtgggaagctgaggctggagaatcacttgaacccaggaggcagaggctgcagtgagctgagatctggccactgtagtccagcctgggtgatgagtgaggctgtctcaaaaaaattttgggcgtacggngagggtaccgagc

SEQ ID NO: 194415 - DNA, 366 bp, Homo sapiens
agaaccgatgactaagatgtcagttccaatttatttttcctcatttaacactgtttattattttaaccaataattttcctaatgctttaaagttcttcttttgcattttgctcatgcaaatagagcgtttcagtctaattgaacaaatccatactaatcagcatgcatataattgtgacactgggaagcttagttctaaaatgagacctgttatatgacactttgcctgtagatggcaatagaaagctaattactaagtagctgtctttgtggccaagcatacaccttcatcttcctgagagccagtatactttgatttttttctcaataaaatgaaacacacatttttaaaaagattaaaacttc

SEQ ID NO: 194416 - DNA, 479 bp, Homo sapiens
aaatactattaattagagatgagagctgaagcccaaagaagttaagtgacttgtccaacgtcacacagctaggagctgggtttgaacccaggcaacctgagaccacagcccacactcttcgctaccatactgccttaggctgctcacaggggaggtgagtagagtacagtctgtcactggaaggacttcctagggaagcacatacagaagctgagtactaatggctgaaatggggagaggaaggtattctggtcataggatggtgcaacaacctacaagcatggagggatgaaacctgtcactgtcaagacagcaagtagttcctaaagccagaatgagaagggtgcatgcaaacaggagaggagaaacagctagaaagcgagacagggggcagaaaacagtacctaaaatctgggggttgggggagacattaaagtttttatttttattttttttctcctggaaatatggaagatggg

SEQ ID NO: 194417 - DNA, 708 bp, Homo sapiens
tggtaagaggatcccgtcactgttcgattaagagtctttctatgagtctatagttctatactattaactcttttaagtttctgcttcaaacactttctttgaagtaatttctttttgaatatatgtctgagagctcacaggctggctaaagaccatctctgcaccttctggaaaattctcttggtatctccctttgcacatacaacagaggagcagccctgaaatcaagttgctacgctacaacagaaaaacaaatcccccttgctccctgaccaccaaatgaaaccaaagacagcttcttggatttatgctacccttttctctaaatgacacactggaaaatctgactcagtaaataagtgagtgtgtgtttaaagaagccctcctcacaatccttctaatcttatatgtagaaatgcactttaattctgaaaacaactggttcattctaaaccaaacagacaatcaggtagagcaaaattgtgtttaagagcagtagctggggctaccttatttggaagaatttggagtgttgtttgggctgtctgcagctctttggagaacatctgataccaatttacagattccatgattcattaaaggattttggtttgttcctattcctttagtcctctgtagttatcctaaagatttccccacaaacagatttcagtattttcctgaatggagacgttatttctctgagtt

SEQ ID NO: 194418 - DNA, 241 bp, Homo sapiens
cactaagctatgacttggagacaaaggccaagtcaagccccactgtgagattcaatgattccttggtggagaaagaagcatttgatgtggagcctgacacacctgaatggatgaactaataaatgattaagaatggaggctacagctgtacacagatcagaattgtaaaaaatgagcttcgtgcttgctagagtggactagatgagatatatcttattgttatttggaaggctccaaaaag

SEQ ID NO: 194419 - DNA, 360 bp, Homo sapiens
cttagaaaaatatggaagaaaatacactaattattaacagtgttaggattatggacattaaaaaccgacttccttatgttctcttgtatttttcagatctgttacagtggccagatttttgtttttgtaattctgataatcaggaaaacagtttagttaggagaaaagtaaaaatcttataaatccatgggtccccgcaaaactctcagaatgaagagaaaaatgggaaggctcagcccaggctccttcgggcctgaggctgagaatgtggccatctcctggcggtcagggttctgtggtgtcagctccctagtgtctggccccataggccaggctgtggcagtgtgggcgcgggctgta

SEQ ID NO: 194420 - DNA, 318 bp, Homo sapiens
aaagtgctgggattacaggcgtgagccaacatgcccagccagttttgtcattttatgtattttggtgattcattctttatcttacagatacagaacacttcattttttaaggcaatttaatactccattctacacttgtatcacacactttacttaatcaccattaatgaaatatataggatgcttccaagcttttttctattatgtcatactaaatgactatccttatctatatggcatatatatgccactttgcacatataaaataatagctaaattccagcaattggaatttctgggctagacggtatgtgtaat

SEQ ID NO: 194421 - DNA, 187 bp, Homo sapiens
tgataaggggatgacccccattttgcagatcaagaaactgaaactgagagaggttatggacttcacacaaggtcactgtaagtgaggctgctgggattcaaatgcaggtttaattttaatgtccatgctacttcacaatgattgtgctctgtaggagaggccgctgcactcccagcaccttcatggt

SEQ ID NO: 194422 - DNA, 122 bp, Homo sapiens
actatgagaaggctgctaggaaagaggtcagtgctaaaataattaaaaatcagaatcttgagtcaaaattaaaaaggaacagtttaggctgggcgcggtggctcatgcctgtaacaccataa

SEQ ID NO: 194423 - DNA, 901 bp, Homo sapiens
  misc_feature (83)..(83): n is a, c, g, or t
  misc_feature (85)..(85): n is a, c, g, or t
gattaaccccctaataaaattaattaaccgctcattcatcgacctccccaccccatccaacatctccgcatgatgaaacttcngntcactccttgggcctgcctgatcctccaaatcaccacagggctattcctagccatgcactactcaccagacgcctcaaccgccttttcatcaatcgcgccacatcactcgagacgtaaattatggctgaatcatccgcctacgcttcacgccgaatggacgcctctaatattgcctttatctgcgcgtcttcctacgaacatcgggcgaggcctatattacggagtcatttctctactcagaaacctgaaacatcggtcattatcctcctgtcttgcgaatatagcaacgagcgcttcatagggctatgtcgctcccatgaggccaaatatcattctgaggggccactagtgaattacaagacttacatatccgcatcccatacattgggacagacctagttgcaatgaatgctgaggaggctactcagtagacagtcccaccctcacacgattgctttagctttcagttcatcttgcccttcattattgcagccctagcaacactccatctcctattcttgcacgaaacgggatcaaacaacccctaggaatcacctcccattccgataaaatcaccttccacccttatacaccaatcaaagacgccctcggttaattctcttccttctctcttaatgacattacactagtgctcaccagactcctaggacccagacaatatacctagctaacccttaataacctgccaattagccgatgaatttcattggctaaacatttcgatcggcctaaatgggggtctgtccttaaaaaactcactaaaaaacactcattcaaaaggtaatttgctagat

SEQ ID NO: 194424 - DNA, 368 bp, Homo sapiens
  misc_feature (83)..(83): n is a, c, g, or t
  misc_feature (85)..(85): n is a, c, g, or t
gattaaccccctaataaaattaattaaccgctcattcatcgacctccccaccccatccaacatctccgcatgatgaaacttcngntcactccttgggcctgcctgatcctccaaatcaccacagggctattcctagccatgcactactcaccagacgcctcaaccgccttttcatcaatcgcgccacatcactcgagacgtaaattatggctgaatcatcctaaccctactcctaatcacataacctattcccccgagcaatctcaattacaacatatacaccaacaaacaatgttcaaccagtaactactactaatcaacgcccataatcatacaaagcccccgcaccaataggacacgaatgttca

SEQ ID NO: 194425 - DNA, 126 bp, Homo sapiens
tatcatcagggaattgtaaattaaaacaagataccattacacacctattagaatggccaaaatccaaaatgctgacaacaataaatgctgacaagaatatacggcaacagaagctcttattcattg

SEQ ID NO: 194426 - DNA, 444 bp, Homo sapiens
actcaaaataccaccaccaccaacaaaaaaaattagctgggcatggtggcaggtgcctgtaatcccagctactcaggaggctgaggtaggagaatcgcttgaacttgggaggcggaggttgcagtgagctgagatcatgttaccgtactccagcctgggcaacagggtaagactccatctcaaaaaaaaaattgaaaaataaataaattactatttttttagtagagaaaagtttgctttaagaatgtagcaaggtattcatagcacctcctgcgtcaaataatctgataatagaaggtgttgaagctgtgctgtccagcatggaagccacttgccacatgaaactattgagcacttgaagtattactagtcaagtgttacagtactttcagaattggtctggtaggctttccagttttctctggaaagctccttagagaaaaa

SEQ ID NO: 194427 - DNA, 132 bp, Homo sapiens
gtatgagtaattcatccacataaattctgctattacttgagtatggcatagtttggcttttttacatgaaaagtgcttcagggaaggtatatggtgaagaaagagaaaatatctccatctgtcagggtcaga

SEQ ID NO: 194428 - DNA, 189 bp, Homo sapiens
ctgagtccaggaggggatggcatccaggtctccttacctatcctggagcacagaaagaagaaaaccagatgaacaggagccaaacacatcgctttccactaattatagagcagaatttaggttaacagacttcctttttaaacagctaatgcccatgggaaggtgaagtcgtgggtcacttatacctta

SEQ ID NO: 194429 - DNA, 577 bp, Homo sapiens
tgtagcctaagttaggtagaatttaaggttaatgcactggacagaataaagtggatagtatgtaatgctggcccagtaaattaactaagcagctataacagtcataaacaagtaggcaccaaacatagaagctctctataaaagcttcaaaacacaagaaaagaattcaatgagggccaggtgcagtgactcacacctgtaatcccagcactttgggatgctgaggagggcggatcacctgatttcaggagttcaagaacagcctgtccaacatggtgaaaccctgtctctactaaaaatacaaaaattagccaggcatggtggctcacacctgtagtcccagccactcgggaggctgaggcaggagaatcacttgaatccgggaggcagaggttgcagtgagccgagattgtgccactgcactgcagcctgggcgacagagcaagactctgtctcaaagaaaaaaaaaagaatttgatgaaaatacagtaatattagatttgctgcatttgttttgtagatagatagacccaaaagatacagataaaggcatagggaattggactaacaaaatcag

SEQ ID NO: 194430 - DNA, 258 bp, Homo sapiens
catcccctgcatcctacaatgcacaggctggtcccaaatgtcaactgctgaggtggagaaacccgactttagccccattctgagattttgctttaatcagtgttgactgtggcctgtggtgcagcatttatagaaagaaatcttccaggtggtgctaacccctactcacgggcatgcagaactgaaccgctggggtggctaagcacagccagaagaggggagaggggctggagacgccaggaagagatcaagcacatt

SEQ ID NO: 194431 - DNA, 502 bp, Homo sapiens
atactgcttaatcagtggttttcaacttggctgtggataggaatcatgtggtgattacaaacagttatatagattctgaggcctcattatcacaaggtgcagagagagggcagacagatgtttaaaagtcaagctcctccagtggttttgatatgtaaccagagttgaggacatgcacagaatctttgtgatgtgaactgtggtctacagactagctgcactggcatcacctggaagcctgttggaaatgcagaatctgaagctcaggccagaactattaaatcagaatctgcattttagcagaatcccaggggactggcatgatcattaaattttgagaagcactgcagtgagaggctgtgctgtgcatgttctgacaatatcaactagaggaaggtggtgccatttccgaagagaatgtaagagccttgggtttagagaaaagacaaacttggtattgtgagataatctgttcagtgtaaacatttaaaatgtaccctta

SEQ ID NO: 194432 - DNA, 556 bp, Homo sapiens
ctgtcttacatgtgacgttgtctttcacccttaccacttctctcttccccatccacatggaattttagtgtaggcttgatgtggaatacataatcattcattagaaccaaagcagccttttcccataaggacagatgcaaatgatcaagattagcttgaaacccatgtctaatgctatcaagtttccaaataaaaagccaagcaatgaggttgtttaaattttttattagcaattttaatgttaattatagagtattcctgaaaggctactctgacctatttcttgcttaacatattaagccgtcaccagaacactaaagtatacagttttatgtaggctctgaaatccttgatttttatactcatataagattgtacactaacacaaataaagaaaaacactatggccataaagtagaaatggtaaacttagcgatatcccagattttttttgaatagaacttcaagatggatttctccatggtttaactatgagttctgattttcaagtgctctataaattttgagctcattaacatattgaacgtgtgtgcgt

SEQ ID NO: 194433 - DNA, 282 bp, Homo sapiens
agatgttccgtgtcaggtagttaatcaatgataggttgataagcatgacaataatcagctagctattcttatttaaatttctgttaaatataaggaaactacttaaatgtaaaatattctcaatcaaggacaagcagtaattattttcctaaaatgtgaagtactgtaactatttaagacaaaattaggatgtaaataggatttttctataaatagtatttctcaatattttttgaaggtctgacaaaggctaaagcaaggttagaatattctttttataat

SEQ ID NO: 194434 - DNA, 438 bp, Homo sapiens
tgcaagctcggtaccccaccactcctatagatcagtagagcaaagggctttctttctttgcttgactcaaagatgttctcacaacaagtacataaatggtttcttgtacacatccttaaatatctgctgagtgcctattaagatgttctcacaacaagtacataaatggtttcttgtacacatccttaaatatctgctgagtgcctattatgtgctacacatgatgctcattactatggatgcagctctgaaagagacagccaaaatctctttgctttcatataacatttatttcagagtctaatgcattcacacctagaaactaagtttaggagattattcataagaggaaaaactcaggcgactgatcatcagaatagaataatctttgcaatgacgttctccaaacagactgagctttaagtgagggagtgtttg

SEQ ID NO: 194435 - DNA, 353 bp, Homo sapiens
cactactaggctgtttcctccacatctgactgggtcattttatgccttctggttatggctttaaattgcgtatgaccccgcataagtcttctcagctccctgggccttggttacctctttgcggcactctaaaaagcaaagcagttggacaagagtctttgtaaaggcccttcgagctcattctagattttctaagtggggagattgctgtgaggcaccaggcagatgaggtgcagggtctgttgcctgacgtgctaggacagttcaaagaaaaagcactgtgtgatctgccatggccgcttctgcacctggtgctgaccccacatccggaagcattttggatgcttccagca

SEQ ID NO: 194436 - DNA, 367 bp, Homo sapiens
ctatcacaggaagactgactaccttgcccctgaacttggagttcaatcatttcacttactttgataaacagaaaattactacagtttgcatagagatttgagatggcttccatactggggattcttcttctttccatttaccataagagtatggcctatctagtacactgttcccagaagaagaatgagaaactaatgacgtgagattgctgccacctgatccagattaaattggcaaaactctaacgtcctccaagatgtagaatttggcccatctcaaatcaccacagccatccaccaaacccagcttagaaaaataaaatccaggcccagcgcaggcgaggttgaggaaggcagattacgaggt

SEQ ID NO: 194437 - DNA, 318 bp, Homo sapiens
gttcccagtgcatcataagaagttaaaatcactgtgtgctgaaagggtaaattaggtgtttaggttcctaagtttgtgttggtatcactagtctatggaacagaaatagtttccagggttggaagtcaacaagcatccattgaaattctctacttggtggcatattcttgctggagtctgtgtaatatcaacattgctttaaataattttccttaccttattttattttgactatttgagatttttaaattaacctattgactcatcctttttcttttgttgtctcaagctcttcggtttttgtcgctgtttttattg

SEQ ID NO: 194438 - DNA, 317 bp, Homo sapiens
tccaatactttgacacacttgaccttgtacacctcaggtccccatttttcactgtttcccctcaaccacaggacagcctgtaaacatttaaacatcttctctcccagcaaacatctgccatgagtccatcccaagagcaagctccaagctccaaacatataccaccctccacggcaaatcctgttatttctctcttttttttttttttttttttttggggtctctcaacttttaacacacaaagttaaaatcgtgtgtttctcccttgtttgtgagacacccccccccccccccccttaaacatctccattatctcg

SEQ ID NO: 194439 - DNA, 572 bp, Homo sapiens
ggagagggagggcaggtagggcaaaggggctgagcgggaggcccagagggccagacatgtggcccccaaggcagggagaatgctgggagctggtttctaccctgtcatttgtgtagttgaacagccagagaagagaagcagtgccagggttaaagaccccaaagtctcccaaccctgccacttcatctcacaagggagtaacgtgcccaaaagcacactgcaaaggaccgagctgggagtgagacttgggtttctagcctcctacttgaagaatcttcaaagatggcagtgtttggcaagattagagaccatgtcagtgcttggagggaatgtttagaaaacccccaaaggggctctccagttcctgtggtggtgagacttggtctgctcaactgagactaaactggcaggggtgtttatggcacagcatgtatgaaaagcacctaattcagtgtctggcaccaaatgggctcagccacacgcgtgtgtggggagctgaccaacagattttccctgtggtaaaataggcagaaccaccaaacagtctgtgcttgtgtggccactcaagtggg

SEQ ID NO: 194440 - DNA, 428 bp, Homo sapiens
gtggacagcttcttgcctccaggtgttttcatttcagccgctcagtcctatcccttgctcccaaatattgtcttacaagagagtagtagccagcgctccacttccttcagcccagagtggccagaaatgatccctgaccaacgcagctgagacccaggagccaaagctgggaccttgagtcacagtgaggcctgcaagaactatacagaggtgacctgaggacaggacacagtgctctgacctcaggtggcagaaaggacaatgggcccgggtttgagttgactgagcttgcacggctaattcatggtgaagccaggcttgggcacgagcccagtctttttctgctgtgcctttccagacttgaggcctcactggccttgactcccacgctctgtcctgtgccttgggagaggagcaggttttgaagg

SEQ ID NO: 194441 - DNA, 136 bp, Homo sapiens
gtatgtcaacgctggggtgatatactggtaagccaggttcctgggtgtagaaagaaatacatgcagtgcagactcatcttcgcagtgtagcttgtgctgtttgttttgttcatttaaaggctgcaggaatttacct

SEQ ID NO: 194442 - DNA, 128 bp, Homo sapiens
cactatgcccagctccttatggttttaatttgtaattctctgataattattgatgttgaacattttgtcatatattttttggcaattttttttcttcttttaaaaattttgtttttagccataaggcc

SEQ ID NO: 194443 - DNA, 448 bp, Homo sapiens
atgagggactggagaaactggtaaaagggctgatggtaaatattgaatttaaagaggcccctccccaaatacttatttatttattttgcatggctaaagaagctgtatgttcttcattttaaataggtctcacaaatttccaaaaggaaaaatacagtagaaggtacaacctggggctgggcacagtgccttacacctgtaatcccagcactttggaatgctgaggcaggcagatcacttgaacctaggtgttcaagaccagcctggacatgacaaaaccccatctctacaaaaattagccaggtgcagtggcatgcgcctttagtcccagctgcttcggaggctcaaggaggagaatcacttgagcctgggaggcagaggttgcagtgagccgagatcctgccattgcacttcagcctgggtgatgggagtaaaaccctgtctcaaa

SEQ ID NO: 194444 - DNA, 262 bp, Homo sapiens
aaagtgggaaggggcgggcgagggcggaggaaggcgatcctgagccttctccgcacccccgggaccgaaggcttgggggagagggagggaggaggaggctgagtgtcctagagcggctgaggccggaggcctggtgtccccagcctaagcagagggccccgggggccgggtgggtgggggtctgtctggacgaattgttctgtgtgtgaggtctgagctctgaggcagcagtgttagcacaataaagaaacattgagacgtg

SEQ ID NO: 194445 - DNA, 355 bp, Homo sapiens
ttgtggctattcttgatgtagcttctatgaatattcttgtacaagttttttgtggacatatgttttcatttcttttggggaaatgaaaaaggggaatgctagtttaactttataagggactgctaattttccaaagtggttgtaccattttatgctgccaccagcaatgtgtgagttttccagttgctctatatcttgtaattatttaaagttgtcagtcttttcaattttggccattttaatgggtatgaaaaggtatcttgcatagttttgatttacatttttctgatgactaaatgatgttgagcaccttttcatgggcttattagccattcatacatcttttgtgaagtgt

SEQ ID NO: 194446 - DNA, 159 bp, Homo sapiens
actcccgggggagcccgggagtaccaggttgtctaaggagggggggaccaggcccaggccggacacggagcaggtcaaactccccgtgttgggcgacggtgggaccgcgcctgcgagcaacgcctgcagttccgcccgggacatccgacgagacccggt

SEQ ID NO: 194447 - DNA, 508 bp, Homo sapiens
gctgggattacaggcatgtgccaccacacctggctaattttgtatttttagtagagacagggtttcaccatattggccaggctggtctggaacccctgacctcaggtgatccgcctcggcctcccaaagtgctgggattataggcatgagccactgcgcccggcccctggccctttcttgagctgctgcaaagccagcaaaccccttactaggctcctggaagggggatgagagccccagaccattcagccttagctcagccttgaaaatagctgcttgcttcctggcccagggaaacggacatgctgcccggaggataggagagttggctgatggcgagtgagcgtgggttagtcgatgctagtgtttgtttacatgcctgggttacctggaagatcatgacacatgcagtcacttggttgttttgagaacgggccagagtgacaaagtgttcagttgccactgtggtcaagccataggaaatgagggtattcctagctgtgcctgt

SEQ ID NO: 194448 - DNA, 470 bp, Homo sapiens
aagaaaggagggggaaaaagagcctctggctgcccctaagctgtctgttaggaaaattcgctgatctcagtgtatgtcaagagagcactcggaagacaccaaaatttcaggtgccattactcctttgttttgcacttgttttcctcatagtttgtgtattcctaaagcaggcagatgatataaaccactgggagagatggcccaaagcacaggtcatgggtcagagatggaagggattctggaagtaaccattactgtctagagagtgaattcataccctggggagtcaggattctataagtagattggtggggaattgatttagaggttttatttgacacgactttggggtttgagggtcactctggtggcagtataggaaatagcttgaaggatgagtagcactaaagagttcaaacagaaaacaggacccgtgtatttggcaggaccacagtcttggctcctgatca

SEQ ID NO: 194449 - DNA, 259 bp, Homo sapiens
actctagaatgcttaaaactagagagaatgcttgcatagagataataattttgaagagaattccagagggaaggagaaatggagtttgaggaaaaggattaggattctggtgatagacatctaaataatccaatggactggaagctccacaagggcaggaactctgacagtcttgtttattgcttgtccccagttcctagtgcaatgtcttgcatgtaatgagcacttcaacatgcttatgaataaatgaaagggaagg

SEQ ID NO: 194450 - DNA, 571 bp, Homo sapiens
taattcagaatgtactgagtacaacacatatgccttctatgtgataagctcccagcattatttattcaaagaaaacttgccttgttgcaaaaatataaaaaaacttaaaaaaaaaaaacaagtaattacacaacacaccacctcctacaacaccagattccttttctttcctttgtaacctgaccagaagaaaaacaaaacattgttcaaattgctgagacccacaaagttcaattagagcataaaaaaatgctctcccaaaatatagctactagcagggaaatgagcaggctaagcctcctggtgaacctggacattgggcacaagtaacaggcacatttagacaccaacgaccagattccacatgactgaatccagaaaccctgccccttcccattcccttggagatccagggggacgccatcaattgctcactccttctccttacacatacagttaggggtgctatactatacaggggaaggcgtgaggaagtcacacatgctttggtgttcaagaagctcataaagccattagggaaagagcaacatgccagaaagcagttgtctct

SEQ ID NO: 194451 - DNA, 238 bp, Homo sapiens
agcttgcagcaagctgagattgcgccagtgcactccagcctgggcgacagagcgagactccgtctaaaaaaaaaataaaaataaaaataaaaataaagacaaagataaaaaatagtcaactgaaattgaaaacgctaatcaacatattttttctcagtttctgtgaaatgtatattacattagctatttgtctttgtactgacaccaagacatcagtcattagtaataatggaaacag

SEQ ID NO: 194452 - DNA, 457 bp, Homo sapiens
attccagggctctctcccatcaagatactatattaaagttacttttcccattccaagtgtacttattacacatatagttatatactttgaaaaactactacacaaatgcaagcatcctatacatgctgttctgtatcattacttttcagtttatagtatatcctggaactcttcccaaagcacagaaagatttactttattatttttactattattttaaaatacagagacaaggtctcactctgtcactcaggctgaagtgcagtgctgcaatcatagctcattcgaacctaaaactcctggactacagatcttcctggctcaggctcccaagtgtttggattacaggtgtgaaccattgcactcagcttgcactaggctatctcactctttttagtgtaacagagaattccatcatgtgaatgtttcattctttatttagctactctactgatgg

SEQ ID NO: 194453 - DNA, 210 bp, Homo sapiens
tgcaaaacagacttgattcttagagcttcaagatagctgctatgaaaattataatgggctgtgacaataccattttcagcccgtccagttctgcaccaaacctagtttcagaaggacaacactactgcttgagttgaggtttcagccaagtagcatcaaaggaaagcaagtttgtggtttgcagttctgctgagctgcactcagtgactc

SEQ ID NO: 194454 - DNA, 166 bp, Homo sapiens
ttaaagtttttgagccattcaatgttgatcaaaaaaaaaggtttaagatgaaaaagcacatcgttctggcatttgctttctgaagtagaagtaaaatattgtttctctattaagattgctagagcttgatgtcattggttttctggtttatgtatgtttttgttat

SEQ ID NO: 194455 - DNA, 873 bp, Homo sapiens
ttgggtagtgggctaggagcatccctgctctagtggcccctgattctgcaaccctaggactcctctgcttcctcatcagacacaaaccttgataagacagctccagtgagaaagccctgggagaaggtgaattaaggacacttcctttgtaggaggagctgatctcgctaatgggcgactttttaactaagcaggtcagaaaatcttactgaaagtaaatctgtggctcaaagagacttcggtattcttttccctagtactaactgtggaaaggagtgcccccaagcttctgactgtcatacctcattccactgccttttagggctgggtctgaagagcttacactcctgctttcagagctggttgacgggggtgctgttctagaatcctaacccagactggcaccatgaatgatgggttgccccactgccaagctccagacccagcttggcttggggcttgctgccactgcaggtcaaatgaccaccctatgtggaaagatgcagcagtgctgcctgtcccatactggccgtgacccttgagcctcagaaagggagacatggacaattttccccacaggtagtcttagctttccaaacatactctgactcaccagtcaaccagtggatgaccacagttcttgtatttatgggaggtatcaataaaccactctttgtgatcacagtcaagggagaaatcaagaagagggaagtgtaatctgtgaccagatatacccggcacctgcagaatcagatgccagcctaacagctgtcagctgtgcatgaggcaacatgcatctcttgattaggaatgtgcaccagtgacacctaggctcacctttcactgacgctttacctctgaggtgccaccagt

SEQ ID NO: 194456 - DNA, 268 bp, Homo sapiens
ttaggtgaagaaactgaagtttcaggaaatttaaatagtttgattcttcctgtttccttgccacttttccctaaattccagacgaaacccttcagtgacacccctaaaattcatctcaaacatgtctacttctctctctccagccaccaccctagtctaagccaccatcatttcttacttaaatgacttcaatatcttcgtagctggatcttctcttccatcttactctctctatactccagagagagacagagagacgcagcagcca

SEQ ID NO: 194457 - DNA, 512 bp, Homo sapiens
cttcaaacaaataaccttatactaataatcagtacaacccttctactaattaccattctaatcctaggcctaatttatgaatgaacccaaaaaggattagattgagttgaactggtaaatagtttaaattaaatgatttcgactcattagattatgatagaccatatttaccaaatgccatttatttatattaacattatattagcatataccatagcactgctgggagtactaatctatcgatcccacctaataccatctctattatgcctagaaggcatcatactatcaatatttatcataaatacactcataattttaaacatgcatttcactctaggattcataatacccattatcctcttagtatttgctgcctgcaaagccgcagtaggccttgctttcctagtctcaatctccaacgcataaggcctagactatgtacaaaatctaaatttactccaatgccaaaaattattattccaacaattatactgttacaatataactct

SEQ ID NO: 194458 - DNA, 615 bp, Homo sapiens
cctctttcttgctctcctggctctgacactctaggtcaccacaataacaactccggaaacctaaagacttgtggttcagccatctgcacttcaggcatggcagctccgcagctctctccagcctcgcagaggctggttctttgttgaaatccatatcaaatcctgcaaaggttttccttcaagccagcagtctagggttgcagaacttttctactatggatgagtggttgaaaacataaaggttcttaaaagcaagcgtttaaatcacacaaaacccccaaagaagaaacggattaaaacacctgaatttaactgatttttttttctttttggtaaagcaatggcttcaagtgctaccgtttaaactccattaaatcccacagctctggagtactttggatctaatggtgatatttacattttttatttaaacacaccctacttcagatgcagatggagatctgatttgtctttcctgaaggctgtccctccctagacggtaatttgctttgtaatgactttcatttcactaaagagcccattccccctctccggggcttggggttggagataacaaaagagctctgggaggtaataattacagtcattagttca

SEQ ID NO: 194459 - DNA, 370 bp, Homo sapiens
tttgggcaggcaagtcagacagggtcctgtgtcgcagagatcagcatggacgcacctgcagtggatgtgggcacagagaggtgacaccttcccccagggactcaggaagccatacgggctggtctgaggcagaacagtggaaagacagatgggtgggtagtggcgaccatggcaactccagacgtgacccatccccatggtttatgggccggacacgcaccccgctcagctgaggccccatcatttgtctctcttagtgtgtgtgcctatgctttgggggtagtgggtggaggagggaggggctgtgctaggcagttgacaggaaggggaatgggaccggaaggggcctaagagggggaagggttaggat

SEQ ID NO: 194460 - DNA, 413 bp, Homo sapiens
ttttgcagcatcatattggtatggaagacctcagcaagataaggcctgtagggaaaccctgaacttcatgacagagcacacaggtcacctttggaagcagccacattcagatggggagggctgatgtcagattatagaatgggaaggaatgtgggaagtcaggactgggagtgtacgtaagtctttcatctactaccatttcttccctaacccacaacagctaacatttatctaggctgtagtacatgccaggccctttgcgtacacatttaatcctcacaaccaccccacagggtgggctacagggactaagctcagtgcttgtattaccaccagattatgttcacctccgaccacatgcagagaacccctactgaaacaccgaaacgggaatgaatgtttagctattacat

SEQ ID NO: 194461 - DNA, 469 bp, Homo sapiens
tataaaaaggttaaaagaaaagaaacatttagtaacccactattaaaatccacgaaagtaaccaggaggtaaaattaggttaaaatatgcaatattgtttccaacatgatgacacattatcatttacttaatacaatatttaaaaccaattcaataagttatagatacctgataaaaaattcatcaaaaattttttctaataccacattttaaaaaacaacaggtaccagcagttcagatgaaatattttcaaaaatattttatcttgtttctttgtaataaaaatcaataatcaattccttaatgcaatgaagtaataaaaaattttcacatcatcttaaaattagctaaggacattaaaatgataagccctatgaagagtaaatctggcaatcaaaaagttatccattttaaagtttttctaatgttcctttgattacatataaacaaaacaagtcctccggttgta

SEQ ID NO: 194462 - DNA, 466 bp, Homo sapiens
aaagtcatattttgcagtcatcacagtaataactgattcagacaagaatcatcaatgaacactaaaactagtgggtgaaagacgagatgataacatagtctcaaagatcttcccacaaattgcttattaatttcaaagccaaaatagcaattttttagtggaaaaacctaggagacaccagttcacacaagttatcaacgctaacgccaacaaaacacatcatgtgtttcctattgtgatgcactgacaagtatgcattagtcatgcaatactcaatctacaaacatttaacttgaatctaatcatgaggagtcaaactcaaatttagggttgttctacaaaatagcttgttgtcttcaaaatgctcatttcatgaaagacaaaaaatggctatggaactgatccaggttgaagactaaagaaacatgacaatgaaatgcaggcatgatacattttagattggacc

SEQ ID NO: 194463 - DNA, 134 bp, Homo sapiens
gcggaaggaggagccagcatatgacatggcaagagagagagaaaaggacagaagggagaggtcccagagtcctttaaacaaccagatcttgggtgcgttaactgagtgaaaactcactcaccatcaaagggaca

SEQ ID NO: 194464 - DNA, 528 bp, Homo sapiens
actccctgtgtgaagccgaggaccgctaccgcacagagctggcccagatgcagagcctcatcaacaatgtggaggaacagctgtctgagatccgggctgacctggagcggcagaaccaggagtaccaggtgctgctggatgtgaaggcccggctgcagaatgagattgccacataccggaaccttctggagagtgaggactgcaagtacgtaccctgttgtctatgtcaacaccgtgtgcaaaaacagataacttctcttgggaatgacctaaaaggagctctggaggccaggtgggggtggcattgcagatcccatctttggagacaaacttgctaccactaggcctggtgagctaatgcctgcctaggcgtaggtgtgggcgtacaggagttttcaggtcatggcatttgttttgcggaccacgttgtgctcccagttgctgggtactcccatagagggcgtaaaatactgaatgctcagcacattcaggttttgctaattctctccaggagaagtattccaataa

SEQ ID NO: 194465 - DNA, 493 bp, Homo sapiens
actccctgtgtgaagccgaggaccgctaccgcacagagctggcccagatgcagagcctcatcaacaatgtggaggaacagctgtctgagatccgggctgacctggagcggcagaaccaggagtaccaggtgctgctggatgtgaaggcccggctgcagaatgagattgccacataccggaaccttctggagagtgaggactgcaaaaacggcaggtggaccaggacatgagtatgtttatgggcctgcagaattatgtgacacaaaagaatgtcatcggatggatcaacacctcaattaatgagggcagatacttgggctggactgtgtagcctctttgaaggcctaccacagaactctgatttcatgggtggactgtctgcggaggagtcctgacttagcaagaagcccaagtaaagaattttatgggagaagggactcttcagaggaaggcaaataacagactgaaggaaagggcgtttgaaaagaagtga

SEQ ID NO: 194466 - DNA, 297 bp, Homo sapiens
ctgtcttctggttgccttcattttcttggtgaattaggaccccgacagaggcaagagaggaggtggtgcaggtttgaagatccagggagaagttgtgaaatttgcataatctcagagagcggggagtgaaaggaacagaaagacacagagattggagtgatgcagccacaggcccggagcaccaaggattgttggcagccaccagaagctagaaggaggcacaggaggaccctccctgagaggcttcagagagagcgtggccttgctgactcctggattgtggacttccagcctcca

SEQ ID NO: 194467 - DNA, 427 bp, Homo sapiens
agatgccaacaaggccaagccagtaatataagtgatagctaacttttcatttattcagcattttctgtgcactattttaatttcaccctcataactctatacggtaggcactgctatatccccattttacagctaaggaaattgaggcacagagagataaagagacttgtccacaatcaggcagctagttaagtagcagagccaggatttgaacccagctctcctggcttccgacgacctcacacttcactgctacactacgctgccttctccaaggggcctcctcactctgatggctgctgccgccacctcccttcctgggcatctgcccctctcagcaggcagagttgttctacacctccaagtgcataacctttcatatctgtcaagtatctacttcaatgaagttatcttggccacaaagttt

SEQ ID NO: 194468 - DNA, 639 bp, Homo sapiens
catgtacaaatgttaaggcatggtttaataaagctcaatatgcataaactctgctttttgcttcacataaagatgttacagaaaaaaaacaatttcctaacctgtaagtacagaatccagtagaggttgaggaaccttttccaaaaaatccaaaatttcagattttggattttttcaaattttggaatattttcaaataaataatgagatatcttagaaatcttgagtctaaatgtgagagccaagtctaaacatgaaattcatttaactttcacatataccttatatatgcatatagtctgaaggtaattttaaacaatatttttaattaataagtttgtgcctgaaacaaagttgtgactgtattttgaatgcaactcgtcacatgaagtcatgtgtggattttccactttgataccatgctggcagccaaaaagccgtacattttgaagtgttttttggagctccaattttcagattagggacgcttaacctgtaatgtcactcaccaagggctaaagatccatcccgttatcctactagattttagcatgctattttccatctcagctttctgtcatcatcttacttcgatatgttctcattctctcatcattttgttttcaacagctcttcaac

SEQ ID NO: 194469 - DNA, 527 bp, Homo sapiens
ccagaagctgattaagtaaaatatggtcactggaagtgaactctaaacatagcctaagaggagaacttttctctcaacactaaaactcataaaaacacgtaagcaagtgtgtcggtcagtcactcccttaaacacaggtgtctggcaagatagtgagaaatcatcccacgtctaacgtccatgggcacagactcctgtttgcttcagaatccaggagatgctggcatttggccaggtaggccttcttttctctcaactcccttttaatctcatctccttcagtgatgatcattctcaaagaattatttcaagagacactatctttgagaagaagaattatttcaagttttaatttctagctcatctacaaatccacgactttttgaaatcaaagctctccaaaactctgacacctacaatgtgcttctttcctctaagtttgatggctattacctaggagacatgcatgccttccctggtagtttagagacaaagtttggaatatgatgtgctcagaaaaggggtca

SEQ ID NO: 194470 - DNA, 545 bp, Homo sapiens
gacgccccccagccactgcacctttcccttcctgcgggtggggagactgaggccctttggctaagacgggttggggagcagaaccagggcctgcctccagttggccttgtggcctcagggaactcgttcccttcccgagcctctgtttctgcatttgtataatggggctggtaggacctccgagtaaaaaggccggacacagtgggggtgctctggagaggctgtggctgggatgggcgtggggagcccgcactctgctcccattgctaccctcacagcctctgcaggggctttgagcagccagcaccttcactccagcctgtttcctgatctggcgggcacacagtgcaatgtgaaagcaggtgtgcgtgcacacccacacccgcatgcccacacatccatacagtccacaccatcacacacacacacccacacacatgcatacagttcataccatcacacacacccgcacacatccatacagtccacaccatcacacacacacccgcacacatgcatacagtgcacaccgtgtcacacacaca

SEQ ID NO: 194471 - DNA, 160 bp, Homo sapiens
aaactgcacactttcccatgtatggagagtggaggacaggtcttatgtcttactttgtcttatttgatcactttcttagagattcaagattctcctaacttatcaggtttttttctccaaaacacctttccccccaattcactaaattatatccatattt

SEQ ID NO: 194472 - DNA, 223 bp, Homo sapiens
accgtaaaatttttaaagttgaaccaaataatctgttaattctttcaagttcaatattctattgacccttttttcagaacacatccaagtcgctcacaactcccattcaaattgtaaaacaattaagatttagaattaggagactgggggcaaaagtgaaatacacagatggtcaaaagacctggactgtaatccccgccatccctttctacctgcgtgactt

SEQ ID NO: 194473 - DNA, 398 bp, Homo sapiens
cttatttcacttagcataatgtcttcagtgcttatccatgttgtagcatattgcacaatttctttcctaaggctgaacaatattccattttatgtattacaacatttttttaatccattcatccatcaatggacacttgggttgcttctacctttttgtcattgtgaataatgctgccatgaaaaagggtgtacaactacctctttgagaccctgctttcacttctttggtacatacccagaggtagaattgctggattatatgataatgctatgttagtttttttgaggaaccaccatactgcttcccatagtgactacaacatacttccaccagcaggtgcacaaggaaaggttccaatttctctacgtcttcagaaacacttgttattttatgtg

SEQ ID NO: 194474 - DNA, 488 bp, Homo sapiens
  misc_feature (402)..(402): n is a, c, g, or t
  misc_feature (410)..(410): n is a, c, g, or t
gactctagagtatccccacctgctacccctcatataaattaatctctatgacaaactggctgatgagatgcagaggatgaagggcagtgatggcaagggaggagtgtaggatggctttctatttctgacttgctgaccaagtagagggtggtgtcaacatctggggtaagtcatgaagcaagaggagcagattttggaaggagggggagtagaagaaagattctcttttaaaagttgtgattttgagatgcccttaggaaatcttgccaacaatgcccaagtagtcatttggctccagagatctagtattatagctggagacatgggtttgagttaatggatgtatgaatcgttagaatatagatgtctacctaaaccaatgggttatgggaaggacccacntgggtaangactaagtatatgagaagaggagtggttgaagatggagcactgggtcacatcagcattatggggacagatggaggagg

SEQ ID NO: 194475 - DNA, 138 bp, Homo sapiens
tgtaatgggtatggcaaaaggtagtgcccagacaggacagcatggtgaatatcacctgggaacttgggagaaatgcatattctgagccccacttcctttcttaatagactagggcccagcaacctgtgttttcacaag

SEQ ID NO: 194476 - DNA, 292 bp, Homo sapiens
aaatggaggcgagaacatattaaagaaaagatagaaataaagtttcccatagctcaatggaagacattaatctataaaccaagaagtttccttgagtgtatattgtaataagtgcaaaaaggattctcaagtatgtcatcgaaaacatgtaaatacctaaaataatgagatgctcctaaaagtttttaaagggaaacaggaggaataaaactagtacttgacttctcatcaacaacaatggagcagagctttcaaatttcgaaaggaaaactcttttcaacctagaattcta

SEQ ID NO: 194477 - DNA, 222 bp, Homo sapiens
gctgggtcttagtgaggtggaccccagctttgcctgccagctctgcaattcacttcctagatcatttgttcccctgggacacaaactactagtttgtcactggaacttctctgggcctgtctcagaatgggattaacataaaggagtggaactgttcagcagaggcagggagaaataagtaagttccctcctcctcagcttctctttccaacctccccttgc

SEQ ID NO: 194478 - DNA, 114 bp, Homo sapiens
actatgagcacttatgaaattagcttgtataatcttactgcccatccacacaacatggttatagtcaatagtattatctttctcagtgtttacctttgaactccttatacttct

SEQ ID NO: 194479 - DNA, 176 bp, Homo sapiens
tgaactgtgtccagctggcaggatttttgattgccaagatgaccagctgctttcaaggagagcagaattcaaacggtgattaatgaagtgatagggaggagactgagaaagagtacatgaaattgtactctgtaacccagggctatgctgagactagagggaggatttcttgggta

SEQ ID NO: 194480 - DNA, 204 bp, Homo sapiens
aatatcatctccaacattttcaatagcggcagttaacatttattaaccttactttgtgccaacccttgtatttcagcactttttaggctttacctttgctaatcctcacgacaacattaggaagtattattattgtccagatgaggaagctgaagttcagagacattaagtaatttgcccaaggtcacagtgctggtgagaaat

SEQ ID NO: 194481 - DNA, 238 bp, Homo sapiens
gagaaaagatgcaagacatttctaccgtgggctgagcgctgcctggagggcagggaggaaggggtgagcggaccgcgctgggatgtgggtgcctggaactgccaatctctccgttttccccttggctcctaaaggtctcttagcagcatttcctgcacgctggcaccccctgtcctcctaacgttttactgcctgcgtgtttctctgtgcttccccaccctccgacccacagggcccg

SEQ ID NO: 194482 - DNA, 419 bp, Homo sapiens
aatgggctagattccactgctgaagatgaagaaagatgcttggcaaacagtttccaaaatgctacagctttatatcaactgagactagggaatcaacaactgcgacttagaaatgcaaaagtgaatttgtataccttggataagctgaagaataacttccaggggacaataataatagatttcctgctaaacaaatcatgacacctttgtacatagcattgaaaagtgtaccgtgaaaggcaaaaaaaggaaatctcacaggtcaagaaatccttgtatagagaaaaagtaactgccttagctaacagtgagcaaaggagtcactaataataacacgatagcatgactactaatatattagtcattatttgacagcccatgggggcctcacctatttctccaaacacaatatacatagt

SEQ ID NO: 194483 - DNA, 134 bp, Homo sapiens
acaatctttcacccaatcatagggggacaagcccattaacggtggcttaacatccactgatgattttgaattatttcctgtggggattgcaaaatagctatttttccaattctatcattcttctatcagcttgg

SEQ ID NO: 194484 - DNA, 402 bp, Homo sapiens
tttgagtgtccatagagatgacgggaacacagccacctcatctgtttacatcatctgtgcctgctttcctgccacaaccagagttcagtagttgcaacagagacctatggcctctaggagtctaaaatatttactatctggtcctttacagaaaaagttagctgacacagttctagtgcaaagagcacctaatttctgcaaataaaagtagactaatcagcaagggtttgttcttttcatttttcatctagaagtgtcagagaggcaatgagagctttttctttccttaacactgggtctgtatagaaacgtaagagaaactcacaagaagtaactcggagccattcaagacagagaaacctaaagaatggagaaaaggtgagttttgctatcgtcatctga

SEQ ID NO: 194485 - DNA, 122 bp, Homo sapiens
aaaaagcttgcagaatggtctgacgtgtgagaaaaagtggtttcacttaaatttcatttcatttttcccaacaacccattgtcttaatacctgtgctctgaatgttcaaaagaatgaaaaag

SEQ ID NO: 194486 - DNA, 230 bp, Homo sapiens
cttggctgcctgcatgaggcctgtcccatcagacagtctgcagaccaaggaaatgtgagcggcagtgtccagactcatccaagactgagttgtgaccaagacagctactgtattagttaagatgtggagaaaaccacccttgaatcatgttgcagcaacatcaaggtaggacctcatgcttggtaaaatccctacctgggaaaccaagatctgaatgacagcaagaccag

SEQ ID NO: 194487 - DNA, 531 bp, Homo sapiens
cacaacaatatgcctctgagacttaactatattgttgcatatggcagtaatctattcttttgcattactgttgaatatctctttgtatgaatataccacaataattttatctacctttaccatccacaaggacataataatatccttagattttcttctaaaaggtgtgttatattttatatttcatatggaattgatatttttgtatgatggagggccaagattatctcttgttcttgtatgaatagccaagtgatccagtgttatttactgagaagacccccatttctccactgctcaggactgctacctttgtcataaatcaagtactcatgtaagtatgagtacgtttttgtgtctctattctgttttattaatctgtttgtgtctctttggtaaaaaataggatctcagctgagtgcactggctcatgcctataatctcaacatactgggaagctgaggtggaagaattgtttgaggccgggagtttgggacccacctggacaaactacagaaaccccacctctag

SEQ ID NO: 194488 - DNA, 526 bp, Homo sapiens
gtcctaccttggcctcccaaagcactgggattacaggtgtaagccaccgtgactggccccgttctatttttcactttcagtacagtgttcaatgagttacatgaggtactaaacacttcattgtaaaagaagctttgttttgcccagctgtaggctaatgtaggtgttctgagcatgtttaaggtagggtaggttaagctatgatgttcagcaggttatatgtcataaatatatcttcaacttaggatattttctacttaggatgggttttccaagatgttaaccccatccattgtgttaataagttgaggagtttatctgtgtgtgtatgcatcatggtgtcctttagcaaatacagtcttagcagtggaaattgctggcagtatgatagggacacttgaaaattgcatagataattgccaacttgaaggcagagggtggtgctctttgcatctcagagcctagcaaaggtaggtagttgctcaacaaacggactaatgttctaatgcaaatgctgaatgctcca

SEQ ID NO: 194489 - DNA, 543 bp, Homo sapiens
ttagattagatcagtgaatttttaaacttatgctctagaagccctaggattctgggtagaaatgaagctccaatgattgagtgtggggtgggcagtggggactctgggcccttcaaaccaagcagctctgctattcgcttgttaaaatttagagttttataaactgtttcacttaaagaaaggttctactgcttaacctgcctacctgttggcatcactgtcttaagtgatctagagtcagtggcttatttcccacaaggattcagtgggcaactgtggcaatagttcttggctaacctggtcactatggaagttctttccgtggaaaaagattctccatccttcaatttgagataagatttactaattgagacctcatttgtttctgattttaatctttgcatcattttagttttaataaactaactttccaacttaccagattttcgggttgacaaagaccattatttagagaaacacaggcaaaggaaagtctaaaagctttggctggaatttcaactgcttctggtcaagaatatgaat

SEQ ID NO: 194490 - DNA, 574 bp, Homo sapiens
  misc_feature (59)..(59): n is a, c, g, or t
tgtctgcagttcactagaacacatttcaccctacctggtgaaaaaatagaggcacaggncaggtggagctctccccgaagtcagccgcgctctagagacagcaaggagggcaggcacagccgatggggctgggaagtcgattccatcttccgacctgccagcatcatgatttcataacaggcacagaatgcctcagaacgcagattgagcacagtggctcatgcctgtaatcccagcacattgggagtctaaggtgggaggatcacttgagctcaggagtttgcctagcctgggcaacttagggagatcctgcctctacaaaaaataaaaaattatccaagtgtggtggttgcacacctgtagtcccaactacttcggagggttgcaggagtccaggaggtcaaggctgccgtgaggtgtgattgagccactgcactcctacctgggtgatatagtgagactctgtctctaaaataaaataaaataaaataaatgacagtggtccatatagtaccttattcagaaaaggcttgatgtacaagaaaataagttatttgtgatcaggacagagaag

SEQ ID NO: 194491 - DNA, 300 bp, Homo sapiens
gaatccggtctcagggattcgttgactgtggatggggcgggttaaggggtctcgagtcccggcgatctctttcctctgggattttttacatgaaagagtgcccacctcacgtcctgaagctcctatgtcgtacggttgggtctcaatggtccccagtgccctgccagctcgcacaggcctgccctctggtttctgatgacccctctttaaaggtgtcactctcctttgatggtcacctgtgcttaggtggctacactgccctcgtcaagcccaggcagccttgctgacgccactgttcac

SEQ ID NO: 194492 - DNA, 314 bp, Homo sapiens
gtgggaaaaggaaaagggctgttttcttacacttgataatgaaacaaaatggagtttgaagcccagcagagcccttcaggaaagctggccagggctgtgtgggaggagatcctcacgtcagtacgatgagagcaagagagagtggcaagatggattgcgtccagagctgggcgagcagcaaacaggaagggagcagtgaggggatgcaccacaccgtggcctggcaccaggccctccctggtgacattgggaaagtaggtcagtttcagagctggctgggggatgaatggtcagccaggagcaagtggtgggaa

SEQ ID NO: 194493 - DNA, 350 bp, Homo sapiens
actgctcactgacagagaccggaaaacccaacactgaccaatgttggagaggatttagggaatgaaccaaaggggttcatacaggatctatcttcctaatgactatcaacaaatatgaatgcacctaccatgttctaggcatggttccaagtactgggattcagtgagatgaggcttctgccctcatggggcttaaatgctcctctgaagaagatggaggacaaagagataaagcaacaaaaagttaacttcacagagagaactctgggggagaagctgttctaaggttggggaagagggagggggcttcgattcggggtgcctccacaaggacacttggttgtcaggga

SEQ ID NO: 194494 - DNA, 538 bp, Homo sapiens
agatatttttcagacatagaaaagttaaaagtaatatattatcagcaaacctggactatgagaacagtgtaaaagcctttcaggaagaaggaaaataaagaataatatctttgtgcagatagaaacatggatccacacaaagaaatgaagagcactggcaatagtaacaccataagtaaatatacaatacctgcccttattacttaaatatcttttaaagataattggctgtttagaaataatagcagtgtcatgtgagttctgcagcatgagtaaaagtaaaatatatgacaacaataacctagagtaaatggaaatatagtttagtttgtaaggttcttagactgtgtgtaaagtcgtataatgcctattaaaagttggctattacaagttatctttaagttaaaacatctgtatggtgtaatccctaaagcaaatgctagagtaacaaaaacagtgataatattacaatattatcccccaccatacccaaatattaatcacatacacagaatagttagcagtgtattactttcca

SEQ ID NO: 194495 - DNA, 279 bp, Homo sapiens
ttctccattcgatctcagagatttctacttttgagcctttgctgctttttctgctgtgctgttttctctcgttagatctatgctttcatacatctctcccttgaatccttctataatcatcccaactagccgactcttagaaatttatctttacattagagcaattaggtcatttactctttcattcaaaaattatcttgttcaacaattcccacatggcagccgcaggtgctggttatgctggtgattcaggtatttaagggcatatcttcgtctctc

SEQ ID NO: 194496 - DNA, 582 bp, Homo sapiens
tgctgagattacaggcgtgagccaccgctccaggccctgtataccttctttttctataatcgatattactatttttttgtttgtttctttttggctccagtttggtattatgcctattcttgcattttagacagatttattgagataatacttacatactgtacaattcactcaaaagagtttttttttaatgtatccacagaattgtgcaactattttcacaatctatactagaacatttgcatctcccctaaggaagccctgtacccattagcagtcagtccccatttcctctctctcatctaccccttctcagccttaagtatctgctgatctactttctatttctatacgtttgcctattttggacatttcttgtaaatgaaattatacaatgtgtggtggtttgtcactggcttctttcacttagcatatttttaagggtcatcgatgttgaagcatgtgcctgtacttcatgtttttaaattgccaagtaatatgctattgtatatgtttacctttctgacaactactctcttgtgtttccaagcagctgcacgattttacatttttactaacaac

SEQ ID NO: 194497 - DNA, 571 bp, Homo sapiens
ttcagacatcagaagagactttaaacatttccttccacaagggttctgtaactacctgttaatcttccctcagattccccaactcaccaaaacagtaagcagccaaaagtgaaatttcttaaaaaccaaataaaaatatcttcccaaaaggtcagctctgttactttaaaaagcctaactgcaactattacaatgcatgggtttgcaaccactgcaaatctgtatgctcaacttttactactctaaaatctgcttgaagtcattaactcaagcgtgcccacttccaggttgtggtacagctgcatgatcagggctcactgcagcctctacctcataggttcaaacgatccttctgcctcaacctgagtagctgggacaccactggcgtgagccacagtgcccagctcccacctaaagattttcagttccaaaaacttgagactagtttctgagtaattaatctccaagacactttaaaatatgacatacaaccataattaagtttctattttcataacatcgcacctccaggaaaagagctctgacttctaagcaaaaagataaaacaaaa

SEQ ID NO: 194498 - DNA, 958 bp, Homo sapiens
  misc_feature (732)..(732): n is a, c, g, or t
tgagacggagtcttactctgtcgcccaggctggagtgcagtggtgcgatctcactgcaacctctgcctcccgggttcaagcgattctcctgcctcagcctcccgaggagctggattataggcacgcaccaccacgcccgactaattttgtattttttagtagagacgggggtttcgccatgttggccaggctggtctcgaactcctgacctcaggtgatccgccctcttcggcctctcaaagtgctgagattacaggcctgagccaccgcgcccagcctacggccgggaactttttaaggctaaccctgccatccgcgtcaccgccggttccggacgccccgagggaaggcgggtggtggagcgttggaagaaggcagaggattgtgtgtgcagaattgggaaagaaaaaacgtggtgcgaatgaatatgcacgcgaggcctcagtcctgtgaactcgctgatctggagaagcccttgtctgcactgtccgcccgattgccagggcgtctgtgattgggaaggtgaggaaagcgctgcaggaagagttctctgcaggatgctgggtgagatcaaagggagagcttctgccacacctcctacttggtgtgtgcgggggccggcacaaagaccatctctgctctgcttcccctgtctagccaggtcagtcttctctctgacgcggaatacagagctggacaactctgcctcggcctctccatccgtaataagantagaaccacccccacttctgatctccccctctatggatccagaatatttgttttctggtcctctcatatggacttggccgtcctgattcctcccaccttactttcaaaaaaacaagactctctttttggttcacctcagggctacggaactgtggggcccacgcccggaacgtgtggctggctaaggcacaggttcgggccgggaacgttgtgctggaatggcctg

SEQ ID NO: 194499 - DNA, 532 bp, Homo sapiens
agacggggtctcactatgttggctggcctggtcttgaactcctgacctcaagtgatccgcccaccttggcctcccaaagtgctaggattacaggcgtgagccactgcgcccagccgagccaggcactttttctaagcactggagatctggcagaaacaaaaccgagctttggctctcatgtgacttacatcccagtgggggagaaaggcaacaaatgaacaagatatacaacaagatgcatgtataaaatacacagttcaggcaacaacagtgctcaggagaagacagttcacctgacagagaaggagagaggtggggagagggcaacaccttccatataatagttagaaaaggcctctgatacagttgcatgagaatggagactcactgaggtgagggatggggccatgtgggtatctgggggtgaacattccagacagagggagtggcaaatgtcaatcagtgagattggtgtatctgaggaatggcaaccagaatgcagtacagggtgtaagggagaaggtggcaggga

SEQ ID NO: 194500 - DNA, 481 bp, Homo sapiens
  misc_feature (15)..(15): n is a, c, g, or t
ctatccccttcccgnacgcccaaatgggcaaacgtttcctttaacaggcttgctgtcacctcatcagttatttaaggtagttcatttcacagcagggggcaaaaagagagaaaggaaaaatttatcatttgctcaaacttgattggtctgaggaaaagcgtggctgtctagaagatgcctaattgctgctgtgatcctgtactgattctctattttgtcccaggcttcttattgaaacgttaatcaggattaggtctcacctcttgatgaatgattttgtaaaaacttgatatttctcatctcagttaggaatgtctgtatgcaagtataacgccactgcaactgaatgggaagataactaatgcccttaatttcacagagggctgtgatttggtacatacagtacaaatcaggggaaatcagaatgaaattaattttctttttttgcaaaggcactacctctgttatataatgagtcact

SEQ ID NO: 194501 - DNA, 376 bp, Homo sapiens
tcaaatgataattcttagttttttgagaaatttccatagcggtttctatagtggctttcctagttgacattcccaccaacagtgggagtccttttctctgcatcctcgccaggatctgttatttttttgtctttttaacaatagccatactgactggggtaagatatctcattgtggttttgatttgtatttctctgatgattaatgatgttgagtattttttattcacctattgactgtacatcttcttttgataattgtctattcatgtcctttgccagtttttaataggattttttttttcctgttaagtaccttatgtactctggatatagtcccctgtcagatgagtgatttgcagatattttttcccatt

SEQ ID NO: 194502 - DNA, 180 bp, Homo sapiens
tcatcacattcctaatggtcaaggatcaagtggccagaaggtggcgccaatagcattatttaactcttcaacaggccttttgcatgcagaatgtcgatgaacattttttcaatccagaaaggttctttgagaacatcgagctctaatgtctcaaagtcacacatagataaaggaactgat

SEQ ID NO: 194503 - DNA, 439 bp, Homo sapiens
gcctaccacgatgctgattcagaatactcctctcatttgcttttctgatatgaacagcttttatgctaagatctaagtgttttagatttggttatccttgaagcctttttaaaaatctgacattcttatctaaagctcaggtagcttaaaaattattctctggattggaattaaatattttaatgatgatgatacaataaatatttgatgacattttgattatataatcagggataaaatagtaccccccgaagatgtgtaccaacacattcaagtactgaagacttgattaaaactcctattaaggaatcagaaataagatgataaaggtgaccaatggagaaatttaaggaccagaaacatatttcaaaaaacagcaagatgggatgcactgtatgattaaaaacacaaagagaatatcttgtttggaaaccaagcc

SEQ ID NO: 194504 - DNA, 342 bp, Homo sapiens
cttcgatcgagtcgtgaccgactgcaatctgtgcctctactaaaaatacaaaacaagctgggcgtggtggcgggccgtgtattcccagctactcagcaggctgaggcaggataactgcttgaaccaaggaagcggccaagattgcaccactgcactccagcccgggcgacaaagcacgattcagtctcaaaaaaagaaagaaggaatataagattattcaggattttaatcaggagactgagaggggcatgtctgtggcaccatctttaaagaaagaaaggggccgggcgtggtgactcacgcccttaatcccagcactttgggaggccaaggcaggcggat

SEQ ID NO: 194505 - DNA, 423 bp, Homo sapiens
cacacaggcctatttgtctggagatttaaagcatacaagaggcgtccctggatgcttttctaccagtcaggagctttgaactcaggcctgctgtcttgtcctggctgacacaggctctatcaggcacctttttccccatgaaaaacactgggtccatcaacgttgaaaagcagttaaggcaggtaaccacccctctgttgcagtgatgcctctggggggacagggccttattttccaccatgaagtgcctttctctgtgattttaagttgacttgagcaccagggaccatggtgtttttacggagcgagtggtctcaacgggacaattgtgtgcccctggggttatttgccaatgtctgaggacatttttagttgtcacagccctgggagaggatgctaaacatttcataatgcacaccacgg

SEQ ID NO: 194506 - DNA, 273 bp, Homo sapiens
ttacagaagaatgtgttagagaaggcaaggtgatcacttttacagtattttttattattgctctcattatttattgttagtaataattactattattgccaacaacaagctactttatttctaaaaatttacttttgcagtttgcaattcctttatctccagacctgaaggccaaattttaattgcactgtaatttccaatcaagtaaccatgacaccagctgttcttgccaggctctattctgtggtagagggggaacctgtgttctcttta

SEQ ID NO: 194507 - DNA, 495 bp, Homo sapiens
tcaggtctgtctcctttaccaaatggggggctgttccgccagcaccccagtagggaggatgagaggatgccatgatttccagggtggtgtcagaacctgtctgccagggctctgcagggaggggtttggggttgagattgggagacctagaaatcgaggggtgtcgggggcctcggctggggggcaagcacagatgaggatggaagcagctcagtgtcactcagtctgcactgggaatgggggatcccaaggccagggctctgcctggtgccaactgtgtgaccctgggcacgctgctgagcctctctgggccccagttcccttattcgtacaacgggaatgatcgaggagttaacatgtgtttaaaagcaccgaggcttggccgggcgtgctgcctcacgcctgtaatctcagcactttgggaggccgaggcgggcggatcacgaggtcaggagatcgagaccacggcgaaaccctgtctctactaaaaataca

SEQ ID NO: 194508 - DNA, 619 bp, Homo sapiens
caggagcatagaaattggttgttagctttattgtcagcactgctattactagaaagggaagataagaaagatgaatggaaacaaaagaattttagagaaatgttgagaatttaaaggaaaatcataatgaagtcctagagtctgcctcctgaaattttacactgaatataatggagttgaatgtaattctgaaatctttttcatttaccaactgaaaatccttcgggtagaaactttccttccagtaacctgtggttcttagccatcaagaagaacagcatatgctctttctggacttcaccccgtggagcagtttgtgtgaactggtgctaggtcccttcagtaaaggatggacctaccaaggggcttaaaagttggtcttggtataagaacatgccacttactacaatctggaaatggcctgcctattagatcagcactgtagcatctcaaaacaggatttggaccagtatgctagacttttctttttcattagagatgatgtaaatattaacacaaacttttaagacaagtgttgtaaaacaagcatctccttctcttttggcatttcctttttgtccatcttagtggagttgtcagtgtacttatcagttggaaa

SEQ ID NO: 194509 - DNA, 656 bp, Homo sapiens
ttcaaatatctccctttttgtgtgataatatttattgtcatcatttttgtgttatgactttttgtttgtcatgaccggctaactgcatgaaaaatagcttactataagcttataaaaatacaaatatataggtacacaatatgatataatatatacacatgtatatagcaattgtatatgtatagagagagcaattgctacatgccaggtgctttgtatacagtatctcatttattcatagcatctttgtgaagcaggtgatattgtctcctttttatagttgagaaaatggaagctcccagaacttcattggtttgtcccatggccacacagcttgcacgtgatattgctggggccagaacccaggactgcctggctcttcagctcatgtcctcccttagccctgtgccacactgcgtgtttcacaagtccaaattgcttgataatgaaatgtaacaacagagaaggctcactggggaaaagttaagaaggtggtttggtttgttacagaacgtgaatgagaattacaggaatgcctttggaaggaagtattcttgctgcttgcacttctatttctgatgagtgtctgcatgataatagaaagtaaaacatacactgaaagacaagagctgggttcaaaagtctggggctcaggt

SEQ ID NO: 194510 - DNA, 894 bp, Homo sapiens
tctctgacaatggaataccattgtcatttaaattgtcatttaatacaggtttacttctgtttatttctacccatgttttgttcttctcatgatgtgacccagggggatttagcagttgaaggctgaagaaactagaactctcgttgaaactggacaacttactattgcaggaaaaagcactagttcaccctcccctcccctcttctctttttccttttctttcttttttgagatagagtcttgctctgtctctgaagctggagtgcagtggcactatcacagctcactgcagcctccacctcccaggctcaagggatcctcttgcctcagcctccccagtggctgggaccacaggcatgtgccacctcgcccggctaattttcaaattttttatagagataaggtctcactatgttgcccaggctggtcttgaactcctgggcccaagctatcctccctcctcagcgtcccagagtgctggaattacaggtgtaagccatcacacatggctgagcacaagtttgtaaaacccacctgtccagatggctgagctaaccattctcagaaacgaaactacaaccctagagtagatacatgaacactttgccttggcccaggatcctgaagacggtgaccatggacctgctggctagccttgcctcctctgctgcctgctgcagctcacactctcctctcctgaccctagaggttgctgaatgggtcacacactccttttagaccagtaacatactgagctgtttcagccttcccttacacttcattttctagagagccagtcatctatttggatcttacttatatctccccaaatttgttactgttgttgttttatctctctgaaactttgctatcacaagctggattctcttaaca

SEQ ID NO: 194511 - DNA, 539 bp, Homo sapiens
aatgtgcttgtccccccgccccgactttcttaggtgcagtggagtagtgcataggtggtgcatcctgagggctcccgaggggcatcacctgcccagtggggaagtgagcctgctttcagttagaggcagggcctgtgattgttgggtcacagctgggtgtcttggtggtgggaggaggaggaggagtggtagatgtttctccaggccctcatctggctcttgtaggcatagctcaagatagtggtctgtgcctggtgtcatcacttgcttttggcctcctgctgtgcagacatggtctctcagctcacctctgggattcctgtgtcgtcttcccattgagggcttcaggatgtctctatgtcctgagtcacccctttatgaaacaacctagattactttcatccctgtgttgtctttcttatccttccatctccttttgtcctccacttcccccaaagggaatttagtctgaattttaagcctttgggaaaggaaaaaaaaagtagtaatgtaattttctttatggttactgaagtgac

SEQ ID NO: 194512 - DNA, 432 bp, Homo sapiens
actgggtgatttgtggtgtgctgacttcagtggcttctccgacaccgtgccagaaattatctaataagtttattcatcctggcgagcttcctcttccccttgttaatttctgaattttaaatgttttgatgtgaaaaatgtagggaggccaggtatggtgcctgatgcctgtaataccagcacttcgggaggctaaggtgcgtagatggtttgagcttagggatttgataccagcctgggcaacatagcgaaaccctgactctacaaaaaatacgaaaactaaccgcatgtggtggtgcacgcctgtagtcccagctactggggagtctgaggtggaggataacttgagccagggaggttgaggctgcagtgagccatgatcacggcactgcactccagcctaggtgacagagcaagaccccgtctcaaaaa

SEQ ID NO: 194513 - DNA, 663 bp, Homo sapiens
agaggattcccaaagatctttgagcatcacccacattcccagatggccaactgatgtccagtccctcctgcactgcttccacaggcatcagcgctcctcactcctctctgggttcttaggggttattatagcaggtagagcccagtgataaaaatagcaacgatgacctaaagaaagttcaaagtaggaagcagaggtaaaaggcaagatcctgggagccaaacacattgcatgtgttctggcaatttctggagagtctacaaaactgacttccaatgcttgacctccactgcctatagaccatgtctgatcggagttcttctgacagcaggcactaccccttccttgcttctccagtccaaatgcaagcatatcctatcttttgaagcatttgcctttccactccaaggtttaaggaactgcaagacaaatagtataaaaagatgaaagttgctgggaggaagtcagcactgctaagtggttctttacagggcagtaaaccccaggtcttccctgtctctggagggatcaacaggattgccttcccaaccctgtctgcactcagtttctccccagccagcacagggtatctgcctcccaaaggaagaaaatcggctgcctaaacctccctctgcttctacacatatttaacacactctgtca

SEQ ID NO: 194514 - DNA, 678 bp, Homo sapiens
aaagctttcccctcaaatagctcgggtaagtatccacaattgagaaccaaggtaattaaatgcaacataagcatcagaaaggcatggtttgtgatttgcttttttgttatatattatcaagtacatacagtactggaaaagtctattagctaaatgaataaatgaaaaaggcttaacagcatcttttaattatgggctttctttagctgaatgttaacccaaagctatagtgctcaaatacaaacttcagtaaaatgctcaaattgcaagtggccaagcccaatcaaaatctcaagagtggaaccaagatgggtgctgagagatcccagacctacagagaggcagagaaattgctaaatatcaaagaactgggagaaaagcagacgtaggtagaactatatattgttgaggacagaatccatgcacttatggctcaacttcctcaaaagactcacataaaggggggaatacttcctaatatacctattaattctgaatgaagtcagaagatttcaaatctatttactactcttactggcgtgatcttaaaagaaagcttcacacagcagaagtcatatttaatgggattagtcattttcctcccttctttctacaaagtattttatacctgcttgacacactgagtccaaaactataacaatgtgtactaaaacactg

SEQ ID NO: 194515 - DNA, 243 bp, Homo sapiens
gtggtgctacttactgagatggagaagattgagacaacaacaggtttgctttgtttttgagtgtcttatgttcgagatgcctattagtcatcaaagtggcaatgtaagtcattcaatcagtcatgtttgtatcagagctacccctaaaatgttagaaccccaataaaataccttatttcaagtgactcgtgacagttaacaatgagtaataagtctgtgaatgattaacaacaacaacaacaa

SEQ ID NO: 194516 - DNA, 591 bp, Homo sapiens
agcaatataaatactgtgttacagaaatactgagtggtcacactgaagtcagcgacatacattgtactttattgttccctctcttgattgaaagtaattagacagtgactatattctatgattctatcattggcctgtctacagccattctcccccaagaaatttttaaaatagagtagtatataatatggagaaaatgaatcctttctaaggactgacaacacataaaaagtgcactactatgaaatatgttgacttttcccggattacaaagtctaccatgcatatggcttcctctttgactgttttcctttgagaaaacagtgagaaagaggacactaatggcacaggctatacaagcaggaaagaaaacaggagctatactctattactgcacaaatatcagtggggatttatgcctaatccctaaaaaaagactttcaccataagaagtctaatccagcagatgctgagttccctaataccagaatctatatttacacaatccaactcaacatggtctacagcatctatgatttcctcagtcatgccataacattctcaaaaaagtgtgaagcagctacttcatat

SEQ ID NO: 194517 - DNA, 217 bp, Homo sapiens
gtgaccctggaagcatattctgtgacaaaaaaagggttaatggtaacttatcgcctgttgcatctagaggctttgtaaactcgtgtggtgttggtataacacttttcacattcaacaaggttagctcattctcctgtggagaagacttgaatgaaatgaagaaggcttccaacaaagaggaatatgatttaaagatggagtggtttatgcccatctt

SEQ ID NO: 194518 - DNA, 368 bp, Homo sapiens
aactgattttcgacaagggtgacaagaccattcagtgggaaaaacatagtcttttcaacaaagggggctaggacaactggatagtcacatgcaaaagaaccttccactatacacaaaaattaacttaaaatggctcaaagacctaagtgtaacagctaaaattataaaactcctatgactcaataatcaaaagatgacccaattttttaaatgggtgaagggataggtgtggtggctcatgcctgtaatcccagcactgtgggaggcccaggtaggcaggtcgcttcagcctaagagtttaagaccagtctgtagactctatctctacaaataactaaacaaaacaattaaatgatataataaaataa

SEQ ID NO: 194519 - DNA, 250 bp, Homo sapiens
gataaactacttttgcacagtaaaacaatgcagccccctcatctgggtccctacaatcttgtcaatatataacctcgtattctctgattagatcaaatgagagatgacactgagacatggttatccccattataatgtattccatctctaagactgcattggaaacagggttaaagccaatcaagacagtaaaatgaaacaataagatttcttttatttttatttttaattttaatttttgagacggtct

SEQ ID NO: 194520 - DNA, 405 bp, Homo sapiens
ctcccgtcagacgctgaactatgcgctgcacatggaccaagtcatggaatattcaggtgaggagtctgaagtaggcacgtgatatcagtttgccttttagattggttactgcggctgctttcaggaagatggttttacttagagcaagaatggagacccgtcaagagggtaaatgcaatagtccagtagagagctgatgactgaacgaatgtggtacatcagtaggtccttaaggaattatttttacctttaggaaaaggaactatagtttcttaagttcataattgaacaatcacttaagtaattttctcctccaaattctaacaaaataaaatttaattagactcttacaatatttttaaaacattttcatttatcaatatggcacacattcctgctatttta

SEQ ID NO: 194521 - DNA, 378 bp, Homo sapiens
ttcaagcgattctcctgccttagcctcccaagtagctggattacaggcacccaccaccactcccagctaattttttgtatttttagtagagacggggtttcaccattttggccaggctgctcttgaactcctgaccttgtgatttgcctgccttggcttcccaaagtgttgggattacaggcgtgagctaccgcgcctgaccttttgattacttgctttttaaggacccttattttaagtattacttgtctatgtaactgactcctctttaccttttctcaagtagcctataggctgtgtcttattgatgttggcactccctaacatgtacataggatagtgttcagcatgtagtaaatactaaataaatcattgaac

SEQ ID NO: 194522 - DNA, 761 bp, Homo sapiens
aagtgacactgaaaatagaactgattatgacactttatgacctactgtccaggtcgtaaggcatctatacaaattatggagagtgaacctgtggaaaattactttggcaagaattcttgaaaaaagtttggtttctttaaagtacattatggaaaatattttgatttttaaaatatgttttacatgttggcaggaaaaagaaattattggatgctgtgttgagtaacatgcacccatcatggaatcaaagggctctccctctcatctgtggtcttactttttgtagaccttattaagaagctgttttgcacgcttgaggacctgtcccgaatgaaccctactccctactcaggaggggcatgagccctcgctgtgtgtgatgttttctggtgatgctcacactgttctgtgtgggcagacagcgagcagcagtattggacttggagaggccgtgtgccaggcatggtgctcagcggctttcctgtgctaccttattacactcccataaaacccattcagggtaagagttgtgttgttcttcaattgaggaagccgagcctaagcatacccaccaagtggaaaccaggattcctactccaaagcctctgcccttaggacggtgtgaggaaacctgttccttgtgatcaactcaggagccacaaagggcctggagaatatctgctcctcttctacttagagcagaggatgactgacccttggcttaatggctgttggtactgttttagagatgattatacaat

SEQ ID NO: 194523 - DNA, 373 bp, Homo sapiens
cgaagtgtcgatattatggaaggtggtttctgttgacctgcagctgcaacatgcctttgtcttaaaagccttatgcctggtgcataattatcaaaggctgggagaaaaaaggcctaatacatctaaagcttccataaggccacagaagaaagcttttccctgcatgattttgtctgatggttagtgctgcatcatcaggaagtgccgcagaaagatgtttccctgactggggatgcagtgtcctcgtggcatgacacagtggtccctcaggggccctcccagcttcctcgtgccccatctcttcttggattcagggaatttctgaatgccattcccagaagtgcctatcccaaaacatggttaagctagtgga

SEQ ID NO: 194524 - DNA, 599 bp, Homo sapiens
cttgctgacgaccgggcttggtggctcatggaaagttcaaaccccttagccccaggcctcagccttctgtggagatgggatcttacgtatgtgcaacatcaaccactttcttttaagagatgggtgttgctgtgttgcccaggctggtctcaaactccggggctcaagtgatcctcctgcctcagcctcccaaaatgttgggataacaggcgtgagccaccacgcctagccttttatctattttttggtctcttaaaaatgtaaaaaccattcctagcttataggccataaacagcaagcactgggccatagtttaccagtttctgctgttgggagcactgattccttgaatgggaaataatgagtcaatggtctgtgcaccagagacactcattatttctggttattgtttctagacctttttagtgcacacagctgagaagcagacgtttaaagagcaaagtattttcatgagtttatactgatatttccagttcacatttaaggctacaggatttactgaactttcttgatgttctacttgtaatatagggtttcttagcgatagtgggtacgagctcaatcgtaatcctgtcgtg

SEQ ID NO: 194525 - DNA, 117 bp, Homo sapiens
actcaagtggggttaagtttgtggcatgaacaatctgttaaggggagaaagcctagagcaacagagaatcatggccttaaaaataggtactagaggccgggcgtggtggctcacgcc

SEQ ID NO: 194526 - DNA, 486 bp, Homo sapiens
gcaaccagtaggaattaggcaaatagtacaaaatctgaaaaatacctaaatctgaaacacttctggtcccaagcatttcagataaggaatactcaacctgaacctagcaaatatcatttgaaaaaataatatcttaatctgtctcttcaagtaaaagtattatttaaatagtgagtgagaaaggaactacttcttttcttagaaagaaatgtgcaatggtagagcgttttcctcgttggaattttttttacatgtaatcattataagctataacttacatattataaaattctcctttttaaaatgtacagttctgtggttttttgtatatgcatagagttgtgcagcttttgccactgtctagtttaagaacatttcatcaccccaaaagagaccctgcacccattagcctcacttcccattctctcctccctccagtccctggcaactactaatcttcctgtttctttggatttgctatgaagg

SEQ ID NO: 194527 - DNA, 497 bp, Homo sapiens
ccaagcgagtgcaggtctctacgtagaccgactcatagtattatgcatggtgtctgagggtacagcgaccaaattcagcgtctggggtgcatcggcggccctcgagggcgtgcgtctgaagcctacaagaaagttcgcctatctggggcgcctggctcacgaggttggctggaagtaccaggcagtgacagccaccctggaggagaagaggaaagagaaagccaagatccactaccggaagaagaaaatgatccggatcattttcttcttccggctccctgcagtggggccaggcggggcggcggctagagtggtgtttcagcagggaccaccaggcggcgctgcagcctcagcctaggagcccggcagagcccaaaggttccgtggttactcccagtttcgccaacgcggggcctgccagcgtcccactccagtggaagcacttgtgaaaatgcagattccaaggctcaaggattctggcgctgcagatctagggt

SEQ ID NO: 194528 - DNA, 229 bp, Homo sapiens
gtcacaaaaatcaaatggggaaaatattaagatgaagagcaaataaatacagaaagaattttaaagttagtcttgtgatcaaagctaactccacactttaaaaggcttatcatccaaatatttgaagcagatatgagtaatttacaaacagtacaggttattactttttcatttttactaattcaaaaaaataacgtttgagaatgagacgaaagcattgtggttgatg

SEQ ID NO: 194529 - DNA, 469 bp, Homo sapiens
aaatttatttatcatgttatttgatttttagaacaactctaagccatggacaaagcggaagccattaccttcctttcacaaatgaggaatggaggacaaaggtttagaaacctttgtccactagacacttgacactagacacttgtctaagatcacacagataggagacttaaatttagatgtttgatgacgcagagatacagacaacaggaagaggatggaggttaaacccaaaagctcaagcaaagggctgctgagctgagcatctgtgaggctgtactacactgaagggcctgcatgagcgacggtgtggagggagaagacccataagacagttaccagagggaccagcccagacagagaaggggcaggggacagagccattcagctggagccatactgaagaggagttggaactttttccagggccatcatttatgatcagtggagtcacatgatctccttggag

SEQ ID NO: 194530 - DNA, 623 bp, Homo sapiens
actagccagaaaccatagagtgaatgttgaagaagctgacccacatatttccaaggtacctttaaaatacatcttttttaaagatgatcagttcttttggtgattcacgtagctgggcaatggtccaacttcactgtctaatgtctttttccatgaacagtttctcagcagtggtcaggtgagtagcattgaccactcaatgctccactttagtttaggacattgaaagccacaagagaatgttactaccgcctctacaaccagaacaagtgaaaaggtcttcaagagaataacatttttcaggtcctcagagagctgagattataaagtaacatattgaattaaattcatgctactccaaagagagaggaacatacaaccttttcattcccaacttgtaggccaaaagcggacataatctccaaagggggaagaacctgacaggcttcatcagcatttcaaaacttcctatcaagctaaaccaatttaaaaatgcctattagatggccaggaacaatagtttatgcctgtaataccagtactttggaaggctgaggtaggagaatcactggaggccaggagttcaagaacagcctgggcaagatagcagacctgtctctaca

SEQ ID NO: 194531 - DNA, 308 bp, Homo sapiens
atgcctggcatcttcctcaatatagaaaaagaaaaaactggctcgtgtatttttacttctggcttctgggcacttttacagagacttgtttctgtctccaatgacaaaatgtgctgaaagaaatgatggtatactttgaaataacagcttgagtctgctgagaccaaaggtaaatgttacagcaacaaactacagtaccacagacatgcaatatgtacaggaagtaattacagactgttaagaaacacagacaaacctctttaactgaataatcaacacaaaattccacacaagacacatcataacat

SEQ ID NO: 194532 - DNA, 450 bp, Homo sapiens
ggacagaggcaggaagagatgtatctatttttgctggcataaagcatggcagaggtggtgtggctctggaactggcaactgttcagcaggcagcttcctaatccagcaggcagcttcttgattgttctaaaagcagcagctctttcagcagcctactcttgtgacataattcctagaagctcagcctagatctgtttcttcaaccctcccattgattctgtgacctatatatactcattcatcaattcccttctgtttaatagctaaagaagatttcattgcttacagccaagaatcttgacctatacagaatttggcagctagaagtaaagcacagcaagtcgaaggccctaaatctggggttggcttagttgaggaggtagggctttgggcagtgagacttcttgccaacagaagtcaaggtgaggttgagacttcctgccacagaga

SEQ ID NO: 194533 - DNA, 530 bp, Homo sapiens
caagtacctggagtcccagagggagagggtaagacatggacataatatttgaagaaataatgcccccaatttagccaactattatgaaaactataaacccacagatccaagaagctcaataaatccaaaggccgagaaacaacaaagctacactagagcacatcataatcgaattgcttaaaatcagcaattaaaaacaaaaccttgaaacagagaaaagacatattactacatatagaggaacaaaaatgagattgacagcagatttcttgtcagaaacaatataagccaaaaaaccagtaaagcaacatccctaaaaaaattgtcaattagaaattcttggccaggcgtagtggctcatgcctgtaatctcagcactttgggaggccaagatgggcgatcacctgaggtcaggaattcaagactagcctggccaacatggtgaaagccaatctctactaaaaatgcaaaaattagctgagcatgatagcacatgcctgtaatcccagctactcgggaggccgtggcag

SEQ ID NO: 194534 - DNA, 472 bp, Homo sapiens
gtttgggaagatctgaattggctcaacaagtagtatgagaatgcacctgtatgtgggacttgcaagatgttggcatttgacttagtgtgttgaattttggtattccagacctgcacggagaaaggacaatgacaagatcttgatactttatcattggggatactagagaaggagaggaagtgggcgtcaaggtgtatctttgaatgatattggtaaaaggtgtttcattttaaaagttctgatcttaggtcagttacttctacggaaccagagtcatctcaatcaccgttacatggatattttattctgagtacacactattatttagaactaatgtgaggagcatgaattttaatagtctgtgtctagtgtctaatattttttctttcataaagtagaaattacgtcaaatattacaattagagtatttcctgttggcccactattctaggggagagttccctgaaagctt

SEQ ID NO: 194535 - DNA, 683 bp, Homo sapiens
agttaatatccttcatagaacgtacgaacatgataaagtcaatttctagagacatctattaaactatgtaacctttttggaataaagacattagcacacacaaagaaaaatgggttaaagttttctcatcactttattttccaaaccatgcaagtgaccaataacaaagtggactaatcacaccatttaaaaatagtcacctctaagaatgacacactcagacatccctctcccatttagagcatccgcctcattgcacttaacatgatacgatgggaacagagacagcaaagctaacgatgttcagagagaacattcacggtcaacagcccttgctaggttaagcgctgaaaacactatgattctcctcatcaatctcaatcagagatttagaactgaacagcagatgtccaccgaaccatggggattataagacactcttacccactcaagttaaagaatgccttgaccctttctgaccatgcctaatggaagagatccaaaactgcaaccctggggctacgtttatttactttctgagcacatccagatggaacctttatttttcagggtgtcattctggaataatcttatctatgtcagataacatggaggcttttggtttattaagaaacgaaattatggacatcacagagcttccacaggtgagagtatctgctcca

SEQ ID NO: 194536 - DNA, 713 bp, Homo sapiens
gaacacttcagatgttaccaagcatttgtgcacaaaccttatgggataggcagggaagttattactaattccattttgcaagtaaggaacctgaggtgcagacagcatagatatcttgcttcagaccacacagctataaagtggcagagttagaattagaaccaagttttgttttgttcagtgtctagtgacaaaatatatattaattttggaagactgggaaagtataaaaaaaaagtagaaatcatccataattctaccaaccaacaacaaacactgtaaatagtctgggaaatcatatcatacatattgaacctaaagtgctatttttaaaatctaagctgcatcattattttatgtaccatcaagaaagaaacactgccaattaaattctgacatgttacctgttgtgggatgcatctcgatttcagagatattaaaatttgggggaaaggtgtatcttaaaatcactgaaatgtattttgtatctcattgctttctatataaccattataacatgagcagattgttgtaattaggcaaaaatgaatctccttataattaatagctctgattttctattaaagttgattgattcaaaatgttgattaaaaaatacttacagttcatcttctctgaatcaactaattcttcccccatttttctgctgggagcagggggaatgctgtgttaatcaaagtgtctgtgtgctt

SEQ ID NO: 194537 - DNA, 150 bp, Homo sapiens
ggagcatcttttcatgtttcacacttttagaagtgtgttaaaatatttagcccctttttttgtcttgttgagttgaaagaattctttatataatctagatacaagcccattatcagataaagattttgctagtgttttctccccgtgggt

SEQ ID NO: 194538 - DNA, 531 bp, Homo sapiens
  misc_feature (444)..(444): n is a, c, g, or t
tgtctagaggatcccatgcgcgagcttcatcaagtcaatggaatactttgatatgaagagaggcgtgtttatgtgtcagaaacggtacccgatgggagaggtttaaaatggggccctgaccacagtttgattgccaatagtctcacagcagggtccgggctcaactccagttttaataattgcatattgccctgagctccattcagttggctctcttgttctctccagccaccttcattaaatgtccagggctatggaatttactagcgagggaaggttgctgctttttcatgcttcccctacttctgagggataggctggctataaggggaagaggggatgacctggactaagagcacgcctattgtaatgcactgtggcatcaatgctccctctattcttctggctggcagaatttcctataccctgtgggagttttttttnttcaggaaggggtgtgtggcttcctgatagttcatgtgcagattttggtgtagcttgatggaagcgtcgcgcatggggatcctctag

SEQ ID NO: 194539 - DNA, 439 bp, Homo sapiens
aattatttttaaacacagaaagaatttagcatattatttgagtgtcagtgggaatatgtctaaaaaatagactttttttggaatacagtatcagtagtctagttctcatgaaatatgacatgggtaacatggctactataggatgtggggtcaccaggtcatcataaaaaccaccattaatgaaccctaaactctgtgccttgggaagaccatacaaagaccgtctaatccaataccctgtttctaaagatgggaaagcggaggatcaaatggtgaaatgatttgatgtcatgaccttggcaagaacaagtgatacagttcagcttttactatatatttctatttatggttatcttcgtatctttagaagttttgggttttttttttatagttttgtgaaagaaaggatgggaataagatttgtgtttattttgcataa

SEQ ID NO: 194540 - DNA, 711 bp, Homo sapiens
catagcatctacttcccagggcttctgtgaagcatccaccatataacatagatgagagggtgcgtgggacatgggtcaatacacgacttccctccctcatgtgcctgattctaaacagagcagcccaaatctgccatgacaagggtgacagagaggtagctttggtgacttgacctggagcaaccatgtgtggataacatgttgcttagggcctcttctaacctcagggggtgaaagtgggaatgtaccctggggttcctccatccctcctggaccctgggacacctgccacccagggcagagacccctgtgtgccagggaccctgccctgatgtcatgcagttcattgagaacagctgctgcaggcacatcagcagacatttactccctgacactcaactctctaccctccctttcctcccatccctgtcctgtccctggcctcaggtctatggctccatcccagtcaccctgggcaggaagagctgggcagtgtgagtgacagcaggatcgtcaccaaggcacttgcttacatccaggcgccacgctgacctgctgaatgaccttgggctcagccctgcccatctctggccttgagtctgcagctgggctggataatccctggggtctgctcagtggatgggcaactcacgtgccctttcacagtggccttcatgagtcaacagcccaggaagtgatgtcaggttaggg

SEQ ID NO: 194541 - DNA, 346 bp, Homo sapiens
attgccaaagaatctaatattgaataacttaaaatattttaaaagactggggtaagaattttagcttcgttaaaactgtgaacataatttttttgtcttacccacatcacatttggatatgtaacacatatgtactttgtcagaaggttttgtttttaagtaactgaaatatcagtggaatgtttttttcagaaactcataaagaactggtgccttttcattttgatttgtaaatatgttttgtttgttatggcttcatacttcactgtatagagtttcttcataaatggaggtagacattttatctgcagtttcacattctctaatttaaagagatttattatca

SEQ ID NO: 194542 - DNA, 862 bp, Homo sapiens
gtgcctcaataaaacaagatgggaccaaggttaggggtacctggtaagcactggttcattctggaacccctagaatgaatgggggacactgccatacgcaaaggaaaaatggatgaatggggtaatgccctacccactctggtctgctgtaagttcaggaaaaagacagtagggaaattggaggggttgccttctttttctcttctctcctctgttctctctgtggacaggtaatcaagtctctgtaccacaggacacactactaggatacatcctcaagaactgggaaaagtttgactcccaaaccctaaaaaggaaaaggctaatatttttctgtaatacagcctgggttgaataaaagctctaggaccaggaatcttggccagaaaatagaagcacaaatttaaatatgatccatcaactagatttgttttgctaccaccagggaaaatggacagaaatcccctatgtgctggccttcatggccctaagaaacaaccctgacctttgttgggcttgtaaaacagatccatggccatagtcatgcagccccttcccattggttcagaaggcccctcatcaggtttacccagagctcaagccccattgccccttctacccaattatatcgaagtctcccagaagccttctcctccctacccagggccatcctctggacaccacctccttaagttatgccccattcaggaggtttagtggtcccagtggacccactggagtccagactccattcactgtgcaagacctgagccaaattaaaatggaactagggaagtttatggaggaccctgacaaatatatcaaagtgttttataaactgggcttaacatctgaactcacc

SEQ ID NO: 194543 - DNA, 372 bp, Homo sapiens
aaataatgaaatgctgtccctcccacttctcactcccactcctaaatgaatcctaaactacttctgtgagagaacaaaataatttccaagtaaaactccaaggaaggaaaaaaggatgaatattttttgagtactcaaacagcttcacttaagtttctgttagtcttcctattttacagataaagaaatggggcaaggcaggcagatcacttgaggttaagagttcaagaccagcctggccaacatggtgaaatcccatctctactaaaaatacaaaaattagccaggtgtggtggtgcgcacctgtaatcccagctacttgagaggctgaggcaggagaatcacttgaacctgggaggcacagattgcagt

SEQ ID NO: 194544 - DNA, 418 bp, Homo sapiens
caacaggcctggcatggtggctcatgcctgtaatcacagcacttagggaggctgaggcgggcagatcacttgagcccaggagtttgagaccagcctggccaacatggtgaaaccccatctctactaaaaatacaaatgtgtaggtaagcctgattcgtcctataatgtcaaatttcttgctggtatttctcagttgtattatcatttcatttattgttataattacatatgtgtgtgtgtttgtgtgtgtctatcgagggaggatatagtagatagtataatctctaccagttcagtgtaaagaagcaattttctttctctaaagggactgcacattttactaaattggctgttttctaagcctgaacactttgactaacagatgtagagaaaagggctttataatattaaatcaact

SEQ ID NO: 194545 - DNA, 555 bp, Homo sapiens
agggagaatagggttttgattctttgtcattcattggttttgtagctttgagcaagccacttaacatttctagcctctgcctcctctggcacaggaaggctgctcagaggactaaagccccttatcatctagggctactgtcatccccttgggctcgaatatggtagatagaaggctaaaggccccctcagtaaaaagaggggtgaggtgttaggggccactttctgcttgaaatcgacttgagtatacttgaactcattagagagttcactttttattccatcactgatagaacttgaattgaacatttgacgatagagacataaaaagatcttcacgagtttctccaagaagtcacatcttttagttaaagcctgtgttttgatcttgatggtgactggtactccgaaagcagttgtgtattgtagagacatcacagtgtcactgcttccctattcccttagattctccaagcttcaaataccagctcttaaagcatcaggcatttgttgaatgactgccctgtggctgttcatgctggttctgactgtattg

SEQ ID NO: 194546 - DNA, 334 bp, Homo sapiens
aaaaacaggccaacatgagcagagcaaacagaacacacactacagaaacaccgcacacaaaacgtcaagtccaaataatgtaacctaaccatggaatgctgtaaaatattagcaagtagcagattaccctgggccacagcaatcagcttcatacaggcatatttatttcgctgacctgaaaaaaggcagggctgaaaacattaatattcccaggcatcaaacataattcaaaagctccagtaataacccccaaacatatccagcagaaagaaacccgttaccatttgtgtcttggaaaggacagctacttcccatactagtcagtccctctgta

SEQ ID NO: 194547 - DNA, 251 bp, Homo sapiens
tgagtgctcagagcctttccaccctcccatcacgtttgtgccacggccccacctcccacagtttttcctgaagctgtccagctcagaaatccagaactgccgtccccagaatcattcattctctcagagtggctcacttcactccaggaaggtggccccttgtaacctggcggagcaggagagtggcagcatgggactcctgtggtcctgtcgactcaagagagcaccagcagccgaagctgaccccagcc

SEQ ID NO: 194548 - DNA, 544 bp, Homo sapiens
tctccatagtggctccacagtcctcaggtttctctatgattggctttttggagaagccagaaaagaaaaaccaagaaccccactgaggtgaacacatgattgatttcagctccacaactgagtgagacagtttttgggaggcacatcaacctgcaggtatagatgaggctgcaggttcttttccggggctgctagagtggagtcatctggggaccagtgagagaaatgcatcactcactttgtattcttatccctgtggttggggaagaaacactcaccagtccacagaatgtggtcacgtgactagggagagactcaaggcaaagggctcaaaatgccatgccccattttccgtttgtcaataatcagtgctgtcatcttcctgttcatgttgtaagttttgatcttttcaggactgcttccttgccaaaccctcgcgtccactccccaacacactttgtgctaattaatggcatttcatcgcttgattttgaaaaatgaaagtgtgaactacttgtgaaagagctcttagcaagataagaaa

SEQ ID NO: 194549 - DNA, 456 bp, Homo sapiens
aaggagaaaatgaaataaataccatatatctcatttaataaattgccatgaatagaagtaaaaatagctgctggctttctgtagttgggatacttttattaaaattattatgaatgataaagttgacaccatcactgaaatttttacctcttcaatgcattcacctttactaagcattttttctgactcagttatatagctatatttcagaatattaatgataccaaagctataaatcaggcagaggtgggcggatcacaaggtcaggagttcgagaccaacctggccaatacggtgaaactgcatctctactaaaaatacaaaaatgagccaggtgtggtggtggatgcctgtagtcccagctactcaggaggctgaggcaggagaatcgcttgaacccaggaggcggagattgcagtgagccgagttcggccactgcactccagccagggcaac

SEQ ID NO: 194550 - DNA, 690 bp, Homo sapiens
gattattataaattaaatatagacatatcataagttctgtagtgtaaaggaaaaagatgttcatgacagactgagaaaaatatgaatgggaaatatagtttgaaaattacattgggaaatgtatttattttcaaactactgtacttgtaattttgaatcaaaggctaactcccaacttctgctaatgattggatgagtcttacaaatacccttttccattttttataatagaatttttaagtgactataatgtacaaatccattcaataatcaattgaaggtcaaactacatgccagtacccgcatcaggtacagggatagaggtctcagaaagttcacagctttatgagcaagagagtgtgtacgatggcaatataatgaatcagcagtatggcagccagatgacaggagagatggtcaaggaaagcttccagggaaaataagtgaggccatagagaagtcattttttagagtaataaggaggtcagctgagggcatggcatgaaaaacatattccactagaactatttaaaatatcaagatgtcaacagcaaagtatctaagttaactcctttctcctgagacaatgcaaaggaggaggctctgctgatttcatgcactatttgcctgggatttttttgcatgattcttttaaggtgtcaagcactgggtctatgacaatgtagatga

SEQ ID NO: 194551 - DNA, 487 bp, Homo sapiens
gctgacttctatccattagaagctaatagaaccaccaccgtccccacttgtgacgaccaaaaatgtctctagccattgccaagtgccccctggaggacaaaattgtccctggttgaaaatgacagctttaaatatctggaacacatagtgtttcattaaggataggctaagccacagtaactatattaggccattcttgtgttgctataaagaaatacctgagactgggtaatttatgaagaaaagaaatgtatttggctgatggttctgcaggctttacaggaagcacagtagcatctgcttctgatgaggtctcaggaagcctccaaccatggcagaaggcgaacagggagtaggcatgacacatgtcaggagagaacgtggtggccaggtgcagtggctcacgcctggaatccagcactcggggaggccgaggtgggcggatcacgatgtcaggagttcaagaccagcctggccaacatggtga

SEQ ID NO: 194552 - DNA, 377 bp, Homo sapiens
taaaactgactctgcgtacctgtgaccaccttaaaataacctcactctcaaaagaaattttgtttctctttcccaagcaactaactgccccactgtgtccctgctgtgtgcaagtttggccctttgggagacaaaaactcttagttgtagggaaataggtttaggacctcagtgttacagggcacttaatagcagcccgggggcctgacagagttaatgtaacatccacgtcacctgaactatcaggagtttggtagaaaagaagagatgaattatattggcttccattcagagattgaaaatctgtggtaatttgaagtttccgaaaatgtaggagaatgggctgggcacggtgggtacaccgtgcttatctcaat

SEQ ID NO: 194553 - DNA, 316 bp, Homo sapiens
gttatccccaacacaggaacacaacactggttgaataataaatgaacacaaaagaataccaaattctctttgacattggcctggtgagcaacaccagctgaactgtctgcggcagtggggagtgttgggcgataagtgatgttatcgcccaacacagataaaccttgaaaacattaagctacatcaaagaagctagtcataaaatattccatttatatgaaatgacaagaacaggcaaatttatagaaacagaaagtagattggagattgccaagggctgggggtgttggggataacatcaggggtgactacttaa

SEQ ID NO: 194554 - DNA, 148 bp, Homo sapiens
ccgcttctaaaaactgaagctattcaatgaaaaccatcactatcctctcaatagcttcattttaactcactacagagttggcccccaaaaaggtttttattattcaaagggcttgaacaattactttttgggggccaactctgtagtg

SEQ ID NO: 194555 - DNA, 315 bp, Homo sapiens
caaagagatgcttggagatggaaaaggtgagctgcatctcagcaagatacagggcaaaatctactaaaacagagaggcgaagttgggaaattcatattggaacactactcaggaggctgaggtgggaggatcacttgaacccaggagttgaggttgcagtgagctatgatcatgccactccactccaacctgagtgacagagtgagaacctgtctctaaatagaatacaattgtaaaagattgtgcatgtaaacaacattttagtactatcaggtttccttggtcaacaaaccccttcttttctttttaaaaatg

SEQ ID NO: 194556 - DNA, 290 bp, Homo sapiens
tgtattggtggtgctcgcctccaaactccatcccaacactaccctgccccctaagaggggcctgagcatggggtaaaaggctcgctgacagccagagagcaggagcccacgcaagaccaccagaggatgtgcagccgctgttcctagtaggtgaggaaaaagcaggaatctggcatccacacatgtcaggaggcaaaacaggccctgtgctggtttctgcagtcctctccagcccacttccctgctcttcttgctcactggccatgacccaagaaacagcagcagcacca

SEQ ID NO: 194557 - DNA, 504 bp, Homo sapiens
ctttctgaaatctgatcaagcagaggttttatcttaaaactagaatcatagattattattattttaggactgaagagaccttaaagttaagctatagtgattagattctggtgtaataactctcttcattttccatatagagaggttaacctcgatgtagtgatttgaattaactggtaacctttttttttctttttgttatggagtctccctctgttgcccaggctgcagtgcagtagtgcaatctcggctcactacaacctccatctcttaggtacaagcgattctcgtgcctcagcctcttgagtagccaggattacaggcggacgccaccatgcccagctaatttttgtatttttagtagagacagggttttactatgtttgccaggctggtctcgaactcctgacctcagatgatctgcccacctcagcctcccaaagtgctaggattataggcgtgagccactgtacccagccaactggtaacccttaaaaaaaaaaa

SEQ ID NO: 194558 - DNA, 683 bp, Homo sapiens
tatcacatacacactccacagcacacacaacatgccaggcaagcttacacaccacacacacgtacatgtgagagcacaaatccgcacacaaacgcctgggctccttagcagtgttcctttacaagtgaaggggaaagaggcctttgttttctacctcattcgtcgtcatttgtcttgaggaaagcctccgtgtgaaggcaggggaggctgcccccaagcacagcacagctgggaacgcctttgcaagggcccctttgtcctttcagtgttcttttcagtggtttagtgatgacttcactgtacggtactttaagtataggctccttgctaagtaagtccctttgttaagaatggattttaaatcctgagtaaaatcaatgaggaaatcagggaacagcggatgaaccagacagcgcatatgctttacttctaaggaagacgttgaaagataagaatggtggattcttccttccatcagaacggatttttcacagaatcccagacaacaaagtgaaatgccattcaaatgcagccattatcataccccgtggtggcttgagccacctgcaaaccccgtcagcatgcaccggtcaaaagcttacaacgaacagggagctctttcctcgctgcttccccgctgcttccacacagccgccacacttaggagcgtggccccagatgct

SEQ ID NO: 194559 - DNA, 203 bp, Homo sapiens
aactggggcctcaatcacctttgttctggcctataaagttgtgattccacactggaagaggcaagccaaaaagaagacctcgggctgctgctcccacttccccaaactgctcagcttctaaagcagggtttcagaaagaagcatacaattgtccccactcccagctctgagccccgactccagagattttgtgggggatgggg

SEQ ID NO: 194560 - DNA, 239 bp, Homo sapiens
aaagaggcagccacaacacctggcagaggaagcctttctctggaatgaaaggaaatacgggagcaaaggcagcccttgcattccaatttctagccccttgaccacccatcttctccccttaggcccacccccaaatactctctctttacaaacatctgtctgctcaaaagtagccactaggattctgaaacttcctctttacaacaaaactaaactgttgcaacttgttgctaccattc

SEQ ID NO: 194561 - DNA, 226 bp, Homo sapiens
ccacagaaagctttattgaacaatgcttatccaggtgatgaagatctgggtaatatgtcaaaaacaagtgtgcaggaagaagtggaagggagagaaagactgtaggtaacagagttaggagccttttgtaattgatgtaggtgagaataaatttttgagccttctgatatcccaggacttcctgttcttcaacacttcactgaataccacttgtctacatgcatca

SEQ ID NO: 194562 - DNA, 369 bp, Homo sapiens
tggtgggaaagattcgggtggttgaaattgctgtgattatagtgagtgaggtcttgaaggcaggttaagttctaaagcccgaacaggacaaaaatctctgatcaaaataacccttaagagtccactcattaggaagaggcttggtgaatatgcagcaccatctcccagcagctcaacataggcaaccttcccttcaatcctggacagatatgtcattcatgtgaatgtggggactatatgaaaatgaaaaatactggcatctcagcatgtaacatgttaatcccaaggtccttgccaagagacaaggaaaaacacccactgagaacttcattcccagtcacattctgctcaaggtcataaacttgtaaa

SEQ ID NO: 194563 - DNA, 294 bp, Homo sapiens
gatggaaattgcattgaatttatagattgcttttagcagtatggttgttttcacaatattgattctacccatccatgagcatggaatatgttttcatttgtgtgtatcatctatgatttctttcagcagtattttgtagttttccttgtagaggtctttcacctcctcggttaggtatattcataactatgtttttgcagctattgtaaaaggggttgtgttcttgatttgattttcagcttggtcgctgttggtatacagaagagctactgatttgtggacattagttttgta

SEQ ID NO: 194564 - DNA, 373 bp, Homo sapiens
ggccggtaccattttggttggacgatcagagtccagttacataacatactctctgaaaaccacaaagtactttccgaatgtgagatagtagcagtgctatcataattttggttctgactatagcacaaatagcttttaaagatagatttacttgagccatatatgtgggtcctctacaaataagactattattattctggtgtctttttccatcgtttttaagttacaggataattcctcccagtaaaactagcctccaaaggttttaatggcaaaatccaagtattcaaatctataatcagccttttaagcaggaacttagaatgacatgacggttttaattgtcttgttcttcgtccaaccaatatggagt

SEQ ID NO: 194565 - DNA, 195 bp, Homo sapiens
atgttcatagccattttatttgtaatcaccaaaatgtgaaacaaacattcatcaacagatgaactaataagtagattcctgttttggcatcatatgcttttccatacagtggaatacaacagccatgtagaatgagctattgatagacacaacagcaagaatgaatctccaaacaattatgttatgtaaaagatg

SEQ ID NO: 194566 - DNA, 257 bp, Homo sapiens
ggacttcaccctatggtagctgatggggacattagagaaattgtcattcctaccagacaatttagcatttgattatctcttgccttgcactggcttctgacaatttcttatgcctgaaccttatctcaccaatcaaattgtcagccacatagcattaacaaattcttgcagcgaattctatgcagtgtttcaatgtccattattttgctgggttcttatggcaagtttcccctttcagccgtctctagcatcaggct

SEQ ID NO: 194567 - DNA, 365 bp, Homo sapiens
gctgaaaactgagatctcatcttgacacatacacatgaagctgactgtgagtctgcacagtactgacctttgagaataagcatgcatacagggtgacacattttcacatgtgctctactttaatccttatgaagcaaccttgtgagagaaatattatgatgtcctgaaattatagtatttggcctgtaagttcttcctagccaacgagttcacagttagaaccagttttacgttaaccacatctgctgaatacagaaaaaaggaaaccactacagatggaattttaagtcttcagtttataacagacaatcgagagagaatgagaatgtttcagttcatttttactccttgtagctgcctgaccc

SEQ ID NO: 194568 - DNA, 660 bp, Homo sapiens
gaagaatgtaggaggaatcaaccttatcgtatagctaccgtcatgaagactgtgttattggtgaaggaacaggcatatacataaaacaatagaacagaacagagaacctagagaaagatccatacaagcatgcccaactgatttttgacaaaaatgtgaaagcatttcaatggaagcagaatagctttttccacaaatgttgctggggcaatcacacttgcataggtaaaaagagagagataaaaaacaacctcaatctaagtcttagatcttacacaaaaattaacttaaaatggatcacggacttaaattaaaactataaaacttttagaaaaaaataggagaaaatcttcagaatctagggcaaggcaatgaactcttagagttataccaatgcatgatccataataggaaaaactggtaaattaaatttcatcgaaattgaacttttgctctgtaaaagaccccgttaagagggtgaaaagacaagctaaagacaagaagaaaatacttgtaaaccacatatctgacaaaggactagtacctaaaagatataaagaactctcaaaattcaatagtaataccaaaaaatgcaattagaaaatggtcagaagctatgaaaaggcatttctctgaagaaaatgtaatgatggtaaataa

SEQ ID NO: 194569 - DNA, 741 bp, Homo sapiens
  misc_feature (669)..(669): n is a, c, g, or t
cttgtccagcctcccaagcaaggcgaccctggcgtactgttcccgggtccctgcattctctgcccctctgctccacactgctcatcacgactgccttgctgctttgactccagaagaggcctccatgatgctcgtttttcgtttttttgttttcttttttccttaaatacacaacaggaagcacagcttgaatattcatattttattttaaagttcttgaaaacagcaaaacaaaatgaagctagctttgaagtgctgtgattacacagaaaatctccttccattcattcaaatcatgatgactgggcacctacgatgggccaccaccatttgagacaccattctagcttatccattctaggaggtgctacacagataaaaatctctgccttaatggacctcttatactttagtgtgggaagaataaacaacagataagtgaaatatgtagagtacgttagatagtgataaatgctattgaatacatacatgccgagtgaacagatgaatctactgcagactgctgttgagagctgccactcttggtgtcagtttagagtctgaaaatgtggaaggctgactactgaaatgattttcttataagcacgagtcagaagcagagggagaactcagaccttgatctttgtgacttagctatagggcctcacnattggatgagattttaaataggatcctataagtgacaaagtattgtgcttagctataatgcgttatacgcat

SEQ ID NO: 194570 - DNA, 559 bp, Homo sapiens
cttgtccagcctcccaagcaaggcgaccctggcgtactgttcccgggtccctgcattctctgcccctctgctccacactgctcatcacgactgccttgctgctttgactccagaagaggcctccatgatgctcgtttttcgtttttttgttttcttttttccttaaatacacaacaggaagcacagcttgaatattcatattttattttaaagttcttgaaaacagcaaaacaaaatgaagctagctttgaagtgctgtgattacacagaaaatctccttccattcattcaaatcatgatgactgggcacctacgatgggccaccaccatttgagacaccattctagcttatccattctaggaggtgctacacagataaaaatctctgccttaatggacctcttatactttagtgtgggaagaataaacaacagataagtgaaatatgtagagtacgttagatagtgataaatgctatggagaaatgtaaaagcagagaaaaggatgaggtatgagcagactgcatgtcaaacaaggtgagggaacacgtcactgagag

SEQ ID NO: 194571 - DNA, 306 bp, Homo sapiens
ccaagatcacaccactgcactccagcctgggcgacaaagagagactctgtctcaaaaaaaaaaaaaaggattctaaattgactcggcttgtgccatagaaatggcacagcaaagcctggatggcagccatctgtgtacagcatggtttatggaatattttaagtccactgttgagatctacagctcagaaaaaagattcctttcaaaatatgactgttcgctgacaatacggacaatgcagctggtcacccaaaagctctgacagagacgtacgcagacagtcacgctgctttcatgcctgctaac

SEQ ID NO: 194572 - DNA, 475 bp, Homo sapiens
ctgactgcagctgtgctcactgtaatcttgctttatggagcttacaacacagaggggaaggcagacaataagcaaaatcaataagcaaaatgatgacaataatacagtggtgacagtgcctgattaaacaaaaaagaaagcaaccaaattgaatgctaaccaaagaatattcatgtcactgggaagagcatggtaaaactgtctatgctttagcaggacacaaactggtcagtttatcaagctttgcttttctcttaacttctttgaacctttaatactccaaaagtttcaagttaggtgtagaataatctcaggtaaaactaaagttagaagtcctattctcagaatactaacacatcctctgctgagcaccatgatagcctgacagacttcaaacattaaggattctctaggctgggtgtggtggctcatgcctgtatcttaggaccttgggaggcacagattgcagcggaaa

SEQ ID NO: 194573 - DNA, 520 bp, Homo sapiens
gtgcatcagctgtgtcatcaactcacaccaagggtgggggttggattctcttcttccctgttgtgatagacagatgccctgtcattatgtttttatgtgaaatttcacagtgaaagaaggaagccactcttgagaatacagcaatttaaatcaggttgtaatttttaaaaagtgatttacaaaaggtctttcccaaaatactgccatcataatcatctagggtggggagaaaaatagggtgcggagggcagaatcacccctcatccttgctcttccagcagggaacactcattttcacacccttgtgcctctgcagccccaccctttgttgaggtttgtgctgggcatgtacgttccacagagtctgctggtttccagtgtgacagaaatctcatttgtgataaaccttgattttgaattgtagtacatgaaactttaaaaaaagcagacattaaaactccctgtttttttccctaggaaaaggagcattccatcttctggcatcactgtccttgggact

SEQ ID NO: 194574 - DNA, 322 bp, Homo sapiens
tccaggggaggaggacttacaaataacccactaacttgataactgactcctctttgtctaattttccatgacaccaatgttcatagggtaactctcatgatggatttgagtggatggcttttctcccatgctgctctagaaaatagtttatgctaagtagtatgcagtgtaaaaaagccatgatacccaaccttgaggagtttatatatatgtattctactgaaaaatatcacttgcacttttgcctagagatatcaaattcactatgttatttgatactctttgtaaaactatgtggaagagacacaaatttaaaaacaaa

SEQ ID NO: 194575 - DNA, 298 bp, Homo sapiens
aaagaaaaagaaagtagtttataaagagaactgtcgtagtaatatagccaacaggtgagtgtgtttgagcaatacaagtagcaggaaagatggagaaaaccaggcagataattaaaaagtgtgaactaataggacctggtgatttcatgaacggatgtgaaagaattcatggttaatgcatactcatttgcatgtcttctattatgaaactctattaaaatgcctagaagtgaatgaatataaaataaacaaacactgaagggagggaaggttatcattagctgagaataattttatc

SEQ ID NO: 194576 - DNA, 550 bp, Homo sapiens
tgtcagcctcccaaagtgctgggattatagccgtgagctaccacgtatggtccattatatgtatttttacaagaacattctgtgtgctgatttactaagtatggattgataataaatcagcttttgcctgggtgtgacttttataaagtgtcaatgttagaaataatatttacattctgctgaagagttcttgtagtacaattgtgtagataagttataaattttataaatcagaactctgtgcatacttatatgtttttgataccatttttttgatatatgcatacagactatgtattctgagtgtcaaataaactttttttaaaggctagaattaaaatttagtttatgacattgaccaaattgtccttttctggtgaatcgactattttgatacatgtgtcatagtttgcatctaagtttttcttcccttagtttcacgtatgaataaccagatgttttcacatttgtatggtggccataccaaaaattactcttcttgaccccaggaacacccctcttttcccgtttcacttagagatcctactaa

SEQ ID NO: 194577 - DNA, 944 bp, Homo sapiens
ccataaaccaaacaccgcacactcgccagcagttaaccgcccatgtcgcagctacattttccacttagtaaaatgcatatccatttgcttcacaaatcctggcaaagacagaatatttagaatattctgtttagaatattgcagatcatggagggaaacctaagcaaaaatttaaaagtgtattcattctcagatggatttgaaaattatataactcaagataacatttagaaagaacaaaatacagatatggcataaatgttgtttttgacattggtgagaaacaaaacttgtatgcctaagattaataatgttttcctttttcgtctttgtttcttttcatttttcagctttgacacaatcatgaaaatttatagaaacttttaacatgaaacaaaacaactttaaaactgtcacatacactctttcaaagactgcatattctttatttttgcaaaggaaatatgcaatttccttagcaagagaaaggaatgtgacattttcttgtcctagtcaccaagtttaaattatatttcaaggaaatagttaatatttgcagttttatgtctcgttatacatctttgtggcattttagaagtgttttctgtaaaacccagggaaacgaaatgatttcacacttttatgaaggtatcagcaaaatgtaatttaaatttgttttccctccttcagagaattgaacctaaagctttgtgtatggaacttctgttaggtctagtaattacttaacatttgtaatatttgctatatcatttttaggaaaagaaagtgtaaaaaacacgagtctccttcactgaaacagcaggtcacttagagagtaaaaacaaagttggcaatagagtaataattttacatacttagagcacatgaaatgaactctagaatttgtttttaaacaaatttcttgaactctagactttgttttt

SEQ ID NO: 194578 - DNA, 458 bp, Homo sapiens
gaaataatttacgagtaacctagattttcccaaatctatctcatggagctattgtgaggatcaaatgagacagactatgtgaaagtgttttgcaaactacaaaacaatttagagatatatatgacaattatttatgtcattaccagtgaaatgcttttttgactttcattaagatccattcctagcttttccagagctaatacatttggaaataagatccaccctaaaatgctaaatattaataccattttagattttagggatgtttaatttttaaaccctacatgctatagggattccatatctcaagtttaggagacttaatttttaaatttaagctcacttgtcctgcctctgatgtccttaccaattatttataatgttatacattattttctgcagccctaagggaaaatctccattgtggtgacaaagtaagtggcagccatacacaggta

SEQ ID NO: 194579 - DNA, 676 bp, Homo sapiens
agataatggttacttggatgaggcaggagcagtggagggtgaaaagccctcaaatgctgcatatgtcagaataacagattggatgtgggatgttaaaaaaaatgacaactccaaggtttttagttttagtaactacaaagatgtagttgccattaattgagatggagactaagtagaacaagtttttttgttttttgagtggggcataggaatttatttaaacttattttgagataattatagattcacttggcagttgtaagaaataatatagagatcctgcatatcccctacccagttttcctaatagtaacgtctttcaaaacaatagtgcaatatcacgaccaggatattaacattggtacagtcaaaatacggggcattaccatcaccacaaggatatctcatattgcccttataaagccaccccacttccctcctacctcacccctcctgaactcctggtaaccacaaattatccatttgtataagttggtaattttgagaatcttacataaatggaataatacagtatgtaacttttgggattgactttttttcacttagcataattctctgaagattcacctaggttgttacatgtgtcaatagtttgttcctttttaaattttaacttttattttttcgagagtaagtcttgcactccaggctggag

SEQ ID NO: 194580 - DNA, 567 bp, Homo sapiens
cagccacttaaatgagaacctcggataaacggtgaacacttaaaaatatacaagaatgttccaaatagttcatgggatatctttaaactaaaacaattatttgtggttaatctgaaatttaagctgggctgcttgtattttcatttgctaaattggacagcctggccaacacggcgaaaacccatctctactaaaaatacaaaaattagccgggtgtggtggcgcatgcctgtagtcttagctacatggaaggctgaggcaggagaatcgcttgaacccgggaggtggaggttgcagtgagcagagatcgcaccactgcactccattctgggcgacagagtgagactcaatctcaaaaaataacataaatgtttctgccattgtagcatcatacagaaaaataagtagtttcagtgccctaaaaatcctctgtgcttcacttattcatccccaacccctggcaaccactgatcttttcactgtctccatagttttaccttttccagaatgtcatataattgcaaccgtaaggtaaatagccttttcagattgtcttctttcacatag

SEQ ID NO: 194581 - DNA, 265 bp, Homo sapiens
tgtacttttgcatattttcacaatggtaagtggcatccgttcacttctaagtttgggattcctttgagcatttcttgtagtctagtggtaatacataaattctctcagcatttgcttgtccagaaaatacttcatttctccttcatttgtgaaggataattttcctacatatagtatccttggcagacagttttgtcttttcagcactttgaatatattatctcattctcttcttatgtattaggtttctgcagaggaatctgct

SEQ ID NO: 194582 - DNA, 906 bp, Homo sapiens
ggtgtgtatagttttcctgtctcttttcaggatatatattatatcactgatacgtattaccagtattctagattgttgtgttttaaaacatttatgtgattattgtattattattgttctaccacttgcttgtttactccacaaatgtgtttagatctatctagtcttattgaagtatctatagctacatatttgtagttatttcatttaaactgttttatagtattccatcttagaactgaaattatttgttccccatttgttaaaggatatttaggttgtttaaagttttttcctgttatgtacactgccacaatgagcttctatttaaagttgttttgttttgtttttgagtcaggggctcactgtgtcacccaggctgaagtgcaatggcgcagtcatggcttactgcagcctcgacctcctgggctcaagcaatccttctgccttagcctcctgagtagctacaactacaggtgtgagccaccacacccagctaattttttattaataaattttttgtggagatgggttcttgctgtgttgcccggactggtctctaattcctggccttgtgtggtcctcccacctaggtctcccaaagcagtgggattacaggtataacccaccgcacctggccttaacatttaagtgaaaattaactttttccttattatgtaagcaatcatatcttcattattgaaaatataaaaatgtaagcaagcaaacagaagaaaacaaatgtacataatttcccagtcccacctatccggaatcaataggtgttaattaaccctatatattttccagactttgttaatatttgtgttcatgttgtgtatgcatatagttatatgtgcatggtgggtgtgtatattaaacaaataggaaggtactttactattt

SEQ ID NO: 194583 - DNA, 373 bp, Homo sapiens
catagtgctttttagctgatcttccctaaagaccagtttcatcaagttacttcttagaaaatgttatcggcctacttctgcatatcatatgacggtttctggttcttctgttgagctttcaaatccctagcactgattttctgtgttaatcatattgacatatgattaaatgatacgatatctagaatatatgtcacctcatactatgtttttttccatctatgactttactaaattattctccttacctgaatgtcttttccttttccccctatcattctgaaacactgccttgtgaaattaacccaggcactttagcaacatgtgacattctctgagggattgtgctgcttttttaagggtccaaaaccat

SEQ ID NO: 194584 - DNA, 1045 bp, Homo sapiens
ggatttttagtagagacagggtttcaccatgatggccaggctggtcttgaactcctggcctcaggtgatctgcccacctcggcctcccaaagcactggaattacaggcatgagccaccacccagccgaatttttattttatttttctgagacagagtcttactctgtcactcaggctggagtacagtggcacaatctaggcagaggcaacctctgcctcccagtttcaagcgattctcgtgactcagtctcctgagtagctgggattacaggtcagtgccaccacgcccggctgatttttgtgtttttagtagagacatggttttaccatgttgtccaggctggtcttgaactgacctcaattgatccactcgcctcgcctcccaaagtgctgggattataggcgtgagccactgtacctggcccattttttttaaaagtgaaaaaccaaactaaagtgtgataatagttttgaacatttagtggagtgtaagaaaagagaacccatttgactcaggttcactgataaagggttctatttccttttctaggagttgagcattgctgttggttttgtgggaggtaatatttacacaatcatactgctgtggatgtagctaaatagtttattggttaatccccacacaagacaggaaagatgtaattataactacagagagaaaacaatcatcaaggttttaaaatctagcaatgcaaagggagtgaaagagcagacagaagcctgaggctagaaggcaggaaaagaggcaggagggagagggaccttggtactcattttcttcttttacatggtgggatgtagagaaatactgtgtaatactgctgaaacaggaaacagagctaaccaattgaaggactaaaaatagtataatcaagaaaactagagacaaaatagaggtgaagtaagtgtgaatgagttagatacgggggaggcggtaagtcagtagattctgtctgaagttgacacatcagggatagaagcctgtcatttcgttaagctgatcaccatagaaggactgtaaaag

SEQ ID NO: 194585 - DNA, 309 bp, Homo sapiens
atcagccaaaaaatccccaacacaacaagccttcaagttatgaaaaaataatgagtatgtttaagcacagttacagagattgcatttcctgacttttagagttaaaaaaaaaaaaaaaacaggatatagtttcttctttttttctgttttcctttttgtaaatgcagcaggcagacggttttctttttcctccaggcagaacaactgctctccactctagccccttctccctagggctcccccttcacactcccctacacagagccactttccctggaacaggggaggcgtgtgggcagagaggtcaag

SEQ ID NO: 194586 - DNA, 882 bp, Homo sapiens
gcagataaacaagcactggcctcaggataagcagtgttgaaacatttggaagctcctgcagatgctgaataactgacctccagcctctgttccaccagccacaactacagctttgattggagaagagactgatttcagccactttctcctggtataaaagcctgccgttggtggaaaaggaaaaggtggtccagttagacaagatgccaccggcttctgaaaccagacatctttgaaaacccacccatctacctgcaggaaaagagacagggtttcactatgttggccaggatgttcaacaacttctgccttcaagcgatcttccctcctgggctccccaagtgctgagtttacaagcatcagccaccacacccagcctatgacattttcttcattatggctggtactgcctcatgaaaagggggttcctcatgctggatctgaacaacccagcacaggcaagtctggggagcaaggcaggagcctgcatgtggactcaaaggaccggcacccgaaacaaagcagtggctggcacaggtggacaaaccaggcaagaaaagcaactgtccttcggagcagagtccacgtgatgggaagaaacagacacagtctcactctgttgcccaggctgaagtcaacggcatgatctcagctcactgcaaactccacctcctgggttcaagcaattctcgtgcctcagcctcccaagtagcttggattacaggagaaagaacctctcttctactgatcttgaacttgaaggctggtccctctcttctgggggccattgtgaagagaggctgcctaagcctgaagtcaacttaaaggaaggtgaaacagagaaaaaccacacattcaggcatttgatgtcctaaagcagat

SEQ ID NO: 194587 - DNA, 777 bp, Homo sapiens
gcagataaacaagcactggcctcaggataagcagtgttgaaacatttggaagctcctgcagatgctgaataactgacctccagcctctgttccaccagccacaactacagctttgattggagaagagactgatttcagccactttctcctggtataaaagcctgccgttggtggaaaaggaaaaggtggtccagttagacaagatgccaccggcttctgaaaccagacatctttgaaaacccacccatctacctgcaggaaaagagacagggtttcactatgttggccaggatgttcaacaacttctgccttcaagcgatcttccctcctgggctccccaagtgctgagtttacaagcatcagccaccacacccagcctatgacattttcttcattatggctggtactgcctcatgaaaagggggttcctcatgctggatctgaacaacccagcacaggcaagtctggggagcaaggcaggagcctgcatgtggactcaaaggaccggcacccgaaacaaagcagtggctggcacaggtggacaaaccaggcaagaaaagcaactgtccttcggagcagagtccacgtgatgggaagaaacagacacagtctcactctgttgcccaggctgaagtcaacggcatgatctcagctcactgcaaactccacctcctgggttcaagcaattctcgtgcctcagcctcccaagtagcttggattacagctttctctttccacagggtggttaggaaggtagaaggtaatcctggagcttcc

SEQ ID NO: 194588 - DNA, 686 bp, Homo sapiens
gcagataaacaagcactggcctcaggataagcagtgttgaaacatttggaagctcctgcagatgctgaataactgacctccagcctctgttccaccagccacaactacagctttgattggagaagagactgatttcagccactttctcctgtacatgtcagggcctgatctacattggcatacgtggacctgcctcgttctttgtaacaggtataaaagcctgccgttggtggaaaaggaaaaggtggtccagttagacaagatgccaccggcttctgaaaccagacatctttgaaaacccacccatctacctgcaggaaaagagacagggtttcactatgttggccaggatgttcaacaacttctgccttcaagcgatcttccctcctgggctccccaagtgctgagtttacaagcatcagccaccacacccagcctatgacattttcttcattatggctggtactgcctcatgaaaagggggttcctcatgctggatctgaacaacccagcacaggcaagtctggggagcaaggcaggagcctgcatgtggactcaaaggaccggcacccgaaacaaagcagtggctggcacaggtggacaaaccaggcaagaaaagcaactgtccttcggagcagagtccacgtgatgggaagaaacaggtcatgatacttttgagtggttac

SEQ ID NO: 194589 - DNA, 339 bp, Homo sapiens
ctttttgaccacatgactcttccaggtataaaagcctgccgttggtggaaaaggaaaaggtggtccagttagacaagatgccaccggcttctgaaaccagacatctttgaaaacccacccatctacctgcaggaaaaggcaagggacctgacctcgcctgggctcagggaagaggttgctgggatcataaccccaggaagagacgggatggaaggagagcatgcagggagcagaggacaggctactctccaaggaggagagggaagaggccacagaaatggaaaaggggccaggacaagtcagtggagagatggtcagggcctggcgaggaggagcagg

SEQ ID NO: 194590 - DNA, 477 bp, Homo sapiens
agggaggagtgacggctttgagaggtccctgcaagaggcagagtcagtgtttgaagagtcactacatctggaacagaaaggagactgtgctgcagctttggctctctgtaatgaagctatctctaaactaagacttgccctgcatggtgccagctgtagcacgcacagcagagccctagtcgataagaagttgcaaatcagtattcgaaaagcacggagcctgcaggatcgcatgcagcagcagcaatcaccacagcagccgtcgcagccctcagcctgcctcccaacacaggcggggactctctctcagccaacaagtgaacagcctatcccgctccaagtattgttaagccaagaggcccaactggaatccggcatggatacagagtttggggccagttctttcttccattcacctgcttcctgccatgagtcacactcatcactatctccagagtcatctgccccacagcacag

SEQ ID NO: 194591 - DNA, 156 bp, Homo sapiens
gagtaaataagacattggcaggagatttcattaagtgctatgactaggttgtgaattaaatctcaagagttagtaattaggctcataaggaagcagaaagatttggaaggttttaagtaggaaatactagggggccagtaccttgggaggcagagg

SEQ ID NO: 194592 - DNA, 101 bp, Homo sapiens
tagatgtctaatattgaaaaatttatttagccattctaaagcatattttattcatttgtaaaattggttggttggggataaaatgagataatatatctgaa

SEQ ID NO: 194593 - DNA, 1807 bp, Homo sapiens
tggcacgaggcaggctccatgaggaggcaagccttgggaatctgagggatggagactcagttccgcagagggggtctggggtgcagccctgccagcatcaagaggaagaagaagagggaggactcaggagactttggactccaggtgagcactatgttctcagaggacgacttccagtcaacagaaagagccccatatggtccacaactacagtggtcccaggatctgccaagagtccaggtttttagagaacaggccaacctggaggacaggagtcccaggagaacccagaggatcactggaggagaacaagtgctgtggggccccatcacccagatatttcccacagttcggcctgctgacctaaccagagtcatcatgcctcttgagcaaagaagtcagcactgcaagcctgaggaaggccttcaggcccaagaagaagacctgggcctggtgggtgcacaggctctccaagctgaggagcaggaggctgccttcttctcctctactctgaatgtgggcactctagaggagttgcctgctgctgagtcaccaagtcctccccagagtcctcaggaagagtccttctctcccactgccatggatgccatctttgggagcctatctgatgagggctctggcagccaagaaaaggaggggccaagtacctcgcctgacctgatagaccctgagtccttttcccaagatatactacatgacaagataattgatttggttcatttattgctccgcaagtatcgagtcaaggggctgatcacaaaggcagaaatgctggggagtgtcatcaaaaattatgaggactactttcctgagatatttagggaagcctctgtatgcatgcaactgctctttggcattgatgtgaaggaagtggaccccactagccactcctatgtccttgtcacctccctcaacctctcttatgatggcatacagtgtaatgagcagagcatgcccaagtctggcctcctgataatagtcctgggtgtaatcttcatggaggggaactgcatccctgaagaggttatgtgggaagtcctgagcattatgggggtgtatgctggaagggagcacttcctctttggggagcccaagaggctccttacccaaaattgggtgcaggaaaagtacctggtgtaccggcaggtgcccggcactgatcctgcatgctatgagttcctgtggggtccaagggcccacgctgagaccagcaagatgaaagttcttgagtacatagccaatgccaatgggagggatcccacttcttacccatccctgtatgaagatgctttgagagaggagggagagggagtctgagcatgagatgcaaccagggccagcgggcagggaaatgggccaatgcatgcttcagggccacacccagcagtttccctgtcctgtgtgaaatcaggcccattcttccctctgtgtttgatgagagaagtcagtgttctcagtagtagaaggcacagtgaatggaagggaacacattgtatactgcctttaggtttctcttccatcgggtgacttggagatttctttttgtttccctttggtaattttcaaatattgttcctgtaataaaagttttagttagcttcaacatctaagtgtatggatgatactgaccacacatgttgttttgcttatccatttcaagtgcaagtgtttgccattttgtaaaacattttgggaaatcttccatcttgctgtgatttgcaataggtattttcttggagaatgtaagaacttaacaataaagctgaactggtgttgtgaaacagag

SEQ ID NO: 194594 - DNA, 645 bp, Homo sapiens
taggtgttctgtctgctgagaggaagatatttgctattactaattatttagtttggtgcaacaggccagaattgtcctaataatgtcagtgtttaattggtgatatgtaaaatttcttcgacagtttgtaaatcaaattagatactagaaaaaagtttaatgtgtaaaaccatttattcattttgttgaacataggaatcacttgtggaatggcttggacacattatagaattagctttttagcaaagtgattagaaggggtaaatctcctatgtctggtatttggacttctgccagtcttacctgttaggttatacttgaccctaaagaagttcctagtgggtgtgccagggaggagaaccaaaaatataatgaaattggataaattcctcaggtaaaagaaaagcagtaccagtaaagaccaaaccccactggcaccaaagcccagaaatggaatggagctaaacaatataaaggaaattagagcaaagtaggaaaaaaccttggcaatttaaaaattgtgcccaagatagagaaaagaggagagagtgtgtgtttgtatgtgtgtctgtctgtgtgtgagtaatgacagtgataaagggagagcagacaagtctttgagacctgcatagccattctcggggt

SEQ ID NO: 194595 - DNA, 311 bp, Homo sapiens
ttgagttgtttatccgctcatccgttgatagacatttagacagtttccactttttggccattatgattggttattatgaataatgctgctgtgaacattggcatgcattttaaaagcaagtgcttgtggattttggaagcccttgaataaccaaagacttttaagactaaaggaagatcaaaaaagataaaatattttaacactgattgcataaaaagtataaaaaatggtaatgcctaatatagcaagtttgtattgcttatagcagtgtaaatttataatgattttggaaggcaactgggtgtcataaa

SEQ ID NO: 194596 - DNA, 189 bp, Homo sapiens
gaatatgtttgaagaaaatgtctttataaaattctttttaaactataaacgggtgtttaaattaatgtaaaatttaggaaattgatcgaataaacatgaattggcaggaaatgaatcaacctgtgactaagggtagttgttcgcccatttctttgataaagcatgatcttggctgtattcatttgtata

SEQ ID NO: 194597 - DNA, 526 bp, Homo sapiens
ctaaaaggcccagcagtgcccagacccatctctctttgcacttgtaaagtcatggaggtcttcttcattcatcacccaggtctttaagccacctctcaactttttcaaagtatcgccttaagtcggtacctgggcctagtctcaccagcagtaacgaggactcactggcaaatattaataatatccctttcctaaaattatgtctctgtatgtccacttgatcatttctgagcctctttgaactcttccttttttgaaaactcttggggctgggcatggtggctcacgcttgtaatctcaacactttgggaggccaagccaggctgattgcctgaatccaggagttcgagaccagcctggccaacatggtagcattctgactctactaaaaacacaaaaaaattgctgggtgtggtgctgcacacttgcagtcccagctactggggaggcagaggtgggaggattgcctaagcccaaggaggtagaagctcgcgagtgtgctactcatggtacgtcagagaggttc

SEQ ID NO: 194598 - DNA, 118 bp, Homo sapiens
agagggagggagggacaggaaggaaggaaggaaaatacagacaggaagggaaaggaagggaaggaaggaaggaaatacaggaaggaaaaggaagacaggaagaaggaaaaggaagaca

SEQ ID NO: 194599 - DNA, 244 bp, Homo sapiens
gtttgaaattttgcctaggataaaacggaaaaattctacttaaggaaactatatacaaattattttgtgaggagcagtccctgttggtgtatcctaaatctgatgggtacagctttcactggtttgctatttaggcggtgagatctggatactattcttctccatttattttgcaattaaattaaatctggctttaaagacaggccagaagacaaaggaggagttcaaactatgtcagccagag

SEQ ID NO: 194600 - DNA, 142 bp, Homo sapiens
atgattcctggaaatatggggacagagattaccataatttaacatctcttttcaggaacacttatttcattttcctcatttttaaatgtgagtactttaaaacttacagaaaagtttacaagaaagtacaatactaaattta

SEQ ID NO: 194601 - DNA, 171 bp, Homo sapiens
aaggaaacattctctcaggctaacacatcatttagcatcctaaagaaaactgtagcagctgcaaaccataacgtctggatacgagactcaaggcaaaagaattccctggcttagctgagagcatttgacatcgggcctcactgttaaagccagttagagcaaacagtatgc

SEQ ID NO: 194602 - DNA, 473 bp, Homo sapiens
gaaaagcaaatcgaacaagaggggagaaaagtgggtagcttaaactgtctttatagaaactatgtaattaattgaatgcatgtgaaatctatagacatggttgtaatttaagtatagatgttaaaaataatgtaggatctcaaactttaaaactttgaattcaaataatacataagcacatagaaaagttgaaaataaaactggcttgaaaaaatcatactaagtaaaattaaaatgtgtgtttattgcatttataagaacctcagttatgaccaaatatttcagaaatagtggttagctttcttgaaagaataaaggaaaattaatttaaatgtatggggtaaatatgttggtatttattttaaattgtgctgtggcctgggcttctcaaaggaagaaaaaaacagtgaaatatgaagtcaaagtaatgaagttcaagatggtaggtttagcatatgcatttgcctattctc

SEQ ID NO: 194603 - DNA, 593 bp, Homo sapiens
gtactacagtttatttatccattcacctactgaaggacaccttggttgcttccaagtttgggcaattatgggtaaagctgccataaacatctgggtgcaggtttttgtgtagacctaagttttcaattctgttgtgtaaatactaagtggtatatatggtaaaagtatgtttagtttcgtaagaatgccaaactgccttctgaagtggctgtactattttccatttccaacagcaatgaatgaaagttcctgttcctattgctccacattctcaccagcattgggtgttgtcagtgttctggattttggccatgctaacaggtgtgtagtagtgtctcactgttataattcacatttctctgatgacttacaatgtgtaacatcttttcacatacttacaatatgccatctgtatatccttctttggtgagatgtctgttaaggtctatgccttatttttaaaaatcaggttaagctaattgttttttttcttactgttgagattcaagagttctttgtatgtcttttgcatacattttctctagtctgtggcttgttttttcattctccagacaatgtctctcacagagcag

SEQ ID NO: 194604 - DNA, 340 bp, Homo sapiens
ccagcgcgcccagcctcgagtgtttttagattcacagtagatgaccatttccatttctggttcaagtccttcattttatacattaaactaaggtgcactgactcccagtccatcgcctttttggtatctttatggaagtaaaatgtggcaagctttttttcagcctcaaagactgtctcagagtaaaagtttaagaagtactgctctaaataattttattaaatatgccttattagatgaggaaaactgaaatatttttatacaagccttttgctgtagaacaatgggacagaataaaggtagctcacaaaataagggaacatttcttgcctgttttttt

SEQ ID NO: 194605 - DNA, 452 bp, Homo sapiens
atggcatgtaatttatgccacagtaaattggtttagaaaagtcttttaatacatgaaacacctactaaaacaaatgaattaaaaaaaaaaacccccacaaaactcttggctttgaatgactgtggttctgccctttcctggttctcctcatgcctccgggatgagttgcagtctctttcatggaacgctctcttctgctaacccggtaatgagtgttgcctctcaggatccagcctttggccactgctttctaatgccagagctcctctctgcatcatttcactcatactcctgcttttcacaatgatcaagtgactgtcaggggtatgttcctatcctgacctcttctctgagcttcagactcattgattcaggtggttttgtttttgttagtgttttttttttttttccttcaggatatcattagctggtgcctgtgataatggacacca

SEQ ID NO: 194606 - DNA, 516 bp, Homo sapiens
caaatgaaaatagtgtatagcctgagcttagcaattgggcagtagacaaaggaacatagatatcacaatgtggaaagaaagataccagtgtgatgtagtgacgaaacatttgataaaactatcagttgaacttggaagataaggcaagtgtctattgaccctatagctctaaggaaagtagttggaaatacctgggatgttagtgtatcttggtccttctcacttgtagaaaggtattacaataaatagctgaagtcaagaagaaatagacaggtttacaagcagaaataaaaaggaatctggggtctgaaaggacaggaaaatcaggctgattctagatcccaaacacacacaaaaaaagactaaagatggtttcaagcaaagaagacccgttaagatttctcaggtttgcaaagtagcttagattaagggagttacttttctacctttccaccccgcctactctttcagatgccctcaaagtagcttccattaagttgaagagaggtggaaagg

SEQ ID NO: 194607 - DNA, 329 bp, Homo sapiens
ggttttacctcaaacgtttctaatccttcttcaacaaacagttgctggctttgcatttctctttcctccaaaatcaccaaggcctcgacttactgttaaagaggactctgtatattttttaatgaagagtgttgtttttacctaaatcaatctggcctggtatatgacaacataaaaaactcaaggatagagcccaaaaactcgccaaccaagcaaacaataacgttgaacccccttggacactctctgattggatgtcctggatactcccaattcttagtcctttaatacctattttcctccttcttttattcggaccttgtgtcttt

SEQ ID NO: 194608 - DNA, 637 bp, Homo sapiens
cagagaagaccaagaacatcagagtgaatgccatcattttcagttgccattgccaaacatctccacagcctccttagctctccagctgtgctcttaattctacttctctaatttctctaaaacatcccttctcaaattattcctctctgtcttaaacctcccctcttctgctgactcctttcccgtggtctatgaacatgttcaaccactccattttaatcacagtcttgtcatggaatgtccccataatttttgcccaaattgctctctctctctctctttctctttgactgtctgcctctcatatccttctctgccataattcttcttttatttctgtatgctctttttctaacttctccagtcactatgatctgacttctgatccttctccctcaaacccaaataaaatgacccttgctggggctaccagctttctcctacttttcacatccagtgaacacttttctgagtctgttacttggtatctctgtggcattgatactgttggccacttctcatcttggtcttccttccatcattctaaccaaactgttgctgtctcttcggatcttctttttctgctgatctctacatattggtattgaaatgtcctcagattttatactgacttctt

SEQ ID NO: 194609 - DNA, 291 bp, Homo sapiens
gcaaaaaggaagagctcaaaacaggaagattggttgaaaactggttaagataataggcacagttgaaggcaggaataccaaactaaaattgggtgatttcaagacaaagtgttcattctgaatattgagacttctaaactctttttcctcaccagaagactgtcactcaggtttataccttctagcagtagcttagaagagccttcctttgaagaatctcactagcccagtagaaaagactttaagtgacagacatgaaatattaccttcccctaaaatatagcccagtca

SEQ ID NO: 194610 - DNA, 319 bp, Homo sapiens
gaaactgtaatagaaaaaaattaacagcagcaaccaaaactgtaaggtagctagaagtaaatctaatgaaagatatgcaagagatttatggagatgactgtaaacataattgaaggacacagaagaagatatgactaaatggagagacatgtcatgttaatggagaggaagattcagtatcataaagataccagtttaggctgggcgtggtggctcacgcctatagtcccagcactttgggaggccaaggcaggcagatcacctgaggtcgggagtttgagaccagcctgaccaacatggaggaaccccatctctacta

SEQ ID NO: 194611 - DNA, 549 bp, Homo sapiens
tgagataatttaggtgttttcttataaatgctaatgaattactatttggctctacaggtaacaaagccaaatagtaattttagaaaccaaaaggaagatgagaaataaagggggaaaaacacttaattcagttggtcacaaatttgagtgtacatagaatcacttaggaaacttgtatacaatactgatttttcaggtcccatcccatgattctgattcattaggtctggagaagggctcaaaaaacccacattttaataagaagaacgttgaagcaactctagtgtcagaggttccctcatcaaatgctggaaaacactgaattaaagggtttaaggctgggcacagtggctcatgcctgtaatcttagcactttgctccagatgccttccctgacccctcaagcttgggctaaaaggttccctataagttctcaaagtattagacctatccctacctgatcagatggtaattttttttctgagacaaggtctcactcttatctcccaggctggaacgcagtggtgtgaggagaacgcgtcaaaatcg

SEQ ID NO: 194612 - DNA, 323 bp, Homo sapiens
taggcagatcaaagtagaaagctggtagcaaagaagaatttgttcctaagagaaactgttctaggtaaaaagaaaggaataaagaaaacaagacgtgctaaagatgttttaaaactactattaaatagccagaactattagatcaaagattcactaaatatgaagatgcaaatcctaaaaatgaaaagtgacagggagggaaatgggatgagttaggctctgcaaccacaaagaaaaaactcagtaattgttttaggtggaattatattggattcattaattttagggaacacactgtattcccatttggaaaaaatgatttg

SEQ ID NO: 194613 - DNA, 231 bp, Homo sapiens
ttgagtggaaatggaatttaataaaggatattttgtgatcagacaatccccatgagaaacagagaaccagctcagccaggaaacaaatccaaaagctccttgaagatactacctcatgaaacaccaaggagcccctctagactcagatccgggggcttgcaccacctgcatcaccgtgtggctctgaacaccaccacgaaagcccctggagctgctggatccaggacctgg

SEQ ID NO: 194614 - DNA, 279 bp, Homo sapiens
ggcaatttcatgaatgaggtcttccaagcaaatgacaccaaaattcccctggtgctcctcatcactgtgttgtctgtctgagggatggtcttattcttgaccttggctcatccacatttcaaaatgagttcccaggcagacttcagatgtggaaatacccagatcacataagtttccactatgggcagcatttttaggttctggggggtgacttttacaaagataccactaaaaattttctttaggcgaagtcttgccatggttctctgcaccagtaaa

SEQ ID NO: 194615 - DNA, 603 bp, Homo sapiens
agatctgctctcttttttatacaatggagagcctccgggagctgcatatctttgacaatgaccttaatggtatttcagaaaggattctgtctaaagccctggagcattctagctgtaaacttcgcacactcaagttgtcctatgtctcgactgcttctggttttgaagacttactcaaggctttggctcgtaatcggagcctgacatacctgagtatcaactgtacgtccatttccctaaatatgttttcacttctgcatgacatcctgcacgagcccacatgccaaataagtcatctgagcttgatgaaatgtgatttgcgagccagcgaatgcgaagaaatcgcctctctcctcatcagtggcgggagtctgagaaaactgaccttatccagcaatccgctgaggagcgacgggatgaacatactgtgtgatgccttgcttcatcccaactgcactcttatatcactggtgttagtcttctgctgtctcactgaaaattgctgcagcgcccttggaagagtgcttctgttcagcccaactctaagacaactagacctgtgtgtgaatcgcttaaaaaattacggagtgttgcatgtgacgt

SEQ ID NO: 194616 - DNA, 570 bp, Homo sapiens
cattatactgtctggattactgctgtcacctgaggacacttaagttgagtgttcagcgcatctttcaaaacaaagagccacttataaggccaactgctaggttgtcctatgtctcgactgcttctggttttgaagacttactcaaggctttggctcgtaatcggagcctgacatacctgagtatcaactgtacgtccatttccctaaatatgttttcacttctgcatgacatcctgcacgagcccacatgccaaataagtcatctgagcttgatgaaatgtgatttgcgagccagcgaatgcgaagaaatcgcctctctcctcatcagtggcgggagtctgagaaaactgaccttatccagcaatccgctgaggagcgacgggatgaacatactgtgtgatgccttgcttcatcccaactgcactcttatatcactggtgttagtcttctgctgtctcactgaaaattgctgcagcgcccttggaagagtgcttctgttcagcccaactctaagacaactagacctgtgtgtgaatcgcttaaaaaattacggagtgttgcatgtgacgt

SEQ ID NO: 194617 - DNA, 395 bp, Homo sapiens
gtaccatataaattgttagtgtagtatttttcattagtttcaagctggagtgaacaccaattatgtgatttaacagtcttgttgttttgaaaaaagaaaagcaaaaaacaatacaaaaagacatattgtaaaaaaaaaaaaaaaaaaaacccaaacaatagaactctaaaaaactaaccttgcgttgtggaattttcatatgcagattaatgatctttcatttataaaaacagactataaagtagaaaccaaatctggtaatattaattaattatttgtttaccagcactttactgaggggcatgccaatagtaattttatttttaattgggggaggagtgagagatgaaaggggtgggataggttattctgtcaaaaaagcaaacaaacaaaaa

SEQ ID NO: 194618 - DNA, 331 bp, Homo sapiens
actacgtcgcatatctctatatgaatatcaataatgttaaatttcaggacaaaggaaatggttaaaaacgtttgttcaggtaggttaaagaaagtcaacctagaactagtggatattactttatatctaaaagagataattatttcttttcaaaaaggatatgccagtgatgattatagtctttaacagcagtagcttgtgagagtattaaaatgtttcttcttttataattcattctacgttaaaaaaatgaattaaaatgtatgcaaagtgtactttttcaagtcagtgaagaatatgcgacagtagcagcagtttacattagctttat

SEQ ID NO: 194619 - DNA, 127 bp, Homo sapiens
gctggaatccaaaaggaagatgcaaaaatgagatggctgtattagcttataacattctgaattattttcttttttaggttgccatattttttgtcttttccattttaaaatctagactccccaaagg

SEQ ID NO: 194620 - DNA, 258 bp, Homo sapiens
ccagaatacagaaaaactggtgtcacaggtctatagatgtctcttctattacttcatcacttgtggctgccatgtgatattagaacagtaccacccaggttttcagaatcctggtccgatgactttacatcattctgaggccgtcactgactacatctattcatcattctgaggccgtcactgactacatctattcagcaatgtagggtcttctctcctctctgaagccctcccaccccctatttgctcctacatctc

SEQ ID NO: 194621 - DNA, 620 bp, Homo sapiens
acggattgatcatattccagaagggcagtgtgatacagggcaagtgtactgaccatggcagtagccctgggttctggcctacctctgcctctgtcttggttgtgtggtcgatgggttgaactgagtggcttcaaactcttatctgcctccaacattctgtaatcctgtgatttcacaggatgtgtgatagggagaaacatcaactcctacaagggcagcagtgtgaagtcatgagaaaagcaatgtgaagacctgggatgttgtcacagctctatcataaaccagctgatggccttttgtgtagtcacttaaactttctgggtcctacttggcgtcagctatggaaatgtgattggacttccctgatggactctaaggaaagtttcttggattccttctttccctcccttctttcctccttccctttactttcttctttcctttcctttatttccttccttttctttcttgagacagggtcttgctctgttacccaagtggaatgcagtggtgcaatcatggctcccggcagccttgaactcccaggctcaagccatcctcccacctcagccttccaagtaactggtactaactacaggcacaaactaccaagcctgact

SEQ ID NO: 194622 - DNA, 412 bp, Homo sapiens
gttgtttctgggttttcccttaaagaatgagacccctgggggggtctggaattccacatttaagactcagactagaatgcttaggtgatatcttcataacttattgagttacttgcagatgttcattctattcattctaaaataatttcctcttatctactccatctagttacaattcagtctcttccttccattcatttatcttcaaaatgtagaccaggaatcgtcctctgcttccatgtcttcccattaacttcttctgtcctttgtgaatacacctcttctcttaatctcaactgtcttctgttaggtgatcctcaaatttacatgtgcagatctcaactctattctgagtgccgattcacatttctttacatttcttaaacatgtccacctgatgacctcctgatac

SEQ ID NO: 194623 - DNA, 395 bp, Homo sapiens
tgttgggaggtaatgtagcctagtggttaatatcagaagcactggagtctgtttcctcatccataaaatactatctacccccactgggctgttgtgaagcttaaatgaaatgttttagaagtatgcagtgctggcctggcacaggccagttaatggaggccagcaataaacacgacttttacccctggatcacaatcaacatagcaagcatcttcacagaatccttagatatttagaaaggcaggcgtcacaaacttttttttttgtttcaaaatgtccttctcagaaacaccactgtttgctgggttaggaggtaagttctcccacccctaatctaccagccccactcaccaagtgttgctggatctcttccctcactaacaccaccctctggg

SEQ ID NO: 194624 - DNA, 329 bp, Homo sapiens
tgcccccatcagcgccacccagaatgtagcctggcagctgcccacccagggagagagatggggtgaggtcaacagatggcgatgagagagaccctgatgcccacatctgtgcttctgggatgaggaggatgctgatgagggctgcgggctggcttagggactcagtcttgccctggaatccccatgcttctgcatctgtggaccctgctgaccctgaggtgggagaacaattgagtcgaggagatcctgttctcccaaccagacctttgtccctcctttccccgtgtctctttgggctttcctgggccccacctcatgctggtgcccat

SEQ ID NO: 194625 - DNA, 606 bp, Homo sapiens
gtggagacagagtcttgctctgtcacccaggctggagtgcagtggcacaatcctggttcactgcaacctctgccttccaggttcaaacaattctcctgcctcagcctcttgagtagctgggattacaggtacccgccagcacacccagctaatttttgtatttttagtggagatggggtttcaccatgttcaccaggctggtctcaaactcttgacccaggtgattcacccgtcttggcctcccaaagtgctgtgattacaagtgtgagccaccgcacctggcctctagttatactcttctttatattttaaaatgtaaaagttaaattattattgactgtagtcaccctgttgtgctaccaaatattaggtcttattatttctactttttgtactcattatttcaaatatttttaatttttattcatttttattatttccccttttgtatggtgctgataacatctcattctaaaagttgtgggctataactgaaacttcaaccctaagaaatacaaatgctacctttatatttttacttttaaaattatttgagatagattcttacagtctttaaaagaaaataaattctgaaatgctgcggac

SEQ ID NO: 194626 - DNA, 590 bp, Homo sapiens
accatcctctgactctcgaagcagagccctcaggcctccccatgcctccagacttccacagtctatgctgcccacacacttctgtgtctcctcatcgcccttccccctgccgcacggccctgaatattggaactgacactaacatcttagtctggtgttctcacatgtgacctcactggaccctcacaaccaccctgggaggtggcaaggttccaaactaaatccatctccatcactaacaatggagacaccgaggctcagagaagtggaataactggctaaggtcacacagctactgagctgcagaaccaaaattcgaacccacgactacctgccctgaagcccatgctctgaacactcagctccacgatgtcacaaacagccacggccagcctggcatggggacgaccttcacctccccaaatccaaacacgcgtactccaaggaagcttcctcacaagagcctcttctgagtcattcttcagagcatttttctgctcagcttaacttccttcagtctaggatatgacagtatctccctgcagctcaaagcctgctactaccctttgctctgagctccgtccggaaga

SEQ ID NO: 194627 - DNA, 290 bp, Homo sapiens
tcctgtttctaccaccaattagctgtgtgaccttaaccaaattatttatcctccattttcacttattttctcatctgtaaaacgagatagtaaacatatctacctcacctcacaatattgttgtgaggattaagtgagttgttatatgtaaagcacttaggatggtttctgaaatattgtgagggcttagagtttacaattataaactgctgaaaatatgaagagagatagaaatagaagtgtttctaccaataaatttcagtctatgagagagaagtagagaataagaa

SEQ ID NO: 194628 - DNA, 342 bp, Homo sapiens
agaagttgttgcttacttatatatgcaataaatatgatatatgggaagtgtaactccttggctgggtaatttaggtaaattcacttgtttctctgaatatctcttttcctcatctttaaaaagaagaacattaggctacatgacttcaagctcctttttaattttgataatacttgttttagtagagttcttcagagaaacagaatcaacaagatgtatatgtgtatatatgtgtatggagagagggggtatttttaaaactggatcacacgactgtggagatgcaagtctaaaatctgcagggtgggccagtaggctggagacccagagacgtactcagtc

SEQ ID NO: 194629 - DNA, 386 bp, Homo sapiens
tttctttcctcgggcaaagttttccccaagtttctaactatccaaatgaagccaagtagatttcaaaaaccactgtagagagccctacttggggattagagttaaatatagaattcataattcatccaataaattaaactgagcacctattgtgtaacaggctctgtgctggaaattaggtatacattatagtattagttcctactgctgctataataaattaccacaaatttagtaattcaaagcaacacagtttattatcctacagttctagaggtcagaagtccaaaatgggtcttggagggctaaaatcaaggtgtcagcagggcttacttccttctggaagccctagggcagaagccatttccttgccttttccagctctc

SEQ ID NO: 194630 - DNA, 439 bp, Homo sapiens
ctcgtagttactccgctgtccctccgcctcctccccagccccaaatcctgggcacaagctcttctgactggccgggcccagcccccctcatgcccagagaggcagcctcaacccttctccctaaaccgaagctccatccctctcgcgttcttgccttaacccgtgccccaggaccttcctttgcttcccacgcgcctaaattcccctcgcgcccggtgatctgctcgtcagatttcgcatttctagaaagggaccgagcgtctgcagagtgtatattggctagatagttcccaaggctgtttttagagactccagggttttgcctatgggtaaactggcgagtcattgaattggaaactagatcccctcttggaaagatgttgcagatcctcttattttgcaggttaaggggccgtgcgtgtgtgggcttgcctgtgtg

SEQ ID NO: 194631 - DNA, 294 bp, Homo sapiens
gtattcctcagtaataaccagaagggaaatctgcacctttctacaaatattattgtatctgatttttacatgctttgacctagttctcttgaaaaatatatttgaacatgaaatatttaaatgaagcaacttttatttatggaaatacaaaccactttccttagggcatattatataaactttaataaatacatcataagaggaaaaatggaagtatttgtgagaatctagtatttcaattttctttcctctggaatcagtttctctcatatgtaacaggtacctttacatcac

SEQ ID NO: 194632 - DNA, 285 bp, Homo sapiens
aataacaaaaccaaacccacaccgaaaagaaatcacttttagaatgatttggaatgtacattgatttctggcattctcagaaacaagctcaccaactccttggaaaacgggtgccatggagtcagtgcccaccgaagaaaatgtctttaaataagttagttacttggacaagattattcactccttagaaaatacatcaatgtaacaagtcccagcaggcagggtatgcagtacagcaccaatttcccagagggcttagtggatcttgggatgggtagtcacaga

SEQ ID NO: 194633 - DNA, 454 bp, Homo sapiens
actattttccctgcttaaatcctggctcctggcccggcattctgtgaatctctccgtgaaagcaccttgtcagccttcacagtcagccctgattttcaggccagcttcccctccagggagtggctctcaaaggctttcttcgtccgcggccggatgctagcaccgaggcacacagtaggtgtgcagtaaatgttgttggaaggaaggaagtgggtttccgtttgggaaaggaaactgggaggtaaaaagctaggagctgctccctccatctaaatgacttctttttttttcacctcattactaacatttttctccgaagtagaagtctgcccagaagacatgctcagactctaggacctaactagtctcttctggaaatccaagtccagctcttttcctcattatcccgggaaattctgcagacagagtgtggtcaccagaggcagaggggttc

SEQ ID NO: 194634 - DNA, 455 bp, Homo sapiens
ctacctgacaactctttccaaattcttcactgaataacctgggctgtagccagcaggccaaaagacagagtagaagaggataaagagagcttccttgaggcacttagagcccattgtaggctgagaacaggtcaggatatttgagaggaaccaaactgaggcattctgtgccttcagtaagctgtggtttcagaacactgaagagagagcagaactcatgcgaggtaaacttcctgatccctaggaaacaggaggcctgactgctacaggctgtgccacagcagatgaactgggaaagatgcctggaggcacctggtactttccagagtatgaagcactgcagcgccaaggatatgggcggatgggaaggtcgagaggaattttcctaagtctttttaaggtttcattgaatcttgaactgcagtccttcaaaggcataattgctcaggacagca

SEQ ID NO: 194635 - DNA, 250 bp, Homo sapiens
gtcaaagaatattatatacacatgttatggcaagaagcttttacaaattttaaataccttaaaaagcacatgcattttcactgggaagttttaagaatacattctaaatattcaggagtccattaagtggcagaatattttacatctgccccgttcctaaacagtaaaatgaaaatttcattgttctgctttagaaattaaatttgaccactttgaaattaaaggtgcaatattaaccatgtaactgtta

SEQ ID NO: 194636 - DNA, 828 bp, Homo sapiens
cctttggaaaagaatgttttccttattttgtctgttctgtattacatacccatataacagttttatagtatgcataagataaaatgctatatgaacagttaactacagtagtctgcaagtacattttcttattctggttaatggaaacttcataatcagtctgcagggtcataagaggttgaaagagaaggaactcagaaaaaacatgttaaatcttcaaaatgaacaatgagacaccaaccaaaagaatatctgtcacactactggaatgccgacattgctaactcaagtccctagtgcatgcccacgttgctcactcaagtcacaactggaatgcccacgttgttcactcgagtccctattggaatggccacgttgctcactcaagtccctattggaatgcccacgttgctcactcgagtccctattggaatggccacgttgctcactcaagtccctactggaatgcccacgttgctcactcaagtcacaattggaatgcccacgttgctcactaaagtccctattggaatgcccacgttgctcactcaagtccctattggaatgcccacatggctcactcaagtccctattgcaatgcccatgttgctcgctcaagtccctactgcaatgcccacattgctcactcaagtcacaactggaatgcccacactgctcactcaagtccctattgcaatgcccacattgctcactcaagtaacaactggaatgcccacgatgctcactgaagtctctctattggaatgcccacattgttcactcaagtccctattggaatgcccacattgctcaatcaagtccataatg

SEQ ID NO: 194637 - DNA, 536 bp, Homo sapiens
ataatatatttatgataggaggggtatattcttgggtatacagtaaaaagaaagggaagctgttcccaacatcactgagagactgagagaaaggaccatatggccaggtaatcaaccatttgtataacttaatttccttgtttggaaagtgagacaacagtatctgttctatccaattcaaagaaatggtcatgagtgtcaaattatgataacttacatgaacaaaaccctggaaatgcataagatgctttggcatattagacactgttcctcttatgatttcccatatcagactgaatgtttcctgcctgtaagctgagataactgctctctggggcccagcatcaccttgtagagtctggggaaaggtcaataaaaatcctctggagaatacagttgcagacaaagtatagttcaagcagcacagctgggcattcttcaacaccactgttctcagtagctctaagacctccttatcatgacttacttccttgtattttcctgactctccaacttatttataaacggaaaagagc

SEQ ID NO: 194638 - DNA, 905 bp, Homo sapiens
aagtgcttaattaaggggaggatgccagtgttgctgaagctgaatttgcaagagtcaaattggcagatgaggttggagaggaaatgggggttgagggagcaccagatcctatagagcctttagaccatcgtagagactttgctgttctctgagtgctttggtagggatttgaggaaaggagtgacatcgtatgaatgactttattatgtgcccacgtggaggtgtcaaataggcagctattgtgttgcaggtccccaggttcattgattcactaagaggactcaaaagactcagcacgtagtcatactcacagctgtgatttattatagcaaaaggatacaaagcaaaataagcaaagggaaaagatgcatgggacacagtctggaggaaacccggtgcagtcttctaagagtcctctcctagtggagtcacatggggtatgcttaattcttgcagcatcaaattatgacaagacgtgagagatctatcaggaaagcttgtagagctcatttttccaataaaaagtcacataggcactgtctgcctagaatgtgccaaaatttccgccgcccagaaaaaaagcaggtgtttagaatcacattgtacagtttccagcacagtgagccactcttatccaggtgggaattgtgggaaccctcgtgaagttcaagttctgagacactagccaagggccaactttgcaagcaggcattctaaggatagcagtctcaggcctgttatgttaactcgtttctgcacagatgtacgagtctggaatttgggagaaagttctggaatggggatatagattagggtgtggttggcatataggtggtatttaaagccacagaaatgattgatgtcttgataatgcatttgtaagaactaattgggtacatttaaga

SEQ ID NO: 194639 - DNA, 161 bp, Homo sapiens
gtcaggatacttgtcacctggtatggcctgggcactgaaatcagaacagacattgggcatcaacagttgaattggtgacacttaaatgtcaggcctgctcaggatcctctgaccgacctgcatcccttttctctcaggctctctggcagagacttctctct

SEQ ID NO: 194640 - DNA, 641 bp, Homo sapiens
caaatggtcagcagtaggattcactatcattgccgtcaccaactaggaataacttatttgctgtgtgcacaccagaagaagaaccaaacaagtaggctaggaaccagaaaatagtacacaaacatagagttgggataagaaagagaaatagagaactcttacagaaggtaaagttctaatattgataacttctattgtttgaaattgactcctgggaccaaaaaaaagtgtgcctttgcttaaatatttctagtaggtaaatcacctctgggaggcataagcgtggaacctccaaaactgtcgaagaatagttatgaaaaggtttgaaacatcacacctgtacaaatatagagtaaacatatgttaaaaatttaactcattaataaggaaaatagtgagatggaaaaactgctttaaaggaaaatcagaggaacgtgaccttctgaagctaatactgtccaataaggtaatggcacattaacctttgaggttatcatttcttttggggagaaaattaacatgtcacttcacagaagtctaagaactttaattaatagtaaatagcaaagtcaaacacaaatacattcccttaggtaattaaataatccttttgtgagcctgtcaaacagtccctagtgtat

SEQ ID NO: 194641 - DNA, 292 bp, Homo sapiens
atcgagctcggccccccttaccgatggcccatgaagcgatggcaaggttggagccctggctgcctgccgaagccctgcgcgcctcaggaaacttagaatcatggcggagggaaagcaggcagtctgcaggtgtctggagaaggaggaagagagcgaaggggaggtgctgtgcacttttaaatgaccagatcttaggagaactcactatcaccaaaacagcaagggggatatccgctcccatgatccaatcatctcccaccaggctcctccaacactggggattataattcga

SEQ ID NO: 194642 - DNA, 624 bp, Homo sapiens
attctaggattttctcctctctattctgcaaaaaggacagtcccttaaaatataacattctcagaaagactatgtccagtcgtcttggagccatcaagaaactgactaagtggaagtcagagacagctccaccagaataagaggcagaaactgagtcttagtgggtagagtgtgaaaagtccctgttccctttcccccatcctccctcgagctgcagacttaggccttctcctgacacatactgattgtaagcctctttcctcagctcaaggctcaggctcagctctccagcccttctctaccctcctctcggggatgagacagacatgagctttctctttaacacagtctgactggaataaaaggacccaaaagattacttgacaacgtgtgccaaggctgacatctttatgaaagccctttgccattcaggggatgctttgctgagagccagccaaacccacctgctagtccctgttcaacagacagctaagaaacacacagaggtttattcttattattcatattgttaattataaacctcagcagtatcagtttgccactagttgtgcaccccctgactaggaccagagatttcaggtacaaggagtgtttaaaggatct

SEQ ID NO: 194643 - DNA, 495 bp, Homo sapiens
actgctttagggagttaaatatccagcatatttgctttcttgttaatgaatatcctaagtgtgtatcctgactaattgttagtttcttctcaaatgaaaccctttctgtgtcttggctgtctgccttaacgctgtaggaggcagcttcttgcttgggacaaaggcattggtgatgtgttccatgttgaatctgccttcagtgcctgggctggcttgctatggaaatgtgcttagcattgattagggggtagagagctgtttctaaatcctgcttttctactttttatttcactcatttgccagaattgttcttggcaccagcagctccttaacatatagttgttgaatgactgaaagaaagcaactaatgttttaactccttgctaagtctgagattgggaggcagtcccctagagtggatagaaagaatggtggagcctcatcccaaagctgctctgatgaaactgctagaaagcagattgtagttctttgttt

SEQ ID NO: 194644 - DNA, 357 bp, Homo sapiens
gcacctccttctatataaggatctgttgccaaattcagtacttctgtgcaacttcatggtaattaaagtgacagaacagtttcactgtaatttcaaaagagttttccagagaagttgctccgatttttaaactccactttaagtccccagatgaaatgtaaccgtttaaggggaaccaagtagaaatatataaacacagaacaacttagcctggtcaaaattaaaataaaaataggtatagaaaagtaaattaagaaagaaagcaggctgtgtgtctccaaatccagggtttcaaaaatgtcacctctccaaacaccataagcagacttaaatgactaaatttagtatcttactctt

SEQ ID NO: 194645 - DNA, 468 bp, Homo sapiens
atgatgtaacagcggagcaaatgggacaaaaaaggcggaagtttggggaacatggttttacattattaaaatgtgaaaaccgtaaaagcaaagaggggtaaaggaatgggtcctgacaaagactagaaaagaaaagacgagaaggaaataaagagccatccactcgagctcagtaatgctgtgacaacagaataaatgccacttctttactcttgcgaaacacagcgcttattctcaagaaagaaagaagtcaaacctaagggagataattcctaagccctgcctaagagttacagaaataattacttctacctgccagagattccaaaaccataagaaaacagtccagataggagtatgcaatttccccttatttacttttattttatttaaattaaccaagggagttgagtcaaatttcggtgaattcatatatgcctgcacctatctaggtggttagttaagtat

SEQ ID NO: 194646 - DNA, 389 bp, Homo sapiens
atgatgtaacagcggagcaaatgggacaaaaaaggcggaagtttggggaacatggttttacattattaaaatgtgaaaaccgtaaaagcaaagaggggtaaaggaatgggtcctgacaaagactagaaaagaaaagacgagaaggaaataaagagccatccactcgagctcagtaatgctgtgacaacagaataaatgccacttctttactcttgcgaaacacagcgcttattctcaagaaagaaagaagtcaaacctaagggagataattcctaagccctgcctaagagttacagaaataattacttctacctgccagagattccaaaaccataagaaaacagtccagataggagtcgcggtgtattccggagatcctctaggtcacc

SEQ ID NO: 194647 - DNA, 270 bp, Homo sapiens
aggattatgctcatttcagttctgggctcggcacacagaaccactttttcctcctgggattccaggcttgcaatgggaggaacttccacaaaagtctctgacatgccctggagacattttcttcattgtcttggtgattaacatttggctccttgttacttatggaaatttctgcagtgggcttgaatttctcctcagaaaatgggattttcttttctattgcattgtcaggctgcaaattttccaaacttttttgctgttttccttttg

SEQ ID NO: 194648 - DNA, 451 bp, Homo sapiens
ctgtctggaatgttatcaaaccaggactgcacaggcactgcattctctgtgtggaagatgtaagaagcaggcgagttgtccaggatgagttttcctcaggtccctccccagatggctgacgtccttgacatagcagccctggtgaaacaaacatgactcatgggacaggcagccccagaccatcccatacccgtccagctcacccgtcacaggatctgcctacttgttcaggctgggaagaagagagcaatgacgaaaacacatttaaacatttcctccattcatgtcaggaactcatccatataaggcctcatgagcacatggatctggtgcatggtcccctcaagctctacaggcactaggcagtcagcattgctgattggcttaaaggagctatgcacaagggtttcatccaggtcagtgaccatacagatccttccttgatttttct

SEQ ID NO: 194649 - DNA, 271 bp, Homo sapiens
tcaagtttcttgttttctcagccacaggcgcccacctcagggcctttgccttggctgttctgcttttccagaatattcttgcctggctcttcacatgatgcttccttctcattttatcctcggagaggccgccgggacccccaaccacagtgtccacttcagtccctcggtggcctcatgagggtgttttctcgtgtgaatgagggttttatgttgttaatgtggtgggtgagtgagccccattgtgttgcggtgcgctgatctgaccagg

SEQ ID NO: 194650 - DNA, 527 bp, Homo sapiens
ccaggctggtctcgaactcctggatgcaagtgatcctcctgccttggcctcccaaagtgctgagccaccatgctcggctgaagattattttctcttgagcagtattctgttctttcattcaagggttcatttatgtcctgttctgagggtagcattttattctgcaagatacaacgaaagtatcagatcactttctcccttgaagccttattggtgatataaaacaaatatgtaaaacgttttagaatcagaagatcatatgattaaatactcgtgagagttcagaccatcagtattataggatttaagaataaggagagattagtgattaccaaccattggtaggcagcttctttaacaaatcgctgcctgaagtggactctgaaggatgagtgtagtttaggttctacagagtggaaggtacaagggagggtgacagagccagtatagtcctggtggaagatagaacaaagtgccaacaaagcaggaataaggatacagtactttgggaaggggaaaaaaatcag

SEQ ID NO: 194651 - DNA, 222 bp, Homo sapiens
agaagagggtaaaattgtttgctataaacccttacgctgagcttttgtaaacaaaggactcccaatgagaacctgcttgccgctccccagtgatcatcaggataggtttctaaactaattctgccaatttaacaaagcaatgccaagtattaactttggaaaactgttctttagaaaataggaagtcaaattttaaagttactattctcaaatgccagtagg

SEQ ID NO: 194652 - DNA, 538 bp, Homo sapiens
tccgaggagtctctgtttctggggacttaatttgggctccacgataatgatggaaaggagacagtgcaggcgcagcatgcaggatgttcaccagcagcgtccttatcacacttgatcctcacaaaaaggccacgttcttgcatggttgttgccaccgtgctctaaagataaggaagccatggctatgggaggccaggcagctcctcccgcagctggaccacctggaaggctacctcacctccatgcctgcaccttctgggctgtgaaacaggatcctaaaagggctatctttgggccttccaagcaaaacacacatcagggcacctcattaagtagcaagtgtgcaaggcattatatgaattacaaagttctctgcaaactcaagagactcatagctgctctggctttgcagctgttttagagatagggaaaaccacatgaggaaacaaaggtggaaggagaagcctgtgaggcaagggaaggagggggcgggaggaacttcccaccagcacaccggctgtccactctgccccgggtt

SEQ ID NO: 194653 - DNA, 661 bp, Homo sapiens
gcaaaattacacgccacatcttttgaagataacttttagcaggcaaaagaaaaaaagagaagatacttttaaaataaactttttaatgaatattgtaagacatttttttaccctgcttaataaatacatctggatgaaaatctcaactttatgatggcaagatatggactaaatatttaacttaagtaatagggtaattgataaagtaatagatatattttctccaactttcttccttatctttctaaacaaagggtagtggctaatcaatgtattgtactctcaaaagtccttaggccaacgagttggtttttttttcttttgagacagggtctcactctgtcgcccaggctggtgtgtagcggtgtgatcatggctaactgcagcctttacttcctgggctctgatcttctcacttcagcctcctgagtagctgggactacaggcatccatcactatgcccagctaatttttaaatttttggtagagatggggtcttcctatgttgcccaggctggtcttgaactcctgggctcaagttatcctactgcctccacctcccaaagtgctgcaattataggagtgagctaccatgctcagccccaacaatatcttcagtccaaatttctcataaagtgtcattaaagctgtggcctatgat

SEQ ID NO: 194654 - DNA, 3496 bp, Homo sapiens
tgtagcagcttcttctccgaaccaaccctttgccttcggacttctccggggccagcagccgcccgaccaggggcccggggccacgggctcagccgacgaccatgggctccgtgtccaaccagcagtttgcaggtggctgcgccaaggcggcagaagaggcgcccgaggaggcgccggaggacgcggcccgggcggcggacgagcctcagctgctgcacggtgcgggcatctgtaagtggttcaacgtgcgcatggggttcggcttcctgtccatgaccgcccgcgccggggtcgcgctcgaccccccagtggatgtctttgtgcaccagagtaagctgcacatggaagggttccggagcttgaaggagggtgaggcagtggagttcacctttaagaagtcagccaagggtctggaatccatccgtgtcaccggacctggtggagtattctgtattgggagtgagaggcggccaaaaggaaagagcatgcagaagcgcagatcaaaaggagacaggtgctacaactgtggaggtctagatcatcatgccaaggaatgcaagctgccaccccagcccaagaagtgccacttctgccagagcatcagccatatggtagcctcatgtccgctgaaggcccagcagggccctagtgcacagggaaagccaacctactttcgagaggaagaagaagaaatccacagccctaccctgctcccggaggcacagaattgagccacaatgggtgggggctattcttttgctatcaggaagtttcgaggagcaggcagagtggagaaagtgggaatagggtgcattggggctagttggcactgccatgtatctcaggcttgggttcacaccatcaccctttcttccctctaggtggggggaaagggtgagtcaaaggaactccaaccatgctctgtccaaatgcaagtgagggttctgggggcaaccaggaggggggaatcaccctacaacctgcatactttgagtctccatccccagaatttccagcttttgaaagtggcctggatagggaagttgttttccttttaaagaaggatatataataattcccatgccagagtgaaatgattaagtataagaccagattcatggagccaagccactacattctgtggaaggagatctctcaggagtaagcattgtttttttttcacatcttgtatcctcatacccacttttgggatagggtgctggcagctgtcccaagcaatgggtaatgatgatggcaaaaagggtgtttgggggaacagctgcagacctgctgctctatgctcacccccgccccattctgggccaatgtgattttatttatttgctcccttggatactgcaccttgggtcccactttctccaggatgccaactgcactagctgtgtgcgaatgacgtatcttgtgcattttaactttttttccttaatataaatattctggttttgtatttttgtatattttaatctaaggccctcatttcctgcactgtgttctcaggtacatgagcaatctcagggatagccagcagcagctccaggtctgcgcagcaggaattactttttgttgtttttgccaccgtggagagcaactatttggagtgcacagcctattgaactacctcatttttgccaataagagctggcttttctgccatagtgtcctcttgaaaccccctctgccttgaaaatgttttatgggagactaggttttaactgggtggccccatgacttgattgccttctactggaagattgggaattagtctaaacaggaaatggtggtacacagaggctaggagaggctgggcccggtgaaaaggccagagagcaagccaagattaggtgagggttgtctaatcctatggcacaggacgtgctttacatctccagatctgttcttcaccagattaggttaggcctaccatgtgccacagggtgtgtgtgtgtttgtaaaactagagttgctaaggataagtttaaagaccaatacccctgtacttaatcctgtgctgtcgagggatggatatatgaagtaaggtgagatccttaacctttcaaaattttcgggttccagggagacacacaagcgagggttttgtggtgcctggagcctgtgtcctgccctgctacagtagtgattaatagtgtcatggtagctaaaggagaaaaagggggtttcgtttacacgctgtgagatcaccgcaaacctaccttactgtgttgaaacgggacaaatgcaatagaacgcattgggtggtgtgtgtctgatcctgggttcttgtctcccctaaatgctgccccccaagttactgtatttgtctgggctttgtaggacttcactacgttgattgctaggtggcctagtttgtgtaaatataatgtattggtctttctccgtgttctttgggggttttgtttacaaacttctttttgtattgagagaaaaatagccaaagcatctttgacagaaggttctgcaccaggcaaaaagatctgaaacattagtttggggggccctcttcttaaagtggggatcttgaaccatcctttcttttgtattccccttcccctattacctattagaccagatcttctgtcctaaaaacttgtcttctaccctgccctcttttctgttcacccccaaaagaaaacttacacacccacacacatacacatttcatgcttggagtgtctccacaactcttaaatgatgtatgcaaaaatactgaagctaggaaaaccctccatcccttgttcccaacctcctaagtcaagaccattaccatttctttctttctttttttttttttttttaaagtggagtctcgctgtgtcacccaggcagaggttgcagtgagctgagatcgcaccactgcactccagcctggttacagagcaagactctgtctcaaacaaaacaaaacaaaacaaaaacacactactgtattttggatggatcaaacctccttaattttaatttctaatcctaaagtaaagagatgcaattgggggccttccatgtagaaagtggggtcaggaggccaagaaagggaatatgaatgtatatccaagtcactcaggaacttttatgcaggtgctagaaactttatgtcaaagtggccacaagattgtttaataggagacgaacgaatgtaactccatgtttactgctaaaaaccaaagctttgtgtaaaatcttgaatttatggggcgggagggtaggaaagcctgtacctgtctgtttttttcctgatccttttccctcattcctgaactgcaggagactgagcccctttgggctttggtgaccccatcactggggtgtgtttatttgatggttgattttgctgtactgggtacttcctttcccattttctaatcattttttaacacaagctgactcttcccttcccttctcctttccctgggaaaatacaatgaataaataaagacttattggtacgcaaactgtcatc

SEQ ID NO: 194655 - DNA, 780 bp, Homo sapiens
ggtcacgagttcaaaactatcctggccaacacagtgaaaccccgtctctactaaaatacaaaaaaattagccgggtgtggtggtgcatgcctttagtcctagctattcaggaggctgaggcaggggaatcgcttggacccgagaggcagaggttgcagtgagctgagatcgcaccactgcactccagcctggttacagagcaagactctgtctcaaacaaaacaaaacaaaacaaaaacacactactgtattttggatggatcaaacctccttaattttaatttctaatcctaaagtaaagagatgcaattgggggccttccatgtagaaagtggggtcaggaggccaagaaagggaatatgaatgtatatccaagtcactcaggaacttttatgcaggtgctagaaactttatgtcaaagtggccacaagattgtttaataggagacgaacgaatgtaactccatgtttactgctaaaaaccaaagctttgtgtaaaatcttgaatttatggggcgggagggtaggaaagcctgtacctgtctgtttttttcctgatccttttccctcattcctgaactgcaggagactgagcccctttgggctttggtgaccccatcactggggtgtgtttatttgatggttgattttgctgtactgggtacttcctttcccattttctaatcattttttaacacaagctgactcttcccttcccttctcctttccctgggaaaatacaatgaataaataaagacttattggtacgcaaactgtcatc

SEQ ID NO: 194656 - DNA, 3116 bp, Homo sapiens
  misc_feature (1)..(1): n is a, c, g, or t
ntagggctaggtacgaggctgggtgttggtctggaatccatccgtgtcaccggacctggtggagtattctgtattgggagtgagaggcggccaaaaggaaagagcatgcagaagcgcagatcaaaaggagacaggtgctacaactgtggaggtctagatcatcatgccaaggaatgcaagctgccaccccagcccaagaagtgccacttctgccagagcatcagccatatggtagcctcatgtccgctgaaggcccagcagggccctagtgcacagggaaagccaacctactttcgagaggaagaagaagaaatccacagccctaccctgctcccggaggcacagaattgagccacaatgggtgggggctattcttttgctatcaggaagtttcgaggagcaggcagagtggagaaagtgggaatagggtgcattggggctagttggcactgccatgtatctcaggcttgggttcacaccatcaccctttcttccctctaggtggggggaaagggtgagtcaaaggaactccaaccatgctctgtccaaatgcaagtgagggttctgggggcaaccaggaggggggaatcaccctacaacctgcatactttgagtctccatccccagaatttccagcttttgaaagtggcctggatagggaagttgttttccttttaaagaaggatatataataattcccatgccagagtgaaatgattaagtataagaccagattcatggagccaagccactacattctgtggaaggagatctctcaggagtaagcattgtttttttttcacatcttgtatcctcatacccacttttgggatagggtgctggcagctgtcccaagcaatgggtaatgatgatggcaaaaagggtgtttgggggaacagctgcagacctgctgctctatgctcacccccgccccattctgggccaatgtgattttatttatttgctcccttggatactgcaccttgggtcccactttctccaggatgccaactgcactagctgtgtgcgaatgacgtatcttgtgcattttaactttttttccttaatataaatattctggttttgtatttttgtatattttaatctaaggccctcatttcctgcactgtgttctcaggtacatgagcaatctcagggatagccagcagcagctccaggtctgcgcagcaggaattactttttgttgtttttgccaccgtggagagcaactatttggagtgcacagcctattgaactacctcatttttgccaataagagctggcttttctgccatagtgtcctcttgaaaccccctctgccttgaaaatgttttatgggagactaggttttaactgggtggccccatgacttgattgccttctactggaagattgggaattagtctaaacaggaaatggtggtacacagaggctaggagaggctgggcccggtgaaaaggccagagagcaagccaagattaggtgagggttgtctaatcctatggcacaggacgtgctttacatctccagatctgttcttcaccagattaggttaggcctaccatgtgccacagggtgtgtgtgtgtttgtaaaactagagttgctaaggataagtttaaagaccaatacccctgtacttaatcctgtgctgtcgagggatggatatatgaagtaaggtgagatccttaacctttcaaaattttcgggttccagggagacacacaagcgagggttttgtggtgcctggagcctgtgtcctgccctgctacagtagtgattaatagtgtcatggtagctaaaggagaaaaagggggtttcgtttacacgctgtgagatcaccgcaaacctaccttactgtgttgaaacgggacaaatgcaatagaacgcattgggtggtgtgtgtctgatcctgggttcttgtctcccctaaatgctgccccccaagttactgtatttgtctgggctttgtaggacttcactacgttgattgctaggtggcctagtttgtgtaaatataatgtattggtctttctccgtgttctttgggggttttgtttacaaacttctttttgtattgagagaaaaatagccaaagcatctttgacagaaggttctgcaccaggcaaaaagatctgaaacattagtttggggggccctcttcttaaagtggggatcttgaaccatcctttcttttgtattccccttcccctattacctattagaccagatcttctgtcctaaaaacttgtcttctaccctgccctcttttctgttcacccccaaaagaaaacttacacacccacacacatacacatttcatgcttggagtgtctccacaactcttaaatgatgtatgcaaaaatactgaagctaggaaaaccctccatcccttgttcccaacctcctaagtcaagaccattaccatttctttctttctttttttttttttttttaaagtggagtctcgctgtgtcacccaggcagaggttgcagtgagctgagatcgcaccactgcactccagcctggttacagagcaagactctgtctcaaacaaaacaaaacaaaacaaaaacacactactgtattttggatggatcaaacctccttaattttaatttctaatcctaaagtaaagagatgcaattgggggccttccatgtagaaagtggggtcaggaggccaagaaagggaatatgaatgtatatccaagtcactcaggaacttttatgcaggtgctagaaactttatgtcaaagtggccacaagattgtttaataggagacgaacgaatgtaactccatgtttactgctaaaaaccaaagctttgtgtaaaatcttgaatttatggggcgggagggtaggaaagcctgtacctgtctgtttttttcctgatccttttccctcattcctgaactgcaggagactgagcccctttgggctttggtgaccccatcactggggtgtgtttatttgatggttgattttgctgtactgggtacttcctttcccattttctaatcattttttaacacaagctgactcttcccttcccttctcctttccctgggaaaatacaatgaataaataaagacttattggtacgcaaactgtcatc

SEQ ID NO: 194657 - DNA, 2757 bp, Homo sapiens
caacacatgagtcatagtacgagctgggtggtaaatacgagcaggcagagtggagaaagtgggaatagggtgcattggggctagttggcactgccatgtatctcaggcttgggttcacaccatcaccctttcttccctctaggtggggggaaagggtgagtcaaaggaactccaaccatgctctgtccaaatgcaagtgagggttctgggggcaaccaggaggggggaatcaccctacaacctgcatactttgagtctccatccccagaatttccagcttttgaaagtggcctggatagggaagttgttttccttttaaagaaggatatataataattcccatgccagagtgaaatgattaagtataagaccagattcatggagccaagccactacattctgtggaaggagatctctcaggagtaagcattgtttttttttcacatcttgtatcctcatacccacttttgggatagggtgctggcagctgtcccaagcaatgggtaatgatgatggcaaaaagggtgtttgggggaacagctgcagacctgctgctctatgctcacccccgccccattctgggccaatgtgattttatttatttgctcccttggatactgcaccttgggtcccactttctccaggatgccaactgcactagctgtgtgcgaatgacgtatcttgtgcattttaactttttttccttaatataaatattctggttttgtatttttgtatattttaatctaaggccctcatttcctgcactgtgttctcaggtacatgagcaatctcagggatagccagcagcagctccaggtctgcgcagcaggaattactttttgttgtttttgccaccgtggagagcaactatttggagtgcacagcctattgaactacctcatttttgccaataagagctggcttttctgccatagtgtcctcttgaaaccccctctgccttgaaaatgttttatgggagactaggttttaactgggtggccccatgacttgattgccttctactggaagattgggaattagtctaaacaggaaatggtggtacacagaggctaggagaggctgggcccggtgaaaaggccagagagcaagccaagattaggtgagggttgtctaatcctatggcacaggacgtgctttacatctccagatctgttcttcaccagattaggttaggcctaccatgtgccacagggtgtgtgtgtgtttgtaaaactagagttgctaaggataagtttaaagaccaatacccctgtacttaatcctgtgctgtcgagggatggatatatgaagtaaggtgagatccttaacctttcaaaattttcgggttccagggagacacacaagcgagggttttgtggtgcctggagcctgtgtcctgccctgctacagtagtgattaatagtgtcatggtagctaaaggagaaaaagggggtttcgtttacacgctgtgagatcaccgcaaacctaccttactgtgttgaaacgggacaaatgcaatagaacgcattgggtggtgtgtgtctgatcctgggttcttgtctcccctaaatgctgccccccaagttactgtatttgtctgggctttgtaggacttcactacgttgattgctaggtggcctagtttgtgtaaatataatgtattggtctttctccgtgttctttgggggttttgtttacaaacttctttttgtattgagagaaaaatagccaaagcatctttgacagaaggttctgcaccaggcaaaaagatctgaaacattagtttggggggccctcttcttaaagtggggatcttgaaccatcctttcttttgtattccccttcccctattacctattagaccagatcttctgtcctaaaaacttgtcttctaccctgccctcttttctgttcacccccaaaagaaaacttacacacccacacacatacacatttcatgcttggagtgtctccacaactcttaaatgatgtatgcaaaaatactgaagctaggaaaaccctccatcccttgttcccaacctcctaagtcaagaccattaccatttctttctttctttttttttttttttttaaagtggagtctcgctgtgtcacccaggcagaggttgcagtgagctgagatcgcaccactgcactccagcctggttacagagcaagactctgtctcaaacaaaacaaaacaaaacaaaaacacactactgtattttggatggatcaaacctccttaattttaatttctaatcctaaagtaaagagatgcaattgggggccttccatgtagaaagtggggtcaggaggccaagaaagggaatatgaatgtatatccaagtcactcaggaacttttatgcaggtgctagaaactttatgtcaaagtggccacaagattgtttaataggagacgaacgaatgtaactccatgtttactgctaaaaaccaaagctttgtgtaaaatcttgaatttatggggcgggagggtaggaaagcctgtacctgtctgtttttttcctgatccttttccctcattcctgaactgcaggagactgagcccctttgggctttggtgaccccatcactggggtgtgtttatttgatggttgattttgctgtactgggtacttcctttcccattttctaatcattttttaacacaagctgactcttcccttcccttctcctttccctgggaaaatacaatgaataaataaagacttattggtacgcaaactgtcatc

SEQ ID NO: 194658 - DNA, 693 bp, Homo sapiens
  misc_feature (616)..(616): n is a, c, g, or t
  misc_feature (648)..(648): n is a, c, g, or t
  misc_feature (664)..(664): n is a, c, g, or t
tgtagcagcttcttctccgaaccaaccctttgccttcggacttctccggggccagcagccgcccgaccaggggcccggggccacgggctcagccgacgaccatgggctccgtgtccaaccagcagtttgcaggtggctgcgccaaggcggcagaagaggcgcccgaggaggcgccggaggacgcggcccgggcggcggacgagcctcagctgctgcacggtgcgggcatctgtaagtggttcaacgtgcgcatggggttcggcttcctgtccatgaccgcccgcgccggggtcgcgctcgaccccccagtggatgtctttgtgcaccagagtaagctgcacatggaagggttccggagcttgaaggagggtgaggcagtggagttcacctttaagaagtcagccaagggtctggaatccatccgtgtcaccggacctggtggagtattctgtattgggagtgagaggcggccaaaaggaaagagcatgcagaagcgcagatcaaaaggagacaggtgctacaactgtggaggtctagatcatcatgccaaggaatgcaagctgccaccccagcccaagaagtgccacttctgccagagcatcagccatatggtaanccctccattgttccgccttgaaaagggccccnacccaaggggcccctnacttgcccccacgggggaaaaagcccata

SEQ ID NO: 194659 - DNA, 2921 bp, Homo sapiens
tgtagcagcttcttctccgaaccaaccctttgccttcggacttctccggggccagcagccgcccgaccaggggcccggggccacgggctcagccgacgaccatgggctccgtgtccaaccagcagtttgcaggtggctgcgccaaggcggcagaagaggcgcccgaggaggcgccggaggacgcggcccgggcggcggacgagcctcagctgctgcacggtgcgggcatctgtaagtggttcaacgtgcgcatggggttcggcttcctgtccatgaccgcccgcgccggggtcgcgctcgaccccccagtggatgtctttgtgcaccagagtaagctgcacatggaagggttccggagcttgaaggagggtgaggcagtggagttcacctttaagaagtcagccaagggtctggaatccatccgtgtcaccggacctggtggagtattctgtattgggagtgagaggcggccaaaaggaaagagcatgcagaagcgcagatcaaaaggagacaggtgctacaactgtggaggtctagatcatcatgccaaggaatgcaagctgccaccccagcccaagaagtgccacttctgccagagcatcagccatatggtagcctcatgtccgctgaaggcccagcagggccctagtgcacagggaaagccaacctactttcgagaggaagaagaagaaatccacagccctaccctgctcccggaggcacagaattgagccacaatgggtgggggctattcttttgctatcaggaagtttcgaggagcaggcagagtggagaaagtgggaatagggtgcattggggctagttggcactgccatgtatctcaggcttgggttcacaccatcaccctttcttccctctaggtggggggaaagggtgagtcaaaggaactccaaccatgctctgtccaaatgcaagtgagggttctgggggcaaccaggaggggggaatcaccctacaacctgcatactttgagtctccatccccagaatttccagcttttgaaagtggcctggatagggaagttgttttccttttaaagaaggatatataataattcccatgccagagtgaaatgattaagtataagaccagattcatggagccaagccactacattctgtggaaggagatctctcaggagtaagcattgtttttttttcacatcttgtatcctcatacccacttttgggatagggtgctggcagctgtcccaagcaatgggtaatgatgatggcaaaaagggtgtttgggggaacagctgcagacctgctgctctatgctcacccccgccccattctgggccaatgtgattttatttatttgctcccttggatactgcaccttgggtcccactttctccaggatgccaactgcactagctgtgtgcgaatgacgtatcttgtgcattttaactttttttccttaatataaatattctggttttgtatttttgtatattttaatctaaggccctcatttcctgcactgtgttctcaggtacatgagcaatctcagggatagccagcagcagctccaggtctgcgcagcaggaattactttttgttgtttttgccaccgtggagagcaactatttggagtgcacagcctattgaactacctcatttttgccaataagagctggcttttctgccatagtgtcctcttgaaaccccctctgccttgaaaatgttttatgggagactaggttttaactgggtggccccatgacttgattgccttctactggaagattgggaattagtctaaacaggaaatggtggtacacagaggctaggagaggctgggcccggtgaaaaggccagagagcaagccaagattaggtgagggttgtctaatcctatggcacaggacgtgctttacatctccagatctgttcttcaccagattaggttaggcctaccatgtgccacagggtgtgtgtgtgtttgtaaaactagagttgctaaggataagtttaaagaccaatacccctgtacttaatcctgtgctgtcgagggatggatatatgaagtaaggtgagatccttaacctttcaaaattttcgggttccagggagacacacaagcgagggttttgtggtgcctggagcctgtgtcctgccctgctacagtagtgattaatagtgtcatggtagctaaaggagaaaaagggggtttcgtttacacgctgtgagatcaccgcaaacctaccttactgtgttgaaacgggacaaatgcaatagaacgcattgggtggtgtgtgtctgatcctgggttcttgtctcccctaaatgctgccccccaagttactgtatttgtctgggctttgtaggacttcactacgttgattgctaggtggcctagtttgtgtaaatataatgtattggtctttctccgtgttctttgggggttttgtttacaaacttctttttgtattgagagaaaaatagccaaagcatctttgacagaaggttctgcaccaggcaaaaagatctgaaacattagtttggggggccctcttcttaaagtggggatcttgaaccatcctttcttttgtattccccttcccctattacctattagaccagatcttctgtcctaaaaacttgtcttctaccctgccctcttttctgttcacccccaaaagaaaacttacacacccacacacatacacatttcatgcttggagtgtctccacaactcttaaatgatgtatgcaaaaatactgaagctaggaaaaccctccatcccttgttcccaacctcctaagtcaagaccattaccatttctttctttctttttttttttttttttaaagtggagtctcgctgtgtcacccaggctggagtgcagtggcatgatcggctcactgcagcctctgcctcttgggttcaagtgatt

SEQ ID NO: 194660 - DNA, 282 bp, Homo sapiens
gggtacaaatcgaggaccagtagccccttttcaggttgttttgaagataaggtacctgagagccttcagcctgtgcctggttcagagtcagcatcaggaaaataacaaatacaaggcaatttccagcatggaggaagaagagaatgggtctggattcttgttcactagacaaacctgtctctgttaagacttgtgctaatcattgcttgcctgacatatacttatgttcaagacctccgtctgtccttctgtctcgtccttctgtcctgtcctcgttgtgct

SEQ ID NO: 194661 - DNA, 341 bp, Homo sapiens
gctgggaaggagggtagcccgaacccctttatcgtgcaccgaaggggagagaaattggggaagtccaaccaagggaaggcaggtcataaagccaggaactgaacccttggtgacagttagaattaatttgaaaacatacttagggatgctaccttccctttgttcttagaaatttctgctgcaaagtgtgacagctataagcccattcatatgaccttcttctaaggcatggaagtgtggtgcggcaagtggagaagcctcaatgtccaccatatatgtgaatgccaacaacaacggtgatgaccagaacacccccatcccacaattggtcagcaagcatc

SEQ ID NO: 194662 - DNA, 296 bp, Homo sapiens
tactactctttattgcactgagatgtttgtgtaaagtcaaacataaacctggcctacgtgcatatccagacatagcacctttccttaaacttatttatgacacagagtcctttgctcacgttttcctgctgactccaccattaccctctagtcctgtcgcatccccctcaccgagatggggataatggtgatcaattactgctggaggtcctcgaagagtggtgctcctgcatcctccgccgtcatcctcgcggcgatccatcctctaatcgaccgtagctggcgtcctgccttct

SEQ ID NO: 194663 - DNA, 189 bp, Homo sapiens
gggttatcttgtgggcccttcagtagtcagtatctgttgctttgcactctaattatctgctagtattgtgactctccactgcccttgctgttcagtactttctattcttttctcatctcacagcttctattgctgcatgctttttgctgccacatgacctcagctttcttccttctctctgtgtatctt

SEQ ID NO: 194664 - DNA, 192 bp, Homo sapiens
agaaaacatgataggaaaaacctatgtctcaccttcattttctccctgtcctaataacggttcttagcccacagccatccaggcagtgaatcccttaggtagtctaggctctgcccttaacagaacttttttttttttttttgagatggattctcgctctgtcacccaggctggagtgcagtggtgtgatct

SEQ ID NO: 194665 - DNA, 303 bp, Homo sapiens
tctcccccaccatccccaaacaaaacagtccttgggctctcctcattgtcccagccctgagccttgctgttgcctttggaaaatgccagtcaacgttcagagtcctgacggggaggcgacctacatgggaccacctcatgcaatatgcttctaaggtcagggctgggcgtggtaatcccagcactttaggagtccgagacaggcagatcacttgagcccaggagttcaagttcagcctgggcatcatgacaaaaccctgtctctactaaaaatacaaaaattagccaagcgtggtggtgtgcg

SEQ ID NO: 194666 - DNA, 359 bp, Homo sapiens
tagctgggattacaggcatgtgccaccacacccggctgattttgtatttttagtagagactgggtttcacatgttggtcaggctggtctcagactcctgacctcaagtgatctgcctgcctcagcctcccaaagtgctaggattataggcgtgagccaccgcgcctggcctaaatttatttttgagagaagaaaatgctttttgctccctcctagctcatctggtacagcaggagtcagcttgtcctgcagttcagatggtcttgatggcagaagacaccagtcaccattatgtccctttcatcccagcccgcatcccatcctgccctcttcccctgtcctgggttcacgtagtagcta

SEQ ID NO: 194667 - DNA, 361 bp, Homo sapiens
agaccccggatcttagagacgaactcggggtgggaccaggagcggcggtgcaggagccgctaccgccacaccggagacgcacatcacacaaaacacacacaccggagacgctcatgagacataacatacacacagtgcgagccaccgagtagttgccgcgggaactggccgcaggctgagtttctgacggtgccggcctctcagttacacgcaggagttaattacgcttgctgctcccttttcactgaggaggtggacaactccggcctgctctctttcctttacttccaagtttactattgaccctgtgacaggatgggccgaggtgatggaggggaggaggaatgcctttgcctgccct

SEQ ID NO: 194668 - DNA, 458 bp, Homo sapiens
aattgatgttcattgccttagtacagatatgctatatttagatatatttaactctattacacatactgcaaacacatactcttgttgtcttctacactattatatattttacttgttatagtagatatttattttagatgaataactaagtataataaaatagatagcagaggaattaattatctcacatggatatcatttcacctgatcttgatgaacaaggaaatgggtgatttacccaggaataaatataaagttctgtatggtttggaaagcacaaatggtcacctaattttgaaacactttaggtaaattcccattcagaaaaacatttatcacttatataactaatgaaatgcttaggggaaagtgttttggctgtcaaagaaccatactttgcttttagagactatgtttgtatttgaatatttcataaaaactatttctaagccaaggaa

SEQ ID NO: 194669 - DNA, 521 bp, Homo sapiens
cagggggaatccagggtggtgattctgtaccagggcagtggctttggaattgccagctcatagaattctgagtttgataaatggttgttgttttaagctgctggcttttgggctgctttggtacatagcaatacgaaaaggctatgtgcttttactccccagagtagcctcttcaagagggaagcttttcctatgcatatgtcctagaattaggagttcattactcatgtgattctcacagtaactctgtgaagccatgattgttacgcccactctgtacatggtgaaatggaagtttagagagataaaatgacttcttccaagttaaaaaaatctactcagtggtaaagcggaagttcaaagccagtctgacttcaaatcatagagattaacaatcacagtaaaatgtaatatactttgctttgctcatatatcttcagttttcaattcagtttctgagttatgtttaaattatcacttattgatttttccttctttattgagatggaagtctcttctta

SEQ ID NO: 194670 - DNA, 437 bp, Homo sapiens
ctggttatattagaccagtcatcctagatgtgtctgagttgtttgctgcaaatattagtcatttgtacaatgtcaatgagatctctgcttgaaaaaaaatcacatcagaatacctccaatcacatttactacaaagtttagatttattcatttattatttacaagtccttagcaggtaacaaagacacctttaagtaataggctccagagggcagcagataagaatttttctttctgttgttaaagggctttcttgcagtctaagaatgatcattaattccttgttataagaaaaattataacactagtacaactcaacttctttttactgcctaggaaatttttttcccccagagatttgtgtaaatataaggctaaagttgtaaaatatacatatgaaggaatacagtagatatactctgtatttataatgtaaa

SEQ ID NO: 194671 - DNA, 106 bp, Homo sapiens
tgtagcagtttaaacatacacacatcacatgtatgatttcgtgatatcttacatgcaatctcttactttctcacttctttctgagacaagcaattgaagaggattt

SEQ ID NO: 194672 - DNA, 496 bp, Homo sapiens
agtcccagctacttgggaggctgaggccagagaatcgctcaaacccgggaggcagaggttgcagggagccgagattgtgccatggcactccagcctgggcgacagagaggttccatctcaaaaaagaaaagaaaaagaaaaaaagaaaatagctgtgatttataccggtgacacggtctcaagtgttgtactactgctcctgctaaaccatgactctggtttcatacctttactcatagttgaaggaaatgttctgttacagtgagaggttagtgaaaatgaagaggtcacttctctattcaagttattggaccccaggttaaaaaactcttgctctagagacttagcctggaagagcctcttagttctgatggttttgttgctgttaagtggtgacacaatgcatataaaatgcttagagtacattctgagaaaggtggtctgtgtacctctggaattgtgattactactatcaagttttaccagtgctgtacag

SEQ ID NO: 194673 - DNA, 202 bp, Homo sapiens
gtgcacgggaggggagatcatgaaattcattgtccaggggaggaatgtcacaaggtcgattgattagttggagtggggcatgtatatgtgcacgtcacagggattatgatggcttagcttgggctcagatgtctgacattgaggatccttctttatcttcctctgatgcccttctatgagaatgaatctgtaatccgagagg

SEQ ID NO: 194674 - DNA, 401 bp, Homo sapiens
ggagagggttacagatttaaagaaacttgagagaaatatctaccaaatgcaaagtgtagacttcatttggatgctgctctgaacaactgcttaaaaaaatatatatatagggccgggcacagtggctcacgcctataatcccagcactttgggaggctgaggcaggcggattatgaggtcaggagatcgagaccatcctggctaacaaggtgaaaccccgtctctactaaaaatacaaaaaattagccaggcgcggtgacgggcacctgtagtcctagctactagggaggctaagacaggagaatggcgtgaacccgggaggcagagcttgcagtgagctgagatagcgccactgcactccagcctgggagacagagcgagagactccgtctcaaaaaaaa

SEQ ID NO: 194675 - DNA, 368 bp, Homo sapiens
tgcccaaagtaaatggatgtttgatttttcttgattattatatatgcatcaaatttaaaacacctgaatgcctttggtcaactttgtccttcaacccatgactgttgtgcttccttgtgggtttcctagacagtagaaaaatatgcattttatttaatacttttaagcatactgtctctctctttctttctctctctctctctctctctctctagttctcactcttgccttcactcccacttttgctctctgctctctcttcctctgtgctctttcagtcttaaattattacagtttatgcaaagaatttaaatctcatatcttctccactaacttctaatgctttttaagtgtcagggtacatataa

SEQ ID NO: 194676 - DNA, 309 bp, Homo sapiens
aaaccctccaccagcaaaaagatgatgactctctgaaggctcagatggttgttagcattgtatgcctgtatgtgtctgttatttcaaatacggtatcttatttaatcttcaaaggaactctatttctatcactatgttatactccagaaaacagatcctcaaacattaaccaattacaactattagctactgaggtgaaaaagttggaattccaagtatgccttaatcacttcaaatctcagacctcacacatgttatacatgttgcccctttcagagtctttaaaattttaactaagtagaacacaga

SEQ ID NO: 194677 - DNA, 383 bp, Homo sapiens
tgtattggtggtgctggctcaacttctctcattgggtcaaagtcaagatttcagttagagctttagtgatctgaagtcttgactgaggctcgaggacttgctttcatggtggttcgttcacatggctggcaagttggtgttggttgctagtgggacagctgagttcccatcctcgtgggccactccacggatctacttgagtatcctggtagcatgttagctgggttctcccagagtgagcaatcgaagagaaaaagagagtcagaagaaaactgtcctttttatgacttagatttggaagtcacaaagcatcacctctgccacattctgtccattggaagagaaacaccaaggccagcaccaccaatacagggtaccgagct

SEQ ID NO: 194678 - DNA, 461 bp, Homo sapiens
ggtcaataccccctccataatgtctttgcattccttcgtctaacgtgtcagaactgatgactttgataaaaaacaagttttatgcctctctttggccccctgctcgtctttgccacaagagtaaacacagcctgaaagggagaagagtgctggattctgttaagtctgttttacttttcaatattcagtttgtttttgccagacaaactggttcagttgtttttgccagcctggttcttgagatgggcttattgtctgggtaagagttttttcttttttcttttgaaagtaccactcttagtacataaggtaaataattttaaaaattacattatatccagttgtatatctaattttagggtgatagatagttggcctggcctttctaagtgaagcaatatctatccacactcccagatactctccccagctgtggtgaaatgtgagctctctgaatccaa

SEQ ID NO: 194679 - DNA, 195 bp, Homo sapiens
acaggcatttgttgttgacactgatgcagtccagcttgctgaatggcggttctgcatgtgaaatcaacatttagattgattttacacgagtgtttaatgtttgtggaaagtacttttcttggattagttaatattcttgaattgaaatgatctgttttttaatgaatagccaaagagctgctgttcctttaatgg

SEQ ID NO: 194680 - DNA, 477 bp, Homo sapiens
tcctgggattcatcatacctacctgttcccctcttgactttcactgtgacaattttaagtgcatccgccgctcctgggtgtgtgacggggacaacgactgtgaggatgactcggatgagcaggactgtcgtgagtgttggcagaggctgggcggaactccattgagttccactgggaaaggattttcaatcagaaagcaatgccccaggtccacatgagcccttgtgttttcagcactttgtcctgtcctttcacttcctctcgaagtcagataagctgctgagaggcagccacctccttcggagccctcagggcagcactggagctacttgactgctccggagggctttaagtcaggcttccagacaccagacccccactgcctgcagcagcctgactgctctgtgcccacagccccccgggagtgtgaggaggacgagtttccctgccagaatggctactgcatccggagtctgt

SEQ ID NO: 194681 - DNA, 147 bp, Homo sapiens
tcttgtttgctgctcctgaagcactccctctccctggaggggccgcgggtctctctaacgccccagtgggggacctggcccaagttcctttccccggtgataagccctgacccccattcccgggcctgcctaattcagggcgctctc

SEQ ID NO: 194682 - DNA, 282 bp, Homo sapiens
ggcttgtcatgtgctcattcctggttcagtcctgtggctggacataggttctattcaaaggacattttcacaagagttggagaaagatgagtccctccaaaagaggtgatatcctgagtagacagaacaaaaaatactcactgaagaaaaactagaaaatcaatggaaaagaaaaagaaatcacacaatcttttttttttttttccaagacagagtctcgctgcactccagtctgggcaacaagagcagaactccatctccaaaaaaaataaaaataaaaat

SEQ ID NO: 194683 - DNA, 433 bp, Homo sapiens
tagaaggatttactgtggcctgggactgttgcagatgatagagagcatcggggggctgctggggcctcctctctcaggctacctccgggatgtgacaggcaactacacggcttcttttgtggtggctggggccttccttctttcagggagtggcattctcctcaccctgccccacttcttctgcttctcaactactacctccgggccccaggaccttgtaacagaagcactagatactaaagttcccctacccaaggaggggctggaagaggactgaactccacagagtcaggcccagaaagccaaagcttgacagctccaggtcttctcttgccacgtcttggtctccacagaaccacagtgccttaagattcttgatctgcctccccctagagcaggcctggggctcctgcaatgtgtgtgccaacccttt

SEQ ID NO: 194684 - DNA, 636 bp, Homo sapiens
cacagttgccagaaagaaaggcacaagtatgcctgactcaatctggatctccaaatccctgcaggctggtttggaggtcctttctgaaggcggggaggtggttgaaattaacttttgaggcccttttgggaaaccagagttcttaagtttatccaactattccatgggagttccaactcctctgagatgataagtcttccctccacccaaaaatgtatctgagccctcagccccagcaaatagatcactcatgtgtattctttttctctcttggacctaggctacctccgggatgtgacaggcaactacacggcttcttttgtggtggctggggccttccttctttcagggagtggcattctcctcaccctgccccacttcttctgcttctcaactactacctccgggccccaggaccttgtaacagaagcactagatactaaagttcccctacccaaggaggggctggaagaggactgaactccacagagtcaggcccagaaagccaaagcttgacagctccaggtcttctcttgccacgtcttggtctccacagaaccacagtgccttaagattcttgatctgcctccccctagagcaggcctggggctcctgcaatgtgtgtgccaacccttt

SEQ ID NO: 194685 - DNA, 325 bp, Homo sapiens
accacttgctgtctccaccttccctacctttcatcaactccttgatcctctgtaatctggtttctgcttactctgttttattgtatctgctcttgttaaatttctaattgtggactctggcaggcagtctttcatccatattttttcactttcttatgttggccaccccctcctccttaaatcaattcatttcagtcaatcaattctgtccccacgccttccattcatccatccatccatccatccatccatccatccatccatccatccatccatccatccatcttacttcagtgttcctcaggcacacatccaaacaaccaca

SEQ ID NO: 194686 - DNA, 302 bp, Homo sapiens
gtttggttaggaacacgtgaactacggtcacctttctgaactttctgaactcatatgtagtgaccataggtcacctgggttgagttttcaacactgcaaacagggatggcagttcttgaatacacaggagagtgcattagccagtggtgcccggcatcattcagagtgcagtttggcatcaggaatgttccgtcaggtatttgtggtcttgtggagaaaagccactgttggttttggtgaagggcttcagaccctttgactgctcatgaaaccacacagtcttaacatggacacgttggacg

SEQ ID NO: 194687 - DNA, 469 bp, Homo sapiens
tgagagatgtgctgggagtgtggcctgcagaaacacacataacctatgtggtcccgggaaggaacaagggaccgttcatgagaaatgccatagactcaatagaaacggaaccagctctgcactgttctcaagctggattggaaatgagggtgcaatcaacctggaggtcaggaagatgaatctggaatccctcaacccagctctgaccggcaggcagctaagggaatgtcagtgacaatccttcagaactggatcccctccccacttctagatggggctaggactgttttagaatactctggattaatggagtatgacttatgaaaccaacacccttttcttcagggaataatagagcaatgttcaacatgagaaaaggcatgcttggtgtaaaaaggtggtcattacatgattggtcattgtgaaggatgcgtcaaaagttgatgtggcggccgggcatggtggctca

SEQ ID NO: 194688 - DNA, 395 bp, Homo sapiens
gatgggttatcaccatcttggtcaggctggtcttgaactcctgacctcatgatccacctgcctcggcctcccaaagtgctgggattccaggtgtgagccaccgcactcagcctagacctacaaaattatacttggagaatcctgacaaaaaggctggctgagaaagcacacccataattatactcaactctcatatagagaactccatttaactttgtagtgcttcatagccaagacttgccagaaattggcagaacatctctaacataagagagaccaaaagaaagaaaaatgtacctcggagataacaaaaacaatgtaataagcaaaagaaatcataaatgaactgtaattaatattcttgtagaggtgaggtgaaggaacaagaataaatt

SEQ ID NO: 194689 - DNA, 375 bp, Homo sapiens
catctttttcagcaagaactgtccttccttcacacctgcacgtccttccaaatgggggacacagcttcaacagaagacagtaaaacccacgcgcaccaaaaagtttacagaaatgtgtgctgagtgatcctcactgcccatgaagaggtccacgctcaaacatggctaatttggggaaaataaaacagagagtgtgcaacattgctgtgcagatttgtgttttgtattcctagcatgggagttaccatagaaataaaagaggtaagtagtttaagaaaaatcccagttgcatgcatcctggggactgtgaaccaaagaatggcctgagcaactctaggactcttttttgccatgaagagaacgatatttaaattg

SEQ ID NO: 194690 - DNA, 685 bp, Homo sapiens
tggcctgggcttgttcatcgcatgctcctcagctattcattcaactggatcgtgcctccctacatgctgggatctgagcgttgatccaccacacctggccattcaattgtttttgtttcactttttcacacctatacaatcaaccaccactctctacctttggcttactgatgtgtaaggaagaattgaaaggaaaaataactatgactctgctatctttgcttctcctatgtcatcatttccagtggaagtggttggctactacagggaatcagatgagtagaaaaggctgggagagagttccttgtttgttcctgtttcttagaatgccattgacttggttttcaattctgattctataataagggaaagtgcaacctcttggtgctgtcagcatctctcgcagactccgttgtggacatagtaggcttcccttatgcccacttggagccttgctgggctcccatgcactgcggaccccccaagattctatgctcagggcacggcagacacgccatggggagtgtggtggtaactcatattgttgctggtgtctcgtctgcccacgcacatgttctattgccctgttggattttactgataaaacatagattcaggctgggtgcagtggctcatgcctgtaatcccagcattttgggaggccaaggtgggcagatcacttgag

SEQ ID NO: 194691 - DNA, 473 bp, Homo sapiens
acctaaattattatgtaaccaaactacaacttgaccaggcagtatattcttgtaagaagaaaggagtcttctccaatcatagcagccagccttcagccaggggcagactgcagactgaccagatgtgtccaaattagacaaaggttgagctgtaaccaatcagcctatatccaatgccacttcctttttctgtttataaacgctgcttgcccactgttgctgggtggaggtctctgaaacctctctaatgtagatctctcatttaatggggagggtttggcctttaatcaccatcatccctgaacaaagactgaccaattggactcaaatgctattgaactatctttattgcatggactttgagttatttgattttgactagttgtttgttgaaactcctgataaggagtgtacttcagtttcttggcattgtccactcatagccatcataataaatttagggtgatgggcac

SEQ ID NO: 194692 - DNA, 398 bp, Homo sapiens
aatgggatgtgttctattacaaagactttttatattcttgaaatcttacccaaggaatacaaatatgaaatcttttatttgtaaataaagtatatttattgtttgccatttaacttttagcaagctatgcattctccagaaggaaaatgcttagggccattgcagtgatctagtcaagcaataatgttaattggaaatagggtgatggcagtggaattagaatacatgaaataataagatgtctttgagaatttaaatagccatcatttactgttggatttgatatggggattaaataaggtaaaagatttaaggatggtgcccatatttctgttttgaacaatcagttgagtaattgggccacttattgtaataggaaagactgggggagaatggac

SEQ ID NO: 194693 - DNA, 469 bp, Homo sapiens
tagggagattacaatggtcattgcttattaatccagcataaataaaatacacagaaatatgagcctatttggtacaggaattgatctaaagtattccagatccagagaaaaaagtaccttgatacaaccctggtagaacagattgaagagtaaaggaaactaaagctgatagttcttcaacagttcagctcccctaaagaagggtcagaccacttgttttagacactgagagaaatcagccaaataatgaagaaaacaacagagttaaactgaatttacagacatattaactttgtatagatacacaattttttagcatctagaaaactgatgagtaatgaatccagctgccagagactccctgatgaagctaactaaacagtgtaaagatcagtaaatggaccaatttaaagcagtttgctattagcttaatagtgtcagaaattctaaataataatagtaaaaaagg

SEQ ID NO: 194694 - DNA, 425 bp, Homo sapiens
gagacagaaaaagatcagtggttgccggaagttagtggggaaggaggaagaacagaaagggcacagagaatttctgggaagtgaaactactctgtacaattctctaatggtagacacctgccattatacatttgtccaaacctacagaacatacaacaccaagagtgaatcctaatgtaaactatggcctttgtgtgttaatgatgtaccaaatgcaggttcatcagttgtaacaaacgtaccactctggcacgagatactgatagtgtggaaggctgtgcccgtgggagggacagaagaaatatgggaaccgtccgtattttctgctcaattttgctgtgaacctaaaactactcttaaaagtctattttttaaaaaacaacaaattatgacaatggaaaactgatcagtagttgccaggggct

SEQ ID NO: 194695 - DNA, 599 bp, Homo sapiens
gcagcggtgctcctgcactctgtgcctcataataaaatttgcataaaaggattgcacagttcccaaaaaaatcgcattcaataaatgttagctccccttctcatttccacaccatctgagtggcttatatgcaggggaggcaagaattacctactaaagacagaatagtggacctcatatcaccctttgatgattcccagaacctggtagcattagtcctatcatttgggcccataacacaactactgtcccagtcctgcatggtctctggtaaccaagaaatagagaaaaggcagcagcaggtaacacaagaattgggtgaccaacaatctgcaaaagctacagaatccagcccttaaaaggttcaaaccaagtaccaagtacagctcccaatgaaaatatttaggccagatgcggtggctcatgcctgtaatcccagcactttgggaggccaaggcaggtggattacctgaggtcaggagtttgagaccagcctggccgacatggtgaaaccccgtctctactaaaaacacaattaattagccaagcgtggtggcacatgccggtaatcctagctactcgggaggctgaggcagaag

SEQ ID NO: 194696 - DNA, 470 bp, Homo sapiens
ccttattctaagatcatttcccactatcctgtagtctaggcacacagaagtctcccctggtagaccacatacttgcttttatccttcctttacagttataaatattgagcgtaagcacatagtaaatttttgttgccagttatccagagtaattgatacatcattttataaacttttgagaggaggatgttagaaaccattccatcacacttttaataaaaaacggtatcatctcaggtggaagtgaggcctattcacagatctcctaacaggtgattactgtctctgtggcaaggagaacttttatgaacctgccctttgtgagctatgggtaaataaggagtcttggatttatgactgcagctactattaaatagtggacagtttgaacctctctctctcatgatgaactgcagatatgtgacttaaataagccacccaattctgaactgagctttatattgcaactt

SEQ ID NO: 194697 - DNA, 353 bp, Homo sapiens
tcagggtctgtgttttatacttttatccattcactacacctaatgctgtgttggatataaggtccgggaaatactgtgtaaaaattgctggttgaattttggcagatcttggtaacgtgattatcaggatattccaggggaagtggcattagtatacttaaactgatagtttaagtgtcattaatttggtggatggtggcattttggggaaaagagccggtttattggatgataaatcaggaccctgatctagacaggctgcattatgagctaaatcaaagaataaattcaaaagaaaattagatgactgccaatgtacatcagacataaattactgtcattaagaattactg

SEQ ID NO: 194698 - DNA, 662 bp, Homo sapiens
gtggtagcatgtatgctgttagattaccgcgtagcaatcaagaatcccatgtagaaagctttctgtatgtagttatcttaaaaataattttgtatatgaggtgacaaaaaaaggagatgacaattttaataatttgccttctttgaaatattcactcctaacactagtttgagctggggagttaacttttttgcttgtgtttagatttcacttcaacatgaagctctttaaaaaaataacgtccctcaatcattcatgttacgttttaactagactcggcaaggagttagcagtctcagaatcatgaattcatgaaaaagatgagcttttgtgaatgtatttcttgcttcctaaaaaaggtcacatctattaaatataaggagataacatcgtttttaatagtatttcacacattagcaaaggaattttttattaaacatagttatcaaattttttggaggaggtgacaaaaaaagagaggaatacgcccaggatgaaatattgggaaatgctaaaatctagggaaaacataataaacaagaatccagtcaaggaaaatcaagaacttaccacaagcactgggaaaataaatcaggatagtggtgtcggcagacaccaagaggtagaccgatcggccgagtccaaaaactcaaaatgtcatc

SEQ ID NO: 194699 - DNA, 204 bp, Homo sapiens
cagagttgttttaattcaaagatttatttcctgcatctttggaaatttttccccttgattagttcacctctccattgcctaagttaatcctctatatgtcctattctttctttcattttccttttgtcttattgttttgttttctagaagatttctatattttattctccacctgttgattgaaaaaatatatatgtatttatt

SEQ ID NO: 194700 - DNA, 414 bp, Homo sapiens
aattttagaatgcaagatctgaaagggacatgggaatctgtgtttttaacgtgttccaggtgattctgctgaccaggtgagtatggtaaatgtggcaagtattctcaagtgagctcatcagtcccagggctgttagcaccttccatctgccaggccctccctggtctagaccttcagccttgaccttgccctgaaacgccaaactcttactcccagctgctttctctgtccctccacttagatgttagtaggcaccacaaccttttaatgctcaaaatactacttttgagtcctttccaccccttacttggcccctcaattcatactttttgggatggagcctcaaatccagaaatcttctgtattagtccattctcacactgctaataaagaatacctgagactgagtaattt

SEQ ID NO: 194701 - DNA, 147 bp, Homo sapiens
ccctccttccactgtgattctctctgactggcctgtctctgacccctaactcaggtttcaagggctccgttgattccatcaagcctatgaggataattgctctaccttaaggtcaactgatttgggaccttaattacatctgtaaaa

SEQ ID NO: 194702 - DNA, 683 bp, Homo sapiens
gctgactccgaggatccaggcaaagctctacacacacagcacatcattgactcatgtcaacaaaagcccctcacacctttttaagtcgtctgctgctaggccatgccttccttattctgtgcctgggcaagtagctcttgggtgccagaaatagctcctttccctttccattgcatattcttgggtccaggccattgcttctagtctaggagtgagagtgatttggatgctgattctgaccctgagtcatgacatctttgttcccagcctatccacgaatgcaataaacatggcctctttattttcattcaagccagtgataaaaatgtccaatgggactttgcaaaggatagaggcttgaagtcctgaattcagaacctctctctgagaacattaaattgtagcctctgaagaaccgtatccaaccagtccccaagccatccaatggtccatgcaccaaattcatgtcaaccccattgaacttatcaaatgccctactgaattcataaactcttgatctccctcatttctaccggtctcttaatcctatcaaggaaggaaacaagattctcttgaaagagtattttctctgtgaacccacagggcgtcctggtgattcctgctttctgtatgttcataagccacaaatcccctctaacaagccattcctgaattgttttcat

SEQ ID NO: 194703 - DNA, 602 bp, Homo sapiens
tcaacagaatcttgctctgctgcccaggccagagtgtagtgtcacgatctcggttcactacaacctctgcctcctgggttcaagcaattgtccttcctcagcctcccaagtagctaggattacaggtgggtacgccaccatgcccagctaatttttgtacttttagtagagacggggtttcaccatgttggccaggctggtctcgaactcctgacctcaagtgatccgcccacccgggcctccagaagtgctaggattactggcatgagccactgtgcctggccccttctccaaatgttctactaggcaagcccataaagtactgcatttgttttatttttattaaacatatcagaagcaatataatcacacaaacttaacagttaagacaacacagatagcccactatggtgattaacagtcattacttcatagtcacttaaatttttcatattaatgattaattagatattccttttttttaaaaaaatatagacactccctgacttacaatggttcaacttaggattttttgactttatgatggtgcaaaagcagtgcatattcaatagaaatcatattttaagcacctataaaaacat

SEQ ID NO: 194704 - DNA, 389 bp, Homo sapiens
gtagctgggattacagatgtgcaccaccaggtccagctaatttttgtatttttagtagagacggggtttcaccatgttggccaggctggtctcgaactcttgacctcaggtgatctgcccaccttggcctcctgaagtgctgggattacaggcgtgaaccaccacgcctggccttgaataatttttaagagtgttaaagaggcctcaagacaacagtttgagaacagcttgctttaggatgtcaggaatctggagccaggccacatgccgtcatatcccagccctaaccttcctagcggcatggctacagatgaatgactcagcctctctgtgtgtcagtttcttgatctacagtaaggagctaacagtggcaggtgctttgtctgtta

SEQ ID NO: 194705 - DNA, 262 bp, Homo sapiens
atgtgagaaggaaaatgcacatgtggataaaatgttttcatttgacgtcgaaaatgatagggaagtgagagtctgaaaacggtttcacaatgagaacacatggacacagggaggggaaagggaacaacacacgccagggcctgttgtggggtgaggggagaagggagggaacttagatgaagggtcaataggtgcagcaaaccaccatggcataagtatacctatgtgacaaacctgcatgttctgtacatgtattttatgt

SEQ ID NO: 194706 - DNA, 860 bp, Homo sapiens
  misc_feature (584)..(584): n is a, c, g, or t
  misc_feature (758)..(758): n is a, c, g, or t
  misc_feature (841)..(841): n is a, c, g, or t
tataagatgcacgccagtttttgtgggctcctcgtgacctccaaccctgccaataggtaaaaaccagatggattggaaatgaccagaatggcagacatgacctgatccacatgctaccaacctgccactcctgccccctctccgatccgcccctggcatcaccttcactccagccacaaacccctcacagttctctgaatgcgccatggactgtctccctgtggcctcgctgatgttccccgttctgtgatgctgtctctcttctttaacatggggaagtgtgctgtgtcttcagagaccggactcaaatcctgtataaaggcccccactgcgcaccgcccctcagaggctaaccactcactcctgattctctcataactttgcaaaaagcttctattatataccgcttatcaggttacatgacctaggtgcctctcctccccacgcccttttcctctgtttattctacaagtgtccatagaaggaacacattttgtcaagcattgctgaaaaagctatttaggttggggctaagagagtcccccgcaactgccccaacaacctttgtttttcttgtttttacntagaaagaaactgaggcacagagggattagaaaactgacaccaaattgctctgccagtaagtataaatttgaaccgaggcaacctgactctgagaacccacagttttaactgttacactttgtggccttgttagctgaacttaaataagtgattccagctttccagatgagganacctagaagttgaaacctagaagttgaattacttgctcaaaatcccactgctagtaagtggaagaggcaggatttgaactcangacgtaagggtcaaaattc

SEQ ID NO: 194707 - DNA, 229 bp, Homo sapiens
caatgaggggtgcagtcaaagcagtcaggggaagtctgtgggcaaatgtatgctggcagcagcccatctgctaaagctttctgttggttaggtggggtctgttggtgaaaaagctatggcagtggctgctgggaagcacccagtaggtcatctgaggctgtgctgcaatcagacatggccaagcagggaccctgggagagactggcagacaaagtgttgctcagatcag

SEQ ID NO: 194708 - DNA, 324 bp, Homo sapiens
aggctcatatgacattaacagacaagacacttttcaggaagacaggtaagtcatttgttaaaatctcactactcttgtttaacagaaacatatatatgcatgtatatgtgtgtactgtatggaaaaagtggaattagagtttatctagaaaagaaaaaattacctcatctaagtgcagaaatgaataatacgtaaaccataccatacaattgtctctatcatatttccacagataagtcaaaaatttttaaaatcttattgttcatgcataaatgcagaaaacaatacctctagtatatgtttgtgttctattgtactttcaca

SEQ ID NO: 194709 - DNA, 223 bp, Homo sapiens
aaatctccccacaatgtttgtactacattttttttaaagcataataaatcccagttgaattttcccaaggtagagtattgtgacttggacgaccactgtagttttcaggaaacagaaatgtagcaacatggatcccttagacctaaacaacagtggctcaagccctggattccttgagttagggggtaccactccagctatacaaccctccccatgaagcaag

SEQ ID NO: 194710 - DNA, 426 bp, Homo sapiens
ccaaatgctgctctctggaattggcaaagacaaagccaagtaggtttctgagcagacggacagactgacttcagagaatagaaggcccccggggtttgtgggcagcagcagggctcacgtgaatgagagctctatgattctagaatatctaattaacactgacactctcccccagcctctgccttatccttactccacaggctctgcagcagtgagaaggcatctgtctagtgatctgctgatctgcctcaccccaaccaagcccttcaccctgggatgttactagagctcttggttacttgagccacctacctaaacatttgtgaatacttcagccatgggacagcgactgtcaatcaatagtcctcagagactcatcagaacagtcaggggacagtttggtggtaccaagcaatgagcacgggg

SEQ ID NO: 194711 - DNA, 1009 bp, Homo sapiens
caggcgcaggggcagggaggagcccagcagcgaggcaggtggcaccaccaggggggccctcaagcctggcgcgcacgcattccagacgacacccagaccatgctccgccgcctgggcgcccaagctgcagtcgccctctgtgtgcaggcagcagctgcctggcaacccccgagcccgctcgcgctcccagcatcgcagaaccagggccaggtatcccagtggctgcgatcaagccagtcattctgcccggcggcggcggctgcacaggagccagaactgagaacccgccgctcagccccacacggggtgactgccgagtgcccgtgccagcggcccagatctccctcaggtggaggagtgggcgagaggcacggcctgggggccctcaggctgggcgcgctggcgatcccaaggccgaccaggccatgcacctccagcccgcctgggcacctaagctgcagccgccttctgtgtgcaggcagcagcctccaggcaactcccgagcccgcccgcactccccacatctcggaaccagggccagatgtccctgtggctgcggcgaagccaggcggtctgccctgcagcagctgcacgggggcgggaaccggccctcagccccatcccgggtggctgtagaggacccctggctggaggtctcgagctctggcagaggaggacccgggcgggggcagggtctggcgggctctcaggccaggggcactcgtgatccagaggccgcccaggccatgctccaccacctgggcgcccagctacaggcgccgggcaacttccaagctggctggcgcgcccagcctcgcagaaccggggctagatgtcgccgtgactgaggccaagtcaggcggtctgcccggaggcggctgcaccggggcaggaaccgaccctcagccccatccccggtggctgcagacggccctggagcggcccgatctctcttcggaggagaagaggggcgggagtcacggccaggggggccctcaggagggaaggg

SEQ ID NO: 194712 - DNA, 548 bp, Homo sapiens
atctcattagaatattgtgctaattggctgcaaataatatgtcagcaatatttacagctttaaaaagcttttggttttaggtggttgattagcagggatggcattacccggaaaatacaactaggttatagtagtattaaaaataactcaggtttttctaagtttgaaacattaatattttttatgctaaaaggttttaagaaaacacttgcaatttacagcgccttgtttagtcctcagcgatagaatagtgtaattttaaaaaaaccaaagtagggccaggtgtggtggctcaaactgtaatcccaccactttgggaggctgaggcgggtggatcacctgaggtcaggagttcaagatcagcctggccaacatggtgacaccctgtctttactaaaaatacaaaaattagccaggtatagtggcctgcgcctgtaatcccagctcaggagactgaggcaggagaatcgcatgaacctaggaggcagaggttgcaatgagctgagacgtgcaccactgcactccagcctgggcggcagagtgtctca

SEQ ID NO: 194713 - DNA, 347 bp, Homo sapiens
catatgttctgctcaccagcatgtacacagcacaatccccagcatgtaataaccacacaataaaagcataaagggaaaaaatggacacaggcttctgtctccaagttactttactgcctctatgcctctttagagctggctctcagcagaggggagaggaaactgctcctcatgtgaaagataaaccctacaacctatggataaaacagaggcaagaggtgggaatcaggccattaagccttggagaacacaaaggcagctctcatctagagagagctaaggctatctcctcactctgatgccaaggagggaaccctccagggcacccatcccaaaagtccagacta

SEQ ID NO: 194714 - DNA, 547 bp, Homo sapiens
atatgaaaattaaagaagttgctcctgaatgatcattggctcaacaatgaaatcaaggtggaaatcaaaaaattctttgaactgaacaataatagtgacacaacctatccaaacctctgggatacagcaaaagcagtgctaagaggaaagttcatagcattaaatgcctacatcaaaaagtctgaaagagtgcaaatagacaatctaaggtcacatctctaggaactagagaaacaagaacaaaccaaatccaaacccaaccgaagaaaagaaataaccaagatctcagcagaattaaatgaggtaggccatggtggctgtctaggcgcagcagctcacgtctttaatcccagcactttgggaggccaaggcgggtggatcacgtggtcaggagtttgagaccagcctggccaagatagtgaaaccccatctctactaaaaatacacaatacacaaattagacaggtgtggtggtgcacgcctgtaatcctagctactcaggaggctgaggcatgagaactgcttgaacccaggaggcggaggttgc

SEQ ID NO: 194715 - DNA, 465 bp, Homo sapiens
aagtgtgagtcaccatgcccagccacatttgattattttaaaatgtgatttataacttacttacgatatacttgaagcatttaagtaagatattttggaatatatcctatttaaaaacatacatctttggaacatatcttagaagataaaacttgaagctttaaaaagtcagtttgttaggccaggcgcagtagctcctgcctgtaatcccagcactttgggaggccgaggcaggcagatcacctgaggtcgggagttcgagaccagcctgaccaacatggagaaaccctgtctttactaaaaatacaaaattagccaggtatggtagtgcatgcctgtaatgccagctactcagttggttgaggcaggagaatcgcttgaatcagggaggcggaggttttggtgagtcgagactgcaccattgcactccagcctgggcaacaagagggaaactccatctcaaaa

SEQ ID NO: 194716 - DNA, 193 bp, Homo sapiens
taggatggatgaaatggcccggggcctctgcgaaggaagaattgctaggtggcaactgggagttaaagagactctggtttccaggctgaaaaagccctcctttatggaagctgccataagaaggcacagagaactgcaatcagaggcaatgagaaggaaacacagtagttattagctcattagcctgcaacca

SEQ ID NO: 194717 - DNA, 626 bp, Homo sapiens
ataggaaaccccaaggaatatgcaaaacaaacagagctttctgtaactaatagatgagtttgaaaagatcacaggatacaagatagacctgaaaatcaattgtatttctctacactagtaatgaacacgtagagactgaattttaaaatacagtgccatttacaactgctcaaacccaaatgaaataagtataaatctaacaaaacaggtacaggacttgtattctgaaaactacaaaatgccaatgaaagaaatcaaagaaggttcaaataaatggagacagatgccatgtttatagattgaaagattcaacatagcaaagatatcaactaacctctaactgatttacagaattaacacaattctaatcaaaatctcagcaagatttgttacagatatatataaaattattctgaaatttattttgaaaaagaaaggaaataaatagctgaaataactttgaaaaaaaggaataaaatggaagccatcagtctagctgatttcagaacattatatagctacgatgatcaagactgtgggatactggcatagggacagacatgtacatcaatggaacagaatggagaacccaatagctcaccacataaatatgaccaatggatttt

SEQ ID NO: 194718 - DNA, 3663 bp, Homo sapiens
  misc_feature (672)..(672): n is a, c, g, or t
  misc_feature (1237)..(1237): n is a, c, g, or t
  misc_feature (1310)..(1310): n is a, c, g, or t
  misc_feature (1938)..(1938): n is a, c, g, or t
  misc_feature (2410)..(2410): n is a, c, g, or t
  misc_feature (2818)..(2818): n is a, c, g, or t
  misc_feature (3655)..(3660): n is a, c, g, or t
  misc_feature (3662)..(3663): n is a, c, g, or t
ctctctctctctgtacttacttacttaatttatttatgtatttattttactaaattaagagggtatataactgaacaagctctcatgatgcctcccttttaatgtaggagggacaaataatttaaaaagtaaacaagaaaatagcaggtggtgataaatgcagaacaatgacaataatcagtgtgatgtcttagagagcccctaggggccatttttggcagggtggtcaaaaaaggcttctccaaaaaggggatttcagctgaagctttcgtgataagaaggagcatgctttctgagcacgtgggcttaccaggtaaaaagggcagctagtgcgaaagccctgtggtaggaataagctttggcaaatacaaggaattagaagaaggtcaatgtaccagaagcacagtcgttaaggtggacagtaaggaatggaatatgagacagtcagacaaatcctaagaaggcagggccttcataggccaggcgaagagttcagattgtactttaagtgttacagaaagccattggagggtttcaagcaggggagtgacatgacctgactcacattttaaaataattacttcggcctctctttggagaacagaaggtaaggggtaaatgtggaagcaggaaggccaagtaggaggcgagtacagtattttacacgagacncgataaaatctggactgtggttgtagcagtggagatagaaaaatgtaaaagaaaaaagaattaagacacatttttgaggcaatactaatattctaccttacaatctaccgcctccttactctgccaaatctcacacatacagcatgcattcatttatgctgtccattaacgatagtttattgtacacttactatgtgccagatgtagagccaggtcatggtatcacaccaaaagatagaagtcagctcagtctccaacaaataattttgcttagtcatcaataccagacctcatcctaagtaaccagttctgaataagatattattttatattaaagtttcaccaagaaggcatttaaaaaatgcaatattaaaactgaaagccagaagaattctacctgttagtttaatttttctgcttataataagcaataattccacataattctattagctagtttcatgtcattaatatcctctcacccatcttcacagtcaattggaagatcaactagaagagcttcttcaaatgcctgctagaagaattgtttctattttcagttttngtgacctgctatgctggggagattgaatgagatactcaagtaccttgctttttagactggaatctttaatacntggtactatcacccatagtgatgcctcatttttttaggtgactctctgccccctttttttaggtgactcttttcagcacctaatcttggttctggtaagtaggttgagaagctaatccttcagtcctaaattgaatttgcaaattgtcaatgagaagcacagtgttcttcaaacaaaaacagacaatactaggcttagggttttttaaaaaaacttcaagtcaggtataacataacaacctttccagatattagaaaggctgtctcaaatttctttataagctctttgaagaattagcaatgaccatttcctttccattttataagctaaaccttttcactttctattactttctttttttaatgtgttttacaagagtcctttctattattttccactttcatcatctataatatgatgctttcttgactcaaaattatccaacttcctgtggttaatatggacaaaattctgtaaattgtgcacgttattgacttgtagcactcagtgaagagagcaaaccaactgtaccacctggccaatatgcaactcccctgtcctctgccctgacactttagtgcagccctagccaggacaggccccagcccaagagtcctcagtagttacncaaggctcttctgggaatccactggataaatgtgtatcattggtttttctctggcttccctatataattgataaacatagtagtgttatttctaattcaccatttacagaaaaataattgcaatattttaggctgtgtgatataaaaacatattattgacaattgattaaatggtgtatttgtgtcttgttctattaaaaaattaagagtaggttcttagttagaaaagtagtcccctatgactttgagtctcaaatgtattatttaactggtagagcaactgaaaatcataacataagatatgatgaaatattcagatatcaaatttaaattaatttagtactgattgagatcctattttctcattctctacataatgagaatagagaaggtttaagaaaaaatgagggttaagttttagtggagagaatttcagtaattaatttaattttcttcctaaaaatttggaaanggctattgtcattaagtgttaatactgaagtagtgacgctctatggtctcaaatgggaacagagctccaaattcacgatcctgttacaacattgtttatatgcagaaatcaattaaatttatatcgtttacattcaggggctgttaagctgccacaatgctgagaattgcctgtagtaaaatgtctgtagcatgagagagccacatttaaggaaagaaatcagttttactacatacatcatgctctgtcctaatgaatttcaaacacattgaggaattggactagatgccctcagtagtcccttttagccctgaaattttgtgatttcatattaaatgtctttggtcaccggataaccttgcatattgaaaaatgttgcacattttgataagcccagggtgcaagagntctttctgtaagcagccttagagaattgttgttgaattcttcggaaaagtaagtctctagaaaaatctaacgtctgaaaataaaagcagattagagagaggtgagcagcagaaatttacacaccagaatgctaagaaaacattgcagaaaagttctttttaatcttctgataattgcaaagcaagtaggtcactagttgagatagaaacatctttttcaaagcttccttttccagccaggaaaatgtagaaatgtgtcagggatcaaatatatttgcagaatatttactatggaaacttgtagactttgatattttaaaatgcaactgcaataacaggtactttataatcattcaaatgaattatgaacatgtttctaagcagaggccctgccaggcctgatttttatgggtactgggaccctcaattattgctgcagaaaaaacttggcattggtgtctgaaagacttggttttggatttgggcattttgctacttaactagctatgcaagttactagcttaggcacgttaacttaagttttctgtgactttaccgactgtaataatataatagctaccgcatagttgaggatgaaagaaataatatgtgagaaaatacttaaatacaagtttcctttctctttcctctcatctgccatcactgcttctcaccaatggccacactcaggagaaaacacaggcactagtgcccttcgaaagaatttgtactcttaccatccttttatatttttttgttgactcctctaatgtacagcaagtgagtaccatatcaaataaaagaaaattaagttagtaaaattctgaattaacattannnnnnann

SEQ ID NO: 194719 - DNA, 828 bp, Homo sapiens
gatttgtaaaaatataaaatttttatatttatattttgtgtttataaattgtatgccaatttttgtagagatggggttttgccacgttgcccaggctggtctcaaattcctggcctcaagcaatccaccttgcttggcctcccaaagtgctggggttacaggcatgagccactgcacctggccatccatgtaatttgtatgtagggctgatgcacacacctctgtaagtagtgctggggttacaggcgggagccaccatgcctggccatccatgtaatttgtgtgtaggcctgatgcacacacttctgtaagtacagctcaggttaccagcatgagccactgcgcctggccatctatgtaatttgtatgtagggatgatgcatacatctctgtaagtagtgttggggttacaggcatgagctcccgcgcccagccatctgtgtaatttgtacataaatccatgtaatttgtatgtagggctgatgcatacgtccctgtaagttgtgcattatgccttgtaatcagcagcccatagtcattcaaagtctcgccagaggatgggtaaaatgttaaaataattattttaacaaatttgatcatttaatatttaactctgaatgagctgttgactagacaatatttatctaaaaataaatgttaaaagtggcaatagcctgggtgcagtggttcatgcctgtaatccgagcatttttgtgaggccaaggtgggaggatcacttgaggaggccggggattggaggctgtagtgagccataaactcaccactgcattgcagtgtgggacacagagcaagctgaccttgtctcta

SEQ ID NO: 194720 - DNA, 575 bp, Homo sapiens
  misc_feature (20)..(21): n is a, c, g, or t
  misc_feature (26)..(26): n is a, c, g, or t
  misc_feature (381)..(382): n is a, c, g, or t
  misc_feature (386)..(386): n is a, c, g, or t
tagaggatccccaagtaccnnctgcngatttctggacccccagtgcctagtgaagtccctcaaatagtagaccctcaatacatattttctgctgactaaataaaacatctgtgattcatgctttccagtgggttaaccattctccttacaatggtaaagcttatcatggtaaagctttagctcctacttataagtggaggaaaagatggaggcaacataggagcgcatttcggctttctctcatgcgtcggccactgtcttgagttactggcctgatttcttctggtttggactctgaaaatagctttacgggtcctttttgatgtattctgcatttttctttttcttttcttttcttttctctttttttttttttttagnncccncctgcacgggtgggggaagctcatgcccgggggacagacagacacagaaaacttcaacagaattctctatgggtccccagggagagagctgctctttcttctgaagctctgggagctggcccagcccaggacttccttggctcagtctccacctcgacagtggcagaatggcagcctccaaaagaaaac

SEQ ID NO: 194721 - DNA, 426 bp, Homo sapiens
tgattctagagtatcccgctagtgtgcagctctctatagagagttgactccatgatgacccccaccccgagcccttttttatttttttaaagagacaggattggccaggtgcagtggctcatgcctctaatcccagcactttggaaggctgaggtgggtagtttgcttgagcctgggagttcaagaccaacctggcaatatgctgaaaccccatccctacaaaaaaatacaaaaattagctggtcatggtggcgcttgtagtcccagttacttgggaggctgaggtggaaggatcacctaaatccagggaggttcaaggctgtagtgagccttgatcattctgctgccttctagcctgggtgacagagtcagactctggctaaaataacaataaaaaaaagaacgggggttggtgtcagggctcct

SEQ ID NO: 194722 - DNA, 303 bp, Homo sapiens
caggctttcctgcatcaccgttcttaagggctatgctgctggactgacccatcactatctagaaactgtctggaaaagaaaatctcacacaccttggcctggtcttccagatcggagccaatcttccctttagtcattttccctatgcctctttgccctgagaaagctcgagaatctgccaccctctcaccctctccccacagttgaacaaccttcctaatttaggaatcttaaccactttcctaggctaggagggctcttatttcaggacatgaaaatgggatgaaaaaatcagaaagtttt

SEQ ID NO: 194723 - DNA, 453 bp, Homo sapiens
gacatgcccaaggtgcaggaggtatgaatacctccccactgtggctggtaacaccccaggtttctccaactccacagtgatgggctttcctccagagccggttcctcaggggcaggagtgagaagtgtgtgtgtctgtatttatccttccaccagtggctgtgattggtcctgtggttggaaacagggtcaagtaaggcccttgggagtagctgggtgaatggacgatggtggcgtccaccttggacatggcacatacttctggtcgggtatccacgtggctggccaacccggacctgccctattaggggccatcgccctcatggctcatcagtgctgagtttcattgccttcttcgtaatgcaatactaatggatacaggcatgtatctgccgtacactagatgaaatgtggttatttgctcaggtagaaataaagactaaaataccaaagt

SEQ ID NO: 194724 - DNA, 610 bp, Homo sapiens
accgtttctgtaacatttctctcttcaggcaccactcctcccctgcccctctggaagggaagaaaaacactcccaaatacctttacaaaggcacatgtggtgggcagccgacctcttacatgaacactacctcataaagctccaagaccaccgtaagttctaaagcatggtgtttggttatcttaaataatcaaaccaacgaatcagcaaagaacaagagttaaaagagagcagtaaagatcatctagtgcaaccctctaattttacagacaaggaagtccagggaataaatgacttcacaagttactaggttgcagagcttgaatcaaagccataactggaacccaaatctcttgaaatctcagcctacgttcgagagtggcacctagtagagaggtgcacgcttgcattaacacaaatctcataagactgaaatcggcttttctgattggtgagggaaatggctcacattaggaaaagcaaaagtcaatgatactatctcagagttaatgatctgccaaccagaccctaagaaagcttaaaaaataatcggccttaccttaacatggtatcagtgactttgacctaggcacacatctcaatcactggt

SEQ ID NO: 194725 - DNA, 188 bp, Homo sapiens
cgcctaatccttaaacacaactcttgggagattcctgaattctagccacctttgcttatatgggtcttcccacaaaaaaatactatgttgtgatcttcaaggtgacaaaaaagcctttcttgaccattccagcagactcattcattaattcctactaatgaatggggcagtaacatccactgcctgca

SEQ ID NO: 194726 - DNA, 303 bp, Homo sapiens
gggatcctgttgatctgtgaccttgcccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtaatcagggacacaaacactgcggaaggccgcagggtcctctgcctaggaaaaccagagacctttgttcacttgtttatctgctgaccttccctgccaaatccccctctgtgagaaacacccaagaattatcaata

SEQ ID NO: 194727 - DNA, 883 bp, Homo sapiens
ggaacgtggcccagtgtgattccaggcttctagtctccaaaactgtgagagaataaagttgttttaagccaccacatttgtggtaacttattatagtagcatcaggaaattaatgcatgtctattttctttcttttgataatttcatttaaaaatagataggagaaagagggaaaatggtaggaatttttttatttatttttttatttatttttatttatttattcatttatatttggagatggaatctcgctctgtctcccaggctggagtgcaatggcgcaatctcggctcactgcaacctccgcctcctgggttcaagcaattctcctgcctcagcctcccgagtagctgggactgcaggtgtacactgccaagcctggctaattttttgtatttttagtagagatgggatttcaccacgttgctgaggctggtcttgaactcctgagctcaggcaatctgcctgcctcagcctcccaaagtgctggaattacaggcatgagccaccacacctggccagaatgatcatttttaagatgtcaaaatgtattacagaattaacagtgtagaattacttaatcaggaagttaattggaaaagtattaatactataaatgaaaaaacataatagtctaagtacaacaatttatccattcctttagcaatagttggacacttagaatgtaaaactgttcaaacaaattggtatattggagtttgggtagaaagaagggcgttggaagaggaggaaaagagggtgagatgatacattaatataaattactgaaaggtggtgttcacatttagaattttttttttaagttgcatgtttaggattttagtgctcaggaggaaagaaggccagtgttgcccttccagac

SEQ ID NO: 194728 - DNA, 199 bp, Homo sapiens
cttaccctgggctccccacagagtcagagggaaatatgatgaaaaggcactgggatgcagcacatcacagaaagaacaggcccctttcagtcatccattccctcaacacatactaagggcccagcatgaggcttgctacttgaagctgctgcacctatattaaaagtcatattcatcaccatagtggatgctcagcgct

SEQ ID NO: 194729 - DNA, 293 bp, Homo sapiens
ggttatattaatatatgttatagtatatactacattattaggcccaccaaaaaaaaaaggtgtcaaaggttaaaatttttttccaattatttttgttccccaaaatatttttagatttgtgtaatttttttgttttaagtctcctcatcttgattatcatctctaacagcaacttacctcacgtcacttatatactgtcaaatggtaaattgctaattttgctttatttatttattttgagatggagtcttgctctgtctgttgggtgatctcggctcactgcaacctcctcc

SEQ ID NO: 194730 - DNA, 203 bp, Homo sapiens
ctgaaaataaaataaaataaaataaaatacctactgctgcttcagtcagcactaggtctcctctatttttgaaaatggagctctaagctatggtcattatgaggcttagtcagactcctcccatcatttctttatcattaaatcttccctaagcaccaagacaagatagctgggatccccacagacaatgcccctgctctaat

SEQ ID NO: 194731 - DNA, 341 bp, Homo sapiens
atactggcatctactggacagaagtcagggaggccaggatgggaataagcatcctacagagagctgggcacagtggcgcgcacctgtgatcccagctactcaggaggcgaaggcgagaggattgtgtgaggctgtagtgagctatgactgcatctgtaaacagctcctgcactctggcctgggcaacatagtgagaccctgcctcttaaacaaaagaaaacatcctacagtgcacagaccaccacccacccgcagccagaatgtctgccatgccacagcatgccaaggctgggaaaccagggctaaaggagctcatttctgcatttggttcctgcaagggc

SEQ ID NO: 194732 - DNA, 262 bp, Homo sapiens
tccatcctttcatgaaactccttaaagatacaatattctaggattttacaagcttgcaaaatcctagaatattgtatctttaaggattttgcaagcttgtaaatttttagaaattaactcagaattaagcaatttacactggacatgactttaaattgtcatagttagacacaattgacaagaaaattttatttacaggcgtgagccactgcgactggcctctgaagttaatttaataaaacttcataaataaatgtatcaa

SEQ ID NO: 194733 - DNA, 676 bp, Homo sapiens
aaggctggtgtggcagagtcacgagcagtgaggggagagtgcttggagatgaagtcagagaagtggacaaagatgagaacttgtaagactttttggtcatggttagaagttggattttattctaagtgtgatgggaaaccattggagggtttaagcagaggaggatgaagatctgatttatattttagaagaatctatctggttgcttgagaattggttatgggatgggggtgacgggattgcgagcagtcttgcaaatatgagttgggagaagcgaccagctctgaggtatgctagtgggttgacaggatgattaatggagtcagtgtcaagtggtaaagagaacagatgaaataagagtttctgatggcgctgtttcctgagatgtgttctgggacaggagtgggtttggcagaaaggaaatagaaacttctgttttgaatgtgttgaatttgaggggcctgttggaaccaagtggagatgttaagtcggcagatagtttctaccacttgagttcggggaagcagttgtggcctgagatatgattttgagagtctttgatgcatgcatgatattcagagccgtggaatttgttgatcttatctgaggagagagcacagatgaggaaagaagaagcctgtgacccagcccatggggctccccaatgtatagagat

SEQ ID NO: 194734 - DNA, 665 bp, Homo sapiens
aagtgctccacaacactcagtctgaggggaatgctccaggtagtgattgttgccagtgttttgggtggggaggtattatttcccatctgtctacgtgccaacacattattgaaaacaatggatgtgtctgatgcctagaacatgctatgtttgaaagcacttctgtactttttgtacagctctttttgtgtaagcaaagggagacttagaagaactcacagagaattgaatgatgctgctttacccaggccagagggtttctacttcctttgtgtgttttgtcagtgccattagtggtaactggatgtttgaggggaaaccactgaggacacagaggcccatgagctcctgataagccgtgttctttgtggagcaaaccctttgctgtggtagggcctccctgtgtctggagggcatagctgatacttgctgggacacagctttggtcagccccacaagaggtgcccaacaagaggggcagggtctctgctgcaaacctctggatctacatgtggacatctctgcctgctcagacttctatgtggaaaatctaaagcaagaggattattggaaaaggtgtacatttcttttaaacaatttttttattgtagtgttcttttttcttttagcacacatttattagacaaagggataatcctaattaa

SEQ ID NO: 194735 - DNA, 355 bp, Homo sapiens
atgtgctgtatgactttgggtaagtagcttaacgtctctgtctgttaagcctattaatttaaaaatgggactatgaatacccatttcataacatttttgtgataagtaaatcaataagtaaaatgcatttagaatagtgcctggtcatagagatactggctgttattaaatatcttattaaatattcaccaagatataaaaatctgataaaaacctaattgtgacaaaattagattagtacagggatttatctgggacttaatgaggactagaaaatggccatgttaaatgaatctccttaaaactggaattaaaatttgtggatagtgaggattccttgtagtcaaggaatcta

SEQ ID NO: 194736 - DNA, 268 bp, Homo sapiens
tgagacgaccttatctcaaaaaatgaatacataaaaattaaaaaattaaaacctgtgttgacacagattcatattagctagctgaaaagggtacacctatctagagaaaacagctcctttatcatcgaagaaacgcttatgtaacttgtaccatttgtttgacctcttacaacaggaaatctaaaattctcagtagctgatctttgaattttctgctgaagaaccaccactgagcacgtgggctccaatgtgcttaaaaaattatctc

SEQ ID NO: 194737 - DNA, 478 bp, Homo sapiens
gtgccctgacatattgccaattactgctcacactttgagaccattaaggagctccaacaaaaagtaagatgaggccttgagctctggtgtcagtggcatggaaagagagggctgaggattggtgatgggagaattggaggggttgcctggggggatgacagtccatgaatgttcataaagatggattgaaggtgccagaaataaactgtgatgtcaagggcccaaccacttggttctacaaccagttccattcaacaagcatcattgctgatgtctgcaatgagaggactgtgagtgggatatggatttatttcttcacaatccagatcctgccttatttaaggacatgccaccattcactcactagttattgagcaccagcaatgagtgattgcatcgctgggtgctggggagcagacagtgcctacaaaatgaagcctcagctctttagcctggcattcaaggctgccatgttctc

SEQ ID NO: 194738 - DNA, 147 bp, Homo sapiens
aagaggcaaccacatatgtacaatgaaatattttccaactgttttccctggaatcgcaatgctccacagaaacatatgtaaaattcaccatttatggattccatgaatgtttgcctcaaatttcattttttaaactgaaaactcaaa

SEQ ID NO: 194739 - DNA, 498 bp, Homo sapiens
ggctaaaaaaaaaaataaataaaagagagagaaaaaaggaggctgggcacagtggctcatgcttgtaagaccaacacttacaggcagacacaaaaggatcacttgaactcctgacctcaagtgatccacccacctcggcctcccaaagtgctgggattaccagagtgagccacggcacctggcccccaaggacatttagctcagtgtttggttgagtccatccttcttcctccacatgtctgagcaccccacctccatccccctttccctcctggatcctatttttctcccagcccaccatgaagaaaggtcgtttatgccctgggtttgccgcgcaggaatgctaagaatcagaggtatagcccttggctccaagtcacatagccattccagggcaaaatcaaggtgtaaacacagcctcccagttctggaattcttcctgggcttggggcttgcccccacatacccactaactcacctgtctcccattcttcccca

SEQ ID NO: 194740 - DNA, 619 bp, Homo sapiens
atataagacctgaaacagcacaactacgaggaaaaaaaaagtgcaaaagcttcttgacactagtctgggcaatgatgtttgggtatgatactaaaagcacaggcaacaaaagcaaaaacaggcaactgagattgcatcaaactaaagagcttctgcacagcaaaggaaacaatcaatagagtgaaaaggcaacctatggaatgggagaaaatatttgcaaaccacatatttaataagcggttaattcccaaagtatataaggaactcctacaactcaactgcggaaaaaacccaaccaatcaaattaaaatatacgcaaataacctgaagacatttctcgaaagaagacatacacaaggcaaacaaacatatgaaaaggtgctcaacatctttcatcatcagggagatgcacattgaaaccacaaggagatatcacctcatgcttgttaaaatggcttttatcaaaaagacaaaagataacaagtgtctggcaagaatgtggtaaaaagggaagcttggtaccctgctggtgaaaatgtaatgtgttacagccataaatgaaaaagaaaatggaggtttctcaaaaaataagaaatagaactccacataatccagcaat

SEQ ID NO: 194741 - DNA, 369 bp, Homo sapiens
agttggggaaggacgaggcagctgtcatttgcagaacagaatgccagaaaagaagttaagcctagaaaggctccagaaatcctcacagggtgtctttcaatcttttgctaaataataatctatgtatgcatagagtgaaacaacaccaggcaaatttaagaacaattaattccagggggcagaaaaaaggcataagaaaagaacaaaaaacatgggagaaataaaaaacaaatggcaagatggtcaatttaaacctaaccctatcaaaattacatcaagtataaatggtctaagcacttctaattaaaaggcagaaacttcagattggataaaaaagccacacccaaatatataacatccacaagaaaa

SEQ ID NO: 194742 - DNA, 365 bp, Homo sapiens
gaaatcacaggagaagagatatttctccaaagaagctctaaagatggccagtaagcacacgaaatgatgctcaacatcactggccgtcaggaaaatgcaaaccaaaaccacaatgagatgccacttcccacccgccaggacagccacagacactaagaaatggtggcgaggacgtggagaacctggagccctctgcaactgctgcagggaaagcaagatggggcagccaccgtgggggtccagcagttcccccagggtggagaggccgtggctcagcggcagtgtgtaagggaacagggcacaggcaaagcctaaagcgtaatggaataacctggggcttgtggcatctggtgtcacgtaggaaa

SEQ ID NO: 194743 - DNA, 381 bp, Homo sapiens
tctgcaggggatggttcttgaggcaaggcagagcctccacccagtcagtcttcttttggcactgtgcacataaacacgagatacatgagaaagaacaagcaaaagctctctgtaaaacagttatgaagcatactaagaagggaaatccaagtgttgcctacgctagtataaataagcagacagccttgatttaagagcataagtagttgtattttaaagatgagaaaaacacaagttctgcaggcacctaccgctgtctactaaaagctatcgctatcagacctagcattgaacacacaaagcaatttgcaagaaaggaaaaatttgccttgatataagcgctgagcattacacctgccatcacgagtcaccattcgagat

SEQ ID NO: 194744 - DNA, 620 bp, Homo sapiens
cactggaaaagcagtatgtatcaagaaccatgtaattaaaaactacattttagtatacacctggatacataagatacacttgatttttcatgtatttctcacaggaatttgatacttctcactgtgaatactggttaagtatcccttgtccaaaatgcatgggaccagaagtgtttcatatttcagatattttcagattttggaatatttgcattatatctactggagttcagcatccctaatccaaaatgctccaatgtgcagttcctttaagcaccatgtcagcactcaaaaagttttagattttggagcatttcagattagggatactctagctctgtcacctttcccatttttcatataaggaaactgagggtcagaggtgaagtccttttcctagatgtcccacaaactattaagtagaaatgccaagagttaaatccctcgagtgctacataatgatgtttctgtcaacaatgaactgcatatacaatagtcccataagattataatggagctaaaacattcctctcctactgacgtggtagccattctaagagcacagtgcgatgcatttctcatgagtttgtggtgatgctggaataaacaaacctactaag

SEQ ID NO: 194745 - DNA, 379 bp, Homo sapiens
tcattcatcttctccttcaaaatgctgacacaagcagagaagtgaatgaacaaaaactcactgtttgtatttattcatgtttccaagtgattcatgtttagttatcctttccttgaatcaccattcattaaaagtggtttggtcttctttatgcctatcttctctgtttgtgataatctttctattctttgggattcaggtcaatttactaagaaaaactcatgattaaatatcttgaagaaagcagacatgggctgggtgctatggcacacacctgtaatcccagcagtttgggaggctgaggtggaaagattacttgagcccaggagtttcagactggcctgggcaacagagcaagaccctgtctctacaaataaat

SEQ ID NO: 194746 - DNA, 591 bp, Homo sapiens
tactcattgatcctttgtcatacattggatttttgaaatttgctccatttctaaaaacacaatattctaggtgctgtctactttaaaatattgcacctatctctttttttgagacaaggtctcattatgttacctaggctggtcctgaactctttagtgcaagtgatgcccctgcctaagcctcccaagtagctgggactaccagcgtactcccatgaccagttaaaaactgcctctcgtgatttaaacaacatacttctttcattctgagatgccactcattcgtcagtttttattgttttcataggcagccatatgttatttcaagaaaatatttgataatgagtatactaagtttaatataacaattttctttgatttcatttgggtaggatatttctaatacttaaaactcaacttgattataatttttttttttttttgtcacccagactggagtgtaatgacacaactgcagctcactgaagcctcaatctcccaggctcaagtggtccctccagagtagctgggactacaggcgcatcaccatgcccagctagttcttgtatttttttgtagagatggggtttc

SEQ ID NO: 194747 - DNA, 267 bp, Homo sapiens
aggacaggatgaatgtatgagaatcatcttcttactgagaatggtaggacagaagggatagtttagccactatacttcctggaagaatcagtacttgagggttgctgcagctttttgggattgaaggagtatgttcatttcctttggaagattaattttttccttttttttgacatggagtctctctctgtcgcccaggtggaggttgcagtgagctgagattgtgccactactccagcctgggtgacagagcaagactccatctca

SEQ ID NO: 194748 - DNA, 189 bp, Homo sapiens
atgatagtcccaaagtaattcaatgaatcctaattgatgttttacaagaaaagcaaattctcatctacataaaggttaatagattgatgcccaaataaccatagataggtgagttatttaaatttccactttaggccaggcgcggtggctcacgcctgtaatcccagcactttgggaggccgaggcagg

SEQ ID NO: 194749 - DNA, 1035 bp, Homo sapiens
tacccgccaccacgcctggctaattttttgtaattttagtagagacggggtttcaccgtgttagccaggatgggtctcgatatcctgacctcgtgatccgcccgcctcggcctcccaaagtgctgggattacaggcgtgagccactgcacccggcctacaactagcccttaattccctctccagccacctctctctagtctctggccaaatcccttactttagccaaatcagtccattcatttttcccaaacatctggccctctgccttcacctcctttctcacttgtttaaaaatcccactccaagatctagctcaagtttcacctcctccacaaagctgcctgtgccctctgcaactacaaggacttttatagtttttccccacgttggctcctttagctctgttagcacaactcatttaacacctcccactcattcccttgtattgctatatatcttgtttattcgtgtaatatttaatattaaaaattatttttataacctgagaagtaacatctgagcaggaaaaaaattataaccaaagtaatttctattgtaaaagatccaaacaatacaaaaatatacagagcaacatgtgggacattgcccttactcttctctctcccatgcccaaacgtaaccatcctcagctatttgatgtgcatccttctagttccttttttaaatgtatgtgctgacacatgtttgtggaggggttaaaatataaatgggctcatatcacatctgttattctgctacttgcttttttacttagggtatatatacatttgtcttagagattttctatattagtgtaattagatctccttttaatggcttctcagtatttcatagtataatttcttcaaagtaaaacatactgtctagaatctattatttggaggctatcgtgtagctagtacttagctccagacatgattgcaaccttgaccttgccatcagttagctggctctttgggggagataggaagggaggaatggggcatacacaaataactgcaacaaaaggaaaa

SEQ ID NO: 194750 - DNA, 944 bp, Homo sapiens
gagatagggaggaagtcataggtagtagcaggtggattaccaggcgtgagccactgcacccggcctacaactagcccttaattccctctccagccacctctctctagtctctggccaaatcccttactttagccaaatcagtccattcatttttcccaaacatctggccctctgccttcacctcctttctcacttgtttaaaaatcccactccaagatctagctcaagtttcacctcctccacaaagctgcctgtgccctctgcaactacaaggacttttatagtttttccccacgttggctcctttagctctgttagcacaactcatttaacacctcccactcattcccttgtattgctatatatcttgtttattcgtgtaatatttaatattaaaaattatttttataacctgagaagtaacatctgagcaggaaaaaaattataaccaaagtaatttctattgtaaaagatccaaacaatacaaaaatatacagagcaacatgtgggacattgcccttactcttctctctcccatgcccaaacgtaaccatcctcagctatttgatgtgcatccttctagttccttttttaaatgtatgtgctgacacatgtttgtggaggggttaaaatataaatgggctcatatcacatctgttattctgctacttgcttttttacttagggtatatatacatttgtcttagagattttctatattagtgtaattagatctccttttaatggcttctcagtatttcatagtataatttcttcaaagtaaaacatactgtctagaatctattatttggaggctatcgtgtagctagtacttagctccagacatgattgcaaccttgaccttgccatcagttagctggctctttgggggagataggaagggaggaatggggcatacacaaataactgcaacaaaaggaaaa

SEQ ID NO: 194751 - DNA, 339 bp, Homo sapiens
ttgtgagatgaagtgagataatccacaatcagggttaagacagtgcacttgttatgcagtaaatattcaagacattagctactattcaggtttataatcttttatccaaaacacaagggataatacagctttcagaatttcaaattttacagatttagaaagataatataggggctggcgtaatgcactataatcaaagttactataatcaaagtctgcatcaaaatatatgaatgtttacagtaaggaggataaataactagtataaacagccttatgtcagctcaggacagattttgccatgcaaagagatctggcaccgagttatgaaaaaacttt

SEQ ID NO: 194752 - DNA, 437 bp, Homo sapiens
atgcagatctgaaccaagctgagattagggtacacactctcctctactgaaaagtagctagagattccaactaggtgagaagaagagtggggcagaggcagaccagacaaggactgatcacctggaaaaagccggtcatcaaaggtcttggcaaatgctgggtgcagtggctcactcctgtaatcccagcactttggggggctgagacaggtggactacttgaggcaaggagttcgagtccagcctgggcaacatggcaaaaccccatctctactagaaatacaaaaattagctaggcatgctacactcctgtaatcccagctactcaggaggctgaggcaggagaaatcacttgaactggggaggcagaggtcgaagtgagctgagattgtgcccctgcactccagtctgggagacagagtgaaactgggcctcaa

SEQ ID NO: 194753 - DNA, 245 bp, Homo sapiens
gtcatataattcttatattttaaatataaatcgaaccaactaaatttaccgctatatttttttctacatattcttttttcaattttcattttgaaaaaattcagacctatgtaaaagttgagagtagaacaaagatacttggtactcatccctcaggttcatttattgttaatatttcaccatatttacttcatctctgtatacacacacacttttttgtatgattaaatcatttgaaattaaat

SEQ ID NO: 194754 - DNA, 472 bp, Homo sapiens
aaaacaaatgatctcaatacctctcaacgtgggcacacatctgtaatacacttttattgtgcaactttaaatgtgtgtgcctttctccattaattgactgtagtttaatatttttaatagtgctctgtgtaaagatgatgcagtttgtgagtcagatttcatactgagcttaatatactcaaaacctaagcttccagtggtattacttgtgatttttttatgagatagagaattacatgaaattctagtaatccagtttccacacaaaattatttcaataagcacatatccaagcaatttgtacagaccttgtttaaagcactgcttcttatagggctcaattggcagtctcaggagcttgggatgctaccaacagggcatttaggttttcatttttatgaaacaaaaggcaatctggaaatagctaaatttattttaaggattttattcactgatgtcccgtcaaactaaa

SEQ ID NO: 194755 - DNA, 710 bp, Homo sapiens
aatgtaataggtaaacgtcacctatacctgggttggaaaaggctgctctatcagtaggaagcatagggaagacctgaactggttttaagtgatgacaagttcagtataagcagtgggaagctgccgcagtaggaagacagtgtaatccgagcacgcttcagtcggggttgaggatttctacagtagctggcggcatcagaccccatctgaagtagtgtgcccgcggaaacctatccggacatcaagaggcctttcagcaatactgatctagggaaccactgaagaaagggaggatttttggctcgcaaaatagattacagtgagagggtgtaaagatttccaaataaatgcctggctgtcaatggcagtttctcaaaaagatcaaagtagatgttccagggaagggagacgttaagcacaggcagtttccagggtgatgcgtttccctggaagccggactggaccccagggctccagcgcaggtggagaggttgggcctcgccaaaagagatcctgggaaacttccaggacttccaggagccccgagggctcgagcgttcacatacgcgccccgccccggggcggcccgggcagagagactggcgcggtctctcctggcgcccttcggccatcgcgcgccgccgtccccgggcccccggaccctgggcgcccagcctgcgcgggacacacccaggcgccgcctcccaggg

SEQ ID NO: 194756 - DNA, 254 bp, Homo sapiens
tgtaggcaactggaacacaatggtaagtatttgtgcatccaaacatagacaaggtacagtcaaacatatggtataaagggtgaatgatggtatgcccatgcagggcactcaccatgaatggagcttgcgggactggaagttgccctgggtgagtgagtgagtggtgagtgagtgtcgaggccaaaggcatgagtgtacaccactgtaaactttagaaacactgcatgcttaggctacactacattttctaaaga

SEQ ID NO: 194757 - DNA, 434 bp, Homo sapiens
ttacaaacaaaatgtgagatagaagctcatcttttgaggacaaaataattctacaaataagataatagtcatctagattaaatttgtcaatttacagatataaaaactgacatgacatgagatggtttaagtgtcaaacataagggtctttggctaggcgccatggttcacgcctgtaatcccagcactttgggaggtggaggtggatggatcatctgaagtcaggagtttgagaccagcctagctaacatggtgatacaccatctctactaaaaatatgaaaattagccaggcatggtggcaaactcctgtagtcccagctactaaggaggccgatgcaggaggatcgcttgaacctgggaggcagaggttgtagtaagccgagattgtgccactgcactgcagcctgggtgacagagtgagactctgtctca

SEQ ID NO: 194758 - DNA, 255 bp, Homo sapiens
attctggtcttttaaagacactgacaggaaaatatagttatatagctaatatgggggagggagtggtatggattgaatgtttgtgtcctctctaaaattcatgttaaaactaaatttccaatgcagcagcattaagaggtgcggcctttaagagatgacttggccatgctggctctgccttcatcaataaattcctgccttagaaaagtcttgagagcgtgagtttacctctactgtcccttccaccttgggagg

SEQ ID NO: 194759 - DNA, 518 bp, Homo sapiens
tgtgcatgtgtggggacaggggaaatatgggaactctctgtacttttcacgcaatttttctgtgaacctaaaacagctctaaactattaagtctattgaaaacaacagcaacaaccaagccatggcaggaggaagacttccttggcctaacagagggtattttcagaagtcagatacttgggccttaccccaaatctactgaatcatttctgcaggaataggacgcagaaataagtatttttggctagacacagtggctcactcttgtaatcccagcactttggaaggccgaggtgagtggatcacctgaggtcagaagttcgagaccagtgaagccaacatagtgaaaccctatctctactaaaaatacaaaaatcagctgggcttggtggcatgcacctgtaatcccagctactccagaagctgagatgagaggatgactggagcccaggtttgcggttacattgagctatgaaagcacactgcatccagcctgggtgacagagcgagaactgtct

SEQ ID NO: 194760 - DNA, 597 bp, Homo sapiens
  misc_feature (19)..(19): n is a, c, g, or t
taccgaggtgatacctaancattcaaatatccacatatgacacgttttgtggtttcccagatatagccttaatactgtaccaagggatggtggtttccctttcttgccaccaaaccacatttcagtcaaagctcctttaatcttttaaatagtttcccacagataccctttttcttttctctgatagaatggggcattggtcttgcatttagaacaatatacagtgcactttaaatgcttcaggccttgaaaagaattattcccaaaggcctatcacagtttacctgagggaaaatgtacaaaacaggcactattcacatatccattatgctactggttagacaggaagaatgaggaagttttccaatagcggtatcatcttgtggacatcatcatgagcttcatatacccattaacaatgcggagattgcaccagcaacacatgaggccctggccaactgtggtattttaagatcaaactgtaggaaaagtaaatacttactgtagaaaaatgtccaccacttatttagtctactgatagcatttcctgcaagagagaattgtgtatttattcgtggatatttgaatggttaatga

SEQ ID NO: 194761 - DNA, 701 bp, Homo sapiens
tcaatattttaagaatcacaatgttactaccattattcgtctgaataaaaggatacatgatgccaaacgctttacggatgctggcttcgatcaccatgatcttttctttgcagatggcagcacccctactgatgccattgtcaaaagatttctggatatctgtgaaaatgctgagggtgccattgcagtacattgtaaagctggccttggtcgcacaggcactctgatagcctgctacatcatgaagcattacaggatgacagcagccgagaccattgcgtgggtaaggatctgcagacctggcttggtgatcgggcctccgcagcagtttttggtgatgaagcaaacaagcctctggctggaaggggactattttcgtcagaagttaaaggggcaggagaatggacaacacagagcagccttctccaaacttctctctggtgttgatgacatttccataaatggggtcgagaatcaagaccagcaagaacccaaaccttacggtgatgacgacgaaatcaatggagtgacacaaggtgatagaagtcgggccctgaaaaggcaaagacaatcaaaaacaaacgatattcttctcccatctcccctggctgtgctgacctttacactgtgtagtgttgtcatctggtggattgtttgtgactacattcttcccatcctgctatcctgactcgaagatttca

SEQ ID NO: 194762 - DNA, 533 bp, Homo sapiens
gccacaggtggttcttttacacatgcctgtcccggtagtgtccccgtctcccttggcccctgggtacattcattcacctttatcctccagggtttagcctcgtggtccccaggtgtcctgagcctgtgcttttcgctacctggctgtgccgatcacgagcccccagccaggattttgcctgtgtcatgtgtgtttgtgccactcagcatttccctctcacttgtgttgcacatgtgtgcctgcctgtgtgtgcatttgggtcgcccatcttccacctggatcagcccttaccccgcttgaactccgtaataggtgagggttcacttctcatgtttacccctccctccgcctccactcacctgcaggagagaaataccttctaatgggtgtggacactggaggaactgttacattaaaagtgcataagaggcctggcatggtggctcacgcctgtaatcccagcactttgggaggtcgaggtgggaggatcacttgagcccaagagttcaagaccagcttgggcaaaaatccca

SEQ ID NO: 194763 - DNA, 252 bp, Homo sapiens
cctttgggaacctgacagaggtggaggggcaggtgtccgggctttgagctgaaggcagtcagtgcatctgctttctatcttcacatcagactcgttccccatcctgtagagaggaggttcctcaacctccctaatcactggtgctgtcgggctgccttcatcctgtaacctcaacctcctgggtgtcaggttgtgattccatatccccaggctgtcccaggagcgaagggtgggtgctgaaggcagctggtg

SEQ ID NO: 194764 - DNA, 279 bp, Homo sapiens
gcagtctgatctttgccgggtaacaattcttctctctcctttccctgtgtctttccagcagaggctctgcctgccttttttcccaactatctttccaagaacatgcacaggaaacagccttggatgatggagatagcatctccctccagagcacagggcaaatgtgctttgtgcccactgtagaagatttggttcctaagcttagggttcctctcctgcaatgcagcccttgatgtgtgcggatgccatggggccctgactacatcacagctatgggca

SEQ ID NO: 194765 - DNA, 204 bp, Homo sapiens
cttttgggttagttaaagggttgatgctctaaaaatagcatttcctaaactacctggagatcctcattgttatgaatgagaacagcagtgattgcttaaaatataacatcatgattccagctatttaacgggactataaacttttgcattgtttctggatttctaaatatacaaacttagttgggtattacataaaacaatcac

SEQ ID NO: 194766 - DNA, 158 bp, Homo sapiens
agcaatcagaaggatagaatacatgggttttaagggggatggggggagtaaaatgggagatcgaacatggggcaggaagccttttcatatgagtccacagcccccaccaccatggaagggagaaagtatcatgggttggtatgataacggcatgccta

SEQ ID NO: 194767 - DNA, 444 bp, Homo sapiens
cagtcatgtaatcactgcagcctcaaactcttgagctcagcaatcctcccactttggccttctaagtagctgggacttcaggtgtgtgccattacacctaactaatttttattgtttttttttctagagacagaatcttgctctattgcccaggctcacgtgattctcccaactcagcctcccaaaatgctgggattacaggtgtgagccacgcacccagcctctttttttcttttatcactcctcaactgaggagaatgttttgttttaaacatatgtttaggaaaaaagtgattacaaatcagattttggaaactattgagctgtgtatgaatggattcaggtacagtaaatcacaaatcccaaaaccatgtagagagtatgagaacttccttgaatgactagctccttagacaacacagctgttctatctccaatattata

SEQ ID NO: 194768 - DNA, 1074 bp, Homo sapiens
ccctgcttcggctcgcgcacggtgcgcgcacccactgacctgcgcccactgtctggcactccctagtgagatgaacccggtacctcagatggaaatgcagaaatcacccgtcttctgcgtcgctcacgctgggagctgtagaccggagctgttcctattcggccatcttggctcctccccccgagattgataaatccaagaaaatagagaagatcaaaagaagatacatagctgaaaacacttgaaggtatagactaccttgaaagtcacgcaagaactgttcttcctgctttccatatccaaggttctcactctgttgcctaggctggagtatagtgacccaatcactgctcactgcagcattgacctcctgggctcaagcaatcctcacacctgagcctcccaagaggctgggactacagaacccaaattgcctcacagatgtctgcacagatcacagcaggtgttaaggagcagaaagctctctgggaaatgagagtccccttcttgctacagggacactgaagcacaaggaagaccactgtccccaaaagccaggatccatttctacctgtagcaccactggcagcacctgctgttggaaagatcttcttccacaatttctgagaactgtgctctaccatgccattacagggactcactgaatactaaaactctcaattgttcatggatcaaaagtaaatgaataggacactgtaacctaaaggcaaggataagaaaactgggatttaaatgtgctgggactgtaaaaacaaaaatgctaaggagtaaagctttacctagtaatgaaaataaaccaggagaaagagcaccacaccagagcttagaaagcttctgttctttcctgctctccccagttgttccctgaagaccaggccatgtcttcctcataattgcatattactgtgcctggcacatactagaaagctatttaaaattatgtacttgttagcatattgacatgataatatgttcacaatgtatcatagtgagttataacagcagtatgggcagtgtgtatacatttctgtaaagaagactggaaactgataa

SEQ ID NO: 194769 - DNA, 345 bp, Homo sapiens
ccctgcttcggctcgcgcacggtgcgcgcacccactgacctgcgcccactgtctggcactccctagtgagatgaacccggtacctcagatggaaatgcagaaatcacccgtcttctgcgtcgctcacgctgggagctgtagaccggagctgttcctattcggccatcttggctcctccccccgagattgataaatccaagaaaatagagaagatcaaaagaagatacatagctgaaaacacttgaaggtatagactaccttgaaagtcacgcaagaactgttcttcctgctttccatatccaagattcttggccgatcgcccaggctggaatgcagtggtgtgat

SEQ ID NO: 194770 - DNA, 310 bp, Homo sapiens
ggtatggggtagagacagagaatttgtactttctaacaagtttccaggccatgtgggtgttgctggtacagggaccacactttgagaatcactgatctagagctctgcactctattttcagaatccaaagcacctaatacagaatatatggttgttttaaaagttccagagagcagttataaactgaactcatgcttgatcccagctaccactgttagttggttaatgtatttttaccacctcacaacatattctgttgcagtaattcttaactttggaaaattttaaatccttcgtccagaaatactgg

SEQ ID NO: 194771 - DNA, 345 bp, Homo sapiens
aggagggcaggtgacaggcggggaggcttgggaggaagaagcctccctgggctgaccacagagggttctgcatgccttgttggtgagtgtgagcctcgcctggggtcagaagtcatagaaggttatgagcaagggagtggcttgactactctgtgtcaagaagcctaagggggcagcagagagtgacgtggctcatggtgggatagtccggggtgaggagaaggaaccccagaggagtttctcaatggttgggtcaaaagagagtgaggacccaaaaccaaggccacagaaggaagaagaaaggacagtgaacatggagctgggtcagcagggcccgggctgcgg

SEQ ID NO: 194772 - DNA, 284 bp, Homo sapiens
tcatcggctcatttcagttttcaggatttccatatgtctgaacaaggttaacagcagaggggaaaaaacctgatatattgtctctgccattgaaatatggggtcaggtacatatatttttgtaatttacaaggtcagccacagtactgatttatagcctttctaagtcaatgagtgtcttagtaataagactctaaaatacctcttcacttctcctgagcacccatcaagtctgtctgccaactcagttttcagtgaactgaaatgagctaagtcctgtaggtg

SEQ ID NO: 194773 - DNA, 301 bp, Homo sapiens
ctctggagaaaatggagaaactctgaagggttttaagtacctttcctgaagctgcagactccataacctctctttacaaagagctcctgcagctcctacagaaatgagtggctgagattcttgattgcatagcagagcttctcatccaaaccctttccctttttagtgtctgtgtatcagtataaaagttctataaactgtagttacttattttaatcccaaagcacagtaacaatatatttcatcctagggttggcagtttctctaagtgttttgtttaattatcatgataatatctgca

SEQ ID NO: 194774 - DNA, 353 bp, Homo sapiens
agacatcgacgaacacgtggatacacaccacacacatttatacatatgcaccatgccctcacacatacacatatgtgcatacacacatatacacatataccatacactcacacatatcacacacaacacatgcatacatgcacacattcacacacacataacaccatgccttcacacatactacacactcgcatacaccacacatacatatacacaacacgtgcatacacgctgcacacacattgttccatattttccatttaattggccccagtatgagccttcattgttcattcattcagcaaacgtcccctgagtgctagcccagggctccacgaggactggggcctggc

SEQ ID NO: 194775 - DNA, 486 bp, Homo sapiens
ggcattgccacagactccctcatatatagatacacacaaacacaaatcctgatctctgacaccatctcgagcaggaaagttgcaaagcttcccaattccgcttcatcctctggaacctcgctggcggttccagacttcagaaagttcttaatgatgaatccttggcttctagcctccttctttccccaccactccccaggctgagatcatccagccctgagctctgcacctgccatgtgccttctgggatacccacttggaaccatatattccatgagttaatggtgtcactatcacctcctcttctatatcaataattttaccttaatcttctcatttactacttcactaaaaagggacctaaaaaaacaactagtcttctctgccttcccctacttttttattggtgttgtcgaagttgcagaaactgagatcacagaggaaacgggatgtagctaggatcacacagttaggcagagtcaggac

SEQ ID NO: 194776 - DNA, 212 bp, Homo sapiens
tgtagacaatcctactcaaggtaaatgcaaccagaaacaaaggacattgcccctaacaaggacttgggccagaattccattgttcggccttcttgccaagggctgagacatgctttctgtcagtatcattgaagtatgatggatggttcgtgctagtctaagaggagcaatatctcacgtcgctggagtgtctagggacaagaatgctttta

SEQ ID NO: 194777 - DNA, 366 bp, Homo sapiens
tgttcaagtgattctcccacctcaacctcccaagtagctgggactacaggcacatgccaccatgctcggctaatttttttattttttttaatagagacggggtttcaccatgttggccaggctggtctcgaaatcctgacctcaggtgatccacctacctcggcctcccaaagtgctgggattacaggcatgagccaccgcacctggccagatgctgttggttctaaatggcactttgaggtgttctaatatgaatcagatattagaaattatttagtcatagcagctcttgtttgtgtgttcatcttttcttgtctatatctttgtagattgtacaaaactgaagcataactatggggataattg

SEQ ID NO: 194778 - DNA, 430 bp, Homo sapiens
ctgacatctcagttgggtttagtgtcgaaattaattcagggctttttcaccattgctaatgaataatccgtgtgccaaggaaatgacttcgtgaaccccagtgagacttttaaccaagctgagatcaggcctgcaaacttcttcaatttgtcagttttcacaaagcccttttcagtagtgtgtctgtcagaaggccttatgttccccgcctcccaaaactgtaaaaggacaagaaatgtgagtgtcattgctggccacgctgtcttccctggggttccggagagtgggggattgggtgcatgccggggtgttcataggttaggaattgtgccagatcttcagggtcgttccactcacctgtcacaactgacctttgccgcactggcaccagcccttggcgagaaacaagccctttcatttgtgtggtaaa

SEQ ID NO: 194779 - DNA, 325 bp, Homo sapiens
  misc_feature (37)..(37): n is a, c, g, or t
cggactctatcgcgacgctccatcaaccctagctacnagtgctaggattacaggcatgaaccactgtgcctgcctgcttttcatttttaatcctgggttctaaaatgcaagaattaatttccaaataattagtatggaatggaatcccactttttcctgtgtgctgagagaatgatcaaagatcacagaaaagagatggagacagaagaagctgagagcaagggcatctttaaggatttcttcagtcttgttaatctgggtgtaaattctgtgtggctgacagcctctgaggatcccttgaagttttgatggaagcgtcgcgcat

SEQ ID NO: 194780 - DNA, 145 bp, Homo sapiens
tgttttagagacacttagagtttattagaagtcgatgataaacaggtagttatagtacatgttagaatggaatattcagagaactataggattataaaatacgtgctcatttaacccatatgtggcagctaagttaactcatgaa

SEQ ID NO: 194781 - DNA, 112 bp, Homo sapiens
atatgaatatacatgtcaagactataatgtttgagattttctattgcttatttcattagtttctttctggacctattccatctgggctagcagctctgaaaacaaagtagtg

SEQ ID NO: 194782 - DNA, 663 bp, Homo sapiens
taaatacatatcaacctgaaatagtcagtttacaacacaggttgatgagcaacaaatcattgcctgccacataattcatagtctataaatatttgtcaagtggatgaataaagcctatcctcatcaaataatgggttctgtggatttaagacttgcagaatgaaggtgtaagaatctggatggaccttttccccagaaaaaccatttaacaagtgaaaattacagatgacaatcatttaagtctctgaaaattgtcccaaaggcatgcagcaaatggagaaagagtcattcaagaaaaacctattaaattatggtaaagacagtgagagtctgtggcatttgagccagaatgcatccctttacccctacccagagcttcatgctagagtagctctactccaggcaggtgaagccaagaaggctgtggctgcctctccacccagtccttagcctggagctgcagtttcacccagagagggtcaggctgccatttcttatcttccccagttccatgctgcagaagctctattttaagcaggcatggccagaaggattgagtttccaaccccgacccagccctgactcacaggatggaagctttattccaggtgcaaaggctgagaacactggagcccttttgctcccacctcaacttgccagtag

SEQ ID NO: 194783 - DNA, 384 bp, Homo sapiens
aaaaaaggtggatgagggacaaggtggtgcaataagaaactagagaaatagccagaatttgtatcatgcggggccttgaagaagatgttgtagatcacaaagttattctaagagcaatggaaagctaccaaggggtttggggcaggaagtgacatgccccagtttgtatttttaaaatgatccaagttgaacttgtacctctggccatgatggaggaactggtactagaaatgatctcccattgaaaacaatcataaaactggaaaaacaatttgtagaaatcattttcaggtattgaacagcaaacagtgcaaacttacaatctttgagagaagggaaatgcgtgaagcaattactacacaattgtccagccttttctctgca

SEQ ID NO: 194784 - DNA, 371 bp, Homo sapiens
aatcctataacgtggtctttcgtgtctggctcctttcacttagcatattgttttcaaggtcatccatgttttagcgtgtatcctatttatttaatttgttaactgttaaaatatctatcccaatttgactcaaaagtttgctttaaatcaaaagtaggcgttcagtttcaacttttcagcatctgttgagaatatcaggcgttttttttttggacctattaattggggccattattgggctccatccttgaattctagagtacccatactgtgccaaggtctgtggtgtgtgtgtgtgtggtgtgtacatgtacatggatgtgctttttttttttttttttttacatgacggatcatatttgcggatactt

SEQ ID NO: 194785 - DNA, 301 bp, Homo sapiens
attttatgttttcttattatattcttcactaaatgtgtgatgaacaaaagttatttaaaataaaacaaactgctgttaaaattgggatgtaaaaattgagtttatatttaaggtccataaaaatatggtgatagacttgcgatgatacacctacagttttctctcaccagaagcacattttcttgcgtttgtaaaatgttggctagagttaacggtgtgactggtaactgcagaacagcttctgggtgtaagatttaaccaatagttaatgcacagagctaactttcctaagtgaatggcc

SEQ ID NO: 194786 - DNA, 333 bp, Homo sapiens
ggcggtcggagggtaccggtgctggtgttatggatgttgcgttattatagttctgcgagaagattgtgggatgaacgagtagttatttaaaataaaacaaactgctgttaaaattgggatgtaaaaattgagtttatatttaaggtccataaaaatatggtgatagacttgcgatgatacacctacagttttctctcaccagaagcacattttcttgcgtttgtaaaatgttggctagagttaacggtgtgactggtaactgcagaacagcttctgggtgtaagatttaaccaatagttaatgcacagagctaactttcctaagtgaatggcc

SEQ ID NO: 194787 - DNA, 724 bp, Homo sapiens
caaaaagctgtaataaagcaaatcatactaacccctagaattgtcattttcaataatgtatctagtttaaataatcataaatgtccacaaaaatttagctacaaatgaggtcattatataatggtattatttttaatagtgaaaaatcactagcaacctaaaaatctggcaggaaatgattagttatattacattcataaagcagaatattatgattgctttaaaacagctgtatagaagaatacttaataacctggatatgatctgtagctgattgaaaaaagcaagctctgagaggacatgtagtatgtggtccaattttttgtttcaaaacaaagcaaaaaccatatgcagaagggaaaaattgaaattattatagtctctggacagtgagattatgggtgatttttttttttcttctacctacctgattttcagattttctatagtgaaaacagtaataaggaaaaagacagaacaagttattttttaaattaagaaaatggaacagattttgtttctgtggaaaaagactagattgaaagttctcatagatgcctcaaggaagtccatttgtgtcactgatatttccttagcatttagcaatattggctagtcagtcaaacactaagagtaaaagtaaaacagtgttgacacctttttgtcatttcagtcttatatctgttagaacaagggtggtcatttttctggttttgaacatacc

SEQ ID NO: 194788 - DNA, 297 bp, Homo sapiens
tctatttttcacccataaaatggtgcaattctgccttgcttaccccgtaaggttatagagttataaggatcaaagctactacaatataataacaatgaggaggaggaggaggaggcgaagacaaggctttcttgaccttgctgacctacagacctgtgactggtgcccaaggacgaactccgctgtggatggcagccaggaccagggcaggttcctgatgcagatggctgtctgatcccagccagtcctggagcaccggtgccctgtgccctcattcccgaagctggttcccctggg

SEQ ID NO: 194789 - DNA, 346 bp, Homo sapiens
taaacacccacagtacccttttgattatgctacacctctgtttaaacctatgaccacctccctcactctatctttgcctacagagtaaataaaccccaagctccatagtctggccttcaggacttttcataatctagctctagctgacctttccaatgctgtacatagataaggacatattttggccaaactggactgcttaatttcctcaaacctgccctgagctttcctgcttctgaacatttgtaccatttaagccgaaattcatttcaggccatcaatgctcattgagtgatttctgtagaaaactataggatctagcaggttgaaaaagtctttctttagg

SEQ ID NO: 194790 - DNA, 457 bp, Homo sapiens
ttctagaggatcccttcgattgcgggcacttacttgatcctactgctcaggactgtcccaattttaaaactgaaagtcctgtgttctagaacctctagttttaaacaaacctggacaactgcccatcctagcttctgggcacatcaaaacttcccagctgggaaagaattttcaaattatctagtaaattacctaattttactgatgggaaaagtgaagaatcctaaatcttcagagtgtaaaaggaagttccacgccattcagtgctctagttcaactgcggaattcacggactaatcctctacagatcttgctggagtggcctttcagccttttgtgactgtttgtagtgaaatgtacacacaagcctacaaggcagcccagatgtaccataactgtgggaaaattaaaaaaaaaaaacacagaacctctctaagttgcccgccaatcaaactct

SEQ ID NO: 194791 - DNA, 1138 bp, Homo sapiens
caggggtcttttcccctcaaacctccgttgtcaccaccaccgtcttctccacatcttcccccatgtcatccccaaagcaacaggaacagttccaaaaacaacccaccaaaggactctatttttgagttatctccccttgtggatctcagtgtttcctccaggtgtgttcacccagagcagctctctaggatctgagacagattccagcccaggccatgtaaagactttagatcctagcctaggttacacgtgtatacccggaatggatatgtacctgactgttgtagactttgaacagtagtcaggcttccaaggtgaaaccacagaagtccaacacacatgacctcatttctcacacttggataaacaagactagagtccacttaaaagcattcacgatcactgtatcttactgcatctcacgcgggccactgtcttcactggagaacatcatcatactgggcagccagagaagttcttcaagtcatttccccgacaagcagctttggaaacacctgaaaatttgcaacaaagcagaccagactgctgagtgagtaacatgaaggagaggcccagcaacccgttatcctacagccctccaggtggttctggtccattctacgtgcagcagcctctgcagtacctgagccgtagtttatcctgagttaacatagtcatactaggaatacgccatacacatgtggtaactttagagctggactcaaaactccaaaaatgtatgaacaaaaataggtctgaccgactccacagcctttattggtttcttgctctttcccatcttccttcactgcttccttctgttcctgggatcacctttcaagtaaatcacttgcttttatgtgttgcatcatcatcatgcaaattaaagcaccacaatttattgaacattttatcaaaatgtaaaaccttacaaaagattaacaggttatgtttgattatgggattgaatattacattctcactgttgtgtttgataattttcattacaaagtcataagtaatcaaatgattagacagctgtttaattatacctctaaagaataagcattccatttgcttacataattattgtgactctgggatgaatgtattctgaatttgaggggaaagaaccctg

SEQ ID NO: 194792 - DNA, 270 bp, Homo sapiens
ccttcttcaaggttcaaaggtttattaggtagcattttggctgcctgttgtctcccatagctaccttttcaccgaatgcccccacaccagccacagtgaaataaaaagcctagttcttccctagaaaataaagtagtgagtctgaagcgaggactgtatccaggcacattacatatgttcatgagacagctgcagatcttcctcagcaagaatggtggtgaccacggagtcagttcacaggtaagagtgacctcactgggtggtttcaag

SEQ ID NO: 194793 - DNA, 316 bp, Homo sapiens
  misc_feature (29)..(29): n is a, c, g, or t
  misc_feature (66)..(66): n is a, c, g, or t
tttctaatgtaggtatttattatggaagnatttatatatcaaaagactggctttgtcccacacagntcagggatgagttttatttctctttttgtgattactgtccttcagataagacacggctcacaggatgagattaataaatacttccataataaatacctacattagaaactatactacagggcacatgaatggtgcaaaatattgtggggattcagagatggtagataatatgggcatgctttttctgaagaagttgcttaaagctaggatgtgaaggaggtgggatttctgtgaggtatttgaggtggaa

SEQ ID NO: 194794 - DNA, 156 bp, Homo sapiens
ctggctttcggcacataccagaattgttattagcaaattatctttcagaatgttctatttcgactagggctgtgactacctttccttccaaaacttcgaaactaaatcctctggcttgaagacaatgtctgttattgaggctggtgaaaggacatt

SEQ ID NO: 194795 - DNA, 163 bp, Homo sapiens
ttggcctcccaaagtgctggaattacaggtgtgagccaccgcacccggccttgattccaggtctttagatagtaacttaatgctttcaattaactgccaatcagaaaaatctctgaatccacctgtgactcggagccccctccagcccctgtgccttccccat

SEQ ID NO: 194796 - DNA, 300 bp, Homo sapiens
actctggccaagatgacagagctgtctacaaatacatacacacatgtgtaaaatataacacttttttaaaaagcttgcaagttcttttatgatcccgtgtctgtgcattactgtaataatatggattagaagcagaataactgtatccaatatggagtttgagagaaaacagaaatatatcatctgtacttcaggtgtcctgataaggatcagcggagggttctgccctctgactttatctctactaaatgcatgagaggcagagtttttttgttttgttttttgtttgtttgtttgttt

SEQ ID NO: 194797 - DNA, 286 bp, Homo sapiens
tgatttatcgcccaacaccatcaccttcatcatcatggtaatcattaccatcaccaccaccaccatcatcatcatcaccatttcactctcctagttttccttcagcctctctgtctactctttaatcctctctgcagactcttttcctcttccaaacccttaaaattgaggttcctgaggtttatatcttaggccttttcccatctcccattagacattcactctcagtggcctcattcactgtgggggtgttggggataacatcacgggatcctgtagagcgacc

SEQ ID NO: 194798 - DNA, 589 bp, Homo sapiens
tttaaaaatggtcagactgtattgccagccatcagttagtatgactttcctatctttcacagacagttatttcttattagatagattgttatgtttcatagggtcatgaaatattagaatgggattaataatagcaaattaaaatccaactttgagatatggcatgggagaatgttatggaccatgctaattcgagatggaattatgccttcattttcaggaatttttcaaaatgaaaggattgaattaaagtaaatttgtcttagatgaatcaaaacaagagagggtgacatgtcatttttttctactaattcagaacatttatggagcccctaatatgtgtcagggacaatgcaaatataacaaatacaacaaatacataaaatgaggagctgatgaagtaaggagctgctggtcggtgggacgtgtacagcccattaaggaagctctcaggctgttcccaactctgtgctttgatgatctttctaaggttgctgcagcctcattaaggaagtcacaacctttctctgtttcttatgtcctttggattggtatttttttttcccctcaaatactattgtgttacaat

SEQ ID NO: 194799 - DNA, 308 bp, Homo sapiens
acacgcaggatggcacagaaaaggaaggtctgcaagggctttgggaactgtccagtagaggatgattccctgggaatttgtaaggacatagagcactagaaagggattctcagctgtgggtgcaacctctcagcctctgaactattcctccaacccccttaaaactatatgcttcctaagcaccctcatgatgagcccaggtgacgggtggaacacgcctggtagtgtgctcttcccacattcatgggctcccatgttctacctccaagttggcgtgtgaagggggttacccgaagctcgaaattcgg

SEQ ID NO: 194800 - DNA, 505 bp, Homo sapiens
tctatcaccaactgtttgttacattcaactatgatacatgtcttgttatagaatcagctgaggtctgtattaactttctcaaaaagttacacatagagaaaaatatatataatgtctttaagacataaacagtagtctctaaaatttaatgagcctgaaaaaagagtaccttccaatttatgatgggaatcatttgatctttccaacttcttgatttctaaaagcactactggattagcttactatgaatcaggtgaccaccatcataatcaatggggtgagtgaggcccaagagcttttccaaatattaagaatatttctcttaaaagtgaaaagaaaaaaaacccatagtcctagcccaatattttgtccagcatgtgctccaaaaagtagacagagtattactggaacataaccagtaaaatctgtatttataaaaataaaaaaagaacaccgagaattaaacttaaaagaagtcaaccaggggtcacgatggggtcaaccc

SEQ ID NO: 194801 - DNA, 389 bp, Homo sapiens
agcaacagcagcaataattatagctcactgagcttttatcatgtactctgccaaagtactttacagggatattttatttaatcctagcaacctctgagggagaattaccagtgagaaaactaaggctcagagaactaacttgtacagggttactcagtattttgtgatggagttgtaacataaacccagatggttagactccataccagctctcttaaccactctgctaaattgcttccttattattttccatacgcacatcagtatccacatctagcctagaaaaaaatgagtaagtagtgtttttttggtaaatggtccaaatcagtcagctaagtcttttgtatagtttattactgatctatatatctagctgccataccagagag

SEQ ID NO: 194802 - DNA, 451 bp, Homo sapiens
gttcttgtcacttgcagctgagaaaatcctgaattggacacttatcaaaaaaaagtactttacaagatcactgttaatggctggtaagcatcccgtgatatgcacacctttacatacttttcaagtcttcctctattataggacacttagattctttaaagacgccctgcaccataaataatgctgtgataaacatccttattcataaaatattgtgcacctctctgactgtcccattagacttgctgctaagaccacatgcactttgaaagcttttgagaccttatgatcaaatttccctgccaaacagttgcatttcatgtatatatctgacagtcattcatgaaagaaagcgtctattttttcacgttgttgccacatattagatattatcactatatttctttaacatgtttctcgatgttataggccaaaagggccacctcattgt

SEQ ID NO: 194803 - DNA, 467 bp, Homo sapiens
tctctaaaactactaccggatctttagaaatgccagccaccagggcagcactcttccaggcaaacattatgactaaactgtaaaatattgtgaaaagtattcatgaaggaggtgaagacaaaatcactaaacaggaacgagtgaagaagcaacatactggaacgatgaaatagggagttttttgcaatttataaatttcagcatcaaatgttttcattgtgaggtcttcttaatgttcgtgattctaaatgtaattaagttcaccaatactttgggggtccctattatagcagtcaagggtcttctgtgaagaactgaaatgatgaataactgatggtcacagcccttaaaaaccttataattcaatgaaaggctaaggagaaaagtccaggtgctcattagctattaaaataaggcagattttaagacagccattatacagagtaaggcaaagtattgtgaaatta

SEQ ID NO: 194804 - DNA, 843 bp, Homo sapiens
ttcactgttcggccacttccacggacccgatggctgtggccaacaatgaaagcgagtccccattccgagcgattaccaacaatggatagatttgctctcttggtccagggcgctgtggagtaccaacgaatagtttctgggcagcgccttttgaaggtagacaccagcttgaagagacgtgaggagtcagggtgcgggtcgtctgtcccttggcactgaagttagggtcaattacactgattagggctatgacggtacccagtggagcgtcctcctgtacagggaatgatagtgacttactgctaactctggaacactatcattgatgtccaagacttctatcaagtctgtgcagtgatcaaacattggggaattgcctgtgtcaactgcctgtatttgaatctttcattatttagtttcctcaaaacctatctttacatttatttatccactgtctgaatctatgcgaaaaagggcttctatgttaggggagacatcagttgcaaagaaacaatgtgacggtttgaaccctcgtcaaaatccaaggggttaagtctaataaccagtgtaccttctcttgcattttccagtaatttcacatgatagactcctttgtcaaacactgggcatcatcatttacatccagcgctgtgatatataatgctttggtgcctgtcagctcagcttcgcccccatcagttgctttgagcaccaagagtagctctgaagtgacttactatctgaaagaatttttaaaatacaccttcaagtggttttacctgccctggttggtatttccagggaaaaataatcattgcggcacagtatgtaagtcatcagagc

SEQ ID NO: 194805 - DNA, 152 bp, Homo sapiens
ggtgaatgcagacaggagttcaggggaaagagaagccatgagtatctcaagtgagcagcagcaggaacaggacacacgtgaaaatctacgcatgctccttcagggaacgtttcctgaacaccttttctctaatgtattggtccttggcatga

SEQ ID NO: 194806 - DNA, 148 bp, Homo sapiens
accttcagcgctaaccctacccacatatttcctgtattaaaacaaaaaaacccttctctaatttgagtctgctttatggatcattactctgtacactacttctttttgttgtcagactttgtgaaagagtaatcagtagatgccagtt

SEQ ID NO: 194807 - DNA, 216 bp, Homo sapiens
caaagtgttgggattacaggcgtgagctaccatgcccagccaaggctaggtatttaaatgtcaaggagttgatttcaacttagatgcagtgacccccccccaccccttggaagaaaggtacattacatcacatttgccatcttgaagtaagattcattgatagtataatcaaccacacacacattaaaacaacaacaacaataatataatactcta

SEQ ID NO: 194808 - DNA, 396 bp, Homo sapiens
gtgaatgagatgggacaggcacagcccttagcacacagccagtggtccacagggttcatggtgctgaagctgcttcttatttcttctttccagtctccttgtggtttgtgtgactcataataacaacttcatttttggagttgttgaagacatcttcctagaaagacttgactcaagctgagttttcaagcatgggtagagaatagcagcatggaaatgagataaagacaatttcgggaaaggaagaagcacgtggcaagtcacagtacccttgtccctttaggaaaagaaagcgtccctactgatttcttagataacaataacaggccctccagtgcctggtgccaaattaggtccaccagaaagtaccaggcaaggttccttatacttcactga

SEQ ID NO: 194809 - DNA, 346 bp, Homo sapiens
atgtagtgaatggaattacaggaacaagtctgggagtcgtcatccgtcattccttacccaatacactggtgtatttaaacgagccagtggaatgctgagcatcataaggaagaggattcaaagcaaaacagtaaacaggagggttcctttgaatctcttacttgaactaggcagttgaaaagtgattggcgtcaataagatcctgaagcctttgccaaatattaaagaagtaaaatataggccaggcaagttggctcatgcctgtaatcccagcactttggaaggccgaggtgagaggatcatttgagcctaggagtttgagaacagcctgggcaacatagtgaga

SEQ ID NO: 194810 - DNA, 311 bp, Homo sapiens
agtaggacctcatgacatcatagctcatggttagaattcaatttggaataagtcttgatgttggaatgggatcactgcactgggagcccctggtggtcaggagctgtgctttagccatcgccgaactccagcatcgagtgcagtcctgctgcctgatacacactcagaagttaaaggcactcaaaagtcctatggttcattcttttttaaaaatttaatttttaaaatatgacacataataactacatattcatggagtacatagtgttttcatacatataatgtatagtgatcaagtcaggataattagc

SEQ ID NO: 194811 - DNA, 353 bp, Homo sapiens
tcaccatcctgagagttcccacgtggccccttttcacaggtctcaggcagtctgatgtgacttctctcacttttgctggcctggcagtggccagatgtaggatcctcaagggttctcatcatcagctgagctgtgaagccgactcccaccatcaagagaccccaaaatggggagagctggggtcatggcttacccaggttctgtgatgcatgaaatgaaaacagggaatatttctaacccaactttcaaactctggataaagacgcggtggccatgatatgatcctgcttctcgtgaaagccgtaatcagggggccagcaggctctgggttcaagggcaggagttctggccca

SEQ ID NO: 194812 - DNA, 669 bp, Homo sapiens
cactagtcagtctctctagagtaactagtgttagtataaatccggtgagaacatgctcactccgcataaggcctgcgtcagataaaaacactgcactgacaattaacagcccaatatctacgatcaagcaacaagtcatcattaccctcatgtcataccatttgtagtgacatgagagggggagaggagttcatataaatttgtcatccttggtctagcataaatgttttcctttctgtaaaatttccttccaaaatctaagaactctaagtagagcccacttagaggtgagcccacttacagcagtatcatccggacaataccctgtctcaagaatggcttgataaatatcagccccttcattttttattttctcaagaggcaaagatccatttaagatctgaaagagatcagtcagccctattttttatcttgagtattagcaatggggtagagaaataaccaagaagtcagaaattggtctaaaatgctagcagaaagacaaaaacagagaagtttaagagcaggcaagagaaaaccaaataaggttcaaagagtggtgcggtagaattcctccagaaactatctcaggtatttaagactaacattggtgccaaaagtcaaatgccatgggccagcgggaatctaaatacacttttgggcttctta

SEQ ID NO: 194813 - DNA, 828 bp, Homo sapiens
gtctacagctcccagcttgagccacgcagaagatgggtgatttctgcatttccatctgaggtaccaggctacaccctgcaaggtcattatcattagctgcactttacaggagaggaagctgaggctcagagaagcaaactgccctcctacttatgttgaagactttcccatcctatgagcccaggtgggagaagctgaaaatggcagaaggtcacttttccagctgccctgtgcctggtgagcctgtgacacagaccccgttgctcacatatccacccagtttggtgccataggtggtaggcaggttgcaaactctgcgcttatgtgcctcaagagacagggctctggatgtatgaggtcaaggctgtctgaagaagatgaatatggtagagataaggaggattttccagtgattgaagagagacttcctagtcaaggactgtggttttggagcagcagcagcagggtcgtgttccctgtctctggcagtactctgaacattggcaggacctcagagtggtggcccaaggtgcctaggctgccagccttgccaaaacttcccttcaatcagcttggtgaggaaggagaaggggctgaggcagtgggattctcagtggtaatccagggtgaaccaatgttctataataatattagagggacctccctatgtctgggccctgtgtcctaccttaggaccatggcacaactccctgtggggagagggaagagaaatccctgtgaatcactcaggctgaatttctcaccaacccagcaagatggaagctcagagttgaaatcaagttgattaataaaacattttaaaagaaa

SEQ ID NO: 194814 - DNA, 406 bp, Homo sapiens
gaccttcacagacaacagctctcaccgccggtttggtcacacccctctgtttcctcagggtcacttgtaggtcagcgtttgaactttgtgatttctatctccctccttcaatccaatctttgacctctagtatttgcccacctgacccataaacagagaaccataatggttctctgatttgtgttttcaacaaaaccccacctttaacaccactcacctctaccagccaacaaaaccccggctttaacaccgctcgtctctaccagcccctcttctcttagtcgcttcaccactgaggcctccctgagcagctagcagaaaaggccttccatcccgctggctggcgctggtacccgcgaataggttggtgtgtgtctttccagacatgtttgtgcacatatatgtt

SEQ ID NO: 194815 - DNA, 326 bp, Homo sapiens
caggagaccattttaaatcaggattctttcctaaataactttggaaaaatacatgaattgcacaagtagtacatgtttgtaattaggtatttcttaagcctatagaatctttgcctgagactccttctagatttaaaagtcttgaccttcaggatttaagactctggaaagatatttagtaaatggtttttaaaaataaatcagttaatttttcagttaagcttctaccatatattgaaatacataaatatctatatatataaatgtgttaaatactttaaaattctcaaactatttttcctgccaaaatatcacagtaggaggca

SEQ ID NO: 194816 - DNA, 552 bp, Homo sapiens
  misc_feature (27)..(27): n is a, c, g, or t
gctgaccatagaggacccctcgaatcnacggtttctcttggctatctgcctacgagtggaactgataggtcatagggtaactctatgtctaacattctgaaaaactgacaaaccgttttccaaagcagctgcaccattttacactccccagcaatgtacgagggctccaatatgtgaggtttatccacattcccaatgtgtaagggttatcctcatcctcaccaacatttgttattatcttttttattcaaaccatcctagtgagtatgaaatggtatttcattgtggttttggtttgcctttcctcttgtctaatgatgctaagcaccttttcaagtgcttattggccatttgtttatcttcttcagaaaggtatctattcaaataatttgcccattttaaaatcaggttgtcttggccaggcacggcggcccacacctgtaatcccagcactttgggaggtcgaggtgggcagatcacctgaagtcgggagcccgggaccagcccgaccaacatggagaaaccgtcgaattcgagtaaatcctctagatc

SEQ ID NO: 194817 - DNA, 695 bp, Homo sapiens
tgttcatccatgttatatcagtatttcattagtttttattgcactgtatggatataccacattttgtttatccattcatcgattcgtgaacatctgggttgtttccactttgaggctatcatgaataatgctatgatcatttgtgtataagttctgtgtagacatatgttctaatttctcttggctatctgcctacgagtggaactgataggtcatagggtaactctatgtctaacattctgaaaaactgacaaaccgttttccaaagcagctgcaccattttacactccccagcaatgtacgagggctccaatatgtgaggtttatccacattcccaatgtgtaagggttatcctcatcctcaccaacatttgttattatcttttttattcaaaccatcctagtgagtatgaaatggtatttcattgtggttttggtttgcctttcctcttgtctaatgatgctaagcaccttttcaagtgcttattggccatttgtttatcttcttcagaaaggtatctattcaaataatttgcccattttaaaatcaggttgtcttggccaggcacggcggcccacacctgtaatcccagcactttgggaggtcgaggtgggcagatcacctgaagtcgggagcccgggaccagcccgaccaacatggagaaaccgtcgaattcgagtaaatcctctagatc

SEQ ID NO: 194818 - DNA, 843 bp, Homo sapiens
ggaaaagaaaagcatcacaggcctcagatgtatatgttatatatgtgcgatttgcacatatatgcccgtgctggcatctctgcgtatctgcatgcagttcacttctccgtcactgtccccaggaagggtggcagcctcatcctctgtttcctacttctcctcacctgggcgtttgcccattcagacgtgcaattgtgcaattccaagcccgcagttcttcagctcctgtgcttcccttattccttgaataaggctgggctacaagatctcagtggagttctgtgagcacgctggactcaggaaagtccgtcgcagggccctggtagagcggttactggagctcgctgtctgccgtggaagtgggcgtgtggctgaacgtgtggcttcaggattccagcggtgcctggtagaccttccagccgagggacctcagaccctctgcctcccgcgggtgcatggcccgtccctgagcctgtcgctgtctcagttctgggctcgggcccctcatgggagcggccctgctgggacagtgttttcccaagacgccccaagccctcgccctggcagctccatgaaccccatgcagactccaacaggggcttcgagcctcttcctgctggggtcccacggatggtgcaggcagaggcccgagcactcctggtggccccgtgtggcccacgtcgctcagtatctttcctcgccttgcagaggggtgtgaagcacaaggctccagtccaggccgcacagagcagcgatgggcccctcctgaaggacctcctacggcggccaaggcgcagttagctccacgctaggtaactgtgcggctgctggacgccgcccgtg

SEQ ID NO: 194819 - DNA, 295 bp, Homo sapiens
cctcaatgtagaactaaaactataaaactgttaaaacatgggagaacaaaagagaagataacccacagaatggaagaaattattgcaaatcatgtctcttataagggcctagtattcaaattatttaaagagttttacgactgaataagatgccgtgcgtggtggctcacacctgtaatcccagcattttgggaggccgaggtgggcagatcacgaggtcaggagttcgagaccatcctggctaacacagtgaaaccccatctctactaaaaatacaaaaaattagacgggcgtg

SEQ ID NO: 194820 - DNA, 307 bp, Homo sapiens
tacagcaagtctctgtgccagaaagtctttgtgccagcacacaatcagcaaaatccatcaaacatcaacacagcagctctgtcctgtgcttgccctgcaaattcagaagcccccatggtgctttccgctggcttctcgggcgtttctgattgtctcagtaccgagtgatcttgggcaccgcattatctgccacataatttagaacaaggacatttggtgcttcgcagatgtcctcttctctttgtaccttagtaatattttattttctcataaccattttaagatccattcttgttgctttcctatc

SEQ ID NO: 194821 - DNA, 449 bp, Homo sapiens
gagtgaaacgtcgtctcaaaaaataaaaaaaaagtccaggcgtgatggctcacacctgtaatcccagcactttgggaggccaagacgggtggatcacgaggtcaggagttcaagaccagcctggcctagatggtgaaaccctgtctctactaaaaatgcaaatattagctggacatggtggcatgcacctgtaatctcagctactcagaagtctgatgcaggagaattgccaaaacccaggagggagaggttacattgagccgagattgcaccactgcactctagcctgggcgccagagcaagactccatctcgaaagaaagaaagagaaaggaaattccccagggaagtacctcagcttatttcataaacaggtactgaaggaagcagaggcttgtggaggacttccccacctcatgcagctatttgggccatggcgtctgaaattta

SEQ ID NO: 194822 - DNA, 281 bp, Homo sapiens
atatcttcattgatggagaactccatccttccaggtgctgaagccaaaagccttagagtcagctttgacgcctctgttaatctcacgcccatatccaacctctcaagacatcttgctggctcttccctgagagcacactcagaaactgacccctctcaccatctccatcttcagcttactgtaatgtcctcctagctggtcttcacttgcattcctgactccttatctactcatcccaactgccaacatgaccctttgcaaacttaaggcagagcatattt

SEQ ID NO: 194823 - DNA, 122 bp, Homo sapiens
gattggtcagtaagtgcagcaaaccaccatggcacatgtatacctatgtaacatacctgcacattctgcaaaagtatccagtttgtttattttttgttttttgtggggttttttttagaaga

SEQ ID NO: 194824 - DNA, 397 bp, Homo sapiens
taggagtggttagtagcccttctctcatctgttggggtggtcatcccttttctgcatcagtgaaaataacaccctatcatttcacttcaagcacaaatgctacttttgtctcatttttggagttataaaaccatgtggattaatcccaaccaggtggtggggagccaaagctaagctgtttctttcacctctgacccgcgcgattagtttgtggaagaacgctctccaaacccataggaagttcacagacagcttggattcctcagagggtcttcggtatcgattgtgtagcagaaaaagcaagcatgcctctgggtctttcctctcttctccatagtcttttttatgtctaactggtgttgggttgctttacctctccacccatagttaaagaaag

SEQ ID NO: 194825 - DNA, 469 bp, Homo sapiens
ctgtcatagtcggtcttcttgcttagtaggcctgagataaaactttctcctatttcatccctcctcctccctcttcctgattttacatgttatttagttgtttctccctctcactataattatttgtgagaagttacaagagttatactatggtagagcagacaggctttgcacaccttcagggtcagttctggaccaaaccactcagaaaccactgcacggatgaatggctggagattgtggggcctattgtgtctccaggtggctgtggttacatgggatccctggaatgttaattaattttcatatttccctttaaggtacttctgtggctcaaacaatgaatttctgagttaggtcccaaagtggcatttttgtttgccaacaccctcataggaaactgtattagaagctttcttgtaatatttaagagcctttaaaagagcgagactccgtctccaaaaaaaac

SEQ ID NO: 194826 - DNA, 312 bp, Homo sapiens
ctgtgtaccaagcatcgtgctaagtgcttggcgcatatcatttaatataggaatcaacaaacctcttctgtaaagggtcagacaataaatattttaggctttgcaggcctctcttacaaacactcaaatctgctgttacagtacaaaatcagccacagacaatacataaataatggatatggcttgtccaataaaacgttatttataaaacaggcagctataagctgtggacccctgatctaactgaatccccacagctcaatgaagtagatatcattcattcattcattcattgaataaatactacagaat

SEQ ID NO: 194827 - DNA, 704 bp, Homo sapiens
aaaacatcattttcacaagtcattcttgagacagaaaagtggaaatagaagttcatatatggttgtttcactatctctaatcttatgtacagtttttagtcagttgacagccatataattcttagttttatatactgatagtcattagaaattacaaattttaaaaaatattcatgtctcattctacgaatcaatgtaaaaatttcattcacttggttatatttcttcattttacctggccttgactacttctttcctgcccagcattaaatttaattaatgtctaatttgtttacttggtttagttattttggccatgttcagtacacttgttatgaagcaggcatgtaggaatgttgacaagtttatggtcctcactcttccaaatccctaatggcggcaccccaacagacacataccacaatgtaaacacatacacacacacacaatccgtgcccacccatactcacccacgtacacacagacacacacacacactccagtggatcaacacataaaacactccacaggcaggcatcgtacagcagggatctcttagtgcactacacacttctgtaaattatcaggactcttcaattgaggtgagtctacagagatttcaaaagctatttgagtgttaagctatctaactagtggttggacactatttaaataatgcattaaacacaactcttgaggctctg

SEQ ID NO: 194828 - DNA, 481 bp, Homo sapiens
tctttaggtcaaactaccttaatgttatcatacttcaaatatcctacacattctttctgaaccactccttccctatggcatataagccctggctctgggggctaatggcgtgggatctgacaccttgtctcaccacttcctgagagaaacatggcttctgctcctaagtccctgtttctttctaagaaactggatttgtcagcctccttccttggcccctccgcttctccggacattgggggtagatttgcatagacctgcccaccacggaaccatggggcagctaggtggcacctaggctgcagccctgatcacctgtagctgcatgttctaatccgttcaactgcttccagccggccatctgcccaagtgggcggaaagcaggggccacgtcagctttacttctggcacaaagtaggtgctcaaacacccatcagataatggtcaagtttagtttctggtgaaaacaaataatggctct

SEQ ID NO: 194829 - DNA, 295 bp, Homo sapiens
tctctgaaaaaatataaatattattagcaaggagaaacaatatttaggatttgagtaaatcaatcaagaaaaatccttggagggtagtggggagggtaatggaaaagcacaggctgaaaagtcctatttggtcacattccgtagcttttcattattggtttctactagcaaatagagtaaggtacaacagaatgttcaatgcattgaaagaacattttgcttctcttaaaagtcataaaagagaaacagaggatttctctaagaaaaaccaaaataactccctctggagtaaccc

SEQ ID NO: 194830 - DNA, 357 bp, Homo sapiens
cgaggacccggcgtgtcaggagccagatcacgccactgcacttctttatcctagataacattttctaaatatttgttcaattaattatattggaattatttctggaattaatttttgccttcccaaagttcatatctagcatatttaagtttgataaacttgcatctttattaaagaaatctctcattggcctaatagcaatattatccaatatcaacttcagatttaaccagcctcaactggttaagagcttcagatggcattatactaaatggagagtttcctcagattctaaatctgtgctgtccaacacaataaccactaatcacatgcgactatataaatttacattttctc

SEQ ID NO: 194831 - DNA, 165 bp, Homo sapiens
tccctgatcacaggatctccctaactttttacatttgtgagcagtggttctcatgtattcatgtgctggagatgcagactcctgggtgccattcccagagcagctgattcagtaggtctgggaggcctgggaatttgcatcatcccagggtggcagatcattctg

SEQ ID NO: 194832 - DNA, 233 bp, Homo sapiens
gcaggaagactggttagaaagctagcaaaatcaactacaaagggggataggtcatgccagagatgctgatagctcggatcagggtggtaatgcagcaagggtggtggtaagcagtagtcagatctggagtatatttttaggcacaagctatggggaccagaagaaaatgaaagaatgaattcaacaaagaagcccaataatggggtagggcaggtggtaaactgtcaaaaaga

SEQ ID NO: 194833 - DNA, 479 bp, Homo sapiens
gcatcaccttctaatattcttttcctaatttgaaaacgtctgtttattctaaatttaattttttaaatccaagctgcatgtcagtcaggtactctcccaaaccttctctaatttcctgaaatgaagaatgagttataacaagaaatgttttacttattaaagtctagattaaaaataagatttgaccgggcacagtggctcacgcctgtaatcccagcaccttgggaggccgaggcgggcggatcacttgaagtcaggagatcgagactagcctgacttacatggtgaaaccgtctctaactaaaaatacaaaaattagctgggcgtggtggcacacgtctgtcatctcagctacttgggaggccgaagcaggcgaatcacttgaacccaggaggcggaggttgcagtgagccaagatcgcggcactgcactccagcctgggtgacagagtgagactccatctaaaaacaaaacgaaac

SEQ ID NO: 194834 - DNA, 742 bp, Homo sapiens
tttaggattgtaatgtcttttgtccaattttcgtatcattccctttacatttgttagttaacatttaattgtaatgaatatattgtctgacatttctaataggttaagatctctttcagtattacatgtattcttgcatatcccattcgtttgctgattttagagtctctctccttgacttttacactgcttgatatctttacttggttagatggtgatagtagtggttgtggtgacaacaataagttgatgttattgttaagggcttcaacacactgagctttgatttaggcattgttatcagtccatgtgaattaacccatctagtcctctgaaagccctatgaggcagttattgttctaattttatagatgaggaaatgaagcattaaggaggaggtaaagtaccttctgtggctggtgagttgcttggccccaagatatgaacccaggctggcttgagtttaactactacattgtgcctttcctctaagtagtcttctgatttccttatttccattcttccgcccttttctcttttcagcaaccagagtgaatttaaagaataatcttctagcatattttaatgtattcagttagagtcaggtctttactgtggctaaaggccctacgtggccttgtagcttgctcctccctagagttttctactctttgcctcctctttgtgtattcctcgaacatacacatgctctcatcatagggctttggtgttgctactccct

SEQ ID NO: 194835 - DNA, 472 bp, Homo sapiens
  misc_feature (373)..(373): n is a, c, g, or t
  misc_feature (464)..(464): n is a, c, g, or t
catagcgagctcggtaccccaccactcctaagatcagtaagaatcaaagtgatttttaggctgtcttagtgtacacagcaagggtggtgaaaaagtcaacctgcactagttagttgtgggatcctgagaaaagtaacaatgggtggaaatacctagaaaaaacagcacaagttgaatgctttaaaaaatttgaggatatttactttggaaaaaaggcttagctgggcgcagtggctcacgctgtaatcccagcactttgggaggccaaggtgggcagattgcttgagcccaggagttctgggctgtagtgcgctatgccgatcgggtgtccgcactaagttcggcatcaatatggtgacctcccgggagcggnggaccaccaggttgcctaaggaggggtgaaccggcccaggtcggaaacggagcaggtcaaaactcccgtactgatctataggagtggtggnggatcctc

SEQ ID NO: 194836 - DNA, 320 bp, Homo sapiens
gtgttacattttttaaaaagtgttgatattagctcacatcttcttcctataacctctacttctgcatcatttatttcatcatatagcttaaatttctctcttattcccaactatatcctagtcattcctgtgaaacattcttgaatccaaaaatggtagctcacagtattaccccgttctatccatgtactcacctgaatgaacacatggttagtgtaacctaacatattcttagtgggcagatgttggctcttaataataatagttttggggcgggcacggtggctcacgcctgtaatcccaatgcttgggaggctgaa

SEQ ID NO: 194837 - DNA, 362 bp, Homo sapiens
aaaatttagatacatcttagattagatgaagacctttcaaaatagggctttaaaacatacaattcaaatatacgtgcttatacttttacgtgaattacaaattgggtaaagatagaaatttgtttctacagaactgccaggaattatattacacattgagaccactgatttttgacactggccactttgtccatttgaattttgctgctgagttactcttttgggcataattctgcagagtggaagtctttaaagataaaggaagggctgagaatgttttattcttgttgacatatgagtatgattcaaattgagttttatggaaagatcactcacttcatagaaatttttttattttacct

SEQ ID NO: 194838 - DNA, 591 bp, Homo sapiens
actttttgtttgtgccacctgtctatattaattctctgtattttccccatatgcttacttgcatacttatatggttattctctgtgtatttcctgtttcttttctctctttttttctaaatgtattgaaatttctgagaagatgaaaataccacctttatggctactcctaatggcaataagcgtagtcaccaacatttatttaatgttggctctttgttcaattaatctttgtggcaactgtaaaggcacaagttactttatctccatttgggggttaaatctgttgaaactctgaagaagaaaggaatttgtctctaggtcatgcaactggaaaccctggacttgaacccctagcactgatatatcctaggggttctagttcagattagactgatgctagaacccctgacctggtctccacagacccctcaacactgcttcacgtgcagagcaggaagcaccaggacatccttcctaagtggtgttaagaacttgatctgatgaagtatccatgtgtctttgagtaagtcatttaacttctctggaagaacagcttctttacaaagtaaggtcgtctgcctcttagttc

SEQ ID NO: 194839 - DNA, 394 bp, Homo sapiens
gaagagggattgggtgtattctgcgtgggcagaaccatgaccaggagagaggggaagccaagaggagagattgcagatggataaagaagtttctcacagtcgaggaataagaagcacacgggcaggcttccccagagaggccggtgccccaacctagaggacacgaagccgaggccaggactgtggaccgcagctggagacccctcttgacccgcgggggctggtgtgctaaggtgcaaagggaggaaagagcaacatgcagggtgacacctgcagacagttctccctgttctggaatcttccggtcggccccaggggtgcacgctagggcagcccatagccagcccctgctagatcccggctcccggcaaccctcaatgctgaactctcccag

SEQ ID NO: 194840 - DNA, 316 bp, Homo sapiens
ggaaccttccattaatcagcacataaagtgacctatttaacccttacagcaaccacatagcataggtattgccatttttactttcttccatagaaaacaaattgtagctcagagaaattaagtaaattgtccaagagaaccaaggcagaggtcctgaaattcaaacacaggtctcacgtcaaaatccatgtgctctccttgacacatgtcacttcctcttgtctggatgccttctaggcttccctttgactaaactctaaacaactcatatgttgacaagtaataatcatatatatttatggtatacaacatgatg

SEQ ID NO: 194841 - DNA, 288 bp, Homo sapiens
ctccgaaaataacaccaaggacttaaaggagaagaaggaagtaaattaaggtctaggaaatgaagagagctaataagctacctaaatccaacagtagagagaagagaacagaactgtcttatgtttcaaagatgaagatgaatttttttcctctgttcaatcagtaaatacttattgggtaccaattatgagccatacattcttctaggaaatgggactttaagagttaaagaagtcctacttgccttcatggacttttgaacctagtgacagggaaagagacaacaa

SEQ ID NO: 194842 - DNA, 275 bp, Homo sapiens
cacattgtttttgagaagatgggttaaaaccagttacaagtgactaatattaaaatttactctctaagaagtgatgagtaaaatggttttatcaagtcttgtgttttattaatggcatgaaatatagaaaagcaggcttagagatactattttttacagttggataaacttttgtacacagtagaaatctgattttgccatgtgtttttttgtttatgagggagaagtgttcaatgactttttcccaaagatttttttttttcattcagtgaatt

SEQ ID NO: 194843 - DNA, 133 bp, Homo sapiens
actgggaggcaaagaagagtgctatctggcctctggttcagtgggtggtggtaagatggtcggagtatgtggttaggctcaaagctggtgacctattagactattataagttacagttttcttccttactaca

SEQ ID NO: 194844 - DNA, 243 bp, Homo sapiens
tggaaggatcgctttgagcccaagagttcaaaaccatcttgggctcaagcaaaccttccaccttagccttccacagtgctgggattaaaggagtgcgccaaagtacctggcctccctcccatcgtctttttaacatttctcaatgtgctctgtcactttcattcccattgttaccaacccctagagcaataacgcacaacagaaatgaaagccacatatgcaatttcagattttctagtagcc

SEQ ID NO: 194845 - DNA, 343 bp, Homo sapiens
ccacaacattcaactgatttcaaatattatattattcactttaacgattttgtccatagctgtttgacttctcttgagtcagtttgactatcctagcgggatgatgaaaacccactacttaggaagaacagtttactactacagtcacattctgcataaggaaaactgaccaaggttacacataagctggtaaatgttaacaaggggatctgaacccatatctacttaattctaagacccttctcttcacatttaactaccataaaagagttcttttcaatcatattttaattcatcatgatttctgaaaattttgagtattattctagagatacggactagc

SEQ ID NO: 194846 - DNA, 341 bp, Homo sapiens
aattcagtctatgacaagtgagaatgacaatattggcaatgaagttaaggaacagacacttagacacagttgatgggaatgttaattgggacaatctttttggcaagtcggtgtttcaatatatagaaaaatttagaatgttaatttcatttcactcaatgattctgcacctaggaaattaccttatgaatatgttctcaaaagaatgcagtgatatatgtattgtagcaatattgcaatagcaaaaatgtctaaaaattagatgtccattggtggagaaatagttaagtaaaattggcaatattcatgcagtagaatactagatggcagtagaatactag

SEQ ID NO: 194847 - DNA, 523 bp, Homo sapiens
cccagcactggttggtgctgttggcatagactctgaaagctctcaagctgtctgggctcacgtcccaggtctctccccagccccccacccccacctggtgtgttgcctgaactggagccactcaactccctgtgcctctatttcctcacctctgaaatggcaatgccaagagcactgttttagggggctattctgagcattatatatgctcatagatgggcctggcacaaagtaagtgctcagtaaatgtcagctactattatttcctttttttgttttttgttttttgtttttagacaacgtttcactcttgtcacccaggctgcagtgcaatggtaggattttggctcactgtaacctctgcctcccgggttcaagcaattctcccgcctcagcctcctgagcagctgggaccacagacgtgcgccaccatgccaggctatttttgtattattagtagagacagggtttcaccatgttggccgggctggtctcgaactcctgaccttaggtgatctgcctg

SEQ ID NO: 194848 - DNA, 528 bp, Homo sapiens
cactactggttcccacattgcacaggacaaagttcaaatgtcttagcacagtgtttctgtccctatcctgcagttttctctctcatctcccatgttcatagcctataatctctccaactttcaccttttcataggctgcttagtttcacttagtttctttgtggaagacctttaattttcccttataaatcctactatttttaaaagactcagctcaagttctatctcagaaaaccttaactaccaagatctggttagatgacttgcttactttatcaaagcacttatcacataaagcagtatagtgtcttccactagaatgtgatctcctgaaaaaaaaaatctttgatacctacacattcatgcatctaactaatatctgctaagcaactacatgacaggcactgtattaggtgtttattacttaatggtgaacaaaacaaatatgcccctgtccttgcagagcttgtaatctataagaaaagaaaatcaaagaaacaaataaatatggtgagatctgaaaaaaca

SEQ ID NO: 194849 - DNA, 438 bp, Homo sapiens
agatgcagccaagtttgtaatccaagcgcctggctgcttggctctggcagcccctcacagccctgctctcccgctcccacattgcagccgtccccaccagccgctggggccaaggagcctcgggtgctgggaggggggcctgcggggcctccactgggaggcccagcttcaggcttctccccacattctcgctctctcgggctggtggggagataaggaaagggcttccctggggctgaggatgaaggaggacttcagccctagtggtctgaccctgaggtgggcactacctggggcaggggacagatgcccactccacccactgcacgggcacaggaataccacgttccatctgcagccatgctagccaagaactcactgacctgagcagtgagttaacatttttatagtacacattaaattgatacataactatta

SEQ ID NO: 194850 - DNA, 225 bp, Homo sapiens
atcaggatgacaatatataattaaagtcttctgatcatagcttgagaccagtcaagggaatgtttagtttcctccacaaagagccaccaaatatcctcgtatgaggtcccagcccaacttcaatggtctcgtgttaaccacctctttaaaagccctacctccaaatacagtcacattctgaggtactaggggttagggcttcaatgtttgaattttggggggaca

SEQ ID NO: 194851 - DNA, 260 bp, Homo sapiens
acgtaaagagagccagttgacatctacacaggcagttccttctctacaggagaggaaccctaagcttagggaaccctaatcttttaagatgggcagtaagcatgcctaccctttcgctccagagggagacgttattcttattatactggataatatgtatccccgccttttgctctggtggaagacactatctctatcttccaaggctgctctttagataatatccgtgaaaaaatagaaacaaagggcagtcagtatct

SEQ ID NO: 194852 - DNA, 233 bp, Homo sapiens
tattatttacattataataagagaaaaccaaagtacagagttgaaataccttgctctgaggtcacacagctagtggtgaagctagaagacagtccatatctgcttgcctatgagcccttaactctaaacaaacacatctacctttttggccttattttcacaaaaaaaaattgactacacttcagatagtgattatttttgcctagaatgcctgtcttcctactgttattaaa

SEQ ID NO: 194853 - DNA, 455 bp, Homo sapiens
taggcatgagccacctcacccagccaacatatgtgctcttatagttttgtgatttttatgaacagtttcatttgcattcccccatgccatttttcctaatttataagtacttttcaactattttagcttgtttttctttgctattggaataagcaaataatatgtgtatcttacatatgcacattttttctttttaattaatcttgtgatgaattcttggtacatttcctggggaaaaggatttaaacatctttatggttcttaatgatttttttaaaaagaattattgaacccaaaggatcttgcaggtttcagatgttacatgtttacttttttgtgtagcaaatgttcattaattgcctactttgtgccaaattcaggcctatatcttgctgacgttaggttgtcatttttcttagttttctttgtgactattaaaacgttatcttctaatt

SEQ ID NO: 194854 - DNA, 431 bp, Homo sapiens
ttatttcacttagcataatgttttcagagttcatccatgttgtagcttgtattagaatttcattcctttttatgaatgaataatatgccatttatgtatttgccacaaattgttaatctgttcatctgttgataaatatttggattatttcctttttattgacaaatattgtaataatttccttgtaatatcttcatgcacttatatatatacatctagaaacagaatttctgggtgttgccagatttcactccaaagtggttatactaatttatagtcatagatgtaatgtgtttctctttagctacataaaccccatcatagaaacattttaacaaaaatgagatgtgttttataacatgctttaaaacttaaccatacattgtgaactctttccatccaataaataatattttacaatatgattttaa

SEQ ID NO: 194855 - DNA, 393 bp, Homo sapiens
ggaagggcctccaggaggctaagatgacactcagctgtgaggaaatgaggatctcagagaggagcaagaaggagaaactaacatcttatcaccatgatgtgccaggcatcacgccggaagcgtcatcactgttacctcgctcggaactcacagtcacctgcgaggagtgagattggggttatcatccccatttcacagatgtgcaagttgggcttagttacaactaaaagtttttttgagtaagactgccagcgacaggacctggggtcgggctgctgagagagatgaggaagcagctgttactctcttggacccagacctcctctctccgtgttgttgttgttgttgttgttgttctgttattgtccctgggtgctttgagtttcatttgtt

SEQ ID NO: 194856 - DNA, 268 bp, Homo sapiens
ttttcaaagtgccctcattgctaccttcagtgggcccaaaaacagccagtgggtgctacctctgcctaacagatctcaccaacaagtctctcatgaacatccaccataatacaaaactgagactggtctcaagtgtacctttcatagaacagacataaattttaatgtagtatagactaaaagcaaatgtattaagatgcagtctagcagtctgtctttccattttaaaagaagttaataatcatttaatttctatgtctaattagag

SEQ ID NO: 194857 - DNA, 215 bp, Homo sapiens
tatttaatggtgaaactgtcagtccttcactgaaaataaagagcaaaataaggttgcctactgtcatcactaatattagactcttcactcagatttctatatgacacaattggacaaagaccctatatatgtgtgtttatagaaaagtatataaatatatggccaggtgaggtgactcactcctataatctcagtgctttgggaggccaaagagg

SEQ ID NO: 194858 - DNA, 157 bp, Homo sapiens
gtcatcctctattccccatcaacccctgccataggcaaccactagtgtactttgtctctgtagatctgcctattctgagcaatcacataaacggaaacatacaatatttttttgtgtgtgtctgacttctcttagcataatgtgttcagggttcata

SEQ ID NO: 194859 - DNA, 480 bp, Homo sapiens
gacaggctgactccagattaactctggaaaaaatggggattatttcacttcatcttgttcaatgtagtgcttcatgcagtccacattttaaatgtgttatcactgcttataacctcaaaatagctttctataatctctaacaggaagttagtaaaaactagattttagagaaaatatttgtaagaggtgataaaaagaggtcagttgtaactaatatagttccatcttcagttacactacacatagttcaggaagctttctttatgttacagtgtttattgcatgaagaacaaccttaacccttaaataaggggaaactggtgaaggtgactaaatatagctgctttattagaatggctttaaaacctaaataccatttatttttagctcaaatatatacatttagaattagatacagaagttttagctaaaactatagaaagatgtaaaattaagaaaaaattccagtgctttgactat

SEQ ID NO: 194860 - DNA, 642 bp, Homo sapiens
ttgataacgtcccattgaacagatgaggacaccgaggctcagagaggtgcagtgcctgcccacaaatagggaagcctgcctttaaacaatggtctacctaaattctcaaattttctctatctctatgggcctggatttatgtccagaattttagctcttctccctgtttctgccactgtcttcaaattcaaactccaggtctttctgaacccaaagtttctcttttcttttctttcttttcttttgagacaggctgtcgctctgttgcccaggctggagtgcaatggcatgaatatggctcactgcagactcacactttgggaggccgaggcgggcggatcacgaggtcaggagatcgaggccatcctggctaacatggtgaaaccctgtctctactaaaaatacaaaaaattagctgggcgtggtggtgggcaccttgtagtcctagctacttgaaaggctgaggcaggagaatcgcttgaacctgggaggtggaggttgcagtgagccaagatcgcgccactatactccagcctgggcgacagagtgagactccgtctcaaaacaaacaaataaaaaacaaaaaaaagacaaaaaacaaattaacaaaaataggcaaaataaaaaattattatatgatgt

SEQ ID NO: 194861 - DNA, 454 bp, Homo sapiens
ttgataacgtcccattgaacagatgaggacaccgaggctcagagaggtgcagtgcctgcccacaaatagggaagcctgcctttaaacaatggtctacctaaattctcaaattttctctatctctatgggcctggatttatgtccagaattttagctcttctccctgtttctgccactgtcttcaaattcaaactccaggtctttctgaacccaaagtttctcttttcttttctttcttttcttttgagacaggctgtcgctctgttgcccaggctggagtgcaatggcatgaatatggctcactgcagactcagtatcctaggctaaagccatcctccagcctcagcctcttatgtagctgggaccacaggtgcgtatcagcacgcccagctaatttttgtattttttgtagagacagtgtgtcattttgttgcccaggctggtcttgaactcc

SEQ ID NO: 194862 - DNA, 286 bp, Homo sapiens
cctagggttggctaagccacctctgtctttcactatacatagggtttatgttaaagggaaactggctagatccatgtatattcaaatctgtgtgataatgcaccatcttctcacaggaatctcctagactgggagtccagatgcctacagtctaatctcagatctcatgagttctgtgatgctaataactcacttaacctatctgggcctcaattccttcatctgtaaaacaggggcactgagaaggtttgagctgaattagaattcccacttctaacactgcaca

SEQ ID NO: 194863 - DNA, 953 bp, Homo sapiens
cgggggttccttgggcagacaggcaacctcatgaacaaggcagcctcaggagctcctctccctcctcagtggctccgatcgcgtcacctgtagagcttcagcccagcgcgtgggttccttggcagagcatagaaaacatgactcagattttgaaataatggttccccagcttctgcaaaacaggagaaactggaactgaaattctcttcttcctaaagtaggctgactagtatggcttcagaagaaaagtactgttataatggaaggcctccagaaagaaaaatggttctttcccacatcaagacagtataaaattagtatccctacaaagacaatgttatccccagcaattcaactcagtgttcatcttatctaccacctggaccaagtttagcacctaaaatgatataatgccaaatgcctggactagtgtccactatactgaaggcacaaaataattattaatattaattcattctcctccaactctcagcctcagcagggagttcagggctaaagacagagaaaaagtacatgcaaataaacaaaagtgaccccaggcacaatggcttgtgagcttaaaataaagatgactccaaacagaaacctaccttagaggcaagcaattcctctcctaaacatctgcccaaaagaaataaaaacatatgtggaacattgctcataaaaacaaaaaagtggatactacctaaatgtccattaactgatgaatagtacaagatggcacatctatgcaatggaatattatttagcaataaaaaggactgaaaaactgatacatgctgtaatatggatgaatcttgaaaactttatcctaagaagccagtcacaaaaattaacatattgtatgattgcacttatataaaatgtccagaataggcaaaattattgaggattaatagttacctggggctgggaatgaaaatgggattaac

SEQ ID NO: 194864 - DNA, 533 bp, Homo sapiens
tgttgatgataaaataagattaatggtacatctaatatcctgacacttaatgcaaataaaaacttacatgtcataatgggaaaagcataaacctttggaggatcacatacctgctagcagttacttgttctagcaccttcgaatactgaccttctctatgcatgaaatgaagttaatttcaaccccaaagcattttttatgagaagtaaaaatgttacatgtgcatataaaatttatgtctcataaaatatcaattaaccatctcctgacagagaagtagtgtgtcatccaatgttagccttttaatttatacatgaatattgtttatataaaaaagtatatgatgcaacaagacaaggctggctaactcactatccatccaaccttccttcttcactaacagaaccctgattttatcagggatctacttttctctggttgaccaggtaactcacagtaaatttcattccatttcaggatttgcttagaaaaaggcaaaagacacaggtcttgctcacaagtcatcagcaatc

SEQ ID NO: 194865 - DNA, 847 bp, Homo sapiens
  misc_feature (660)..(660): n is a, c, g, or t
ctggattttgttgactgaatccctgtggtattatatgctcttctgcctctgtacttcctgtctattgatagataaacctagaagcttgtgagattgaggggttttttttggtctttttccagcaacagtactttttaggtggtgatgcattcttcctccaagaggcacacaatgtctggttctctatttgtggcaacatcagccactgatgagcagtacctacatccatgacagaattagggctgcaaaagggagatactctatcattcttcatgtattagctgaagtagtctatgaagggagacttcccctcatctaccatttcattacccggtggtacagtttgatgaggaaaggcagagtgagcatttagatctcttcctacatttaccagttctcaaaaacagctacttcatccagggctttatttaaacattttcctagacacttgataaacatcttttttgtgtagagaactgcgctgggcactctgacggctacaaaggtgagttgggcacagtgcctgcatttaaggagctccccgtctaatcaagcaagattcttgctcccatcagggagcacacataaaaaaaactaaaaaaaaaaaattatctgatgggacgaagaccatcttgctcccatcagtgggaacctgtgaantaaagagtcaaatgtatgaaagtcctcatggaaaaatgctgacaagcactaaaaatcactgtaaattccttggagagttctcagaattgcagaagttcagaaaaattactttggtctttcacatgtcaatattcaggaaagaggttctttctcttattacattcctccgggctgatggacgcagact

SEQ ID NO: 194866 - DNA, 472 bp, Homo sapiens
ttcttggaggatagcttatttgatgttttcttctatttcttactttctcttcccttccttcaagtcctccctttttgccccccccccccccccccgttttattgtaaattttttttggaagccttcctcaaatgattgttgatttcagactgcacattcataattaagaatgagtcattaaaggccaggcgcagtggctcacgcctgtaatccccacactttgggaggccaaggtgggtggatcacgaacgaggtcaagagatcgagaccatcctgaccaacatggtgaaacaccgtttccactaaaaatacaaaaaaaaaaaagccggacgtggtggtgagtgcctgtagtcccagctactcgggaggctgaggcaggagaatcacttgaacccaggaggcagaggttgcagtgaaccaagattgcgccactgcactctagcctgggtgacaaagcgagactccgtctcca

SEQ ID NO: 194867 - DNA, 711 bp, Homo sapiens
aggagagtcaagtttggaccaactcggaggctcattgtctttgacagacacccagctggtgaacctgtgtcctggaggaatgcaggagcagctgctcattgtattcaaacctttgatggaaggtggtttgaatgataatggttgaacagactccaaggctgagaggacgggcgggcggcttccttcagtgtccctgaggccaacacactcagtgctccgattccacagagggggactttgggtggtgctgggggcgttgaggaagaagggcccctgggcacagccagcagtgctgtcctcagtagtgatgacaaggaggaggaggaaaagggaaaagaggaggatatgatgacaaagatgatatttaatccctcaaacttgcttttagggaagttcctccatctgcatgtggctgtgtgtcagggtgattattagtagggttacgtgaacacggcacagtggtacaatgccatcagactaaattttttaaaagttttaaattttcattgtaactggcaattaatgatttttaaattatttttatttatttattgtttctttgagacaggtctcattccgtcacccaaggctggagtgcagtggtgtgatctcagctcactgcaacctctgcctcccagctcgagcgattctctcacctcagctcccaagtacctgggactgcagatgtgtgccacaacacctggctaattt

SEQ ID NO: 194868 - DNA, 470 bp, Homo sapiens
gggcaaagcctacatatacacagtaacttcattaagatgattctggggaaaataaatattttgtttacattagaaaaaaacagattaaaggcgaagtttaaaagatagtacacaaaccaatatctgagttttgtttgtggtcaagattaaaatgggcatttgtgtgtgttgatgtgtttacagagcagacatgtgaggtgtctcataaactgttttgttttgttttgtttgtttttaccaaagattagttttcaagtttgagtacagatcacctaatgatattagcattttcacatcctgcaaatattgatgacagtgccttagtgagaactcttccccaattcaaaattattatccatgtctcccagtcttgaataataagagcaataataatagctaaaatacactatgtgattattgaatgattaatccaaactaaccctctagctttctaactcatatctatatat

SEQ ID NO: 194869 - DNA, 453 bp, Homo sapiens
acactgatgaaagaaactaaagaaaatgcgaataactagaaatgtatcttgtgtctataagctgtaagattaatattgttaaaatgcccatattaatcaaagcaatctacagattttatgccatccatatcaaaacttcaatgacatttttcacagaaatagaacaacccgacaatttgtatggaactatagaagatgctgaatagccaaagtaatcttgagcaaaaagaataaaactggaggcgtcacatttcctgattttaaaatctactataaaattatagtagtcaaaacaactttatactagcataaaaacagacaaatagactaatggaacagaacagaaagcccagaaataaatccacacatttacagtcaattgatgtttgacaaaggtgccaagaacacacaatggggaaaggacagtctctttgataaatggtgttgggacaa

SEQ ID NO: 194870 - DNA, 135 bp, Homo sapiens
acaacccatatataaacccacacaaataatgtctgactgatttttgagaaaggcacaaaaacaattcaatggaggaaacatagctttttcaaaaaacgttgctgaagcaattggacatccacaggcaaaaaaaaa

SEQ ID NO: 194871 - DNA, 180 bp, Homo sapiens
tgaatatatatggtacgttgtgaatatgacttctcaattaccccaaatcagcctacaaagacatggcatgtgtgtgggaggaaagaagattgagtgggcggagccttgtaggtaccaattctttctgacataaaaaaaaaaatagcagtcctggggtgcagggggaaaattcttgaaact

SEQ ID NO: 194872 - DNA, 351 bp, Homo sapiens
gccaagactcagttctttcagccttaaaatggagatagtgttgtgtctccttcacagatgtgttgtagagccccagtgagataaacggtgcatggagagtcttcttaaactgtagagtactgtgcagcagaagagagagctggcttcaacacttagtcttgtgaccttggagctgacggctgcacctccctgtgcctcagtgcattcatctacaaaataggaataaacacatttcttgctctttcctttgtatttcattttatcttctaaggaaaccaacagtatacttgctatttcgtcgaggtgccctactttgaacttggcctagccatatgcaagggtaccgagctc

SEQ ID NO: 194873 - DNA, 390 bp, Homo sapiens
caaataatccatgaagaaaacatattagaattaataaatgaattcagcaaagttgcagggtgtaagatcaacactcacaaatcagctgtgtttctacataccagcaataaaaaaaaaaccctaaaatgaaagtaagaaaaataattccactttcagtagcatcctaaagaataaaatacccatacctaggaataaacttaactaaggaagtgaaaggtttgtccattgaaaactataaaacattactgaaagaaattaaagacctaattaaggccaggcacagtggttcatgcctataatcccagcactttgggaagctgaggtgggcggatcacaaggtcaagagatcaaaaccatcctggccaacatggtgaaaccctgtctccacta

SEQ ID NO: 194874 - DNA, 919 bp, Homo sapiens
aggtatggaggaggcagaaaaggctggaatacggcctccttctctggctggggggtgagtcctagccatggcagaaaagagcaaagccacatcaagcagagcagggcagaggctttgtccagaaaccctctaccccagtcccacccccagccttgggcacagatagttgggcctggcctgagctctgctggccacagccatccaggagccaggcgagcatgtgtgggtgtgtcctccccaggatggggggccctgagggcagacaccaagtcttccgcaccttcctacctgctccaccacagtgttggaaggcactacccactgccaattacagccaggcgcctttcctgaagccctggttcacttcattcacagcccattaccatgtacctactgcatcctaggagcttcacagggacaggaggggcagggagcattgtcatcacccccaactgtttgtgggtcaaggagaccaaaacaaagacagtctgaagaggggggcccctggaggctgggagttcctcaaagctacccagaggaagtgtggctggaggagagaacagaggatgggcagggattagggaagagaggattcactgcagcaggggagggggctgtcatcaagacacaagagcatgagggtaggcggatgtgctgaccaccagctcgagacccactgcctgggggaaagtggcaggaataaggtgtacctgcagagaggaggcagaaggattcctcctggggcaggagaggccttggggaaggaatgaagggagagtcatattttactgtttcttttactacactgttgaatctcatacaagaatgtattactcgtggcattaaaaaaataatggtgaaatctaaatcatgtgttgagtttagttaagagtagtgtactttttttttttttaagtaa

SEQ ID NO: 194875 - DNA, 346 bp, Homo sapiens
atgaaaaaaagagaaagatttgaaaccaacaatttagcttccatcttaggaaatcaaagaacagcattataaacaaaagaaataataaaaaatagaacacagaaatcaaaaaaattaccatagaaaaatcaataaaatcagctcattgaaaagatcattaaaatggattaaactctagccaggctagcaaaaaagggggaaagatggagaaaggggaagaaagaggaagaaagacacaaactactaatatcagaaatgaggccgggcatggtggctcaatgcctgtaatcccagcactttgggaagccgaggtgggcagatgacctgaggtcaggaattcaagacc

SEQ ID NO: 194876 - DNA, 225 bp, Homo sapiens
tctgcagcaacaggagaaagatacagcatccacaagtcacaaaaggtgggagcttttacaaagagatagatatcttagaaacgaaaatgaaatcatgaaactaaaagtagccaacaaagaaagtgctcatgataaggcggagacctccagagagtaatcctgagccacaagggaacagcagggagaccacagcaaccggagcactttctttgttgtctgcttcag

SEQ ID NO: 194877 - DNA, 239 bp, Homo sapiens
atgggtgctctagaggatcctctctctccacactgggacgggatccggaaagtatggcagaggaggaagtgttcagtcaagaatgggattctgaccatctcacatgccccatgcattggcagagctacccgtggcctgctggcctctttgcatgactctcaatgcatctcagaaggagatgctgaattgttctaatgctcccaaagcatctttctctgaggagcccagtgtgcttctaa

SEQ ID NO: 194878 - DNA, 504 bp, Homo sapiens
tcagatggatcccccatcaaccctaaatttattatgtaaacaaactacaacttgaccaggcagtatattcttgtaagaagaaaggagtcttctccaatcatagcagccagccttcagccaggggcagactgcagactgaccagatgtgtccaaattagacaaaggttgagctgtaaccaatcagcctatatccaatgccacttcctttttctgtttataaacgctgcttgcccactgttgctgggtggaggtctctgaaacctctctaatgtagatctctcatttaatggggagggtttggcctttaatcaccatcatccctgaacaaagactgaccaattggactcaaatgctattgaactatctttattgcatggactttgagttatttgattttgactagttgtttgttgaaactcctgataaggagtgtacttcagtttcttggcattgtccactcatagccatcataataaatttagggttgatggggtaccgagctcg

SEQ ID NO: 194879 - DNA, 354 bp, Homo sapiens
taggccccactgacttgcttttggtatcttaatgacatcaagctccttgcttccttagctccttgcttccttgaccttctcatcctttaggtttcagctcagatgtctacttaaagagattctctggtcaacctgtctattaatgtctgttccaacaaccagttacttcccttatagcacttataatttgtcattctgtttctgacttctacttcttatccatctctccagtagactgtgaattccatgaaaacaaggacggtgtataactatttgctgaataaattgataagtggatggacaggttctgtttccaaatttcattgactcccttctttgcttccctcccaggcc

SEQ ID NO: 194880 - DNA, 405 bp, Homo sapiens
gagaacttacagaaatgtgtacaagcccagtgacgttccaagactctcggcaagtgtcaacagagaacagacgtgccaagactctttctcacagtgaattctctcaggagaaaccaagccctgctaccgatgaacttatactccagacatacatggaaacaacttaccatgcctgcgagtcagcaccaacaacaaacagccaggttcatggttgtgaatttcggataatggaaagactatctaaaagagaacatgaaaggaacacatttaaaatgactaaaatacgccgggcacagtggctcatgcctctaatcccagcactttgggaggctgaggcaggaggatttcttgagctcagaagttcgagaccagcctgagcaatatagcaaaaccccatctcaatta

SEQ ID NO: 194881 - DNA, 265 bp, Homo sapiens
tgacgtatgatcaagccaccaaatctcagcatttctttggacaaaagacaaccttttttagtgaaggaaaattcacagcaaccaatctgggtagggattccaggtgattcttgccacctcattctcagtcattctcactagggttgattccacaaccacattataaactcctagtagaccaggccaatataattgctcatctcccatgacacccaagtgtcaataaataccaatgaatgaattgactccatttgtttgttttgca

SEQ ID NO: 194882 - DNA, 367 bp, Homo sapiens
gtttctagaacacacaacagcatttcactaacatttttatgaaactcaacaaggaggttccatgctcacagaacaagcattacttacatcaactacatatagccaggataggtgtgagataaaggcagtgcttaagtaagggaaaagacatcacttctgcttatcaaaccttattttctcactgactcacatacaaggaaatgggctgttcagaaaaaaaaagtacagcagtaccaagaacaccttgtactctttttcagactgaattttacggggctctaactacgcagtaggctctgtagtatgcaaggtcagagcctagcttctttattcctgtcctcctcaaaagtcagatagacagaaacta

SEQ ID NO: 194883 - DNA, 435 bp, Homo sapiens
tgaggccaaatgtattcaaataaaaaagaaaccaatctattaataagaaaaaagaaagagcagcatgggcagatcagagaggaagttcgcgctgacagcactcacacccgccaggcccatccccagcacttccaatgcaaataaacacagcttcaattccctgatcacttccatcacgggagtattagtatcctcccactttagagaggagactgggcacatggctcacgcctgcaatcccagcactatgtgaggccaagacaggaggattgctttaggccaagagtttgagaccagccttgccaacaaagccagtctctacaaaaaaaatttcagaaaaaaaaaagagaggagaaaactgcggcatggggcagaggtgcgataacttgtccaaagttgcagggagagcagctggctggcccaggatgggcccct

SEQ ID NO: 194884 - DNA, 204 bp, Homo sapiens
agttagcagtgtttgaaggctgaaccacataactctcacttgtcactatctcgcctcaagtaaatcactgataataaatctaagtttcctcatctgtaaatagaaggggatgaatcgggtcactgccaaggctttttctagctcagagtatatttctacacaacccttttaacctacaatcagagtttatatgtggagcatagc

SEQ ID NO: 194885 - DNA, 624 bp, Homo sapiens
aagctttactagcctgtaataggtgttaaaagcttaataatgcatggttataggcacgcctgtttaaaatgcctaaaaacaccctagcattgaaccacactaagttttagaaatctttcctcaaagttctgtaaattactattcttcagaaaaacagtacttcaacaaatttcattttgccaagtcagcaattacagcatttttctcattgtgaataagtcacaatgtaaatgctatcctgtcccatttactagtctttctctcgatttttcagtcatctggttttgctccagtactaggatagagcccaaaaaatgaaaaattctaatatccttaacgtgtcctcagtgacaaatgaacttggttatttccaaaagactacatgctaagtaatcactaatgttgcctattgcccttaattccaccatccattttaacttcctcgatgcttcttaaaattagtgaagctttgcttaacaaaacaaactacaaaaacaatgtttctataaactgaagatcaaaaattacattttcaaattaaccattaaaactatttttagtgttaataaataaaacttaacttccgtgtttaaatacagaagaacacatacagcattaacaatt

SEQ ID NO: 194886 - DNA, 532 bp, Homo sapiens
cttagaaccatgttgcagtatgagattcttcacattcagttcttctttcttcctccatccattttcagatatggtgctttgtggtctgaaggtcatccctgcttcctttcccttagtctttcacaggcatttctcccaacaggtagtgagaatgggttttgggttctggaaatggttcagtcacagtaatgatatcatcctgggttttatgtgggacacaaatatttcctggcacaaggtggccacacaaatgaggatttcatcaatgatgaaactgagaaaatgtgcaagtggagaggattgtcttgtaggtacaatgatttgggcattttaaagataggagaaaaacatgtctacaaggactgtggagttagctaattattgctaaattctgttgatgcccttcagaagaataatgagaaactgaggtcaatcaaaaagcaattaagggagaagtgtgagatccagtgagacactttggtagtttacaaagaggtccattctcctgcagtagaagagtggattcagagga

SEQ ID NO: 194887 - DNA, 487 bp, Homo sapiens
ggttccatttttgtgactcagtttctctagctgggccatctgtctagtccttttatgtggcagttcacccccagcatctcccctagcagacccattggcttcaattcaaaatctgcaccacctaagaaggaagaatagcatgggcataccaaactgcaggagctcctctctctaagcctgtttgtttctgtgactatgccccagggtagtgggaacaatgcctcttctttaccttgaggagtatcatcactgatgtaataacacatctccctctgtcttgtagtctaaacccagaaagggcaaagccaagacatttatgtctggttgcaacacttcctttcgctgtctcctttccttctctctcatcctattttcaaggacaagatatgtaggtttttctattaactctatatcatatctttttttttttgtgactgaagattagccttaaggacagacttggccttgatatgctaaatggagcatg

SEQ ID NO: 194888 - DNA, 541 bp, Homo sapiens
agtcttgccaatgctacattaacccatagaccatgagtattggttctataacaatcttattttctctgcaagctgtgtaagaactaaggccaacatgtctaacagcctcggctaacagactaaaaagacagatacgcctctagagtccatagacggaacagaggggccaagtctccctgatttgctctgtgcagaaggaaacgttcacggggaaatctccagcataggatgatccttcctggagttctgaactctcaaaaacgcaaatgggaaaagcaggcacagaggacgcactgagagaaggaactcccttccagctcacagtgtctctatgcagggaagatttgcctgcccagagggaagaaaatgatcaaactttcagaggtcttctaggctggtaattattgattacaatccaaattcagtgaataggtattttcacaggccatgtgaaggtgcagctctacgcagcgtaacagcttaaaatgagccttcctgttgctgccctatatttttgctctaaaaagttgtatttttctca

SEQ ID NO: 194889 - DNA, 345 bp, Homo sapiens
ggctgatggaggaacaggtttggagcatgctgaattgagattctagcagacttccctacaagtagagatgttaaagaggcaatggatatacaagtcaggagttcagaggagaaattcaggctagagataggagtcagtgatatacaggtagtatttgaaaccaggaactagatggatgagatcatcaaaagaatgcagatgattaaataaatgttaacagacagagagaaaaggggagataactgagccctggagctctcccaacatttggcggcttacaggttcaatcagccaaggagattgagaggtaaccagtgagatatgaggaaaaaaatggcatacgat

SEQ ID NO: 194890 - DNA, 248 bp, Homo sapiens
cagggataaccttacccaatacgctggggttactgtgaggattaaaaaagaaagactacagagcattgtgtttgactcacagcatgcacttcgtcaatcctgatccccccttccctgccccttagtgcccatgttaggcttgacttattggcacatgagttccacaaggtgccagatggcactttccatggtaaaggaatctataggtaaagaacaggctttgtctttctcctagtactgttaggatt

SEQ ID NO: 194891 - DNA, 490 bp, Homo sapiens
ccacctacagtccggttagtgcatctaaagtccaaataccactctacagtatgaaagtattaatctatctgttctactgtgaggagctgagtttcacaaatgagaaagagtgagcaagaagcagaaaccactttaatcagagtggttactgttctaacattccaaaactgaatttatctcacgtgtttgtgggactggtttcttttttaaaaggaatataaaaagcagttttctttttttcttttttgaggcagagtcttgctctgtcacctaggctggagtgcagtgatgcaatctcggctcacggcagcctctgcctcttgggttcaagtaattctcctgcctcagcgaagaatagcattatatagtacagtgatagaactcctgacctcaggtgatccgcccacctcggcctcccaaagtgctgggattacatgggtgagtcaccacgcctggcctattggtcctttttaataatatctgatgacca

SEQ ID NO: 194892 - DNA, 465 bp, Homo sapiens
cagggaggtcagataaactgcccaaaccaaatccaggcccagccagaatctcagctccagcctttgcgccttctgataaaacccagcatcgcttgaatttccagtacacgctgctcaagtcttcgttaagcaataaataaccacacaaccctacgtgtcatgccaagttccatatggccatccagaaagagacacatggagctggttcctctcacctttatgaccagtgaaaagcgcaccaacacgaagacacgcgtgaaaggacctcatctcctacccagactgacaagcaagggatttttttcactcaccgtcagtgggatggttctaagcaccgaggccaacccatttcacacgattatttcacaaaaagaaaccttctgtgggacgtgcctgggcgactgaaaagacagccagcaaaactgagaaccttgttctcaaatctataccctctcccaaggcagc

SEQ ID NO: 194893 - DNA, 275 bp, Homo sapiens
ggtgccttttctctgttgggatggcatgtgctcaggcccgggaggaggcctgctcatggcccgtggactacaggttacatggcaagtatgatcaatgccaccaggaatagcagcagctctctggaggctgaaagctattataggcacccatgatgctgggctctaatgacagcccagagaggaggctgcaacacgagcttgtcccctgagactcagagctttgccccctacaagaatctgtccttcatgaccagccagcatctggtacttgcccc

SEQ ID NO: 194894 - DNA, 319 bp, Homo sapiens
tgtattaaaagagttgccagcaaacttttcctctttagggccagattgtaatggttcagactctgagggccacatacagtctgtgctacataattgtctttatgttttgttgtgttttctttttacaactgtttgacccctgtaaaactgtagaaaatagtaagagtagatggcgggagcatctaggaagctatcagagtagtctaaggaggacctgatatggcttgggagagaatggccataatgagaaagaagagacttgccataagattttagagttgaattgacaaagcttgcttctagataggaggagaggagg

SEQ ID NO: 194895 - DNA, 314 bp, Homo sapiens
gacgcacattaatcactactatttaatcctaccctgtctaattagtctatataatctgataaaaaaaattagaggtataaaaatccaaaggaagaggtaaacttatcactagttgcaggtgatgattataacctagaaaccccaataaaatcgcttgaaaaaataccacaaacaataatggaattcaataacacagaaagagagaaagtatacagaaatcaaaagcctgaatatatataagcaattaccagttagtatctataaacccatttaatagcaacaaaaaggagaaaatatcctggaataacaagaaa

SEQ ID NO: 194896 - DNA, 429 bp, Homo sapiens
atagtaggttcagcatgcactgaggatgagataaagcatggtgtactgggcactgctggagtaaatggtgttggtagcaatgaggtagaaattaagctgtaaggttagcagaggccaggacatgaaggatcttatcctcctatgaaagggttgagactttatcccacaagttttgtggagttgcttaaggagataacaacatggctagacatgcaataagttgaagataaatccgattagttcactaggccaatggaaacctggaaacctgagatcttttaggggcttcgccaagtcaaaattattttcataataatgttgccctttccacactcattccctcaagggtacagtggagtttcctagacatatatgacgtgataaaatcattgctctgatgactaatggaacatgatattgtgttttaga

SEQ ID NO: 194897 - DNA, 598 bp, Homo sapiens
attgttattccttaccatttcctatgctcagtgttttcatgtacagttgactgttggataacacacattgtataacccattaacatttcaaacatcatgcttcaaactcagtttatcctctttgaaaactctccaccgagcagttaatccaatctcccatatttgtattcattactgcacatttctctcaaagttcaatctctctttgctatataatttctctctaggcatatcacagtacctgataaactcaataaatatttgtcaagataaattgaaaatcataactatgtccattgttactcgtgtaatatgaattcataaatgtgactgtaaaagctaatcttcatttgcatataaagtttgttctctacagatacagccttcatgtaagtgactacaaagatttgcttttagccttagctcagatcattcaacttagagtttgtgttagaaaaacagttttctttttcctgaggctacgtgttaatttggaatattacctctccacagtgtctcatattacccagaaaagatgactgttttctcttttttttcttgtgaagcctgtcttaaaggtggactttgatgccacagc

SEQ ID NO: 194898 - DNA, 393 bp, Homo sapiens
ctttctcctctttatcaagatcatacacacccacaaatagacaagtttaattatgctcattgatacctctctactacaaggggcaagaaagaggaagaacgaacaagggtagatttgtctcgggaaaaaatggttcagttttttgtgtgtgtctcaatggttcgaaatcccagtggtgtttggctgtgtccaatggttcaattctcatctcctcttttcccagaatgatttatgtcttctctgaactctttttatgtttgtacttaactttcatgtgaataagatgcttatctatttcgtgtgtgtgtgtgtgtgtgtttctgagtaagtattgactgggaaaaagagagaagtcaatcaaaagtatactgtgcaattgagagaggctggccc

SEQ ID NO: 194899 - DNA, 190 bp, Homo sapiens
tttatgtcttgcaggaaacattctttacaatgaaaaaaaaaaggatcatactcttttaagccattttttgtcacttgctaagaagttatactgagaatgttaagaacttgaaaaatgttttagaacagataataaactttgtgttttggaaatcctgctaaagtatcgtgttttgagagcttaattttta

SEQ ID NO: 194900 - DNA, 364 bp, Homo sapiens
gggcaaatgtctgtgagtttggagatttgcaatcatttctgtaacactcagaggtgctaataaaactaactcagggacctcctaaacatgttacttttaaggtatgttcaagatgtttttaggtatttccagatatttcctcctcctacctccattctggactacagaaaataaacatgaaagtacaatttcaaagcaaaatgggatcaacagagtgaatataagtaattcaaaaccaaacaatgaattacttggagttcggtttgttcaaaccatgagaatgaacataggctggcagttttcgactttgcttggcatgattctgcaagctgacaaattaccttcatttttatttgatttgact

SEQ ID NO: 194901 - DNA, 414 bp, Homo sapiens
cccaaagtgctgtacttgccctccttgaacctagttcagggtgtgatctagcaccacaccacatggaaccagtttaagaataaaaataagtatgtatttcttgagtacctgctgtgcagcaggtgctccacaaacattatctgattggaatttcattggaattacacagtaactctgaaaggcaggtaacattgtcaccattttacagatgggaaaaactaatgttcaggaagattaagcagtggcttaggataacaaagctttttacaggataatgctcaactataagtaggctgttgagtctcagttacttaacctgtcatctgtaaaatggggatgaataatatttgttctgctaacctctcgtggttgttatgagaaactgttacaaaaatagatgtgttgcagaagcga

SEQ ID NO: 194902 - DNA, 486 bp, Homo sapiens
agccccattaaaaataaaataggcaaaggatttcaacagacatttccccaaagaagatatatggatggtaataagcacatgagaagatgtcagcatcattagggaagttcaaattaaaaccaccatgtgataccactacatgtattttagaattgctaaaattaagaagactgaccatatggggtgaggatatggaggaaatgaaattctcatacaatgctattggtaatgtaaaatcaaactaccactttggaaaacagattaaagtttcgtgaaaagttaaacatgcacctaccacatgtcccagcctctcagttctaccagaaaagaaagcagatatccatacagagatttgtacaccaatgttcatggtacatttattggtaaatagccccaaactggagacaactcaaaagttcatcaacagatgaatggataaacaaattgtgatatatccatacaatggactattactcagtaaaaaag

SEQ ID NO: 194903 - DNA, 204 bp, Homo sapiens
cttaaagaagagaccaatgaataaatgagaaagaaatggaggcaagagtcagcaaggtagatgttatctagtttcaaagcagccttccagttccagattccagggttttatgaagcaatgatcttcttacattaagtcagtgacagacacccctgccctgtcaatgccatataataatcatttttcttttgtgtaagctacttt

SEQ ID NO: 194904 - DNA, 455 bp, Homo sapiens
tataggcatgagccattacgcctggctaattttgaatttttaatagagatgaggttttgccgtgttgttcaggttggtcttgaactcctgacctcaggtgatccgcctgcctcagcctcccaaagtgctgggattacaggcatgagccactgtgcccagctgattttttataaatgttaaatcaacactatattcctgatgtaaacctaacttggtcttgatatttttacccttttcaaatattgctagctttaggttgctaatattttacttatgttttcacatatttataagtgagattacctgtaattttcccttttcttactgtccttgttaggttttagtatcaaggttgtgtgaatttcataaagcaaagtaatgtattttttctgttccctcaatgagtttgcatacaactggaattaattcttccttgaatattggttagaatttgc

SEQ ID NO: 194905 - DNA, 393 bp, Homo sapiens
gcggaggttgcagtgagctgagatcgcaccattgcactccagcctgggtaacaagagtgaaactccatctcgaaaaaaaaaattgtctcattacataggcaagctttactacagtccctcgactaaatagctgagttcgaatataattcatacctgaaatggtgcatttgcagtgggaggaggttaggaacatggagagagtgtcgtatttcttcaagtatatggacagaacattcctcacgtgattctcaaacgtggtcccagaactgcagcctcagcagctcctgggaacttgtgaaaatttgaaatttttgagctccaacccagcccagacctattgaatcagaaactccaggaaagaggcttacaagtgtgttttaagaagccctctac

SEQ ID NO: 194906 - DNA, 411 bp, Homo sapiens
ttcccacgtgaagtttccgtaactagatggggggataaggcttgggcagaattcccagccatatctgtaaacagcaaggagagctcctccccctcccttctgctcccctggaatcttgcccttctataatagcatgcaggacatcgtgcagtagtggtttttctgtgtgcgaatctctcattagactgggagctttctgaaggcaagggcaggggttatttgttgttcatttttatatccctgatgtttagcacagtgcctaggacagcaatcaagagatgatggttattccatttgttcatccattcattcaacaaaatcatgtggaggttcagagcagggagagataggctttgagagaatatgtgaggccttctttcagaagtagccagtgccagtagcacttgctct

SEQ ID NO: 194907 - DNA, 302 bp, Homo sapiens
ctgtctcagtttcctaactagttgggactataggcatgggccaccgcacccccttaatttttttattttttgtagagacagggtcttgctctgttgctcaggctaatctcaaacacctagtcttgaactcccggtctgtaactcctgacctcaagtgatcctcccacctcagcctcccaaagtgctaggattacaggcatgagccaccgcctcctcactttggtctttatctccatttgcctaacagatctttccactaggccatcaccacagattcaccagctccattcccctacaccaca

SEQ ID NO: 194908 - DNA, 604 bp, Homo sapiens
aagaattcaaagggatgtacgttcaaagtgagtcactgaagcactatttgttatagcagatgactagaaacaggtatccattgagaaggaattggcttaatggattaaggtacgtcctacagtggagtagtacacagctgtaaaaaaggaatgagaaaatagactgctgtagagggatctccagataacactgttaagagaaaaaagcagaagatatatatagactaaaaaggagggaaagatgaagcatacctgcaattaattctgtttcaaaaagacacattcaaaagataaaacgttaataagaacatagttacctatagaaggaggtaaagaacaggtgaaggcaataggactggaaatgaggaatgaaccttgatagattgatggcataaccaaacaaaatctgtttcatatgactttaatgactttctaggcctcctgatacaacataaaggcaaaagagccacagagacatcttaaattgcattcagtaagcttattaataagatttgatacatattttgaaattattatatatgtagtacagggtaaagaaaataataaatcatgttataatatttaggaataaggattccagcaa

SEQ ID NO: 194909 - DNA, 413 bp, Homo sapiens
ttggggaatggggagcatattttaacatttctgaatttgccatgggagtgtcagggtacctcttactgatttctttagtagattgtgggattaattgttcattccatcttatttctgtcacaaatccaggaactgtatgctaagtgccccattcactcaaactggatacactttacacaagtacatttggtgattacctaataagagacaaacttcaggtccttgtggagtgtcttagtccattaagtgttgccataaaggaatacctgaggctgggtaatttacagacaataggtttatttggctctcagttctgcagactgtataagaagcatagtgccagcatctgcttctggggagggcctcaagaagcttccaatcatggcagatggtgaagggggaacagatgtgtg

SEQ ID NO: 194910 - DNA, 321 bp, Homo sapiens
cagagcaagactctgtctccgaaaaaaaaaaacaacaaaaaaaacctcatttaatatacattaacactgaactacgtatcagtcgctagcactgtaacgcatgcctgaatgaaacttatctaacacatgtatttcctccataaggcacatcacagccttcttgcacttagaacacaagatagcactttgtactacacttgggagtcaattttaaatagcaaaatcaccaacaaaaaggagaaaaatgcaaaaaatgtagttatactaactagaccgcaaagaggccaattgtttatactatgagagctgatgcaagaagac

SEQ ID NO: 194911 - DNA, 265 bp, Homo sapiens
tacactccccaaaagtgttttcccaggaaagccctatttttttttcagcgaggttaataggactaaatctccatggggaagggtcaagctctttgggaaagtgcatcataggaacccaccaagagttgacttcatcagcctttctcagctcttcttttgcctgccccaaagattacagaacaggagtgtttgttttctcagattcatttgtgataacttagtcattttaaggatgttcatgtgtccattgactttttttttcttt

SEQ ID NO: 194912 - DNA, 439 bp, Homo sapiens
agacctgtgtgcatgtgtatgcatatgcatgtgtgtgtgtgaactgtatataggtgaaatctaggaatgatccacttagtttcagcaaacatctatgctcaagggcctatgctgctcataagacttcacacctacttgccctcaataagttattgtcccatggaagaaaccaatgcagatgatataacaacaagcatggagggctactggcagggtgaggggaacatggccaatgaaccgttcctggaggtgacacctgaaatgataaactgttgtcattactaattttctgcctctgtctcctgccagactgcaaactctttgatggcaagaaacaagttctgtttaactttgtactcccatggggctgtttctacagtattggctgaattgatttatccctcacagccacatgcaatttggctcaaatcccaaggct

SEQ ID NO: 194913 - DNA, 458 bp, Homo sapiens
atgtccttccattagaaagaataacatcctcaggccctactcttcatttgtatcacaaagaacattttgcttttaaacaaactaattattgtatctattagagtaagatagggtcatcctaagtatcacaaggaggaaattctcttccttcaatatttgagtaacaccttttacaagtccacatcaccttttcaatcacctaatgctgtgccccagccagactggaaattgctttcctttgtccacttcagattcaaaggcctatattcctgtttgtgatcacggaaggttaaaaaaatcagacaagcatctgtgacacttcaaaacaaaaccctgaaaacattcactcccagtgatctccattgcgaccccttctcacacacttccatgggctcctgcaaaatagtgtcacgaaaactcacagtgaaaaatgactggtgcataaacaattcacacac

SEQ ID NO: 194914 - DNA, 415 bp, Homo sapiens
caaagaagggtgatcttcaaatgttaaagacaacaaagtcaactcaaaaaagctggtgctcagaaacttagcttactaagagggtgatcactgtatgctgggcacagtcctcactccctggagagttctcactctaccgtggatgttttgcacccttcctctctttttaactcaccatattcctgtgagttcacatgataactgtatgagtttcctcttgctgctgtaacaagtggccacaaactgagtggcttaaaacaacacgccttgtaatcccagcaatttgggaggctgaggcaggcagatcacaaggtcaggagttcaagaccagcctggccaacatggtgaaaccctgtctctactaaaaacacaaaaaatagccaggtgtggtggcaagcacctgtaatcccagcta

SEQ ID NO: 194915 - DNA, 510 bp, Homo sapiens
ctgaattcagaggagcaacagacaatacaacattagttgaagatttcaataccccaatatcagaaattctttaaacaaccagaggtacaatacatatggaaaaacatacagaaatgtacagcttagtacactgttgcaaaatatacattcacaaaactactatacaaattaagatagagaacactgccagaacctcagaagcttccagtgtactcctttctaaattctctcaccccgacatccctagccaaacaacttttcttcataacttgaaggagctaaataattgaggttgtcatacttctataacactgtggaatgtatgcttgcaacctttagaaaaccaagtatctaaaaatgatttttaaagagctcttctaagttctattctagacctgaaatattttatggtctatgctcaccgaattctgacttactagctatagttaacagttccggattgcttttacctgctaatcatttaatccttatgatcccactttacgccaa

SEQ ID NO: 194916 - DNA, 342 bp, Homo sapiens
cttcagagtaaaaaaatgaaaatcactttcccaccagaatcaaaaaagcttttctaccactctaaacagattattgtttatttgcataggtcattatttatattactttaactagactttatgagttcacttaactatcttttcagagcacaaaactgaatgtttacatttcaaaaacttcaaattccatttctctgatctacccaaaattattagctttttcatttacaagctgtagtacaattcttagggtttttatttgcttttttttttttttttttttttggaaaaggattccccgcctggccccccgggggagaggtgcaagggggaacccgacct

SEQ ID NO: 194917 - DNA, 390 bp, Homo sapiens
cctttggacaagcgctgacacttcttttgcctattcttctttgacactttattcattcaggttccaaacaatcttgcctttaatatgctctacagatgacatttcaactggcaacatccttcctcagatattttgtttttataaaggcaggatgtggcttcttcattctgacctttgggcacttattattatgaaaatacataagtgaattataaaaatccatttattgactcacatgttggttcaccatataaaatcagcaaaaatgtcaccacaacttctacataccacaccccaaaaggagaaacttcacgtactaccatactattaagtagcctcagagatctctacccactgttttaatgctgagttccacaatgaggtcatgtg

SEQ ID NO: 194918 - DNA, 244 bp, Homo sapiens
agaccctgtctctacaaaaattacaaaaaaattagctgggtgtgatagtgtatacctgtggtcccagctattcgggagcctgggaggttgaggctacagtgagccaggttcctgcgatccagcctgagttactgagtgagaccctgtccacatccccacaagaggtaaacttatgttcatcaaaagacatgtacaaggatgttcatagctgctttatctacaataaccattcactgcaaacaac

SEQ ID NO: 194919 - DNA, 474 bp, Homo sapiens
caaaaaggggaaaaattagccaggcatggtggctcacacctggggtcccagctgcttgggaggctgaggtgggaggatcccttgagcccaggaggttgaggctgcagtgagatctgatggcgccactgcactccagcctgggtgacagagcgagaccctgtctcaaaagaaaaaaaaaatctgtcggtagcaaaaagtaacagtctcacgctgttactggctgttactagcagtgtcgcaggaaagcgacagacttactttatttgtgaagaaatgtctgcatgtacccgagtctgaataaccacgatttctttttcagggattttcacaaaaaaagaaaatggtgttccattttttagtcgcttattttttaattttagagacagcgtgtagtcactttaaagtgaccagctaatcacttattcagccgcagtgttctagcgttttcctcatccccaccaacatttgatcatt

SEQ ID NO: 194920 - DNA, 509 bp, Homo sapiens
agatatgctattggttggtgatgaaagaaggagcttgcaccagaatataaattatttctgtcagctgattttattgttgttattgtgtccccgtaacaagatttttctaaaaatttatctttgcctgaacatccccaaaacactgtgataaagaaagtaaaaatggcattctgggtagcactactctaaggtttctccaagaagagaaattaaaaaaaaaaaaaatgccaggcacggtggctcacacctgtaatcccagcagtttgggaggccaaggtgggtggatcatgagatcaggagttcaagaccagcctggccaatatgatgaaaccccatctctactaaaaatacaaaaattagctgggtgtggtggcagctgcctataatcccagctactcaggaggctgaagcagagaattgcttgaacctgggaggcggaggttgcagtaagctgagattgcaccactacactacagcctgggcgacagagcaagactccatctcagaaa

SEQ ID NO: 194921 - DNA, 680 bp, Homo sapiens
ggatcagtgatttgcttagttctaacatgtagctgggacaatttatagaactgattccatgaaatgatctcttcaaaatcatgggtggtcaggaaatggacacatgaaatcacaaaatacattgttacagttaagtcacaactgtggtgtagagagaaactcctttcctcaaagtccttagaaaattccattgcatactttttggaatgttttagccaagttaaggctaaggctaagagatgtagaaagggaaatagaaaattgaagacagtggtatccttgtagttaagaagcagaaaatctcagagtaaaatttgtcatataccatttgcaaattaatatcagatgctctaaattcattttgtaaaactatttgttagcttatctataatttatttatttaaaaatacttcattgaaataaaacaaatgtgtgttggctttgcatttactattctcagaagtatgagaaggtcagttactggtatcagtgtttgttctcccttaggtgattctgtttatgcatatttgacttactatagaagttatcatttttgtaggtctaatgtcaatttgaattaaaatgattcatttgtctccatcagtgtttctgctatcattgatttctttctgtcagtattttaaacaatagcatcactctgtggaaagtgaaatgaatgt

SEQ ID NO: 194922 - DNA, 373 bp, Homo sapiens
gtattctgtaagtatataaatattatttgtatccatctgcaacttgctcttgttacactatattgagatggttttgagatgtatccatgttgatattttttgttgtagttcattagttttctgttgtacagtattctattatgttaatatacttcaatttaattatctcgtcctgtcaatagacacttaagggtttcttttttagtttttcactgtttaaaacaagactgcaatgagtattatgtttttgttcttatacataagagcttctctaagtatatatctagagtagaccttctactttctagatataagcaatttgctcttcaaagtagttgttatccgttcatactaccagcagagttcctactgc

SEQ ID NO: 194923 - DNA, 728 bp, Homo sapiens
tttgagcagggaatttggaaaacattagttgagacaatgagatatatactgcagagaaatctaaagaaatcacgtttgcagaaatatcttcacagaaattggtggcctcttcagattttcaatagacaacaatatattaggtttgagcaaaagtaattccgtttttgacatttctttgaacggtaaaaagcaaaaccgcaattatttttgcaccagccgatactagtagttactgtcggatatattgctgcatgttattgtcagtgaaaagtaatgtcttctattgttctaacgtcagccagtagataatgattactgataactagtggagcaactaggtaatagctggcaaagagctgacttttagagtactgagatctttgttgggaaaatgaattttaggaggtgtccacatgatgggaacttactcaagttgggttggagaattgaggaattgagtgtgtgtcttacatgatagatgttaatgaaggtgaaaggaggaggagtgtttgtttagtggggagaggggcagatacaggagttttttgctggtttggaaaatgttaggtcaatttggacctgggaaataggttgggtatgacctggtggaataacaacttagaaaaatggtattaatatcttctaagaagtcattctgaagattcattatcataaggtttagatttttattttaaatggtaacagcgatacttcattgactatgttaa

SEQ ID NO: 194924 - DNA, 343 bp, Homo sapiens
aaggggcttgacagattatgctgtaggctttgaaagcttttgaaaacctgagggagtctttttttaagtgattactttgaaagagctcatttgcatatataaaacctggatttggggagcccttaagggtccctttaagtgtcattttacatcataactgctaatttactacaataagtgaccctaggctaatttaaacgtagattgaaagattgaataaaatatattttaatttgctaggaatcttagccttaagggtagttagtgtattttaccctctctgtgggatgctgggctgttaaaccaacaaggtgtggtccactttcacaagcatattaacatt

SEQ ID NO: 194925 - DNA, 781 bp, Homo sapiens
tcaccatgtacagtctgtgtttctgtgtgtaagttttgataaattttaactttttttttttggagagggagttttgctttgtcacccagggtggagtacagtggtgcgatctcggctcactgcaacctctgcctcccgggttcaagcgattctcccgtttcagcctggatttgtgtattttatggtagtaaatcataaaagactagtatctacatatattttatgcattcatgacatacctttttaattttttccatatttctaggctatgtggttcatctgcaagttttttcaaattgttgcaaatctccaaaaaaattttcaagtgaactcgtgcagttcaaacttgtgctgtgcaagagtcaactgtatttgcttattttctcaaaaaggaatgcctaaaggataatcaagaaactaatgaaactgccagatgtggtggtgcacacctgtagtcctagctactcaggaggctgaggtaagaggatagcttgagcccaggagtttgaggccatcctgggcagtgtatcaagaccccatctctaaaaagaaatacgaatttttttttagagaagttaatgaaattgatcacatggccatgctcagtggctgacacctgtaatcccagcactttgggaggccgaggtgggaggatcatttgaggtcaggagttcgagaccagcttggtcaacatggtgaaaccccatccctactaaaaatacaaaaaatagctgggcgtgttggtttgtgcctgtaatcccagctactcgggagggtgagg

SEQ ID NO: 194926 - DNA, 435 bp, Homo sapiens
aggatcctcagtcggttctaccatgctgaccaggccggtctctgcctcccgggttcaagcgattctcccgtttcagcctggatttgtgtattttatggtagtaaatcataaaagactagtatctacatatattttatgcattcatgacatacctttttaattttttccatatttctaggctatgtggttcatctgcaagttttttcaaattgttgcaaatctccaaaaaaattttcaagtgaactcgtgcagttcaaacttgtgctgtgcaagagtcaactgtatttgcttattttctcaaaaaggaatgcctaaaggataatcaagaaactaatgaaactgccagatgtggtggtgcacacctgagtagctggtatacaggcatgcgccacatggccttgataattttttttttaatggtagaacagactggta

SEQ ID NO: 194927 - DNA, 439 bp, Homo sapiens
ccaatcccagaggagtcaataccaacggctagccagcctggatagccaaggaaggggaagagcaacccagtctcaatgccacccacttactccactgcacacagagactctgtggtgggcccagctgggagaggggagaaaatgtaagttcaatcaagtttagagttttgggttacaatttgaaatggacattctaatttctggatagagtctgagatgatggtttagcatgaatgcaaaggtctctattgcctaacagtacccagaaaagtcataagatgttctttataaataaagtttaaagggacagtttgaaagcaaataaaatgtgttttacactttgggagaccaaggtgggcggatcacctgaggtcaggagttcaagaccagcctagccaacatggtgaaactccatctctactaaaaataaaaaaaaaat

SEQ ID NO: 194928 - DNA, 196 bp, Homo sapiens
gcggtgactggtccttgcgcagagtggtccttgcacagaggtagccaatggaccctcgaggctgtaccccagacaccgcgaaccgaatttgctaacatcttcagccaccgtggcctccgcgtgttttgtgggcccatcggtgttcagtgagggattccgtgtgtctggcaatgtgtgtcaacaggtgttggcctga

SEQ ID NO: 194929 - DNA, 361 bp, Homo sapiens
agtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctct

SEQ ID NO: 194930 - DNA, 286 bp, Homo sapiens
tgacttggttaatgactctattttctgaaatctgagaagccagtcctgggccctatgggtcatggctgcagaaggaaacacagtccccactcttgaggaattcatctgcttttgggagaggcaggatatattcaagagaactaaaaaagttggaaaagtaaccaataacccaaactgtatccctagtttctgatctttgtgagtacaaagttatattctttctttacagcaacacacacacacacacacacacacacacacacaccccagggcacagcacacaggg

SEQ ID NO: 194931 - DNA, 500 bp, Homo sapiens
atcatgtacctcatgcttcactgtctctgcacctgggaggcactcttgttatcccatttttaaaaatttacaagtccccattatgcctcagaaaatcttgttttcccattttacaggtgaggaaacaggtgcagagaggccaggtgcttgccagggtggcactaggcagggataaagcgggccagcggctccagagtctatgctctctccacctaaagttaagaaaacagttacagagaagtaagaggcagtgttaatatcagatgaactggaatgaatgggccaaaatcgtatttaaaatgcatgctaatacagtctgtaaagactgtcacagttatgaagccttgctttcccaagtaacatgctcactatgcgtaaaccagaagcagctgggcagagtaccaggagcacagtgacaagctcctgtctgtgacagatcattgactaaagatcatgtgattaaaaggtgacatggaatagaggcatcgcatctcagaatc

SEQ ID NO: 194932 - DNA, 571 bp, Homo sapiens
aattaaacatacatacgcatcactaaaaacaggaaaactgcttcgctcttgtctgatcaaaataattctaactatattggtggtttaacagcagagcatgacataaagtttatcacctacggtgtgtgtttttaccttgggcaagtgattaaatgtgtcctctgataaaaaatatggttaagaacatatactccagaaggtgttttaaggaatagattaaaacatgtatattaaagcactttgtgggtgctatataaccattttaatgattactatcctttgtacaagagattcttgggtagttaacaagattagaagtgaaaatgactgaaacagtaatagtaaataatttctcatatatctgacatcttcagttatgcttcaaataatttacaaggtttgtgatttatcccctaaaaaaattatttagcagtaaaaaattagatgtctgaacatttcacatggataccataaggccaaggatcaataaatctaatgaaatactcacaccaggaaacgcagtttttcactttgtattattttgttgctcatagtcacagttgaaacatac

SEQ ID NO: 194933 - DNA, 272 bp, Homo sapiens
cactctgcagcaacaggagcactctgggcttgagaacccttggtatcctttcatcttcttttaagaaaatgctgagaaaacaggcaaacttccctgggaatgatgggcgggcccagacatattccagatgggcatgattttggttcatgttgcaacaggctggacagcttgccgttgttcacaggtcatccgctagacaacagagcagcttatcttcgcgaagttgaaggcacaggaaggcttatggcctgacccttcacctacagatttga

SEQ ID NO: 194934 - DNA, 195 bp, Homo sapiens
gattaataacttgttgcatgtggtttttgtagagtgacagtgtaagaagccagactgtgcattacaaggagtgactgagaactgaggacatgaagatggtgcaagcatttttctaagctgtctgaaagggaaggaaagaagggaagtaagacaggcccttgagagaggtgaatagctgcggagcacttaaataca

SEQ ID NO: 194935 - DNA, 492 bp, Homo sapiens
attcagcagaaagtggctgcttgcatagtatgaggagactttataccaaaacaaagatgaaggtcatctaaagaaaagaatacagtggtagaagtggaaaagcttattgatacatacaatcctagataagagtccaatatggcccaagaggaggtaaaataattagtctcctctactcagctctgcagtgctgtagactcttccaacttcaggtttattactgtcgaaaagagaagcagaggctacctaagtgggccagaacacctaccacataatgagttaggctgtaaaaatggtattatcactaaaaatttgacatctacgaagtttttatgtgttctctattcataacatttttagggcataaggatagacaaatgtctttctagagattacctgggataaacactagtgtggcaggattagcaaatgctcatattccagggcatcatgcttccaccccatttaaataatctgattgtttcattactc

SEQ ID NO: 194936 - DNA, 433 bp, Homo sapiens
agcctgggtgacatagccaggccctgtctctacaaaaaaaaaaaagttaaattagtgaggtgtggcggcacacgctacagtcctagctacatgggaggctgaagtgggaggattccctaaccccaggagtttgagactgcagtgagctgtgattgcaccgccgcacttcagcctgggcagcacagcaagaggccatctctaaaaaaataaatttaaaaaaagaatgtgttgtacacggacaagttactgcatgctagagatacagtgatgaacagaactgttactctcattgctaaaacatgactgatttcaggcaaggtgcagtggctcacacctgtcatgccaacactttgggagaccaggtagggaggatcacttgagcccaggagtttgcaaccagcctggacaatatggtgagaccttgtctctacga

SEQ ID NO: 194937 - DNA, 608 bp, Homo sapiens
cagcactaggcaaattattgaggcagaaaatcaacaaagaaacacaagaaaatggccttggcaaaaaattcctgactaagacctcaaaagcacaggcaatgaaggcaaaaatatacaaatgggacttaagtaaaaaacttctgcatggccatggaaagaatcgatagcgtgaacagagaatcttcagaatgggacaaaatatttgcaaagtatgtatgtggcaaagggctaatatctgaaatttagaaggaactcaaacatctcagtcataatgagaaaaactcaaataaccctattaaaagtggtcaagtaatatgaagagataatttttaaaaacgacatataaatggccaaaaagcatatgcaaaaatgctcaacattactaatcatgagaaaaatgtgaattaaaaccacaatgagataccattttataccagtaaaaatggctattaataaaaagtcaaataataacagatgttggcaaagatgcagagaaaagggaacacttacacactgttggtgggaatgcaaataagtacaatctttatggcaatcagtatgcagctttctcaaagagctaaaaatatatctaccatttgatgcagcaa

SEQ ID NO: 194938 - DNA, 498 bp, Homo sapiens
ggtcccatcaccccacccctgtataagccacaggaagcttcctgaagctgtcaaagggcgctcaaatgagtgtcccacttctatggagccaagggctgaagaggccatgctagaagccgctgtcccatcaaggccccaggcctgtaccacagccaggtccctcctgctagcagtttggcaagaagggtccttggcagaggccccaactctggattaatattacaccaagagaacccaaacaaatggctcctgactttcacgctccataaagttctgaggcttaaaataaagatgagtttggaggggagggggtgtcaacaatagtcagcatagcagagccacaggatgaaacactgtacagccacttaaaagagtgtttaaaaccacaccgttccattaaaaattctcattatgtagtgttacaccaaaaagctagattcaaaggtatgtaaatcagtaagatcacaactagtttttaaaacttgtgcacattaaaaa

SEQ ID NO: 194939 - DNA, 359 bp, Homo sapiens
gattccaagctttctagccagttattatcctatctacctaaccatcactacctacctcctctaggccaatggccaaacaatgcatcaaataggtcctagaggaataactacccacattaccactaaggaactcaactataacagctctgcctgttatgttctccctgatacggatcttctactcagagtaccccatttacaacaactatagattccatgcgccactccttaacaaacctcagtaccactgactcctcagtaggccactagtctccaaaagagttatgagctacataagaacatggttctcaagcctgtttccttcctagcacacctaagggttacaacatgtaacttct

SEQ ID NO: 194940 - DNA, 251 bp, Homo sapiens
aggtggtggcgccaaggtcgtctagctatttatcttagttctgcttctttccaactttttgctttctcccttttctcctgtcttataaaccaggcaaaaggggaggttggggagaagctgggaaggacaacaggagaagtggtggcctcattccatactaatatttgattaaataacccattctatgtaattttagccaatttaaatggcaaataataaatgatcaattatatacatacataaaacttcct

SEQ ID NO: 194941 - DNA, 539 bp, Homo sapiens
agaagagggttgtgtgttcaactcattcaattctgtaagcattgctgaagcaggtgctgtatgccagaccctagatgggctacaagcacatacggatacataggaaagagcccctaccctcagcaagctcactgtcagtaaaggagacagaaatacatcaatcaaaggaggaagagaagatgaggaattcacagaaaggataatggagtttctgtacaagatttaccagaaagagagtggtgtgtagacatgcctggagcagacaccttggagccgctgacagaaggtgaagcagtccaagaaaatgtggaaacttttccgctgctctacacagtccacaaacctgtccattttatttcgttgaagctttgtctgagagataaccaaatagacagtcaaagtaagttatctcagccacatatggggagtggatgctgctgaattgtgattaattgggggagccatataggtacatttggcatgatctgggcctatgcggtcttacaatccctgtataaaactagacaatgaaaaacaga

SEQ ID NO: 194942 - DNA, 413 bp, Homo sapiens
tgttgacagacttcagtctttgttcctcccatatgacttcagttagtgaaaaatcagggaggggatcataggtaattgtttttttctttggcgagtctggactttagccagatgagggaacttctgggaacaacttcattctgtgcttggagagagacagggaattgagagacaggagtggggagaaggtcaaagggactttgaagatccttcagttgagtatgtcaaaacaccgtatttcaggcgatcagtttctgagcccgaacattgcacaacctggacccctctgtgcttgattttaagaaaaataaaaatgagtccttgcaccctggctccctaaccagaaaaatgcaccttcaaccttgctcagctcttgactcctggcaagttgcacttcctcctgtgctcagggg

SEQ ID NO: 194943 - DNA, 385 bp, Homo sapiens
tcccctcaggcaacaggtctctcaaatcacctcagatagaagtttttaaatgacctttaaagagagagcatctttctaatatttaacaatcctgatatttaagtaaataaaaaataaaatctcctttatatctaatctgaatcgcttaaggtacaatggtacaataacattcaggttttgttttatttcatatcatgtcactaatttttgaaatgatatatctgatggcgatggtggtgaaagtaaaactgcatatgtatatagacaaacagcattaactaagcttcccacacaaactgctgttacataaaacctgtaggaagtaattctaaaagaaactttgtatcatagaaatatttacatttagtggtagaagtgaaatctg

SEQ ID NO: 194944 - DNA, 633 bp, Homo sapiens
ttagccctcagcaattcaagtcctcattaagcactcacagatgagagtgttttttagacaaaattgcaacattctgcctaatttaaatttgctagaatttgatttattctaaataatcttgcactatactaaaataagtgtgattcaaatacatttttagtaatgagtagttaagtaagacaaagcaagacatccttcacaatagagatacagagagatccccagtcaagactccaatgatattaagaagtgtttctcttttataagaatatattctaaattaaatgaagcatatatacacacatatggtgataaacatgcattatgaactcttcaaatattcacattaaggtcaagaaacaataaaacttaaaaaatgctaattcagttatgacaaaacaacaacaaaaaaagtttccaactgtcacagagatcaggaaagattctgacccagtggatttatattcctcgtccttcaatttccctagtatgattcttgattcttggacaagcccacctttagctcctaaaacatgatggttacaccacagtaatatgaaactcaactcctatctttacctaggactatggctaaaatataaaggatcacagaaagacaagaactgtttcaag

SEQ ID NO: 194945 - DNA, 289 bp, Homo sapiens
atccagaaaactttctcctcattgaaatgtttctgtgacaactgtcttcttcctttcctcctgtttctcttgaccagacctgagtcatttcgcctcctggatatctctgtcttgtaggcactcaagcccaatgttaatttttgtgtatgtgtatttttttttttttttttactttaagttctgggatacatgtgcagaatttgcaggtttgttacacaggtatacacgtgccatggtggtttgctgcatctatcaacctgtcatctaggttttaagccctgcatgcatt

SEQ ID NO: 194946 - DNA, 616 bp, Homo sapiens
tggggacagggtctcactctgtcacccaggctggagtgcagtggtgtgatcataactcactgcagccttgacctcctgggctcaaaagaccctcctgcctcagcccaggagtttgagaccagccttggtgacacagtgagaccctgtcaagaaaagaaaagaaaaaagaaacgaaaagagaagagagaaagaaagaaaagaaggaaggaaggaaggaagaaaggaaggaaggaaaaacaaaataaaaagaaaggaaagaaagaaaagaaagaaggaaaagaaggaaggaaggagagagagagagaaaggaaagaagggaaagaaaggaaatgaaggaaggaagggagggagggaaggaaattaattatatttttaaaaaaatccttgtagtcagaccaaatcagaatccagctcaggtgctacacagtttatgcctgaccccaagttcatgaatcacaggcagtcccacccagaagatgtagatatgtacagcacactagaaactgaagcagactgcaaaaagagactgcatagacaactatgagatgtgtgaagttgcaaataattattttaaaaatcatgtaatcaagatatgaacaccaatgagattaaaatc

SEQ ID NO: 194947 - DNA, 629 bp, Homo sapiens
aagtcagggcaaggtgaatgtacaaagatgaagacatgacagtaggcaaaagctatgagacagagaaaagacatacaggataatagtggagatacaaacagacacccaaatccaaggacaacagtggagttccagaggcaggatccataaacttttactgatgtggtctctagagctatcttggatccagaatgaaaatctggctccaatttttatgagacgtcactccaataagactcctgtttttccattttcatgaatattatttccaatctcatttcacacatatgctttcaataagctatctcaccccaacccaagctagcttgtctctggtctgtgcaatcaagaaagcatacctggccaggtgcagtggctcccgactgtaatcccagcactttgggaggccaagtcgggcagatcacctgaggtcaggagttcgagaccagcgtggacaacatggtgaaaccccatctctactaaaaatacaaaaattagctaggcgtggtggcatgcacctgtaatcccagctacccaggaggctgaggcaggagaatcactggaacccaggaggcagaggctttagcgtgcagagactgcgccactgcattccagcctaggtgacagag

SEQ ID NO: 194948 - DNA, 783 bp, Homo sapiens
tttatttagcaaatgtggttgtgatttttttccagtgcaggggaattcgttggccttgtcaatctcggtatcattatttttagtagtctttctgagactttagcctataaaacagttttgctgaaaccccaaactctctaaatattacatggcaaatttgctttcttttggaaacctcggtgctgatgggccagctgaagtgcaggtgagctttttcagggaagggtgggacaacagtacatcctggactctagactaatactactcctaagaggcaatttgctaaatcctactgatttattttttttcttttttctctttttcatgttgtagtgtccagtctacttcttactgggtattgcaaaaatgaattttcttgctctatcacccaggaacattgtgttttgggagctgggtctttcctctttaacataattccattccccattttgtagcaaatcagtctgctcctcctctaatacctaaaagtcaacaaatacctgcctcaagccccaggtttcccatcttctcccgaaggtcttctagcatcggtttggttagcaatttcctgccagagccacctacatcttgattattttggtcagtctttcggggatttcatttcagacccccttcgagaaacactgtagcccaactgatcccaggggttggtgaactttcagttttattttccctgacggtgttaacgcccaaacttttcacctcctaagtcaaaaaggactttgactctagctcatttcctactacctccaacgtcagtta

SEQ ID NO: 194949 - DNA, 400 bp, Homo sapiens
ctgctgaggctgctgacattatggagcagagaccgaccaccccgtgtgctccttctgaattcctgacccacagaatctgtgactccaagaaaacgtttctttggtcccactagatttggggagacttgttctgtagaagtggtaatggcaaccatgagttgaatgaatataggaaaagtagaatgaaaagtgtgcaaaggacagtgttgagtcggggagagtagagtgaaaagaagggagtgaaagagtcttggggacagatccatactgagttgctgtgctactgtgagtcctaacaacagcacccatcaagtaagagagttttaaatcagtggttttcaactgtgggttctaactcattaaaaggacgtgaaatcaatttagtgtgtcacaactggca

SEQ ID NO: 194950 - DNA, 388 bp, Homo sapiens
tcccctagataaccatgcacactactataaccaccctaactcctgacttccctaattccccccggccgtaccaccctcgttaaccctaacaccaaaaactcatacccccattttgtaaaatccattgtcgcatccacttgtttattacgtctattgtctagcccctccactattgaatctccagtgcctagaatgccaagcacatagtaggtgctcagtagatatttgcagaagagatcattcttttactgttccagatattttgatagcagttttctgttggagctgaaagcatcttgaaagcatgatggatttcccttgagttgccttggtgtcctatgccctgcattttcaagacagtcaaccatgtcttaaactcacagtcagt

SEQ ID NO: 194951 - DNA, 185 bp, Homo sapiens
tgctgtttactgatgatatgatgatatacctagaaaaccctaaagactccttaaaaaactcctagatctgattaatgaattcagtaaagttttagcatacaaaatcaaggtacacaaatcagtagcactgccatataccaacaacgaccaagctgagaatcaaatcaagaactcaacccctttta

SEQ ID NO: 194952 - DNA, 1217 bp, Homo sapiens
gccttagggctatgggagctggagcggagaggagagaagcaccttgcctttgctggtgtttttcccgcagcagatggagtctcgctctatcacccaggctggagtgcaatggcgcgatcttggctcaccgcaacctccatctcccaggttaaagcgattctcctgcctcagtctcctgagtagctgtgattacaggcgtgcgccatcacacccagctaatttttgtattttttagtagagatggggtttcaccatgttggcctaactcctgacctcgtgatctgcccatcttggcctccgaaagtactgggattacaggtgtgagccactgcacccggcccaaacatttctttttcttttcttttgagacagagtcttgctctgttgcccgtggctggagtgaaatggtgcgattatagttcactgcagcctcaaactcctggccttaagcgatcctcccatcctggcctcccaaagtgctgggattataggcatgagccgcagcaaccactcctcacatttcttgagcatctgtgatgtatcaagccagatgctgggcactgaggttgcagaaggcattgttcctgtcttctaggagccccaggctagcagggaagacggatgtgtatagagttaaccacaataccaggcctcaacttcccgtctgtaacacaggtggaccatgctagattgtcccagcctgccctgtgcttcattagccggtcaacagatccatctcaaatacctcccatgggtactcactgattgctttaacccaaaccatggcactcttgaagactttccctcaggaagctcaaggactatgcatccttctgggtcagaactggacacacagccaccagtgctggacaatggcggcggctcagggacacactggagccctggcccctgcagagctcccagcatgggtgggaagagagatgcaaatgaccacacgcgggtgaggagactccctcggtgcggctgggatgagccctagacactctcaatcacccccacgatgaccccttcccagaggtcccctcagtcatctgccctgaaccaagctcttcctgatcctagaccctccaccctccctctatcttccagggcttggtgacattccaggcagaaatttctgacccttttactttggtccctccctccccagcccagtctctggtcaaactggattcctggctgttcccagaacgagc

SEQ ID NO: 194953 - DNA, 619 bp, Homo sapiens
acaataactcacagccatccaaagaaataaagaaaactggtaaaggtaactagataagtaaatacaagagtcagtagtattgtatttttgatatggaacttcttttactttgaatatgatttaaaagacaacttaaacaataattatcaatccaagttaatgagcaccatattaattcattagggctgccttaacaaagtaccacagactgagtagcctgaacaactgaaacttatttcctcctatttctggaggctagaagtccaagatcaaggtgtcagcaggattagtttcttctgaggtctctcccagatgcctgccttcttgctgtgtcctcacatagtctttccaccgtatgcatgcatgtctgtgttccaatctactcttcttatataggtaaccgtcatgttggattaaggctcacccatatgatctcacttaaccttaataaccacttttaaggacctgtctccaaacacaatcaccttctgagatactgaggattaacacttcaacatatgaatttagggaggacacaattcagcccataaaaagcacacagtgggccgggtgcagtggctcacgcctataatcccagcactttgggaggctgaggtgg

SEQ ID NO: 194954 - DNA, 192 bp, Homo sapiens
aagtcgctcacaaactcaaagatccataaacatccattctaggcaaacaccatttcactaatctgcccactttgtttcatattgggtattctgctctatttcaaggtaattttttaaaatggcaaacaatttaataaatgttctattttagcaaaactgggagttttgtagctaagttgccatgtcaaaacg

SEQ ID NO: 194955 - DNA, 354 bp, Homo sapiens
tttagagagcataggacatctaaatggagacaacaaagattaaaggagttgtagatattgatggcatgataacactgatgacatcagataagcatgtattgggtggagagaacatcatgtggaaatgtccagagtaaaagcaatcatggcttgttggagtaacaaaaaaaatgtctcaatatggttgaagcatacagcaatttggataacagagcaggagatcagttgctgggccttgtaaactttgttaaggaatttaggtatcatcttcatagcagtgggaaaccattgcagggttttaggaagaggtaaggtgatcatatctgtattttagaaagatctccctggctatat

SEQ ID NO: 194956 - DNA, 380 bp, Homo sapiens
tattggtggtgctggcacttcagataagaatctgtcatgcagaggctccaggggcaatttgcacttggaaaatctcgcagactagtacttaggaaaactgataactgccgttttgaggtgtctgtgttttctgttacattccccggatactctcagggtaattgtagactccaagctcaggattactactcccaagtaatgtgaatcaagcattctgagtccatgaggtcaattcctgcagagacttgaactcacttcctcctccttgccacattgatgagcagttcctcggaatgggtgggaagactgacctactcttgagagagccccaggacatgctgtgtgtgtgcgcgttttgagtgaactgttccaagcgagtc

SEQ ID NO: 194957 - DNA, 510 bp, Homo sapiens
cccaaattctaataattagtcttttaatgtacttttatttggaggacaacatgtcacagaaaaaaaatttggtttaatagtgtaaatttatgtaacactgaagaaggtgttactttaagaaaatggatgaacttttgacagttgaattcattaagtgcatatttcttaaaccttggtaaaattgatcccacatttgtggctaaccttgtaagtattatggggaaggagaccctccaattcattttaaattgtgattatatagcatttgcataggcctgagatgttttccttaagttcgactattgtgtatatgatattctaatgtgttacttaaaatatgctttcaaacactgggtataatgaatttgaagtgaaacatattttaatgagtagtcttactaaaaataataaacatgtacttaaaggaaacttaaccattttcccatgtggcataatgtctttctgatgtcttagattattgagcctcaacaggcttgctctctgtgaagg

SEQ ID NO: 194958 - DNA, 305 bp, Homo sapiens
actgaaactgaacgccacacccactaaggccttatgaggaaggaagaaaaaagtaatgatggctttccatgacttcagcaaacatctctaactccgttagtatctgctgattctgttccctattcctaattgcctataaatgtatacacaactaccatattatagtgaatgcaacaagaattagttaagtactcacaagctgtcaacaacactacctttcttctactacctcacacctgacactcagggtttaaaaaaaaaagctactaaaaatacaaaaattagccaacgtggtggcacacgcc

SEQ ID NO: 194959 - DNA, 230 bp, Homo sapiens
ctgagctcggtacccgtcagacgctgaactatgtggaaaagttcgactgtacagcaaactagagaggacagcacaatgaacctcaaggtacccattgcccagcttcagcgattctctacatatggccaatcttgtttcatctgatgcccacccatttttgtcacaatctcacattatttgaaagcaaattccaggtgtatcatttcatgcacacatagttcagcgtctga

SEQ ID NO: 194960 - DNA, 318 bp, Homo sapiens
tgctgggtttacaggcgtgatccactgcgcttggcctgcattgtgtttttattctgaaggctggcttagcctgtgcatgttcaagtagagaacatggtctcttacagctcctgaatcacagtcctagggggaggggctgacaggaccagcttgggccaatcactgtatgggcaggaggtgcagccccatggaagaacatggttaccctgattgtaaccatgtggatggtagggaagagtcagttctcacaattagcaggagtgatgttatagctcttgcagcctccagcctggtgcaggcaaggtggaggagatgttc

SEQ ID NO: 194961 - DNA, 647 bp, Homo sapiens
tcctcactcatttctctcaatgtcctaaacataaattatacctgggagggttgatacaattaccaaatcctagctaaactctttcagattttggtttagtgaacctctgtaaatgtctggaaagcagcccctttaatatgctccacagctttccagtaagttcccccatatctaacattggagaataatgcattagataaccataaattcctttccataagagaaaaattactccaaaattttgtaattaactaaaatcaaacaaactttctgaaactaagttattgctttataaaaatagacaaatagaaaaagttaagtaatgagccataaagtaaaagaaaaatctttttgtgtgatttcaagataataacctctccctcaaaaaaacaaaagcaacaaaagaaaaaagtcatatatatgtacacacacccacaggttgagaggttttcttcatcttccctccccttttcaaacagagttttccttaccacataacatctagtgaatcaaaatctcacatctctgaattgctggaaagaaactggatgacagattaagaaggaaaaagtaccagtgcagtggcttgtgactgtagtcctagtgctttgggaggccctgagcctaggagttcaagaacagcctga

SEQ ID NO: 194962 - DNA, 273 bp, Homo sapiens
agccaggacatcccaagtgatctgagaatcccttctatacagggcccaagcagtcactcactaggacattgtctttcctagcctaatgtccctaaggtcttttccaactctgacattctttgaggggatgatccttttaaacttcttactagcaatcattaactaccaagttgcatggcaatgagctcagctggcttgaggctagtcagaccataagatcacatgtttcatccctgaggaaggctcttgctgtatttcctgaacttcagactc

SEQ ID NO: 194963 - DNA, 284 bp, Homo sapiens
gacatgaaatcgtgtaacacacctcctccccacggtcaaaaactaaaaacacggaagctaggaaaagacactggaatgaacctctagagatgaagatgacgctgtgtgagacgaaaatcacactgggtgggattcacagaagaacaggcattcagaagatctgtgaactcagagaaacggcatgtcaacaactcaaacatgagcaaaaacactgagtgtggcagggagcaccgagagagaagatcactggggcaaacaccgagtgtggccgtggggtaggaggt

SEQ ID NO: 194964 - DNA, 377 bp, Homo sapiens
taacattgtaccgctacactccagcctggggcgacagggcgagaccctgactttaaaaataaaaaggaatttctgataggaagagcaaaatactccgacaaaggtagatagatatgacaggtggttggtataaccaccccataagttacggatgcgtaattaaaggtcaaactggttacagtgtatccagttgaacccttagatgtttggtgttttccccttgactttgctcataatgtttcctgaggaggttggggctaacacatgctaacacacatgctttgttggattcacagagtgagttttgttgttttaaatacatagttttatcttaagttggagggtctggaaattcttggatggagaacagacagtga

SEQ ID NO: 194965 - DNA, 134 bp, Homo sapiens
tctggaaaatatgaggttattgggagcttatttttcaaaaaataaatgtttaagaaagtgttctgaccatgttagtactggtgggtcttttttgggcagaggactcagagttttgtattttcctgaccccgttt

SEQ ID NO: 194966 - DNA, 391 bp, Homo sapiens
ctggcatgcagacaaggccgcccctgcctgccgtggccttttggtggcctgggggctctgaagcaagaccctcggcctgtcgccctgctagaggcctgggcagggcagggggatctcggggaggacttgggctgggcagactcgggcctttgagagtagctgttccggggaggggattggctggggctggggatgcagtgggcagcaatagctgaggaggcctgggggctgaaagctaagagctctgggcccatcctggccgtcctgaggtggccccactgcctgcagaggtgctgggttcccggtcagcttgtggtggccttgggcactggtgggaccaggtggctgtgttgggccccacagcctggtgggagatgtttttgcttcagca

SEQ ID NO: 194967 - DNA, 576 bp, Homo sapiens
agcccaccgcttgtaaagccaagtccccgtctctttggggcctggagatcattggtgcctagggaagaaaggaggggctggttttcctagatctaggtctagttagttttttgcttttctagctttttaattatagaaaaggtcaaatatacgcaaaagtaaagagaagaaagaattcctgtgtagttattagctcagggccagtcttatgcgttgacagccctgactactcccccaccacagagagctctcaactgtggaggttttctcttttaacagctttactgagatgtaattacatgccgttctgttcacccacttccaggatacgattcagcaggttttcttctattcacagaggtggacatcccccgccacagtctatttcaaaaccttttatctcaccaaaaagaagcaccaccccttagccaccactggtcccccagccccaggcaaccgccaatccactttctgcctctgtgtatatgtctctcctggacatctcgtgtaaatgggtgataggcagaccctgtgaccggcttctttcactgtgttgtttttaatgcctggttgaac

SEQ ID NO: 194968 - DNA, 794 bp, Homo sapiens
actggactcaagagctcgctctgcctcctgccgtgcccacgcctgctcatctccagccacgctggcctccagcgacgcagctgtctctccacctcgccatgctgacgcccacccaggctgccggtgccctgttctgcggcctggggcagccaccccacagctttcagggctcctcctcaggtcctcagccaaatgtcgcctctccaagagatacatccccaaaccactcatctaaagtggacccttcccctctgcaagtcacatctccttgtttcgtctgcagcatggcacgcagggggaatgtatttagttgtttgccactcgtctctctctgtgtgaacataaatcccgtgacagagagaagcctgtctgccaggacaggcactcagtaactatttgtaggataaatgagtcccctaacacctatgtgaagagagatcacatggcagggcaacttccgagacggaggccaccagaagtagacagtagctcccaacttggggactaggtaatttgagggtgagggtgtgtgagtgaaggtgtaagggtgtgagagtgagggtgtgtgtgaggatgtgtgacagtgagggtgtaaggtgtgtgagcaagggtgtgtgagggtgtgagagagggtgaaaacgagggtgagggtgagggtgtgtcagtgaaggtgtgagggtgtgagaatgagggtgtgtgtaaggatgtgtgagagtgagaggctgtaagggtgtgctgagagtgagggtgtgtgagtgatgatgtgtgagagggtgtgagtgagggtgagggtg

SEQ ID NO: 194969 - DNA, 541 bp, Homo sapiens
ataactcttagaaatcttgatgctataactttaaaatattagctgctagaaatttggatgtcacaaaacaatttgggaaagatgcagccaaaactttctccttgacctctacaaacacacacactctcacaattcctttactgcctgttgaattttcacaatgaaagcattcttcctgagcggaaatgaaattaagcttttctgggtaatcccacacttttcctaatatgtactgacttcagacaaatacatgtttcacagagtaaatacagcccaagggcccagtttattgttggaatcttttatcatttccctggcattctccctttactcgtagggctacatattttctcacctcctttaattctgcacaaagccaggataatgtatgatttaggttagggtacaaacatgcaggaatagagtattgcaggctctggaaaacagccccacctaaaactgctcctcaaatcctactcgtcatctgttctctcctatggagcctgtcctgaatttcacacaagaaagctcaaggccatca

SEQ ID NO: 194970 - DNA, 158 bp, Homo sapiens
ctttttttcttaaaagtactttaaaaaggaaatttgtttgtattttttatttacattttatatttttgtacatatagttagggtcagccatttttaatgatctcggatgaccaaaccagccttcagagtgttctctgtcctacttctgactttacttg

SEQ ID NO: 194971 - DNA, 676 bp, Homo sapiens
agccagttcatctatagtaatgaggcatatggacataaatgcagataaagggggctctgttagggggtttgaggaagttctaatctggcagcttttgttttctccatgaacaagtagcaaattcatcacaggagagggagattgaaaggaggaagtcaagtagtgggcgagtgccagatgaatagactggacaagtagcatgtgatttctgaaaagcattaaggacctcctggcagttagggatcgcgaacttgaagtgaaatcagtaagcattgttgtacaattttctctagccatgctcagttgcatgtttgctggtgtggagcagaacagagggttggatttaaccaggattgagttttagccaatcatgtgtgatcaaagagggcaaaggactcattttaatgattttgaccatggaatttaagctgtgtaggaagggaagtaagaatatgaggaaagtgaggaacagtgacaggtggaaggattaaccacagaagcttgttggagttggggtactagttggaataggctgcatatagacaggagtggtaattggagatgggatgcctgaactcaagattatggaaggtattgttgggaaataacaagatcagagatacactctgggagtgagtggccgtggtcacaatcactggggtagaggagatcaaag

SEQ ID NO: 194972 - DNA, 297 bp, Homo sapiens
acattggtactctagtatcccctaaaggtgaatagtgacattcataaaaatgtgtattggaactccttacctctgccctcttcttcctctcctctgccttccttcctgtctctgtttccccacctctgtccactcccacttttgtccttgttcctaacctctgcccaccttccaacctctggctattccttcacctacatttcatctgctggttccctactggctcgtttccctcagccctgctgttctttaaaaaacaaacaataacaaaaccaaaaaagcctctttacgtatgct

SEQ ID NO: 194973 - DNA, 589 bp, Homo sapiens
catccgtgaaattaaactctgtattgctgtgtgagtaattatggggcccttctgtgctgaggcagagggtgaggggtaaggtgttgattctcagcgttagtgtagggagtcaggtctctctcctctaccctccttcttcctctttctcctcactttttctccttccatccaaattggtcagacctatattggtctgtcctgggatcccatgacactgactctgagcttgcaaattgttctctacttttttctgccagcatattgggtaattaatgccccttctttccacctttcttcctctcttcctttcctcctttctttctttcttcctttcttccttcctctctctctctctctctctcctttctttctttgacagagttttgctcttgttgcccaggctggagtgcaatgatgctatctaagctcactgcaacctctgcctcctgggttcaagcaattcttttgcctcaacctcccgagtagctgcgattacaggcatgcaccaccacccccagctaattttgtatttttagtagagatggggtttcgttatgttggttagtctggtctcaaacacctgacctca

SEQ ID NO: 194974 - DNA, 346 bp, Homo sapiens
tggaggctgaggtgggaggatcacctgagcctgggaaggctgaggctgcagtgagcagtggttgtaccactcccctctagcctgggtgacagggtgagaccctgcctcaaaaaaaaaaaaaaaaaaaaagacacaaagggatgtttggtgccaagacatgaagaatgcttgattcacctggcaatgtctgggataaaggacagaatcaccaggtgggtccccagatgacaaatagttctgagtagacagtgggggtcccccttgaaggctcaattagaggaagcaggttgttgcagtgatggaccaggaggggcaaggagtatgtgcatgatccacatcaacccat

SEQ ID NO: 194975 - DNA, 599 bp, Homo sapiens
accagcctctgcctcccaaagtgctaggattacagtcatgagccactgtgcccggcctctgtgaaataactcttaaattcatgttttctacctagatttctccttgtctctggtcctaaatatccactacctcttacaactccattttggtgtaattaagacaaagcaaacttggcacatcccaaactgaactggttattttactccagatctgttcttcctcctgtctttactgtctcagtaaatggctgctatctatctcagttttcaatgtattgacttttctctttccctcatcaggtcataactgattagttaccaagttctatcactatacatcttaaatacctctagaatttgtctacttttcccatccctgattctgctttcctagttaaggccacaatttcatcttgcttaaaacaattgtaatgatttgctgctttacatctcctgccttgtcctgccttctatacattctctatactgaaggtagaatgtgctttccaaaaagcacatcttattatgtcattctctcacctgataaacagtgactaacaacataaacaccatctctgccttcagggagctttgggtat

SEQ ID NO: 194976 - DNA, 535 bp, Homo sapiens
gtgtttgtgttcaagtaacccttattttacttaacaatggccccaaagtggaagagtagtgacatttggcaatttggatatgccaaagtgaagttttaatgtgcttcatttaagtgaaaaagtgaaacttcttaataaggaaagaaaaaatcgtatgctgaggctgctaagatctacggtaagaatgagtcttctatctgtaaaactgcgaaagaatgaaaaagaaattattcatgctagttttgctgccacacctcaaacagcaaaagttacagccagagcaagataagtgcttagttaagatttaaaaggcattaaatttgtaggtgaaagacatgaacagaaaacatggtttaccgaatctttcatagctaccccctttccctccactgacagcaatatgttgcaccagaaacccatgagcaacaagggatcccctaaaatgactgacacagattcgggaatacagaaggtcaacagtagcctaatgctgtgtcacaatgcctacgtgatgcacctcacttaatatcatcac

SEQ ID NO: 194977 - DNA, 264 bp, Homo sapiens
attcatatcatcttaacacaggaatactggttttgcagatatcgacaactatttggactcaaaaaagacaagttttggaaggtggaaagaggcatacaagcacaaaacatcaaatcccatgtaaagtcagaaagaaaaacaccaactctaaccctgtgtcctcacagagaatatcaacatcttcaaacaaaaacaccccaaaaaaaggttaataaataaaccagatttcctgtcctctccactgactaatcacttaatgatgtg

SEQ ID NO: 194978 - DNA, 594 bp, Homo sapiens
agataaaccacccaatttattatgggcaagtattggtccagacacttccccaaagaagctattatgaaaagccaataagcacatgaaaaaagtgctgaacatcattagtcatctgggaaattcaaattaaaaccacagtgaaataccactacacacccaatgggatggctaaaaatgggaaaggctgacaacaccaaatgttgaagatgtggagcaactagaatgcatgcatttgtgatagatgtgtagaatgctacagtcactttgggaagcagtttagcagtttcttttttcttccttttttatggtaaaatttaccattttagatctgggttttcttcccttcattctcttcatatggtatatcacactgatcttcatgtgcggaaccaatcttgcatttcagaaatagattccacatagtcattgtgtataatcctttaatatgctgctgagtttggattgctagtattttattaaggatttgtgcatcagtatttacaggggatattggcctgcaattttcttgtagtgtctttgtctggctttattaggataatgctggcctcatggaatgagttaggaagtacttcc

SEQ ID NO: 194979 - DNA, 529 bp, Homo sapiens
tgaacagaccaagacaggcttgaagttatgtccagctattattaaagatcttttggctgagctaacaatatgttagaaaaactaaaatggttttgtttgcaaaaacaaaacatatttagataacaagaacaaaaaattacatattcattttttaaactgaggtttagcttagatccagtaaaattcacccttcttagtacacagttctatgggttgacaaacacatatgatcatgtgtaactagcaccacagtcaagataaagaacagttccaccatccaaaaaaactccccatgccggcccctggcagccacctacctgttctgtctctacagttttcctttgaaagaaggtcatttacatgggacagtattcagccttttagacctggtgttttcattagcataatacatctgagatacatccatgttattgcatatatcaatagtttgtcctttttgtagctgtgtattacactattgtatgactttatcacatttgggaaacatttgggctatttccagttgttg

SEQ ID NO: 194980 - DNA, 573 bp, Homo sapiens
aaaaaataacaacaatataataaatttagtttgtaaaatgcttttgaactaagagcccaagactaagggcaacaaactaaacaaattaaaagaccatggtggttagccgggtgtggtggcaggcgcctgtaatcccagctacttgggaggctgaggtaggagaatcacttgaacccgggaggcggaggttgcagtgagccaagatcgcgccattgcacttcagcctggggaacaagagtgagactttgtctcaaaaacaaaaacaaaaaccatagtggaaactgggtgagacctgtagttgtcattaagtagtattttatgacttgcttgcattaaacagaaaattgccaactttagaaaagggaccaccagtacaatttgaacagtaagttgtgttagggatattgtctaagctgtccactaggtgtactaaaaggaattttttttttttttttttgccataaagcatggatattttattctaggaaacggaaaaaacaaaacaaaacagggaacacatctttccacataccattccaatttaactgacattaattcagaaaagctagagca

SEQ ID NO: 194981 - DNA, 209 bp, Homo sapiens
gaaacaaagagtcttgccccaaatgagaaatcatctccacgatgataatagagaaagaaagaataactattttattaataaataagctttagaccagaatgtgatgggaaataaaggcaaacagctaagaggttgaaaagagagaaagaaacgtcactgttactatacaacccatttagtacatgttttcaagataaacactaatcagt

SEQ ID NO: 194982 - DNA, 224 bp, Homo sapiens
cgccttggcctcccaaagtggtgggattacaggtgtgagccatcacacccggcctaaagatttcttaaaacagtgctcaaaagtgctaactgagaaattgataaattgaactgtattgaaaacaagaaattctgttcatcaacagacactgtcaagagagtgggaaggatagttgcaatatatgtgtatatccccaacaggacttgtattcagccaatacagag

SEQ ID NO: 194983 - DNA, 167 bp, Homo sapiens
ttaacctgcgaatatataatgagttggagaaaagaaaactttaaacagatgtcttcccaggtagtatgtgtatctttttggttgactatactctcatttataattccaatcactagaccttaatcaccacagacagacctgatctgatcaaatgcaacaaagcacac

SEQ ID NO: 194984 - DNA, 238 bp, Homo sapiens
gaaatggcagtttacatgcttacatttttcatgtttacaagttttacatgtttacaagtttacagtttgcatgtgtgattcatgatctttgccatgatgtaactcttaaaaatgtcaaagaggtacgtcataaacagtagaaataaatattctgacagatcataaaaagggagggaggattgaagttttcctaggtgtagtataatttttaaaatagactttacttttgcaacagttt

SEQ ID NO: 194985 - DNA, 428 bp, Homo sapiens
tcattccgccggcacggtaatgcatggaataaagatggacatacaagtgggcattgcttctggtgagtctgcagtatagtgggtgatagggatatgcaaacagaaagttgtttttcttgggagatggcactaatccaccttgcctagaaagaagggaagtcttgctgaactgtgcatcctggcatgtatctctgccatcattcattattttcacctttgataatgaaatttctgacaatacagggtgttgttggagttcatttttttgttgataaaagtattactgtaatcaaagaattccttgcagaagttttgcaaccctcaaggaaaagtgataaaaaaacagaccctgcatgatggattgcaggtttcagggaggtgggagttgtccatcctttcgcgttggctttgcttttgtttgtgtaacc

SEQ ID NO: 194986 - DNA, 514 bp, Homo sapiens
tggctgagtccccacgttatccatgtttctaacaaaaagaagaaagaaacaatgactgcttgacaatgacggctaattcctcctttcttccccatctggatgtgttcacaactttctatcatccaaatctagacaaactaaaaataaaaacctacactttgtgaccaaagtcttccttgattagctgttaactgcttttcatttggactcaggaaggctaaagactaggccataggaggagtgactaacttattctttagtcaaacagcactgatgcagttgtcagcaatgcccctgtgactgaggaaagtattgttttacaaagtttttaatattttatggcataataacagtgaatcatattagaattctggtgtaggctgggcacagtcactcacgcctgtaatcccagcactttggaaggcctaagtgggtggatcacctgaggtcaggagttcgagaccagcctggccaacctggtgaaaccccgtctctactaaaaatacaaaattat

SEQ ID NO: 194987 - DNA, 406 bp, Homo sapiens
tgactaattaatctcctcctaccccacgaccaactcattcacatagccattcccttaggatagaaatggactgttccttaagataggccatccataaccatccaataaaacatggtgataccctccctgttttccttctcattgaggcctgttcactgctttcacagtacacagtatttgccagtttgaaactgttttatttttctgtctctctgactttatgaagaaaataacccaagatgttttgtccaatacttaaaaaaatagcccagaacacagtccaggattaaatacctcatgaataacaaatatccctagaaagccctagaggtctgacttttttttagaatctggtaacttaagacttccatagtttttcccctagcgtaagtagtattattcactg

SEQ ID NO: 194988 - DNA, 486 bp, Homo sapiens
ctggactcagcagcaacaccaaatcctggaccaggcaaaaaccacccaagactgaggggctcgtgccagagcggtggccacagccccaccccaccggctcaggggttcttcccagcggcgctgatcatgaagtcaacatgcacgcaagtcgtctcaggaaacttcttaatgaaagtgtcggccacggtggtgtgtaggtggctgagctcagattgcagctgctaagacaccagccacttaccaagagaaagccaggctgcttcaaacccagggcccacggcaaaaaagcatcacttccggccggggagtctggaagccacgccttgtgggaggtcacactggcatctaggccttcgcctgcattgcagaaggagagccgggtccccctcctggagaaggctgtgttccccagccccacaccggctttgccaccacacaggctgttgaggcaggaggcggggctgaatggtcgctgagacagagatg

SEQ ID NO: 194989 - DNA, 481 bp, Homo sapiens
aacttaataacatgaccttgttaaaaggcacctgtaaacactgcccattaatatatcaaccgccactgcctaggctacaatactcatgagctctcagcaggaataaccccaaagcccccctaactggctttccacttcctgtccaacaagacaatctacatattccctactcacctactcaaaaaatctcaaatcattccttaatggtcaccaaatggctaaatgagtacaacagtccttccccaactgtatggctcctcacaggctccatggtattggaactgatagctaaatgacctaagaaggatgggggaaagctaggctagaaacaataactcgacaaacttatgaaagctctttcgaacagtttctaaaactcatttaaaaaaaaaacaacctataaagagtacactgaatttaaaatagatatatttgccagaactaaaattaatactaacagaaattatattactttctactt

SEQ ID NO: 194990 - DNA, 291 bp, Homo sapiens
gattaattggctcagggatgaaaaggtctcttctgaagcaagagggagggttggtgcacagtgatcacttcattattggccctgtctcaccctctttggaggagtggacagatgaccctccaagacggctgggtcttggagagactcggcctttctgtggagtccagagttgctacttgggaatggggagacaaaaaattcaacacaggccatgcacagtggctcacacctttaatctcaactcgctgggaggctgaggtggtaggattgcttgaagccaggagttcaaga

SEQ ID NO: 194991 - DNA, 683 bp, Homo sapiens
agttgcctggagctgcagagctgaggatctggctctatgagtagctgaggtgagagatcaggaattgggggtggggtgaagctcagcagtcatttgttctggccccttcagggaaccaatggctgtgttccaaatggccctatcaccctatggcccccaaactccaactcagccctagaggctccagaacagggaagagggagctcatattcaacagcattcctagatggattagcctttcagcctaaagtactcttggcactctgtgcgggagggagttggaaagaaggaactgaaaacatgggaaagttgaaagttgattttctaactcctgcacaagaaatgttaatcccccaagaatacaccacaatcctcagagaaagagggaagggatcataatatttaaaatcttaaatctttggacaccactattacaaccaaccccccaccactgacgatttcacagataaacacgctaaggctcagatggttcaagtgacctttccaaaagcacagagccgactattgtcagagcataaattagaacccaggtctagggattcaccatccaccctgtctgttctccaagcgtatcatattgtcttcaaaggcaatcctctggggtacttattggtatgaggaaaaaacaccagagaatgccatgtagttacacagcctaacat

SEQ ID NO: 194992 - DNA, 711 bp, Homo sapiens
agactaaggcagtgggaacacattgcaagtttctaagcaaaaggatgacacagcatactgcactgatgtatcagcagactcgaacagtgtggtgaaggtggaaggctattgtcttatccaggtctgaggctctgttcaggaacctgaaggggaagaggagtggagtaggagaaggtggtagtagaaatggaaagggcaaaactattaaacacaatatccacccacaggcagcacaagcccatctgcaccctggagggaccagagaaggagctttttccttggatcaagttagaagaaatccaaacaacagagaaaggtgagatgattcttggaaagataggagagttggcccacccctggctggagatacaacttaatcacagaaccattgctagaaaagcctccacactcaaaggtgtctctgtcagtgtgtaggagaaaccctaccacagtacctgggcttccaagactcatggggcacccaccatgcccagcttgattaaagacaatggtgtttattaattcatccatttgttcatcaaggttgcatgactattatgtgccaaagaataagcagaacactgctctttaaatgttcttaagtgtttatttataacaggttgttaggttgagacagggtcttgctgtgtcaccagtgcggtggcgcaaacacagctcactgcagcctcaatctctcaggctcaagcaatc

SEQ ID NO: 194993 - DNA, 139 bp, Homo sapiens
ccaccgcgcccggcctgataacgttttaagaagagatgagatgatgttgaccacgcagcccacaatggcaaaccattaataacaatttgcgaggaagaaattcatcttgctcatgaccttattgaagaagactgatgat

SEQ ID NO: 194994 - DNA, 492 bp, Homo sapiens
ggcacaccactgattccagccacactcagttttttttcttctccttccaaaaatgcctgattctttctcacctctgggactttgcatgtgctatttcttcttccccgagcaatctttctttttctctcctgcctagatatctccaactattcttaagatcttagcttaaatgtcactctctccagaaagtctttgctgacgcagattgggttgggagtccctgagttgtcttccaaaacataggcctcatcatgttgtattgtaattacctactcacttcatagtctctcccattcgatatcggagccatagggtggaggttatatttgtgtatctattctattctcaacgtgagcaaaaagtatcatgtgattgccttgcagaggtgggcctgggtgagatcacatgggattttataaacaatggaagtgactcttgatatcctctatgctgatggtgatgattttagtggtcgctttcaaggtgaacatt

SEQ ID NO: 194995 - DNA, 196 bp, Homo sapiens
ctataataatcacccaacacattgttgctatcattgttttgagcaaagagttattagatcagttaagaatagggaaaataacagattttatgttgccttcgttttttccttctgcaacactcttttctttatgtagctatgagtttccaacctatataattttcctcctttctgaagaacttctaacatttcttgc

SEQ ID NO: 194996 - DNA, 111 bp, Homo sapiens
aaagtgctgggattacagattgtgagtaggcagtatgtccggcctctaccaaacgtttaaagaagaattaacacgaatccttttcaaactctttcaaaaaactgaagagaa

SEQ ID NO: 194997 - DNA, 1016 bp, Homo sapiens
tttcaagcaggtagtaggagtaggttttgttatttacagagctattcaacaaacgctcttttattagctcatcaatttgccagtcagacaaatggagtcaagctcccatccaggaggttaggagagaaaacactcagatttcacatcacttcaccccacctaatgacttcactttccatttgacttgttgtctggctctgttaattattgaactaaaaaaatgtactaaccagattgaagcggtagtcttcactcccactaaatatgcagagattaaccacaatgcagatgatctggaaacataaattaattttggtcatagaatttttgaggtagaagtatagtaagaaagacttttctttactaaatatttagtggtctctgtcttagtccatttttactgcaataataaaacaccacagtctgggtcatttatagataatagaaatttacttctcacagttttgaaggctgagaagtccaagatcaaggttctggcattgtgtctgatgagggctttcatgctgcatcttcacaaggttaaaaaagacaaatgctatgtcttcccatgatggaaggcagcagcgcaaaaaagcgcctaaactagttttctctagccccttttttaactgtacaaaaaataaataagttaacattattaagttactacttcagtccttatgttgttttttaaaaataatcagtttgaggccaggcgcagtggctcatacctgtaatcctagcactttgggaggccgaggtgggtggattacctgagctcaggagtttgagaccagcctgggcaacatggcgaaaccctgtctctactaaaatacaaaagaaattagctgagcgtggcgacgtgtgcctataatcccaggtacgtagggggctgaggcaggagaattgcttgaaccgaggaggcggaggttgcagtgagccgagatcgtgccactccactccaccactccactccagcctgggcggcagagcaagactccatctctaccaaaaaa

SEQ ID NO: 194998 - DNA, 857 bp, Homo sapiens
caggctcagcagggagctgctggatgagaaagggcctgaagtcttgcaggactcactggatagatgttattcaactccttcaggttgtcttgaactgtgtgactcatgccagccctacagaagtgccttttatgtattggagcaacagcatgttggcttggctgttgacatggatgaaattgaaaagtaccaagaagtggaagaagaccaagacccatcatgccccaggctcagcagggagctgctggatgagaaagagcctgaagtcttgcaggactcactggatagatgttattcgactccttcaggttatcttgaactgcctgacttaggccagccctacagcagtgctgtttactcattggaggaacagtaccttggcttggctcttgacgtggacaaaattgaaaagaaggggaaggggaaaaaaagaaggggaagaagatcaaagaaggaaagaagaaggggaagaaaagaaggggaagaagatcaaaacccaccatgccccaggctcaacggcgtgctgatggaagtggaagagcgtgaagtcttacaggactcactggatagatgttattcgactccgtcaatgtactttgaactacctgactcattccagcactacagaagtgtgttttactcatttgaggaacagcacatcagcttcgccctttacgtggacaataggttttttactttgacggtgacaagtctccacctggtgttccagatgggagtcatattcccacaataagcagcccttagtaatccgagagatgtcattcctgcaggcaggacctataggcaagtgaagatttgaatgaaagtacagttccatttggaagcccagacatagg

SEQ ID NO: 194999 - DNA, 205 bp, Homo sapiens
ataatcatggattttgtgtttctgggtttaaaaagactttacactaattgaggaaatttgaaaattcagtaaggtttgaggaaaaaaaaaaggaaacaatcctgccccccagaaacaaccaccgttaaattttatttcagaatttttaaaatgcacagatatgtagattttttttaaatgatattaaacggcctgtgaacctttg

SEQ ID NO: 195000 - DNA, 775 bp, Homo sapiens
ataataacacatcgagatttggaagatttttgtagaatcaatttcacggccttctatgaattaaaacaacaacttacttaatgactttggaaatattgcttaactaacagcctttgagctattttgatgaatagaaaaacaaaagtcattgcccactattgctaaagtatgaatctcaaaaaggcaaaattacaactctcatgcaaatataaaatgaacacatgccaatgattttattcaactaattatttaatgcaggaaccactaaggtgttaaagccagttcaaagaacatttgagcagctagatatctataggcaatttatagaagaatatttggataagattgttgggttagatacaaaactggttaataaacaacagggcaataaactgtaatattgaggttgtcttttccactggacagaaattatttgcatctctgctggacagaaactacaagttaacctctgcccctattgagctgtaaaatagcccaaccaatagaaagtcagacccctgtaatcccagcactttgggaggccgagatgggtggatcacgaggtcaggagatcgagaccatcctggccaacatggtgaaaccccgtctctactaaaaatacaaaaattagctgggcatggtggtgcacgcctatagtccgagctactcgggaggctgaggaaggagaatcgtttgaacctgggaggcggagattgcagtgagccgagatcatgccactgcactccagcctggggacagagcgagactccatctc

SEQ ID NO: 195001 - DNA, 793 bp, Homo sapiens
atctagagatccccgactagtccaacattccattttgctagcttttaatttgcttcaaaaagtacctgtagtttcagctacttgggaggctgaggcaggaggatcatgtgggcccaggaatttgagactgtccggggcaatatagcaagaccctaccctatgtcaaaaaaaaaaggtgtaacaaaaatgtcatcacattactgtagaaataggaccaccttgtgacccttgaatagtttgttttccactctgctttctctccagctaaagaggcatggtgctttctctccggtagataaaattgagtagcgtttaagtagtactagggtgtgttattcagattgctaccctgaagtaacaagccttgtattctcagtggcctaacacaaaggatattgtttgtgttgtgtgtatgtgttttgctttgtttttgctgttcctgtctttcaaaaaggctttgcaagcaagattgaagtctggatggagggacaaaagtttaccttcttgggatacatcgcaacatatagcttttaaggtggggagggagagataatttatacctcacacttaattggctctgattagaaaggacacaatgacacaagttattttcattcataggtctttagccaaaggaatcacatgacccctcctgtttctgcaagggaggctgagaagtgtagagaacgatttggatatttggatatttcccaagcattgctgcttcagctgtaatttacagtcatacattctcagacaaagctggagcaactctagtacttgacagttactt

SEQ ID NO: 195002 - DNA, 271 bp, Homo sapiens
gatgggagggtagatggccagaaggataaatggtaaagtgggtcggtgatcgatatatgaatgaatcaatgataagtatgtggatttttaaatgtcattttggctccgaagacccaaaactaggtccaaaacagaaatcatcttcaaccagttatatcttatatcctccttgcattcctgtgaaagcattagtaaggtttctatttacctcttgaaagacaaggtctccctcattcattctgatcgcacatagtcagcttgtaataaaaac

SEQ ID NO: 195003 - DNA, 306 bp, Homo sapiens
caaggaagctagaaatctgaaaattaaaggaagagttgagaaaaaccacatccgcgactgcctcctttccagcaactgcctcttttatattttggggtgctatttgtttggaaagactttgctaatagtttgaggagactacaacacaacacaaggcaggcttgcctgctaagccagctagaagtttaattaaatacaattgcttgctgtgtgttcctttcccaaatggtttcatgcatattcatcgttgtaattatggaagtgaaaaaatccacgcctaattattccgtgctccccatctttcac

SEQ ID NO: 195004 - DNA, 345 bp, Homo sapiens
gtctgttgactgaatctggcccatggtcaattgatttgtgacctccctacattaggcacttgttggcacctttctattgcattataactgtcctgaaggcccgaggtggaaggggagatgcagaataaggcggagatggaacaatgagatgacaagagatgaaagacttcaagaaggatggatgattgcctatttcagagattctgcagagggcaaagaaatgggaataagaaaaggctattagattaaagtaaattaattatttggcacagcactacgtctacaggctgtgttctttaaagaaatgatcaaataacatgggaaatagttaagcaaattaaaata

SEQ ID NO: 195005 - DNA, 253 bp, Homo sapiens
aaggaaagtaactgtatgttgaattcacccaaaagatttagatagtgttgtaatcatagctttatgtaagaatacagttctatttaaaaagggaggcagtgaattcagttgatgatctgctgggtcatgatacttcaaggggatggcttaagaagggaaaggtaaagagcatataaaatatttttcccctcttcaaaaaattcaaaaatatttctgtcttcaaaaattgtcatgttaatttaagtcttactga

SEQ ID NO: 195006 - DNA, 141 bp, Homo sapiens
aggggcccttgagatgtcaaactggggagaatggtagaagttttcatggttccgaaaattagagaggggatccctggcaaggaaagtctccttaccacaaattggtccctatcagagaattgctgctcagttcagatgata

SEQ ID NO: 195007 - DNA, 576 bp, Homo sapiens
atccgcttaatcaaaaattttttaaagcctccacttaggtctgcaggttactttgctcactatgtggcaacgggatctaagcttcatatttgaaacacctcagccttctagtgccacctgcacctctctgccactttggctcctgtgaacttagccttgattttgacattttatggtcgtcccgaggtctgtgacatggaaggcatctgtctaaggcacacatttgaattgggtgcctccttttctttcccccacttcctaaagttgcaggggtcaaatctactcccatcatgctgagtgtgcaaaccagcctacttttatgtgaagccattctctgccctgctgctgatatacgcctatcccaagacagtttttaccacacaggcattcatgctgtggaacacagtatggtgatttctcaaaaaattaaagataagactgccatatgacccagcaactccacttctgtatatatatatatgccccaaagaattgaacgcagagactcaaacagatatttgtacacccatgtccacagcagcattattcacaattgccaaaaggtggaaacccaaa

SEQ ID NO: 195008 - DNA, 670 bp, Homo sapiens
ctttatagtgtcgatggtcgttacaatttggtatgttttcccagtggctcatactgtttgtccctttccatgtttagtgcttccttcaggagctcttgtaaggcaagaatgtggatttatttcttgtaaggcaaatatgtggatttatatctgggtgctgtattctatggcctctaccccaagagtcattacttttaaaaatgcaattcaaattagcataaaacatttacagcctagggaaaggcttatggcattagaatccttatttataggattattttgtgtttttttgagatatggtctctgtctgtcatccaggcagaagtggagtggcttggtcataattcactgcagccatgaactctgagtccaagccatccttgtgccttagtctcccaactagttggatctacaagcataaatcaccatgcctggttaattttaaataaaattttttgtcgagattatgttatcactatgttgctctggctggtttcaaattcctggcctcaagtaatctttctgccacagcctcctatagtgctgggattacaggcatgagccaccatgcctagcatagagtattacattattttcaaagtcttattctaagagccatttattgactttggcctaaataactcaatattatatctctgaaacttttttt

SEQ ID NO: 195009 - DNA, 617 bp, Homo sapiens
ataagcacagcacttttttattattactttcatgtgaaaacaaatacaaataaattacagaataaagtaaaaaatatactttaatgaaattttggctcgtcattaacagaataaagctacgtagtgattactcttattgggcaagaggggtaggagtttagaatggggtatgggttgcctctgttctcccttgaggagtgattttaaaggaatgtgtagaaagcattatactggaactaaagcatcacaaacaaaaacagcattctttttaaaaatacatctataaagaaattaatgttttctacttatacatttcaatattaaacaatgttccttaaagctaacctgaatcatgtaatcaaagactaaaattaagttttcccagaagtttattttctacaagtatggaatagaactcagcaaggagaaagaagataattaggagtggcctgaacgcaaggttccttaaagtaccagttggtttctgagaatcataaagtaagcacctgacataaaagatcttcatttccctactaaatatttcaagtatgtctgatttctaggtcattgctcagggccttaattccaaattgagaaagatttctttaatgttcctc

SEQ ID NO: 195010 - DNA, 353 bp, Homo sapiens
acagatactggcaaatggctctctgggaaatttgaactaatttgaattctcaaaatttcctcacacttctgctcacatcagacatcatcacactttatctgtattgccctaacagaaaatgatacgccattgtcatttcaatttcatatttctttgattactagtaaggcagagcaacttttcaaacagtctcagcttacttgttatatttttcatggattgcctaattcacactttctcctattttaattggtatgctcatcattttcttactgatttgtaagaattctttataaattaatgattctgcctctttgttcattatatacaacgcaagtatttgttagatgtat

SEQ ID NO: 195011 - DNA, 481 bp, Homo sapiens
ctgttacaaattctttttcctgagttgcaaataaatcatggaataattcctggaaacctatcacttccctatcagcttctcattgacttaaacttttaaggcactgggttatttccttctttaggtcttttaacagtggaaaaccaaaggatgtctccagcaagctgatgatttcttctgttgaaattccaaacacgaatacccccacctgggtcgagtgggtttgaggctgagccacacttgctcttacaagctgggttatgcttccaatggttgggttaggatcatctttgggtcgtttgagcaaataaaacatggtggcacaaaactcttggatacatacatggatgaaggtaaaacactcacctcacctttggagaagtttcatacccacccacattaagccctcagactcagataacccattcctccagagatcccatggcaaaatacaaatgcatgtgtccaaattccctctgca

SEQ ID NO: 195012 - DNA, 316 bp, Homo sapiens
ttcacgctcactttctgggtagcctcctcaaatggcttaagaatatcacaaacataagtcattagagtccactgaagggaggtgagcacaactccactggctctaccaagactatggtgaactgagtagcaatgctccaagagccattttaacatataaaaagtagaaatccaatggccagtttcgtcctgcttcaaattcttccatggaagttggtgatcattttggaactcttgcagtatctgacgggccttgaccgaatgactaaaatgatgacaagttttcctggcagccactaacatattctcaatgcttt

SEQ ID NO: 195013 - DNA, 197 bp, Homo sapiens
ggacaacaaaatatcagagaattgttttttgtttcactttaaaatcaaatactagaggtaaaataattctagaggataaataataagcatggacaacaagaattttttttgtacataggttagggacaacaaaatatcagagaattgttttttgtttcactttaaaatcaaatacttgctgtgacctatcttcatgt

SEQ ID NO: 195014 - DNA, 472 bp, Homo sapiens
gtgacggtgtccccttctctgtccacgttgcaagaagctatactgtactcaccaagtctttaaatcttgaccacttcaccaaggaaggtatgaacctctccattttacaggcccagttcaaaaagcaacgacaaaaatcaacaccagcaaacctttatggagttctaattattgacctggcctgccagggtccttcagagtggagttggggtgggtgcgggagaggggtcaaaagccagccctcaggagggggccacccgcgcagccctctctccaccatcagggctcttgcagacccaagggcctgccaggagaagcagatgggccatggtaaatctgaggggccattgggatgcccagactgtcccaggtcaccccatttctgcatttttgttcattttgttcaggtggccctgaatgttgtgccctcctcttgggaactgtaagtaatacaatcttcctttcaggcagt

SEQ ID NO: 195015 - DNA, 562 bp, Homo sapiens
tcttctgtttgttcgattctattgctgaaacactcaaagcattttacatttctctatctgtgtccttaatttccagaggttgtgattgctttttatttatactttctatttcacaaaagatgtttcctttcatatcctgcatcatgtttttgatttctttgacttggacttcgcctttctctggtgcctccttgattagcttaataatcggccttctgaattctttttctggcaattcagagattttgtctggaaaggacaccctgttcaacaaatggtgctgggataattgtaagccacacgcgaaataatgaaactgaatcctcatctctcaccttatacaaaaatcaactcgagatggatcaaagacttaaatctaagacctgaaaccataaagattctataagataatatgagaaaaacccttctagacattggcttaggtgaggatttcatgaccaaaaacccaaaggcaaatgcaacaaaaacaaagataaacagatgggacttaattaagctaaaaagcttctgcacagcaaaaataataataatcaacagagtt

SEQ ID NO: 195016 - DNA, 233 bp, Homo sapiens
tatttgttgctactgcatgtctacaattatctccaatttcttttaattaaaaaaaaaaatttaaaaacaggtctgccctgctccagaagctgtcctctgaaccagttttctagattggtcatatttcccttttcatgcttgctgctaggaagctcagagcaaaatgtatgccctctctctaacaagtgtataggacttcctgactacacttctaggtctttctgttcctcttg

SEQ ID NO: 195017 - DNA, 334 bp, Homo sapiens
caatctgggtattgttgacctttcaggaggatgattttctgctctctttaaacaagcccgcatgacccataagggatccagcctgccttatcccatatggagataagtgagggtttgtctgtggctttggagaagagatgacctacgtgtgtgagacagcaacagaagtcgtgcttgttagcatagattctcagagagagaaggctgtggctactcctagcctgttgtaaagaagcatttgtgtttggattgcagcaggggagagtaactattttggtaaggacgaccttcctgagaaggccatttttccagcagaagcaggagttgtgagaag

SEQ ID NO: 195018 - DNA, 146 bp, Homo sapiens
ttacaaaaaactcatctccccagcaacatatgccaagcagttctatctgtgccctttacttggtgcaggcagaatattcaacagcatcttatgtgcaagggccaaggctgctgccttacacaactcgagggggcggcattccaact

SEQ ID NO: 195019 - DNA, 399 bp, Homo sapiens
gacccttttcctcaacccccagccctatcaaccacgggtgtattttctgtaactattgtttaccttttacaaaatgctataaaagtgaaattatcagtatatagccttttgagtctggcttttctcagttacaataatacatttgcaattcatatatattgttgcaatacagatgtataatatattgacctcaagtgatccgcctgcatcagcctcccaaagtgctgggattacaggtgtgagcctgtacatacatctacattagtcatatgtttcctttttattgctgagtaataagccattatatggatgtaacccagtttgttaattcattcacagtttatggacatttgagttgtttccatttgaggacatctccgaataaaatatctgtaaaca

SEQ ID NO: 195020 - DNA, 212 bp, Homo sapiens
tgcccgcctcggcttcccaaagtgctggtattacaggcgtgagctaccacgcccagcccgtgatctcattttctaaggaaaataaatgtataaacaccaaaatatcaacagcagttttctttagatgataagattatagtgctttacattttctgtattttcctcatcattcctaacgtatgagtaaaaccgtgtcataataaagtctctct

SEQ ID NO: 195021 - DNA, 123 bp, Homo sapiens
aagattatagcatcagatggaaggaggtgtgatggcaataccaactacaagggatgagactcatcaggccacccttcagaatcatagccagcacttgtggaatgtatacaaataccaggcatg

SEQ ID NO: 195022 - DNA, 174 bp, Homo sapiens
ctgcattacagaactagtttgtgggttagtgacaaattcttaccacatatggcagtagggatgttctttgggctggaatatttctgcgtgtcagtaatacacttcctgctttcagaagcactgaaagtcagtattgtgaattgttcaaattctacacaactacattgctgaaat

SEQ ID NO: 195023 - DNA, 323 bp, Homo sapiens
tgtgtgagccactgtgcctggccctgcatatctatacttatgccagtactacacttgattactgtagctttatggtaaattttggttactctagattctttgcatttccataaattttggtattaatagtgtcagtttctatcaaaaagcctgctggaatttcagtttgtgttgtattaaatatacagatcattagggagagaattgtcgtttaaaaaatattgagtcttctggtccttgaaaatggtgtatcttattattttttaaggttctttagtttctctcagcagtgttttgtagttttcagtgtaggaagtgttgga

SEQ ID NO: 195024 - DNA, 538 bp, Homo sapiens
aaaatcaaagacatgaaacttttcaaatgacaaagatcctctattctttcaaaagccatgataagccaggaggcactatgagaaggttgataagtgcacaggaacatatataaatctaaagaagtctatggagaagtcatcatattagcaaaaacgcatcatttggttgagctttccagctcaaatatccttcaaatacgtcagtgagagacaattgcaacaaaaaaagaaaaagaaagaggcagtgctaggcagcaaaggaaggtggaattttttcgttatgtcaggacccatcagttctgtagttcacccaggaatctaaggattaaagaacaatccaatataactagaaatttactggcatcatatgtccttaaaaagaataaatactgcaaagaacaaaccaggccacagaaaatgctgttctccttctgactaaatatggtcaagtctcatgaatctgggtttccactcttggaaatgtttgttaaatctgtgtgcactgggctgaaggctcactctgaattttttattagtg

SEQ ID NO: 195025 - DNA, 654 bp, Homo sapiens
tagcagatttgatctgaaacggtataagacagatacttttaaatgcaccaggaaatgtgaactctaaagacatcaaattaatcttgtgaatgcagtagtcactctctttttatctttctttgtaaattggaatttctaccttccattaattgcctttgatttaggtgaggttatggggcaggtaaaaatctcattagcataaactagcataagataagagtgaattgtggagtcagactgcctatattcaaatcttggcttcactatgtcttttagaagtttcttagactctgtgttcttaagtttcttcatcactttgcctctgaagagtaacagattattgtcctaaaatgtgaactctaaagacatcaaattaatcttgtgcatgcagtagtcactctctttttatctattctttgtaaataggaattactaccttccattaattgcctatcgattaaggtgaggttatggggcaggtaaaaatctcattagcataaactagcattagataagagtgaattgtggagtcagagtgtctatattcaaatcttggcttcactatgtctttaagacagtacttagacactgtgttctaaaattcttcatcattgaattaagggcaaggtgactgactggacctacatgccccac

SEQ ID NO: 195026 - DNA, 618 bp, Homo sapiens
aggctcccatcagaaatctctacagacgtcggaaatctatagagatattagataagcatttcaaggtaacttatttcctcattttaccttatggtaacagccctatttacctcttacaagcgttctacggtgtatcaaaaagaccaacaacagtaagaggtttgcatagcactgtgtattccattgagaaaagtgctacaaaaacacaagatagcattttattaatttattaaatctgattccttgagacacatacaaagcggtgttgatggatgaaccaacaaacccaagattaatagcctggtttactgcactcttttctccttccaagccacaagccaaaataaactcaccctcaatttataatgttgcaaaatgtgcttctaagcaccaatgcctgaatccactgtggttattaaaaggatggttgcatccatcgggatgggataggttatgctgtggtaacaaagaacacctaaatctcagccctaaggatgaccacaatggtccctctggggtcaagaaggtaagcccagcagccccatctttctcattttcacctgacaatctggttagccaactctgtggcttacataagtttgaaagatatgaccctct

SEQ ID NO: 195027 - DNA, 318 bp, Homo sapiens
tttatacttaatctttctaaatatacttgtaaaaatgtaaatgttagatcgttcactgataggcaccaatatctttaacagaaaaggttaattcaaacaaatgtcaggctaaactgacaacagaaataaaactggtcttcccaagttcagttccttgtggatttgttatattgctacatattacacctagttttatgtgtctagatgctctgtatctagtatactcttgagagcctccaaatattaatatttctttttttttggagattaaggatagagagattaaggatagagagattaaggatagagagatgccgg

SEQ ID NO: 195028 - DNA, 396 bp, Homo sapiens
ttttccttcctaaatgtaaacatccagtaaataaaacatacatgatattctaggtatagaaacatcagtaattcacttatgaaagaggtacattttgacgtatctggtggtaaggtttttgtcttacatataaagcacttcaccaaaaacaaacaaacaaaaaacccatactgttattatttagagctatatttcttctcccagtttcctcagttgagtagaaactcaccaatttctgtagaattttggttataggacaaggctacaggaaaggtctgaaataactatatgtcacttgactagggaaaagccttctcttgaggcttggaggcagtcatttatcactttgtacttgaaggcattcctctgcagacttctttcctagagtcttcaggg

SEQ ID NO: 195029 - DNA, 335 bp, Homo sapiens
gggtaatcagtggccacagcttgatgcctacctctgtttgactccaaagtggactcaggggtcagatagatccagagggtgacagaaacctcatcctggagactgggggttcttccaaggcttgttcttgtcactttttttttttttttttttgagatggagtcttgctctgttgcccaggctggagtgcagtggcgcgatctcagctcactgcaagctccgcctcccaggttcacgcctcccaggttcacgctcccagctctcaggaggctgaggtgggaggatcactcgagcctgggaggcagaggttgcaatgagtcaagatcatgccactg

SEQ ID NO: 195030 - DNA, 1033 bp, Homo sapiens
agagcgagattccatctcaaaaaaaaaaaaaaaaaatgaaatccgttcaagtattaggatgatgggactgtagatgcatttcctcccattttagatttttaattttgctgttacattcctgcaaaaaacaaaagccaggcaggaaaagttcccatctccaggccatcccgtctggcagatgtcccaaggcaggaatggcctgaactcctctctaccagtggccaactctcctgctccaggcttggttctcaggctttgagaacctcagggcagaacacctttttccaccccagcaagcaaaatgaataggtaacaattgtgcccttgttttgagcaacaggagcagatgggacctacactggtgggctggcctgggaaaggtccagggctggcttggcccgggcagcaaggctgaggaaggtgatgtggcggggaggagaccccagggctgcaggcatgccctgcgttaccctctgcacccctttcctggcctcaggaactctctgtgggatgcgttagaagacctgctgacaggccggataaggccaatgagagagggaacggagaagaggggcacctgggttcacaggccttaagaaagaatttagttacttatttaacaaattaaacaatgtgtgtcacgcatgtaggtctgggaaatgcattattaaaaacacacagtgcagaggtgcagcaccagcatacgggtggatttgggactctaaaatggctttggttgtgtgtggtacaagggagaatgtatacatgtattacgtgtgtagttttttaaagtacacatatagaggaaaagatgagacaagtctgatgagatgtcaacagcaacaattcttagttgtgggtgctgtgaatttcccagagaggaggagagtcctttagctgggcatggtgatttcagcactttagcaggctgaggcaggatcacttgagcccaggagttcaagatcagcttgggcagcatagcgagatccccatctcaatagatggattagatggatggataggtaaatagaga

SEQ ID NO: 195031 - DNA, 760 bp, Homo sapiens
gcttacacatcagtaagggaaacatgaatagggcattatttgagtatctaactgctatctctttctcattcccagctaccagtagaaatatgagatctagtatggatgatttttgatgggggcgggcgttgatgtgccttttaaatattgtagaattcactatgttaggaaataaaataatgacaggcatctgtttttttctgaaaaaaacacaaaattcaggtcctgtacctgccattttaccacctgcaaggatttgggaatccatttaagtttcacagcttttatatctgcacctgtcaagtcaggatgagataagttctgtggaagtgttttgtgaaccagagaatttgacaggtatgttacgtttatacttcattctgcatcattcattcattattgaattattcagtccttcgttgagaacatactacaatgaccacagcagggtccctgtactcaaagagctccctgtctagagcgggagacagacttgcccaaaggtatgaggcatgagctgcagctgaggaatgtgctaagtgcccagcaatgtggaaacacagttaattctgtgggaggaggtgtagagaggaggagaacccatgagaggtggaaaactaagaaggggacaagggttatccaaaggaagctttttggactgcagtatgatgttgggaactttttggtacatggggatagttccctataagaatgaggacgtctttatcctcttttactaaactgagtgctgctataaata

SEQ ID NO: 195032 - DNA, 601 bp, Homo sapiens
ctgtcccaatgtgccagcagggaccgtttccacccgtgtttctcacatgtgtgttactgtgacagagtgacatcagagcctataccgggggggcaggatgcgctcgtgtccaggacccaggctttgcgtccaggtgttgttgcagtcatcctaggcccgagcctctttgattctcttcggctcgggtctgttggctcttttgtttaatagaggagcgatcaggagcctggagggagcagggagctgatgctggtcgcagattgtggctttgtgacatattagccacggttctgaatttatgtgtctgtgaaaggaggatgatcatacctatctcacgggtgtttgctcagatgcccatcgcagtgcctggctggtgggagtgcacccctggtggccactgctattctcattactaatactaatgttctcagcatgacttatttgagaagcgagtttttgtgaagcccgtggaatgaatcagctgagcattccctgctgccgcatgctggggagggcaggtcaccagggatatggcttggcctgcgccgcccactgggccttgcagtgggcctgtccgtttaggatgccagagctcttgcgt

SEQ ID NO: 195033 - DNA, 332 bp, Homo sapiens
ctcaccttggcctcccaaagtgccgggattacaggcgtgagccatcaccacaccccggcatgtcttttaattttttaatgaggtcattagaaagatatccaaattaattatgatgtctcacaccttagttgataatgcttagtgttttgaaaatagaagccatgttattatagttaaaagaccttaattttacgtcattttactaaacgaggtggtaaaccgtttattaaggactgtgtgccctgttataagcgatgtaatcttcacaacagttctataaaataggactgttatccccattttacagttgaggaaatgaggcatagagaggt

SEQ ID NO: 195034 - DNA, 428 bp, Homo sapiens
gtatgtaaactttagtcacacatgtggccgttaataaacaggttctcctccattgtttttaatctctcagtaggccttaatgaaaagaaatcccaaaggaacagggtaaagcctctattaatgatgacattctcagctgggcacggtgacccacgcctgtaatccaagcactttgggaggcggaagcgggcagattacttcaggttaggagttcaagaccagcttggacaacatggtgaaaccccatctctaccaaaaaatacaaaattagctgggcatggtggtgcgttcctatagtctcagctattcaggaggttgagatgggagaatcacttgaacccaggaggcggaggttgcgctgagccaagatagcaccactgcactccagtctggatgacagagtaagaccctgtctcgaaaaaaaaaaa

SEQ ID NO: 195035 - DNA, 387 bp, Homo sapiens
aaattataggattccagatttcataggctcttaacaatctggtattggtagattctttctcccaaataatgaaaagaaaaaaaaagtatgattattgtgaccaaattaatttgactttataccgtttttgccttctgttagtatttagcattcacacaagtgagaaaaaccaaactagagatcatagagttttccaggacatttaaaaaatggtaaagtttttctgttcacacatttttgtttacacgttttttaaccaatgtttgtcatttctatgttggtacctgattaaatttaaaagttgtatgatttttttttcattttaaattttcattgccaacattcaatataataattctcttttgaaggattttgtcttatatacta

SEQ ID NO: 195036 - DNA, 639 bp, Homo sapiens
tactattgatcagatcctcccaaagaccctgacatgaataactgcctttctaaggcacaccataaccctttctagggaaactgctgtgcccacagcccctgtctttgaggtagctgtgtattttgctacttggccttgacacccttttttctccaccccacgaccagatcaaggccactggattgagagtagctacctgataacctgacccctcatgattctgtggccaggctttaaaaaaccaacgtatcaatctgaactaaaaaatatagaaagaatttgcctgttgttgaaggataggaagaaagtagagtatagccaagccatgtttatgggcaacacaagggaagatccaagaatggctctgaaggcaagtccatgttttcatgagtgccattctaggaattacatgtctcatttagtatgccacatgtattttcaaaataatacacatccccttttatgtgtttacttgattgagcttctgttccttccaaccagaaaaagcctaactaaaattgccatgctcaaaacttcgactgagttcgtcaaataaaccatcaatcggaaaaatgcaagtttcaaaatgagaaaaagtctgttggctgagcgcagtggctgaagcctgtaatcccagca

SEQ ID NO: 195037 - DNA, 439 bp, Homo sapiens
ctcccaaagcgctgggattacttgcatgagccactgtgccagctttctcaccacttctagtcaacgctgtactaggagttctaggcagtaaataaggaaaaaaaattaaagacaatgagattggagaagaaataaaattgtccttatttgcatatgaaatgatcctatttgtagttctattatgaaatccttattcttaacctaagaatttcacagtaaaactactataacaaagtttaaggaagtaatcggatacaagattaaaatcaactatatatctatatactagcaataaactgaaattaagagaactctattctgaatagcatcaaaaagagtaaaatacttaagaataaatttaacaaaagaagagaaagatttatacattaaaaactgcaaaatattgcatggagaaattgaagtagatatataaatggat

SEQ ID NO: 195038 - DNA, 309 bp, Homo sapiens
gtgagctatgatcgcaccactgcactctagcctgggtgacagagtgagaccctgtctcaaaaaaaaaaatatgtacaccaggatggggaatcagagtttacttcactaaaagaaataagtacactgtcaccagaggaaaagttgctgatgttattgactatttgcttttagaaatctccctccctagacattcagggcactggcttttctggttttctgaaccctgttccttttgcttcttcattaccttgttcttatccattaaatgtttgtgctccctggagcactgttttgcgccctcttttgagc

SEQ ID NO: 195039 - DNA, 404 bp, Homo sapiens
gacagctttggccctcttcctttctctgggtgtgagcatctgtacagtgtcagcaggacaattatactttttacaggcaatagtggcttagagtcaaatgatgagccttcccgtgttatggctacatggctgtgatagcaagtggaattatgcacctgcactctaaactcgtggagtcattctggatgtttatctctgcctatccttgaccaaagtacaaccatgttccttacagggggattggttccaggaacctgtttggatgccaaaatccatggatgctcaagtccctgatataaaatggcatggtatttgcatataacctagaaacaccctcctgtgtactttaaatcatctctagattatttagaataactaatacatgtaaaggctaggtaaacagt

SEQ ID NO: 195040 - DNA, 181 bp, Homo sapiens
tggtgtaaagttagcgcttgatacatgtttttaccttaagaccacagtttctgagattagcgttggtgtgggaccattaggcccacagggaaagtgaatatttttctgattagctatagaacaatctgaacgtgtaaacaagggaaaataaaaagtgaatacaaattattgttgccgaaga

SEQ ID NO: 195041 - DNA, 382 bp, Homo sapiens
aggagataatatacctcgactgatgcacacctagcaagaaatgaaataggaagtcacacagattaggaataaactatttagtaatctgctttttaaaaaaattattggagtttttttttctaaaaatagtcgaattataccaaaaaacagagtaaccgcaacatgtcaaacaatgcaaagtcctatgatgaattaaaagaaaaacaaaaatgtaccaaatatgttactacaaagcaactgttcaagtgtgctaaaaacaggtgtcttctcccttttcagaggctcccctagtcatttgcaatatattttgcctacttctctaaaaatcaaaataggtcctaataagtaagatacaggtcttcaatcccaacagcaactaagg

SEQ ID NO: 195042 - DNA, 286 bp, Homo sapiens
ctaacctctgtgtgcctcaagtttcttcacttgtggggtaaaaaacaaacagaagttaccacttttgctgtacagttatatggcttagcattaatgtatgtaaaatacaaaacaagagtgctgaaaaagtggtagttctactagtctgctataatcacaataaccttaacaagacaggaggacattgtaccatcaggaatgtgatcacaatgaaattttagttgaaaccatccccctcttttttcttttattcattcagctttcccaagttgaacatccccgcttt

SEQ ID NO: 195043 - DNA, 374 bp, Homo sapiens
taaaatgcattacatgttaatatatatttatgtttgagtgtgtatgtttgagagacagggcatgagaggagaaggacggaaagagagagggaagaagagacggaggggaagagggaaggtggaagaaagggagagaaaagaaggtggggaagaagaggtggaggggaagagggaaggtggaagaaagggagagaaaagaaggtgggaaagagacaggagaggagggaaggagagagaaagaaaaagatctggttaaaattgcactgacttcatcctgccaacaattgctgtgtctgtatggcagtactctgtctttaacaaactcgtggtgctatacagagagacaacacattctatatctattttatgtttgt

SEQ ID NO: 195044 - DNA, 517 bp, Homo sapiens
agaaaactgtattatttggcaatcgttgcttatttctgtccttattttctgtgttgcctaaccaggaaagtgaagtcttaacagctcgggcgatgtggatttgtgagggtattttctgggctgttgtggctgccgcagctgctgctggctcatgaatctttctagcattgcagatacctagacttgatcctgcagagtaattgaagtggtcagatgcttctccagctctggcttattatgagcttctgtaagacaatgtaggaaggcaacaataactttccagactacttcttccttgccagctaaaagcatgtgccagaatagattgtagatgcatgagagtctttgttatagtgacaaatagatcttaaggaagggctatgagttgagaataattgctaattgaattgatatgtcatatcttttccaagtcattcttttgtaccacattagtggatgacttaagtagcagtgctctcaaaaagagtgcttctttagcccgtctatcgctacaaat

SEQ ID NO: 195045 - DNA, 333 bp, Homo sapiens
ctgaggagcaggggtccctcataggaggggtctgaggagcagtggtctggcccacccgggctcgggcagcctctgtttagctgcattctcccgtctgcctggcagccacttgtccgcaggtgcagtctggccccagcggcaggtcacaggacggggcagggagagccatggcagcccgtgggcgttctggagtggggccacctggcttcttgcgggccttggcgctgctccagctttcctgtgggttctactgggcctgcagtaggggctggatggtccgacgatgggcgtgggtgataccactaagagtctgaccttgcagtgcattgcaat

SEQ ID NO: 195046 - DNA, 270 bp, Homo sapiens
agatttaccagaactctggcctttgccccctactgttgtccctcagaatgttcctttgttgttgaagtatcttttctgctctgtgtagaaatctcacacttctctggttttagtgtcagcctcttttccaaggtctggttcagcatcctactatcatcttaattgtctagcaatggttttctctcatctcccaaaaacccaatctctcttccaaatcctgctgtctctgctcatggacctacctcacagttgctttgacttagattcctg

SEQ ID NO: 195047 - DNA, 580 bp, Homo sapiens
tggtcatccaggtgccctttaagacatttggatgcagtcatttatcatctgtatgttgtgttccttcgtcgtctttggactcatttcataatttcctttcttgccttttacttagatgcaaaaatctaaccttatctccagttcactaattttcagtgagttgctgactcccaagttctcagaaggtgattgaaaaatgagcagttgatgtggtaattgggtgttttgaggactaatcagctacaatcaggtaaacctccagggtggctgataaccatatgctgactggaaggagggtattagtgctaatcagtggtttactttcagtgggctctactgaggctccatcctaaggaataaaacaagctgcaagcttataacggagatgaagagtgcagcaggcatgccgtttttattagagttaaggttcagtacaaatccaggatggctttctggttttaaacagggaaagtcactggaaaagctggtgtgaaaacaaagaatgacctagaaatttggtgcccatttatgatgctcccccttgcacataagtgggtagttagaaatgcccagatcaata

SEQ ID NO: 195048 - DNA, 442 bp, Homo sapiens
atccttgtaatctttgtggtgtaatatgagtaattttataatttgctaatgtattaaaaagtaaaacaaaagaaaatgactcatctaactctcatggatatgcaaacacaacatgagacaaataataataatcctcatacagtgaatgaataattgtttctttaaaaaattaatataatcagagctttaggccaagctactttcaaactgctttagaaataactaaattatatgacaatttttttcctagaggagtcactggtagtattaggacattttagactctcttctaataaatttgctatggaatgaatttctcattctttagggagataatgctgttgccctgtcagcagtctgaatccataacaaagtaagatttgtgttaatacaacatttatatagtgaaatcagtttctctaaaatacctttcctgacctcc

SEQ ID NO: 195049 - DNA, 584 bp, Homo sapiens
ggcaatgaaaaggaggcctagcatgactgactgcattttgctcctaacccttcctaccgtgtggtgacatcttccaggctaactgctttttcttatttctgcacataggccaagctatctatgggagggatttagcttacagtttaactttaaagcacagatgataataatcccttccccaaactaactcctgagaagatagagaggttgtatacacaagtaacagtgttatgctgaagatttataagagaagtgtgacctgacaaaggaccaacaattttcaccatccccttgggctctcactgcagcccatgtctgtcattgtcagacctcttcacctcaatcgcctccttcttcctcccttccctaatgtacaaggagccggaaaatagtattaatttaagatggttcttcaggatgttacttcaccatctgttcagtttggtggctctctggaataaagtcaccttccctgcccctacacctcaactctcgacttattggctgtcatgcagcaagtggtgagtgcagtaagccgagatcacaccactgcactccagtctgggtgaccctgtctcaaaaaa

SEQ ID NO: 195050 - DNA, 459 bp, Homo sapiens
ataaattaataataataagaagaataatctttggagacccaggtactatccttaggccacggcttcaagtgctaaggaaggtgacatcatggcctgatacggctactagattacatccttatttcaggcaggaggaagaataaagaatggtgagggccttctaattgcatcagctcattttaaggagtctttctggaatttatttgcatcgcattagccagaacttagttatatgtcacacttaggggaacaggaaactagggaatgtcgtctttattttaggttgccatgtgcccagccataaattactaaggaaaaggggatgaaaggctttccttctctcttccttccttccttcctttttcttccttccttcctttttctttctttctttctctttctttctttctttctttctttctttctttctttctttctttctttctttctttctttctt

SEQ ID NO: 195051 - DNA, 483 bp, Homo sapiens
cagtgtagactaatggttaggagcacgtttagtaagagctacttactgtgtatccttactgtgttatctctttcagcttcagtttcctcatctgtaaaatagggaatattatttcccatcccttaggattgttgtgaagattaagtcagatgcagtgtataaaacctggaaattcataagtagccaattaatgagtggctagtattcctctcccctaccacaaaggtaaaagttggcattttacagcaagaagatagcctgagatcaggagttcgagaccagcctggccaacatggtaaaaccccatctctactaaaaatacaaaaattagctgggcatattggcgcgtgcttgtaatcccagctactagggaggctgaggcaggagaatcgcttgaacccgggaggcagaggttgcagtgagctgagatcatgccattgccctccagcttggatgataagagcgagactccatctcaaaaaa

SEQ ID NO: 195052 - DNA, 514 bp, Homo sapiens
aaagatgtccactctcgccacttcaatttaacattgtactgagtgttctaaggcaactagagaaaaataaaaaaagaaattaaaggcacccaaattggaaaggaataagtaaaactaactatttacagatgtcacaatctagaatacagaaaattcctaaagaatccactcaaaaaaactattagagccaataagcaagagttcagcaagatttcacgatatgtgatcaatatacataaatcaactgtatttctaaaattgtagcaagaagcaaaaaaaactggaattatgaaaacaattccatttaaaggagcatcaaaaacagtaaaaacacttagaaataagtttaacaagtgcaagacttgtacaacaaaacatttttgaaagaaattaaagacaatctaaaaaaatggaaagctatcttgtagttcatggatcagaagatttaatattgttaagatgataatactccctaaattgacctacaaattcaatgcaatcactatcaaaatct

SEQ ID NO: 195053 - DNA, 564 bp, Homo sapiens
aaggttgggaggaaagtaaatggtggagacaatgtaagagcgctcgaacctacctaccaaatagacaaatagatgttttctacccattttgatgtgggtcatttttacataatcacaattcattaccaccatgtacagttgtgtactactaaggaagtgaatggagcttctgttacccagcagtgagcctgaagaggactgtatctgcccagaggacagggccatctgggctagcaataggaggcctgtcagggcctcctgttgccactctggtcctagaaaaaggaattaagaggccaggcacggtggcttatgcctgtaatcccagcactttgggaggccacggcaggcagatcacctgaggtcaggagttcaagaccagcctggccaacgtggtgaaactccgtcagccaggtgtgatggcacacacctgtaatcccagctactcgggaagctgaggcaggagaatcgcttgaacctgggaggcggagattgcagtgagccgagatcgtgccagtgcactccagccagggcagcaaagtgagactctgtctcaaaaaaaga

SEQ ID NO: 195054 - DNA, 562 bp, Homo sapiens
gcgcgagcttcatcaacaaaaaacattatctagggggcactatggtcgcagctactcaggaggctgaggcaggagaatcacttgaacacaggaggtggaggttgcagtgagcagagattgcaccgttgcattccagcctgggcaacaagagtgaaactccatccccccaaaaaaataaaaataaaatgatgaatgaagaaagtaaatgtctatgaagtatggaacaatgatggtgcattggagagtttctcttacttctttatgtccctcccttccctggaagctggaaaagaagctgccagggatgaacacctttgcttctcctcatccttggaaaccattaaaactgcgtctgaatctttgctgcactcctagagtatggactggaaaatagcccaggggagtcaaaatcctgactttgattcacaaacatgcttgaaagaaaaaagaaaggaaggaaggaaaagagaaattgtggctgtgacctaaccatagctaaaaaaatctctttgacttccagtggtttggtattaatggaagcgtcgcgcaggggatcctctag

SEQ ID NO: 195055 - DNA, 510 bp, Homo sapiens
attgtggtcctactaggcaccaggatctgtccagatgtagagaaaatagcgttgaaaagatctggaagatatcattgtaatggagctgataattgattgggatgaatggaacaaaggatcataaaaatgaaaagtaaataaactgaaaacggagtgaaatgtgctattatgaataaaatgggctaatgaggtggagatttagggagtactttgggttgggaattcagagtctttcctcaacaggtgacatttaacctgagaattgaatgatgagagccagctatgtgatcaggttgaagagaattccagatagaatcttttattttgacttaaaacttcatttaacttttatgttggattttataatacatgcatgcttctttcagtgtaaatacactgtggacttttcctccgacattaatgtcatattcattgagaagtccattcagacagccttctccatttagttgctttgacttcagttcattttgtcacttcttataaactagc

SEQ ID NO: 195056 - DNA, 696 bp, Homo sapiens
gagattgagtctcgctctgtcacccaggctagagtgcagtggcacgatctcagctcactgcaacctccgcctcccagattcaagcgattctcctgcctcagcctcccgagtacctgggattataggcgcatgccgcaactcctggctaatttttgtacttttagtagagacagggtttcaccatgttggccaggctggtctggaactcctgacctcaagtgatccatccacctcggcctcccaaagtggtgggattacagaagtaagccacagtgccctgcccctgtcatatctaattttggataagaatccatgcaattggattcatcagcacacctgtttgtcatttgcaatcctgtagcagtttcgtgcacggtgttatgtttgtatgtgaagatgaatgttttatgcccctcaattatcagtaatgaacaaaccacactaaagaaagagtgtaattatcttgctaatatccctatagaaaatattacaaaatagttgtaaaaagaggcaatcaaagagtatgctggaaaaaaatgcaggaaaagacgtattacagagttgtattaagcagtgaattcataaaaatattctgatagttttctagattttgtgctgcttatccacttttcatttgtaattttattataatttattttcctattctaaataaacatttgttttaatctaatttta

SEQ ID NO: 195057 - DNA, 226 bp, Homo sapiens
ataaaaccatttcaactcaaattttaatccagtaaaaatcaagatctattattcctaaagtgaaaagaaagtcatcccaattactttagattaaaattactatgttaagaattagcacttcatcgtcaatgctatttgaaacatttagttatccacttcaactgtatctttcaaggcctaatatagaatgacaatttgttttcttgaatgaaactgagcaaataca

SEQ ID NO: 195058 - DNA, 263 bp, Homo sapiens
caccactcctatagatcagtatagtattggccaggtatggtggctcaagcctgtaatcccagccactaggtagactgaggcaggagaattgcttgaacccagggggtggaggttgcagtaagccaagattgggctgcttcactccagcctgggtgacagagtgagactttgcctcaaaaacaaaaacaaaaaacacaaataatagatgcatgtttaaattcaaagtttgattattgttacccagtactgatccttgagagcac

SEQ ID NO: 195059 - DNA, 580 bp, Homo sapiens
tctttatcactgagctggacactttcaggtgtgtattattttgatggctaaaaatatcctgtacaagtactttcaccttctgcaggaacttaaagtaacttcaacagaagcacaaatgttccataatatttaactttctgccatgaatcttaatagcataaaaatactgaaagagcgaaaaacaattataaaatctctgcatttatatacagtaagactaacgagagaggaaatcatcaagaaacaatttcaaaaaagcctttatcacattcaagaactatactcaactgtttacttaccaagctacaagcaccaagaaaaaagagaaaatgagtgacaaagaatgagtgttgagaaaggaaacagccagagagaaagcttggcacagatcacactgattgtattaggatgttaaacacaggtgcaaagcacacatcaagagagctgctagaacagctgaaaaaggaaagaataccctgtatatgccaagagacaattttgccaactctgacttcagtcctttaaaaaaaaatacctcttttctgattatagaaataatacatgtaacaatgtggaaaat

SEQ ID NO: 195060 - DNA, 148 bp, Homo sapiens
acgaaatttaaaagtaagttagtatagaaattcagactcttgcacaaatggtgctctatggctgatcacccaggaagattgccattatacttgagttcagcttactagtttgtggttgatgatactttcacatttaccttcattgtct

SEQ ID NO: 195061 - DNA, 613 bp, Homo sapiens
ccgagattatgtgcatcagttttgaaacatttctctgtactgattctacatcaatactttgaagagaactattcctccattcccaagaggcttgcctccactcctcttgtgcttcccatagttttttcctcaaagtcaagtcaccttcaatgtcagagatctctgaaagcacaatctgtgtaatttcttccacattaacagaatgcatatgagattgagaatcactgaaacaatcctgataatgtgaatatgctttagctttgttagttaaacttgcagcttcccctgagagagtctggatcatttccattgctgttgacacttgagtaccagcacataacagaagaggagttcttatctaaaaaataagagtaggactttctaagagaaatcagtatgtctagaacgtactgttttactggcagtgaaagcattttagtatataatctaggcttttacctgataagtgagtgaaactggaactatcattaccatttggcccagacaaagataaagattggcccagaaagatttcagggggttttagtcccttttatgccatgagcccatttggcagtctcttgaagcctatggtaaaagtcaccagccatgc

SEQ ID NO: 195062 - DNA, 560 bp, Homo sapiens
agcagggacaaaaacaaagatatgaatctaggtggttttaacgtgggtcatggggggaggagatatttgacagggatatggaagggggagaaagtagataagggatgccaagcatgtcagaaacaggaaagcaaatattgtcctggggggaagcatgataagattatatttacaaatgtatgttgatcatgtatatttaaacgtaattttaaaaagaaaaagttctgtgattaaaaagtaaaattttcccagtctggccattccttttctttattctccttgcttcttgacttataaatttattttacaacttagaaaaaatacaaattgactctccatttaattgatacatttgttttttttttcttttaataggtgaaaacacttttcaaatccaagtttataatttcactgtgcaaggtagacagtaactttttaaatactacttgatcatatcagaaaataaagttttccttaaaaggaaaacttacagattttctccactgtaaatttcagctgagattatataccagaaattggtaccagaaatgccctgaaga

SEQ ID NO: 195063 - DNA, 263 bp, Homo sapiens
ggtctagatctcctgacctcgtgatctgcccgcctcggcctcccaaagtgctcggattacaggcgtgagccaccgcgcccggcccaaagtgactcttatactccattataattatgaatttggaaaacaataaggatattatatgagtctgctcaggctgctgtaaccaaagaccacaggctgtgtggcttaaacaatagaaatttcttttctcacaattctggaggctggaagtccaagatcaaggtgccaggaaactcagt

SEQ ID NO: 195064 - DNA, 268 bp, Homo sapiens
atttctgatggaaacaagggccattccccagagacaggggagcagcccggtgggcaccttcagagggcttcaggtgagggcgtgttctcatgtgtcgggaagggtggaggctgggtcatggagtaggcagcctctcaatgacactctccaagagtctctttttcagcccagtttactttagctcaggcatggggactcgtacctgtaatctcagcactttgggaggtcaagcaggagaatacttgagcccaggggtttgggtcccacc

SEQ ID NO: 195065 - DNA, 490 bp, Homo sapiens
attttgattacattgctggagagctctttccatcctttggtgtgtcattacatttagatttttcatggtgcccaaattcttgtgctgtttccttctcatctggggacattaacatttacaattttgtaattattttcatacaggtgaatattttatttttgttttattccctatatattttttttcttttcctttccctcttcactatagggtgtgactcttgagagtactgagcagggtcttttggctttgtttctatagccctatgcacgtctgtcactaggttttatactgggctgtgcagtttgacctacaagccagtagatggtacttacaggtaacagccagctgcagccaatgtggctgagtatatacttgatcttgttactgagataatctctctgtttcctcaggaaatgggctgattcatgaagtacacagtggtcttagctccctgcttagtcttgggggactggggccaagataggca

SEQ ID NO: 195066 - DNA, 436 bp, Homo sapiens
ttcccttccccaccccaatacagggcttggttctcagccccttttgtccttaccatacacattcattcatgagatgctatgacaaattcagtaattcctatcccttgtctccaagtttagtgagtcatgagcagtgaagctgatgctaaaaagaaatgtcacacctggatgggactgttgaatctactcaatgcctcacctcagaagtggaagttgctgacttcaatattttgtttttgtggtctcttgagggaaagaccttttgatgctggcttcacaagtgacctgccagtccagtttcactagcgcttaccaagtgataggtaacacagccaaaatttgtgattctcgcttgaacccaggaggcagaggttgcagtgagccaagatcgcaccactgcactccagcctgggcgacagagcaagactctatctca

SEQ ID NO: 195067 - DNA, 649 bp, Homo sapiens
aagatctggtccctgcccccagcctggcagaaaaaggcatgtctgtaaataattaagagccatgcaatggtccagcaccatcataacataacgtacaattagcacaccaaccaatcacacttttttccaggaaggcaagagggatgatagccaagtttgaggcaggttaatattgtcctgcgtgtgcttgtggaattcagaacttttagacactgaaatatcattttcactatgaactctattacacgattttccactgtcagaaactcactcttaagagaactcagacagttctcttaaaatggtctttttttctactaccgtttggttattagtcaaggatctctagagaagcagaagaaacaggatacaggagagcaagagggagaaaaacacagagagatcttaaggaattggctcaagcgattatggtggctggcaagtatgaaatctgtagggcgggctggtagaaattctagtaagagttgacattgcagtattgagttcaaatctgcagagtatgccagaataggaaacttggatggcatttgtatgttacatttttgaagcagaactcctttcccaggaaatcttggcttttgctcttaagggttgcaactgattagataaggcccacctacattatgga

SEQ ID NO: 195068 - DNA, 2258 bp, Homo sapiens
  misc_feature (773)..(773): n is a, c, g, or t
  misc_feature (781)..(781): n is a, c, g, or t
  misc_feature (784)..(784): n is a, c, g, or t
  misc_feature (789)..(789): n is a, c, g, or t
  misc_feature (809)..(809): n is a, c, g, or t
  misc_feature (867)..(867): n is a, c, g, or t
  misc_feature (883)..(884): n is a, c, g, or t
  misc_feature (910)..(910): n is a, c, g, or t
  misc_feature (993)..(993): n is a, c, g, or t
  misc_feature (1020)..(1020): n is a, c, g, or t
  misc_feature (1034)..(1034): n is a, c, g, or t
  misc_feature (1073)..(1073): n is a, c, g, or t
  misc_feature (1137)..(1137): n is a, c, g, or t
  misc_feature (1188)..(1188): n is a, c, g, or t
  misc_feature (1413)..(1413): n is a, c, g, or t
  misc_feature (1467)..(1467): n is a, c, g, or t
tggtagagagacacaagattattctaaaatgtatatggaaagcaattccaaaaaagaagagtagaggaattgccctccctgatgttgagaaccgtacagctacagcacagcgttatacggctcctggcagacaaccagtcctgctgcagcgaggtggggacaaggccgggagcagctcacttcccagtagaggccatccgatggcgccagggcacggggcagctgccgtcctcatggcccggggtaacgtgggcacagggtttcctcatcccactgtgctctgtgtctcccctgagcccggtgattttacgcacctgacttcgttagtcttctcggcaatgcccagcgtgcagaccaggctcgagaggtgtgtcggtgtgcccagggtcacgcagcttcctggtggccaagccgaggttagaagctagttctggtgggtgcgaaagcccccgatgtcggcagctctgccaccaggcccgcacaagcaggtggtgtaagaggggaggcgttggggccggcagtgctcaagtcaggattgagccgtctatctggaaggtctgttgagggtgtgtgctggtggccgggaggtggtggcaggctgactacctgccattttcctgcagtgcctaggcccaggagagggagcagcccccggtcaggacccagctgcaggacaccccatcctcatggaccttggttcccgctctccgtccccccacaaatgggctcccagcataacttcccccgagggctcctttcctctccccacacanagccctgntcnggagnggcgcttgcagcacaccaangacaggaggattgggcttcagggaagcaggcgcctggagctgtgtccagttaggtgcntggcgcttgcagatcnnagcatggaatattcatgcctcccccngcccagcagctgcggcttctcatctggaacaagggggtgcttctcccaggaaggccagtgggagcaggggtgtgtctgagaangccgggcgctctgccctcacgatggcngctgatgccacagncccggcctctgtgcccaggccactctccagcctggtgangtctgttctgggaaaagagagaagcaagacagatgtgggccttgccctgtggggccagggcacnggcaggaatcccacttggggttaagacgctgcagtcacccctccaggtgcnggggtcctctgtggccgtggcgttctaggagagatgggcagggagacgctggcgccctgttgtgtagcttgtccttgtgtctgcttcacaggctcttccactgtgcaatttcctaaaattttggcgaggcccatttatccattttaattttattctatggattgtgctttggtgttgagtgtcagagctctgcctcatccagatcctgaagatttcttttttaanataattctgtgttttacatgtaagttcatgatacagtttgagttaaattttatntgagatgtgaggtttcggtcaaaaaaaatttttttttaactaagtgtgtccagctcctccggctccagctgtagcaaagacaaggctgcccttcctccactgaagcgcctttgtgacttttctgtgacttttccgtatcgattaatagggtcatatgttgtttattctttagcctgttgatatagcagattacattgattgattttcaaataccaagctagcctcgtacacctaaacgaagtcccacttggtcacggcataatattctctgttagaaagtggcctggacgcgtctgtgggtctctttcgagttcctctgttctgttctgctggtctccacatctcccctccagcgctgccccagccatgtctgtctgacgtaggagccgtataacgctgtgctgtagctgtacggttctcaacatcaggaagggcaattcctctactcttcttttttggaattgctttccatatacattttagaataatcttgtgtctctctaccaaaaaaaaaaaaaaaaatgctggccgggcatggtggctcacgcctgtaatcccaacacttggggaagccaaggcaaaaggatcgcttgagcccaggagttgggagaccagcctgggcaacacagggagaccccatctctatgaaaaaaatacagccatgagtggtggtgcgcacctgtagttacagctacttggcacgttgaggcaggaagattgcctgaggctgcagtgagccaagaccacaccactgcactccagcctgggtgacagaataagaccctctttcc

SEQ ID NO: 195069 - DNA, 120 bp, Homo sapiens
acataccatcccaatgaaaagctttgcactaggaaaaagtttcctcaaggatagctttggaaaacagaggaaaacgaaacaaaattgcaccaccctgacacagtgactattatgaactat

SEQ ID NO: 195070 - DNA, 626 bp, Homo sapiens
tgtctgtcccgctagagtcaatgtgccgtaatgtcaacctaccttcggccgcagtataattctgcggggagccccccgaatactctctgctggcagttgtgatcctcctggaagtgaaccacgtttatctgcattctcttaccagtttgcttggtgactcagtctccctgggtacactgccaaaaccaacttctagaggaaagtctgagtcctgggccgcagtgaccccatgcagacatggccagccacctaggaggcatgtcagggttgcaggggcccttgaacacttggatcttgcttgttttcatgcttagccatggaactatgtcctagaacatgagtagctttgtttcttgccagacaattcctcagtattgtgcagacccagacacaacaagatgaagaaaactctagacgtctgtgaggcccagataaacccgatggaacagccctgggcaaagccccattcagggtaggggaaacatggccactactaatgcctaaaccaccccaccccatgtctcctctctaagggtcttctatgaccctgacaccatcttcttccaaagcgtggatgaaaaaggaacaggaggcgagcgcagtggctcacgcctgtaatcccagca

SEQ ID NO: 195071 - DNA, 352 bp, Homo sapiens
tgctgggattacaggcatgagccactgcccgtggtcctatttttatttttgaaaattaattatttttgcttcatttctttttatgggtgagcagtattccacagtatggaacaaccaaattttatttatctgttcgttggcggatggacacttggattgcttcccccttttggccattatgaatcatgtttcttgttccttttggtttggttttcccgagaagctctttgcagcccagctgtctgtattcctctagcttggctatttggaaagcaagagaaagcgtagctgagcgtgggtggatggctgggagcgggtgtggggaggggatgcaggaaaggggagtttcagg

SEQ ID NO: 195072 - DNA, 784 bp, Homo sapiens
aactctttaatggtgctgacaggtatcaaatataaagatattacaatttagataattgaggagataagaggaaaagggatctgctccgtcagctcttctgcttacatgggattggaatcatttttatggctcctttcataacttgccatgactccaagcctgttctcaccataaagtttgtgtaaatgctactcttcatgtttaaccttgtggtgattcatctgttcagtagagcaggctgcaaatacttggattattctatgtacctttcagcctcttccaagagaggctacttatgattctgaaaaagtggtcactattccctgaatgtttagaatagtcaagagccattcatacagagggaaaatagtttcccaggtgtagctgttccttaattcatgtacgcatgtttaaaatttatttttgatttctacttcatcttctcttactgtatgacctttttagtgctaacctacttaagtatttctgtctataagtgtttttgtaaaaaaatgaacagactttttttttacccttctcagataagtctataatatttcgatctgaaaacagacagaaaagcagcagtctttgtgtttgtcaccttcattccatcctcttctttctcctgaaaatgcattggtttccttcctttacacttatttcctcgtacttctttgcttccttatgaactgtaggcccttgtgtagctatatagtatttttacacctgttttgtctgctaatacttcagcctaaccttgatcactttctcctgttcctta

SEQ ID NO: 195073 - DNA, 508 bp, Homo sapiens
tcccagcactttgggaggacaaggtggaccacctgaggtcaggagtttgagaccagcttggccaacatggcaaaaccctgtctctactaaaaatacaaaaattagccgggcatggtggtgcacgcctgtagtcccagctgagatcgtgccactgcactcaagcctgggtgacagagtgagactccgtctcaaaaaaaaagacagggaggaagcacgagagaggttcagagtattggtgtttctctatatcttaatctgggtcaaatatataggtatttttttccttatttacattgaaggactggagtgagtcatatttatacaggtgcatttttatgatttttcatcaaactataatttgtgcactttcagtatatgtgatatactttaattttttactgtatgtatttgaggtgtatgacatgatgttttgatatactgacttatcttgatagacataatgaactgattactatcaagcaaatgaacatacccatcatctcatata

SEQ ID NO: 195074 - DNA, 575 bp, Homo sapiens
aacctcacaagtcaacttgttccacagctaagggagtaaagtggaaaatctggcaacatggtgatttactgagagtcctttgagaggcctgcagttccagaagactcaggaaagatagttctgacacctggcattctagaaaacaggctgtctcttccatgaatatgcctggattctctttgtctctcatgtcaaagaggagtggaacagctgcccctgtcagggggcccttttccaaggctcctgcttgctgcagtccccaggataagctggggcttccccactccctgctcctcagagacattggtaccatccaggacagatgtgctccagacagaggggagggtctccaggaccctccccactagacccccaccactgttccaaccctgtgtgaatctcagacaccacgacccctaaccaggtcttggtcaatcaccctcctcactttcttgttttggtcttaagtgtccaaaacactcagactttaattttttagtaattttttaaaagatgacatatatggaaaagtatagaaatcctaaagaacagctcaatgaactttcataaattca

SEQ ID NO: 195075 - DNA, 276 bp, Homo sapiens
aagagttaaggaatggttatgacgacatggagttggtgaggggcagctcctgttcctaaaactttattggtgaagggtatagtactttgagaaaagttatttttaggtgagggaaaagtgccagaagaaagggagagattaaaaattcaagagagacagggggatattgatgacagaataaggttctggagaaggcaggagggtgcagggcaaccacagcgagtccacctgccaacacctccacggaaagagagacccgcctagatagacagactc

SEQ ID NO: 195076 - DNA, 484 bp, Homo sapiens
cggcctctgcagaaggaccagcgcggcagcggggtccccagagagactccatgactgagcagcaaggagaactgggcgttctcggcgaggatccacagaacaacagttccagaaaaagccagggcgcatcgggccgcggcgggttgggataaggaaccgcatgtaagctcttgaccatctgtttaagaagctgtgacatgcgggactcgtggggcagtgactgccggctccacactcatgggtccggcacacagctcatctgcaaatggaagactctccagtcacctcaactggacaaaaaaacgagattcagtttctttcattccacgtgttaatcctgtattccagtatactttttttcttttcttttttttattttggggggatggagtcttgctctgtctcccaggctgaagtgcagtgagctgagatcatgccactgcactctagcccaggcgacagtgcgagactctcccaaaaaaaa

SEQ ID NO: 195077 - DNA, 359 bp, Homo sapiens
gctggcccaacaatttcagtggccaagaaattttatcatcccaggcacaacatttcttgtttgcttgatgtcaattccatgtacagtagtccttccctgagctttcactttccacctttttgagttacctgcagtacaacacagtaagatattttgagagagagagaaaccacattcatctatcttttattacattatactgttattattggtctgttttattattagttattgttgttaatctcttactctgcctaatgtataactatcataggtatgtaggtatagggaaaaacgtagtatacacagggtctgatactatccagtttcaggcactcactgtgggtcctggaactatc

SEQ ID NO: 195078 - DNA, 274 bp, Homo sapiens
actttcctaaaatttctgtgccttctcccacaccatacacagatctgcaaagcatcagggtgcaccagtggttaagactgcatatttgatcaaatctttaaagtctgtcacatctgattatgtaatgctgttccctaaatctgtagcatcctaccctagttcaggaagacaatctggtacactgaaaaatgtatctttcagcttcaatcacaggttctaaagttagagaaatctgtgttagaaacccagctttcctgttttctagcattgtatc

SEQ ID NO: 195079 - DNA, 270 bp, Homo sapiens
tgtattggtggtgctgacactgggtgagaccaaggagaaattttaaagctgtgtgtcctggggccgggggtggtggctcacgcctgtaatcccagttcagaatctcggtgcgtccacaccaaacaattccatgagggctgaagagacagagctgaaaggcttgtctgacatcacaaaagacagaaaagtgagccccattttcatctctatcctgacaatgttcctggcttgatttcctccttccagcagacagaagaatcagggagcgca

SEQ ID NO: 195080 - DNA, 381 bp, Homo sapiens
acttctcccatcaggattcattagcctgtttcagcctctacgccggcaggacaggtcccagctgcttgtcccctgcagtgaggccagttggacaggtggagcctacagggaccctccctggagagcaaagggcctccccagggtgccggccagggaatccctgctttggccaagctctttcccacacatgcctggggagtagggaagggtggtttccagaaaaaatgaaacctctggccaggcaaccatggctttcaggtctggagtgcatgggaaacggaaagtcaggaccaaaccctcagtgtttttcctaagacgatcatcctttggcagagagggacctttgagggactctggagagagagctgagggacagggtgg

SEQ ID NO: 195081 - DNA, 366 bp, Homo sapiens
gagataaccagtgagtcaacaacaccaacgactgaaaagcaaaaaggaatggagatgagaaaaggcacgtcgcgttcaacaggtccaaggtccaagagtacctgaaacttgtcactcttccactgtttcttggctcagggaatggtaccactgccaagttttgctggttagaaatatagaaggtattcatgatatctgcctcccttatgttcattatccaaatcatcacataggcaacagccaaaggaaaaagcacgtcaagtagagagaatcacatatgcaatgtttctatgttgaaagacaacatggtgggttctggagattaaagacctgttagtttgaaatagaagaaggggatagttcatg

SEQ ID NO: 195082 - DNA, 450 bp, Homo sapiens
tgacttgggtagagtgatgtctggttggtgctgcctatctcatataagccagggacaaatcaatgccttatttattccagcttggcttttggtctgtgcccatacctggtttatgccttggacacatgggaaaaaagattgtgttggctatttgagatctcttgagattccatgtgtattttagaatgagtttttctatttctgcaaaaactgtcactgagactttgatagggattacattgaatctgaagatcactttatatgactcaaggacattttttttaaaaaaagatcactttggagagtgttgtcgtcttagcaatattaagtcttcaatccatgaacctggaaagtctttccatttatttagagcttctttaatttctttcagcagtgttttgtagttttcagttataagtcctgccttccatggttaaatcatttctgagt

SEQ ID NO: 195083 - DNA, 181 bp, Homo sapiens
tccatgtggactgaattagtatacctttgaaggtattgtagaatccaggaggagacgtggagtattagaactaggtgctaagtggaaaagatggatttgagagagataagtaataaagttgacagaatttgtccagggggaaatcttgagcaactgctggtatggagcctcggcgtgtgca

SEQ ID NO: 195084 - DNA, 388 bp, Homo sapiens
aactgagaactcctgtacacaaaaatactaggggaaagggcttaaccactgggtcaaaatttgcagttgctctgacatgcacaatcaaagcactcgaagagatatgcctgggaaataggattttattgatatttatgggtaagtttgtttactacaagccttagccatttcttctctttactttcttccttttagcaaaacacactccgcttcccagtgcccaacatgggggcacaggacagggactattgtgctccaggcttccttgcagcacatctcaaccagtattggctacaactccagcaccacgcaccaatttcaggaaaattagagttcagccctttctttctctccattttcgtaatctcacagaggcacagattgcagt

SEQ ID NO: 195085 - DNA, 157 bp, Homo sapiens
ccagctctgccacttactagctctgtgatttatggcaagttatttaacctctatgagcctcagtttccttaacttgccctaaattacatagcttgtattgatcccactctcagcaaggtattacactagttttctcataaatactgtcttttagtcc

SEQ ID NO: 195086 - DNA, 608 bp, Homo sapiens
gcacaccgcttgatagtggtggaaccagaactcgattattttttttgaaagtttttaaatcccatgttttttctttttggtgttagagctaatactttcatttgacttgttttctcttcttttaagcaaatttaatactccttctggatttggaaaaccatttcctacctggtttcaacccataggagaaaaaaatcattctccttcaaggtgcaacactggtaaaagtaggattttgcaggccatatctgattaatcaaatgatcagaacggtctatgattagagataagatagactcttctatgatttttattgctaacaacaaaccaatttaaattatacttttggtgtttcaagcttagtaagtttaaagtgtactaaggacccagctgcattctgttcccctgtgtgcatctccaacttgaagagaaggttcagtcatgccatgtgattgatggtgttaagtgccacattttatttttttaaacctctctgctgtgtattgattgaataaaagcaacaatgattaaagaaaatgatgaaaaaaattgatgctagtttgaatttataaaatgagaaattaagctccagatggagcctcttagtt

SEQ ID NO: 195087 - DNA, 489 bp, Homo sapiens
caggtgttcacctatttgttcactaattcttttattgtgagtgtgcatgtgtgtgggtgggtgtgacatttattatgaaccagagggcaggagccagtgacacagtggtgcagagaataatcatattccctgccttcctggggtcatacagcttggtggaggacacagatgtgaattcggtaatcactccaataaatattctcctacagatgaagaaagatgatacgatgtgatggacaacagagacttatatggtggggtctgggctggtctttctgaagctaagactggcaggatgagcaggagtttgccagacaaagaggagtggagttgttttccaaacacatctcagcacaaagtgttgtctttgctgggagctgaaaaaagatagtgtgggcagagaccattaggtgagacgcttgatatgagatacaacctcaacaggtggaagaagatcatgagagatgaagagaggaatatagtacagca

SEQ ID NO: 195088 - DNA, 328 bp, Homo sapiens
ctgttactcttttcaccccaaattcaaaaaccactaaccatctgcttccaggattgctgttcccagcgcagcccgctgcagtgtgatttctaacccgccttcacaaggtcaccttagttgatggagtcagtggctggtttttagtccttattctgttttgttgttttgttttgttgttgttgttgttttgagacggagtctcgctctgtcacccagctacttgggggctgaggtgggaggatcacttgagcttgggaggcggaggttgcagtgagctggtattgaaccactgcactccagcctgggtgacagagtaagagcccatctc

SEQ ID NO: 195089 - DNA, 123 bp, Homo sapiens
gcttcgatgcattttaattattacctctttgtaagataaaaaatcactgaatacaacttacggagaactataaagtaaatttcaactgccaaagggagaggagggcacaccgaagaatcttat

SEQ ID NO: 195090 - DNA, 155 bp, Homo sapiens
ctgttttacctaggatttcggattctctggagatgggggaagcttcaggctcttccccaaaccctcaccaccccatgcatacacacacacgtgcatgcactcgccactacccagcacacgccatcagccctctccctctcccacttgcacaatct

SEQ ID NO: 195091 - DNA, 474 bp, Homo sapiens
gtttaatattgtaccctaactgttttcatttagcattaaatcaaaagcatttttcatatatctgaatagccttcataactatccagtgtttaaagaatcatgattttatgaccagatgttcagttttagaactttttcttacactagtagagtaggtttgctggccaggcctgcagtatgtcagcattcttgccacacctgggttttcttcccttaatggagagctgaccaactgattttcagctttataagggatcctgcaaccttttcttattagtgttctcttaaacttaagtactagagatgacatcacagaaaatcaagtccatcctactaaacaactacagaacgcctttcccaagagcaggcaggtgactttctccctgtgacaatcagttcaaaaaggcgctgtgtctcttctttgctacatgagatttgacttgtttaataacttgcttatataattttattgac

SEQ ID NO: 195092 - DNA, 560 bp, Homo sapiens
cttgcacgttcttcgactagcccaaccatacgttcattccccacataccccacatttgtgctcaaatgaaatatataattttattgtccaataattcatgaaagcacataaaaagaaagtgcgaaaaaaataagaggctacatattgcataacatcatggataactttgaaggcagttaaagcattttaatagtttcatttgacttcaaaataaatgtgtgcaaaagttagtgacaatgctatgaacttagtttaagtagcagctaaactgtagctattaatatactgtacagtagttgctgccagttagaatagaatgttccaggccaaatattaatagatgcatttattcccactgagcaagctaaaaaactaataaagtattagtttgttaataaagtaatagtaaaactaataagtattgcccacagattactcttgctaattcaggtttatgaaaacatgaatttgtattccacaagaatatattcacatgtggttacattgcttacctaatttgattcaatctaatgaatatttccatgaaggatttatccctt

SEQ ID NO: 195093 - DNA, 1220 bp, Homo sapiens
ctcaaactttttggtctcaggcctagaatttgccgggtaaaatacaggacgcccaattaaatgtgactttcaggtaaacgacgaacaatttttttagcgtgagtgtatcccatgcaataatggtttatccgagaggcgtttaactgggggtcctgtatttttatgtgctaaatctggcaatccaggtctggcgtggtggctcacgcctgcaatcccagcactttgggagaccaaggccggcggattacttgagctcaggagttcgagatcagcctggccaacgtggtgaaaccccttctctaataaatatacaaaaattagccgggctcagtggcgggctctggggtaatcccagctaccctggaggctgcggcagaagaatctcttgagcgcgggaggtggaggctgcagtgagccaagatcgcgccattgcactccagcctgggggatagagtgagactccgtctcaaaaaaaaaaaaaaaatctggcaatcttacttaggaaccctttacactcttaaaaattatactttggacatcgccctacacctcccccatgtctatacttttgtttagttgaattcagagcatgccgtttatggacatcgacaaagggttcagaaaatgccatccactgacatctatgtattagaaattgaaattgagacattttacagcctaagatgtcaagcgcacattcttcagccgttggataatatcgttgcaaatcctgtggactctgaagagtataccgattagagaatgcggagaaaatcgaatagctggctgttattcaattcaaaactgttggaaaacagttttggctctgaggacccagcagttgacaaacagcaggcctgggacaagagcagtatgagaagtcagatcgcctcttttaatgtcactagtcagtacaggcctcgccagacaagtctctcctcagcctcacttggaagaacatgccctctcttcatgatcctgggtttcctagacttagtatccttggaaaggtcttgatgaatatattgtggtgggaagcagtggggagaaacaaacgcctattatgtcacaaaaccacatttagtgcttataacaaccttggaatgagatattatcagattttactgttaattggtgatcaacggaggcacttctatgtggactggctgtcattatagctgctgcccttggcaccaatttcgaggagggctttggaacag

SEQ ID NO: 195094 - DNA, 805 bp, Homo sapiens
  misc_feature (31)..(31): n is a, c, g, or t
tggtgatagatctagaggaccctgatcaatncacacgttcaagctaatggctacttatttcaagacaggcctgccaatatagacaacacaaaggggcctccttagcctcccaagcatgtctgaagttaagtgaccctgcctgaacttttagcttggttctatctgattactttccctccatggcacccaccctggctccctggctttctatttgatttttttttttttaatttacaaaataaatgtccctggaacagttctaaggaatgaccagccagagtcaacctagaccctagcggaaccaagccatggtgtggacacacaatacatcagaagaacaaggctctggggttagacagacccaagtcactgactcaggctgagccatttcctcatctgtgaacagggtgaggatccccgcctgggagctgtggtaagatgtgagcaaggcagcgtctgtagagtgcttggcgtgcagtgggcataccttcatgtctgtagcacggacccatggacccatcacactccctttcgacttccctgggctggccatcctacacaacttccctagctccaaggtcttccttaagaagagactcctccctccccccagtttaacaacataggaactctcctccaaaaccccaaaccagctcacagcccagagggaactgcaggtgctccattgctcccacccccaacccaggggcagtagagaggcagcagggcaagccagagagagggctggggtaagagtccagagggctcactctgtccctttttgtgatcctttgggcattttgga

SEQ ID NO: 195095 - DNA, 200 bp, Homo sapiens
accgcactgtcctctcactgctattatcatcatcacctgctactctacgaagatgctgtgttcttgtttctttggacctcccatagcattttgtattatatagatcttttcacattttaactttttgttgtgaccttgacaccttattcatcttttaagctaagcacctgaaataacactcgtcacacaaaagatgccct

SEQ ID NO: 195096 - DNA, 276 bp, Homo sapiens
gatgtgagcctggaaactgtaaagagccagaaaagaagcagaggggaaaaagacaatgagcaaaacactcagagacgcaggagggagaaagagtcctgctggcattcagaaccctgtgtcaggtctttctgaatcacccatttcctctgtccttctggctgtctggttacctgagtcattaccttcgcattcttctgaagctatttcctattgtatttctgccgtgtgaaaccaaagggtgttccccagcacaagggtttggaattgcagcgctct

SEQ ID NO: 195097 - DNA, 247 bp, Homo sapiens
ctatagatattacctttctccttctctacctatacaattccatgtctgaacttatttagcaagtctaatgactggaacatgaaatattttccaaatggccccactgaatggatctgcagtccatcattgtacatttggaatgatgtcataaatggttacattttaatccttcctgtattttctaaatgggaatagggaggggggaacttgggagaaagtggtttgcatatgatattctaagcccgaa

SEQ ID NO: 195098 - DNA, 221 bp, Homo sapiens
cctcgcggcccggcaggtagctgttactgtttgccaaatggaaaaaagattgattgaaaaacattttttcattattattttccaaaaaggtttttaaagaagaaaacagaaaacatgctaatctttctttttgttgtttatgacctcgtaagtaaagttagctaatcattttctctgtttatattttccattcacctatcagtaacagatacctttcctgt

SEQ ID NO: 195099 - DNA, 237 bp, Homo sapiens
ttaagtaaaactttcatgtgtgggtaacaaatccttgcatgtcaggtggtttcctaaattaattgcatttcacagaattgaaaagatctaacaaactgactcattattacaatgaatttctatgattaccacgtgctttgtggcatgtaagaattcaaataatagaaactgctatagcaaaactcttaccattcttacctttattttgttaatttatggcttctcaacatttacaca

SEQ ID NO: 195100 - DNA, 435 bp, Homo sapiens
tggccctcacacgtgcaggcagctttgcataaaatttcaggggtttcacagatggcttaagcccatctgcaaagtcctcacaaggggaaggtagaactcagattaagaacggatgaagaagatcagaagccttcattcagccaactttgtctcttaatgttccagacagcagccatctctgccatctcaggcctgtgggtctgttgccaaagcagacagccgtaggctgtgttccaataaaactcaatttacaaaaacagacagctagcctgtgggctgtagtttgccgaccccgatctagattctagaggaataaatggaatacatattcactacattatttcctgaaactgagcttttgaaaagaactaaacaaaaaattcaaggttgtattctctggtaagatcaaatttagctaaattaaggcagatccca

SEQ ID NO: 195101 - DNA, 335 bp, Homo sapiens
atctagaggatcccttcgattggcgggcacttaatatacttagatgagaaattttataaatgctgcagcataatagattatcttaaaatagttactgattgttttgtttaaaatgtttgaatttaaaatgttcacattttgaacatccaagtggattgttacttggaataaatgctaagcaatattttttgctaaatttctgatttatttggggagcaggaagaatgccttatcttaattttgaatcacctttgtaagtaaggtgcaacccaaaacataggcaatgctagttgccagatttttgaaccactgcctggtaagttgtccttttggtt

SEQ ID NO: 195102 - DNA, 429 bp, Homo sapiens
ggagttgttccccttttagaaaaaagctgtcttaggattcaagtttggggagcaggggaggatgttcagttttcaagcaagagggccagacaggagagggtccaggacaagccagagggacaggacaaaccaagggtccacaggggtttgtcctggggagggagggaaggccagaaaacaccccatttactgtgtctgagactccagctgggacaaggcccacagcagcctgtcgttaggaggacactcgaaggcatggcatgggggagaggggcagcgcacagcacgcagaggggcctgcacgtgccccgcggactccacatctgtgcacatgcctgtgtgttgtcagggaagctgtgcagcccggctaaaattacaattctttggcgagaggatgttgcttattgtcaggagcagatccttttggac

SEQ ID NO: 195103 - DNA, 661 bp, Homo sapiens
taaagataatgtcttgctctgtcacctaggctggagtgcagtggcatgatcatggctcactgcagcctcgaactctgggcacaagagagcctcctgagtagctaggactacaggagtgcaccaccatacctggctaatttttttttttgtatagatgggatcttgctatgttgcccaggctgatctcaaattcctgggctgaaaggatccctctgccttggcctggcaaagcgctgggattacaggcatgaaccactgtgcccagatgaccccatctttcaataggaggaactttttagggctgtgttctcatgccaccacaacccagggggccagattagctgaggacgtgtcctctaagcccttctgtgtcccttctgttttcagtttctcttctctatgagtatctctgtctcctttccttggaggtgacagagggcacccatgtgcccaggctcacccaggcagtgggtgacaccagtgggtgacaatgtggatggcccgccatgccagacactcactccaatgcccattttacagatgagaagactgagtactgagtggccaggtagactgagcaggatcgcagagggaggatttgttcctgggccaatccccttgtttcccatccatgttccctatccttggcaacttgggggac

SEQ ID NO: 195104 - DNA, 336 bp, Homo sapiens
atcaaagctactttctttcttatttttcgtcctactagttttctttaagaatcttggtttgtacatataagttagcgccagcccacaaataaactggtaggagtaagggctatatacctttccacaccttaaaaccatctgctcagtttgacatttaaaagggcggagagcagagaaggaggaggggggagtagggggaagaaaggagtcagggacagagaaaaagattcaaacgcgaaaaaaatggcttgcactttagcccacaagtttgtgtcaattgcacatagcgcttgaatgcacgttttgcacacaccacgcccgggaactggcggcggg

SEQ ID NO: 195105 - DNA, 619 bp, Homo sapiens
tcctgcctcagcataccgagtagttgggattacaggtgccctccaccactcccggctaattttttgcattgttagtagagacagggttttaccatgtgggccaagctggtctcgaactcctgacttcaggcgatctgccgaccttgccctcccaaagtgctaggattacaggcgtgagccatcgtgcctgaagactcatgtattcttgattgaaataatttgcttatgtctcagttctacagttgaccttctttcactgttttcaaggtcaatagctgtgtgttcacacttctgcattttataaatgttactgtgattttcttgtaaggaagaattaactgtcgggaatcaatgtcatcagaatcttgcaaaagaagtttctttagcataggtatgcgtaagatgcttctctgattttcaaggatgtgggtgataagaccaacccctcccattagcccttccaggcccccatgtaagacttcacacacaccttctcactcatctcagaccttgtcagtgtaacttggtgaaaatgtgagcctccctgcaacttggcgatgaggggcttcaccagaaaagctcagcccgagtgactctgacccctgaaatgactggcaaa

SEQ ID NO: 195106 - DNA, 371 bp, Homo sapiens
gcctacgtgtatgttagtaagttcgtataaaaagcaacctgtttacaataataattgagcagcaagataatgagttgggttttgaagaacagggaggatctgaatagataaagattgggggaaagtcaagaatactccaaagaagaaccgacttccaaaaaggatttgaaggagcttataatattaaaccatacacagagcactgcaagactcaaaaagggttactctacaccatatagaagggaaagattattgaaccagaagcccagggtgggactgctactaccattgagtactagatttatctctgagcttcctagtagccaagataaaaatggaaacttgtacaacatcaccataagatcccagga

SEQ ID NO: 195107 - DNA, 474 bp, Homo sapiens
ctcgggtgactctggaggatcccgtcgctgactatttgttgaaaagcctattttttctccattgaattttttttgcacctctctcaaaaatcacttggacatatctgttcatctgtttttgcattttctactctatttcattgatctgtgtatgtcccccagctgataatatattgtcttgattactatagctatataataagctttgaaatcaggtacactgatgattgcccctttattttctttttcaaaattgtttctggttattctagttcctttgtcttttcagataaattttagcatacacttttctgtatctagaaaaaaatcttgctgtgattttgataggaattgcatcaaatctttggaagaattgacatctttactgtgttgagtcttccaatctatgaacatggtatgtctcaccatttgtttacaacaaatagtcagcagcagggtcctctagagcgcccc

SEQ ID NO: 195108 - DNA, 479 bp, Homo sapiens
  misc_feature (445)..(445): n is a, c, g, or t
ctcgggtgactctggaggatcccgtcgctgactatttgttgaaaagcctattttttctccattgaattttttttgcacctctctcaaaaatcacttggacatatctgttcatctgtttttgcattttctactctatttcattgatctgtgtatgtcccccagctgataatatattgtcttgattactatagctatataataagctttgaaatcaggtacactgatgattgcccctttattttctttttcaaaattgtttctggttattctagttcctttgtcttttcagataaattttagcatacacttttctgtatctagaaaaaaatcttgctgtgattttgataggaattgcatcaaatctttggaagaattgacatctttactgtgttgagtcttccaatctatgaacatggtatgtctcaccatttgtttacatcccgtngttacacacctatagcacacagggacgtcgagcg

SEQ ID NO: 195109 - DNA, 446 bp, Homo sapiens
ctcgggtgactctggaggatcccgtcgctgactatttgttgaaaagcctattttttctccattgaattttttttgcacctctctcaaaaatcacttggacatatctgttcatctgtttttgcattttctactctatttcattgatctgtgtatgtcccccagctgataatatattgtcttgattactatagctatataataagctttgaaatcaggtacactgatgattgcccctttattttctttttcaaaattgtttctggttattctagttcctttgtcttttcagataaattttagcatacacttttctgtatctagaaaaaaatcttgctgtgattttgcagttttactctgacaggctatcgaactacgatggcgaattcggacgattcggtacctggcgcgtgtttcatatgttggagatagggtatatgatccactga

SEQ ID NO: 195110 - DNA, 439 bp, Homo sapiens
ctcgggtgactctggaggatcccgtcgctgactatttgttgaaaagcctattttttctccattgaattttttttgcacctctctcaaaaatcacttggacatatctgttcatctgtttttgcattttctactctatttcattgatctgtgtatgtcccccagctgataatatattgtcttgattactatagctatataataagctttgaaatcaggtacactgatgattgcccctttattttctttttcaaaattgtttctggttattctagttcctttgtcttttcagataaattttagcatacacttttctgtatctagaaaaaaatcttgctgtgattttgcggtatcgcgattcgttagtccatggaaggactagacatctgtcactgtgccgtcttttaaactcaaagacatggtaagcactcgccgtcgttat

SEQ ID NO: 195111 - DNA, 399 bp, Homo sapiens
ctcgggtgactctggaggatcccgtcgctgactatttgttgaaaagcctattttttctccattgaattttttttgcacctctctcaaaaatcacttggacatatctgttcatctgtttttgcattttctactctatttcattgatctgtgtatgtcccccagctgataatatattgtcttgattactatagctatataataagctttgaaatcaggtacactgatgattgcccctttattttctttttcaaaattgtttctggttattctagttcctttgtcttttcagataaattttagcatacacttttctgtatctagaaaaaaatcttgctgtgattttgtggtgcgatcttatatatggaaggactaagatcatgacctgggtcgtcgtttaca

SEQ ID NO: 195112 - DNA, 911 bp, Homo sapiens
ctatttcttaaaccagaactaatgtattctggacacagagtccctgaaaccccagacaaagaaaattcgatgtatctgaacaaacaaaaccgcgtttctttaaatctccaagccaaaaggaaaagtgcagaaacatttactcactgtccgacctgtacatatattttacctgataacccttaaagaagtgccccccagttcagccatcacccatgcagggcaaagggagctggagccggcccagcctgtcggcgcagacactcctgacagctcctgtctgggcacttctttctttcttggagcttctaatttctttcttggcttctgaggcctaacagggtgttttgatgcacacacaggaattactaccgtccccaatcctagggtacatccctagcccaggccagggctttgagttttcctaggagcgggagggtctgcaaagccccacaggctgaaatctcagcgtggccctctgctcatctgctccaggtggaaactctcacccctgagctgcccgacctgggttcaagcccgggtcaggggagttagcaaggagacacctgaaaaataaaaggacagaatggaagtgcacactcccaccgcgggcccgggcgggaagtcggactaagaccgcggcgggaccgccccatccagaaagggtgccccgggtgtgggggcggaaaccccagcgctgtcttcagtctccacacccgcgcctttttcccctggaaaacgagcgtccttggcctcttcggccgcaaccgggcggctccagacgtccaggagggcagaggctgggctggtgcggcgcggggggcgcgggcgcgggctctgcgcctttaaggcccgcgtcggcagagcgagcgcaggggccgggcggcggggcggggcctcggcggggcggccgc

SEQ ID NO: 195113 - DNA, 82 bp, Homo sapiens
gcaacagttgagctctcggacccaaggatacttcagaatttagaggaccttttgcgggcagggttgggtttaatccagggtt

SEQ ID NO: 195114 - DNA, 313 bp, Homo sapiens
gtttcatagctgaagatttattgcatttgccattctaatcttttctagttctaatcatcaaacattttaaaaatattttggagtgcaggtagattgcttgaggtgggaagacgttaaatctgtaaaatggagccagacagtcatgagcagcagtgggactgcattttcatcttgtaggtttagatttagtggcatgatgcctatttcaaaaactaaatgtagcagcaaaatgcttagggcattgtatgtgtgagacattagaatgaggaagaaccaaggggttaatgattataatttgcatagaggaacttga

SEQ ID NO: 195115 - DNA, 239 bp, Homo sapiens
cccaggggagggcacagctgtgtgaccttgagcaagttacttaacctctctgtgcctcagcctcctcacctgaaaatgaggacaataatatctgcctgtcttataaggttaccatgaagaagatcaaattaagagacaagtgagagcatgtggccactctctggcccctagcagatgctcagtaagtatgagctactgttggttctgttgcacacatgacaagtcttgttgggaaacct

SEQ ID NO: 195116 - DNA, 780 bp, Homo sapiens
ttgagacatgatctctctctgttgcccagcctggagtgcagtggtgtgatcatggctcactgcagcctcgacctcctgggctcaagtgatcctcccacctcagcctcctgaggagctgggactacaggcatgcaccaccatacccagctaattttttgtttttctgtagagatggagtctcactatattgcccaggctggtctctaactcctgggttcaagcagtcctcctgccacagcctccaaaattgctgggattacaggcatgagccaccacacctggccccaagtaatttttatctacatattacctatatctaagctgttttactaaaagagtaaaaagattgcagcttctgttaatataggtaatatttctaatccctactaatatggtataaaaacttctttgtacttgcttttacttaataatgtgagcctttttcataggtaccagaggctgatgtcaaattcaccagcatttacagagagaccctgtacttgggccagaaattgaaatatcagcaagtcatagaccttgcccttgggctcacgacctgactcatgtgcctgttttaatggccattgagacctcagcctgctctctcactactttctgaagatacttggaaagttctgtttgctaactttgagagattggtagtttgagtggttttaagtattcttttgttcaacaaattatatttagagagtggctactatatatatcatacattctgctaggttcagatgatgcgacgacggataagtttgaccaggt

SEQ ID NO: 195117 - DNA, 302 bp, Homo sapiens
cagggttatttaattaccatgtatttgcattgttttgagggtgcctttcagagttgatttccaattttatttcactgtggtcttagagaacttgagataatttcaattttcttaaatttactgagacttgttttgtggcctatcataaggtctatcttggagaagttccatgtgccgatgaatagaatgtatattctgcaattgttgggtagaatgttccacaaatatctgtgaagtccatttgttgtagggtatagtttaagcctattgtttctttgttgactttctgtcttgatgaccca

SEQ ID NO: 195118 - DNA, 239 bp, Homo sapiens
aaaaggtttttttccccttttctacaagtattaaacctggagagaacaatacagtgtaaaggctgtgaggtgggagcatgctggggtgttggaagaagcacatgagcttacaaacattccatcaatttgcattcattccaaaaattgtatgcaatttttcagtgacgattcccattgatcaatcatttataaaaactaatggtgagggtcttccatactcagtttactcccttcttgga

SEQ ID NO: 195119 - DNA, 687 bp, Homo sapiens
ttggcagagtccagcaaagcatattctcctaccaaaatgcttgactttttcaagttaaaaaaaaaattgccaatgaagagcacagatagccatctgccaagaaccttccatcttctccattcaggcatttgtacctattggaaaggattaattttacgtgtaaaggaatagggattgaatgattggattataaacccttagagaaacatgctttgcctaccaggaacttctaaatttacattttaaagccaactaaatctttaaatgtctactctatctgtgaaattcaaatagcaattacacaagggttggttttttttttctccctattattaatgaatatgcagcaacagaaaacggatgctagaagatctagtggtaccactaaatataggtagtgttttccaaggaaagcaagggctggacccgatccagagagcatcacaggggagtggacagcccgtggattagtctgaggaaagcagagggacaatgctggttgtcagttccagttcaacatcactttgccaatgcaccattttcaataaaatgagaagtgagcagaaaactctgggtttaagtaatggcacttcagggacagcaggttcaccagctgtgaaatccccacggccttcaggcagcttcattcccacacctgcctcacgtgtggagtgcacgcagtgtcgg

SEQ ID NO: 195120 - DNA, 285 bp, Homo sapiens
tagaggcaggttttgccatttggccaagttgacctgaagtaatctgtccgccttggcctcccaagtgctggcattacaggtgtgagccactacgcctggcctttactcccatttttctaaataataatgtgttctcttactgcccttctcttcgtatcgaatcatcccaatatagttatgtcacaatttttggttaggtcgatattcattatttattgtgctgagtaaataatgtttattattgagccgtttgatatactactattacatttttggtgcaacttt

SEQ ID NO: 195121 - DNA, 558 bp, Homo sapiens
  misc_feature (95)..(95): n is a, c, g, or t
tctcggtacccgtcagacgctgaactatgtgaagacatagctatctaaacttgaggctactgcatgaagtgcccagcacttacatcagtaaggcnggatgagaagcttccatttgtatacagtggattaggatcacaagcatgccacaaaataaaaataccgggaaaaaaatctttcggccaggtgcacttgctgtggacaaggctgagtaggggcgtgtgtgtggtctcactctgttgcccaggctggtctcaaatccttggccttaagctatcctcccaccttggcctcccaaagtgctgggattacaggcatgagccaccacgccctgccaatagaatttcaaagctattaaaatacatatgtaaaacacctccattttaggacacatatacaaaatactaagcataagacatagaaaagcaaatgtgtaaaaatgtgttagtattttaaaatatccatatattattataaggaggcacactgtagtaatgaaagcagtgtaattttggcttcagagtgcacacatagttcagcgtctgacgggtaccgagccaa

SEQ ID NO: 195122 - DNA, 507 bp, Homo sapiens
gaagttatttggacactgggttttcatcatattgcattatttcctctcttgcttgctaaacacaactctgctatttgttaagcatgcctgtatcccccttatgttttattgatacctaaaaccttcggtatacctactggcccctccaagaatgggcattgaagaaagcacctgcctcactctgcacatttgcctcctgtagtgaaaagtctcctgttacacatattctgaagcagaatatgtgtgcctttttacaagagaagagctgagagacaggaactggtcctagaatattatactccagattcttttacacattatttctcttttaaggattagtgtcttgtttctgaaggctttgtttcccataaatgaggtatttacttactcagttaacttattccctgccagagaatattttgaatttacttttgataggcagtgccataaaacttctggtcctttttcacattctcactttccttatagtgatcagcaaggagtctt

SEQ ID NO: 195123 - DNA, 620 bp, Homo sapiens
gtggggagagggggaccgtggggagagggagagggagagattgtcattcttaatagtatgttattactgctgagcacagtaatagccatagtagtggtagctgctgctgttgtcattgttgtcgggtcatttttttttccaccagtaaaataagaattaaaagagtagctatctctacaagatttcgagagttaatagttcaaagatacatataaattgctttgaagccaatgtgctatttaaatgttaggagtgtttaggatatgattatgttttctacctaaattccatcatttacatttgaacctctcacatagcctttccttagaagaggatcatagcaggctgggtgcagtggtttacgcctgtaatcccagcactttgggaggctgaggtgggcagatcatgaggtcaggagttcaagatcagcctggccaacatggtgaaaccctgtctctactaaaaatagaaaaattagccgggtgtgatggcacacacctgtaatcccagctactcgggaggctgaggcaggagaattgcttgaacctgggcggcggaggttgcagtgagccaagatcgtgacactacactcctggctgacagagtgagactctgtctca

SEQ ID NO: 195124 - DNA, 399 bp, Homo sapiens
tttaaagtctttaaatggctcttttacaggctttataatcttcactatgagaataattttcttaaatgttacagatcttttagtccagtttgctttgaccttttcttctttcagtctctgtaaaaagaaatctgtttattttcctgtaggtacaatttcaagtactaagaagtaaatcaatgtacaaaaatcacaggcattcttatacaccaataacagacaaacagagagccaaatcatgagtgaactcccattcacaattgcttcaaagagaataaaataactaggaatccaacttacaagggatgtgaaggacctcttcaaggagaactacaaaccactgctcaaggaaataaaagaggatacaaagaaatggaagaacattccatgctcatgggt

SEQ ID NO: 195125 - DNA, 421 bp, Homo sapiens
tttaaataataatttccagtacatttccctctgcaactcaaggtggccatctcaaaattcatacatcaagacatagaacaaagggcagctttgaagtgggtcacttcagtatgaagtaccacccgttacatgaaaaccgatcattggccttcaaatttatggcgctttaatggggcaagcccagtgccttaaatacagggtgcattacagtattgagttatctgggctaaataagagtgatttagaaggcgcgtccaggtcttcttatagagcaaaagaggctcaagcttagagatcgggagaacttgggcggaacgtaaagaagtctcctttcgagcaaacccaaaaaccagtggtttcgaatcccgaagtagcaaagccaacaggaaagggagaatcgttgctcggttccagtgaattc

SEQ ID NO: 195126 - DNA, 189 bp, Homo sapiens
aacaacctccctcacaaaaaagaaagaaagtaaggtatataaaccatgtattgacaatcacttattcaactctatttatgccaagtaagacttaattttaacttgagagctaagcattttagaatattgatacagaaatcaggaaacaaaaaagaaaaatgcccactctctctccgttcccaaattaac

SEQ ID NO: 195127 - DNA, 563 bp, Homo sapiens
ggtacctgctgtagatattgaatacttagtttgtaccagttacctgctaagcacaagagattcagtggcaaacaagaaagacaacgcctctgccttttatttatacaaaatacccaataaatgtttggaaaaagttacatgcatgaagattcatcctacatgcatcccaacatatcaaaccataaaaatgttcacaccctttgatgttactgattcagtagataattgaatacttagtttgtaccagttaccctgctaagcacaagagattcagtggcaaacaagaaagacaacgcctctgccttttatttatacaaaatacccaataaatgtttggaaaaagttacatgcatgaagattcatcctactgtctcgtcttttcttccacttcacttgtcactgcttggtctctcttgctggttcctcctcaccttcccaaactattgacattggaaggccttaggactcagtttctggacctcttctcactcacttggttgttcagtcttgtatcgtttacatgatgataattcccaagtttatatctagccagaacctctctt

SEQ ID NO: 195128 - DNA, 332 bp, Homo sapiens
acaaggagatatgactagaattaaccatgtggtaatggattagttagaaataccagtatgaactcacatttaacttaaaaaaatcgatagttacatataaaaatgtgtataaatatgtagctatacatgggttagtatacatatctatctatacttcctctgagaagagttggctgtagaatacaaacctataggctgggtgcggtggctcacacctgtaatcccagcactttggaaggctgaggtgggtggatcacctgagcccatgaggtcaagcctgcagtgagctatgatcatagcactgcactccaacgtgggcgacagagcaagca

SEQ ID NO: 195129 - DNA, 375 bp, Homo sapiens
taattagttctaccatctctggcccttataaaactcacagtaggttaatcgccagtgttgggaggtgccaacaaaactctatacaaagctaaaaactagattttaagacctctctttcattaatacctcattgcttttcaactggtcctaatagcctctttttcaggagagaaaagtaaagtgtgggggtatagcttggccaggatagattaatccagtttagagctcttaacacaagtttgcataccaagtttgcaaagtgttaatttcttaggaaaatgacatctcgccattaatagtttatgcatcaattgctaaccatgagcctatcccagtacattttatcactgggtaaaacaaagtctgtaaaatact

SEQ ID NO: 195130 - DNA, 355 bp, Homo sapiens
tgcgttacaggcatgaaccaccaccatgcccagccaatgcgtggatttttaacgctgatgcccaaagcatacattggggaaaggatagtctcttcaatacataatgctgtgaaaaccgaatagtcacatgcaaaagaatgaaaatagacctcttatttcttatcacatacaagaatcaaatcaaaatggattaaagacttaaatgtaaggcctgaactatgaaactgctagatgaaaacactggggacatgcttcaggacattggtctggacaaagattttttgggtaaaatctcaaaagcacagacagcaaaagcaaatatagacaaatgggattgcgtcaagctgaaaagctt

SEQ ID NO: 195131 - DNA, 193 bp, Homo sapiens
tacttttttgattggacacatcaatattaactctgggaaaaacttccatctcactctgggaaaaagtgcaatataaggttatcgatagtcacaaggaaaagcatgcaaaagagaacaggatagttcaaaactggctttggtagaaagaaatccataataaaaaaggaaaacattccaaccattttattttttc

SEQ ID NO: 195132 - DNA, 187 bp, Homo sapiens
agctagtacaccgcgccaaccaagagctggtcaatttttaaggacagttaaaggtggggtttaggctgccaattatcagaacaaatgtaaatcttgaatgttgacacgaacttttaggaaacttttaggaaacgcctaaaatgtggatggtggtatagagtggtatagggtggtatagggtggtata

SEQ ID NO: 195133 - DNA, 256 bp, Homo sapiens
gctgggattacaggcatgtgccactactcctgggtaatttttgtatttttagtagagacggggtttcgccatgtcgaccaggctggtctcgaacttctgacctcaagtgatctgcctgtcttggcctcccaaagtgctgggattacaggcacaagctactgcactgggccacggccaggatttttatgacttgtaaaaccactgtcttcaaggaggctataagttattatgggagaaaagtaaagggctttgtgaa

SEQ ID NO: 195134 - DNA, 459 bp, Homo sapiens
gaattcctggcttgcaggccctgggcaatggctggacaaggtttgttggtctctagggcacagaaagaatctatgcctccgaggattcatagaaaattaccacttcctctgtcattatcttttatttattattctctgtgatctgttggtctttgattccctttgtatttttgattcttttgtgattctccctttcgatttggcgctggtttttaccctgatctcatctgtatcgtccacacctcaatgcaggcttcccgcgcccctgcccgggctcccgcagtgcccccatctacatccctgcctccagtcttgttcattgctgctgccagattcacctccctctatgtccacctgttttggaaccttgccattcccatcctgctctgagcttttgctctgtatttcctctgcctgatgtatcctctcccctttcctcgtccaaccaaaagaaagtct

SEQ ID NO: 195135 - DNA, 595 bp, Homo sapiens
ttggaagcaagtacattcaactcgaggtccccctcccttaacttagtcgccacatgtgcagtagaaaggcaggcacatggcgctgcccaggtagaaacccccgtctgcataacaacagattaaggtgggatggccagcctctttgtgtactaagtaaatagcacacctggtctgaccagtcttctgggccctatgtaaatcagacaccgcctcccccagcttgtctataacactctgtgcatttagccacagatgagacgacccacttggaaggccctctctctctgcaggaagagagtttttctctttctctctattaaacctcttctcttaagctcacctgttatgtgtccacatccttgatttccttggcatgagatgacgaatctagggtatttaccccagacaacgttgctgctacaatgggaagggacaggttccactggcctcatttcaacctcctcccttaagagttgacatacaaccgaccagtgttaacattaaaacagggatctaaagactgacaaagcagagtctatgtcgcagtaagataccaaagtgattccagtagagtaccaaatgaccgataaccagg

SEQ ID NO: 195136 - DNA, 504 bp, Homo sapiens
ccatcaggccccacctcccaacaccatcatactgggaatcaaatttcaacatgagttttcgtggggacagacaaaccatatccacaccatagtgatatccttggactttttgtgtgctgtgtttatccagtctttgatttactgcttacaaatctaaagaatagctctgaaatatagtctagtcctattgtcactgatattttctcttcgatttatttctataaagtgttgcccatgtttttcaaataatttctatgttttgagtaaatactaaggagtgcgatggccagatcttaagagtatgtttagttgtgtacagaactgccaaactgtcttccaaagtgctgtaccattttgcgttcccaccagcggtgaatgagaattcctgttgctcagcattcttgccatcatctggtagtgtgtgttctggattttgtccattgtggtaagtgtgtagtggtatctcattgttctcatatgcatttcctgattacgtatgatgtg

SEQ ID NO: 195137 - DNA, 412 bp, Homo sapiens
tgttacatgctgatacatacatatttgctattataatccatacaaaggaatattatgcaactgttagaatgcagtagttctgttcatactgacatgtatatatccttctataatgtatacttttttagtaattacaaagtcttttataaattaaaaaactttattgggtttggtggcttgtgcttctaatcccagatacttgggaggctgagatgggaggattgcttgagaaccaggagttttgagacctgagcaacatagtgagaccctgtttcttaaaaatatatatatataagcctggatacagtggctcacgcctgtaatcccagcactttgagaggccgaggcaggtggattgtttgagcttaggaattggagaccagtctgagcaacactacaaaactctgtacaa

SEQ ID NO: 195138 - DNA, 115 bp, Homo sapiens
gtgttgtccgtcagcgtttcagaggagttcagctttctaaatctatgcttttctggtatttgatgtttgtatgtatgagagagagagagagagagagaaagaaggaggagggagg

SEQ ID NO: 195139 - DNA, 373 bp, Homo sapiens
acaggcatgagtggacaatgttctacacagtcaagcttcagatgactacatgtcaaagagagacaaagttaagagcagccttacatggtgtcaaagaagcagttagcatcttgacttcccctacactcactcgctgacctgctgcagcctccccgggcacctgccaccacgcccagctaatttttgtatttttagtagagacaggatttcaccatatttgccaggctggtctcgaactccttacctcgtgatccacttgcctaagcctcccaaagtgctgggactacaggcatgagccaccacacccggcctctttcagattttttagaaagtgccatcctgttttccattgtggccagaacattttacatcc

SEQ ID NO: 195140 - DNA, 539 bp, Homo sapiens
cacttgacgtctttcaaatctttgatgctgatcaatctctgcaattcccccagtgtgcagttgtacttttggtaagaagaggaagctcaagatttgactttttctcccataatgaccctcattttgggggtcagaaaggaagcatggacattcactcatctctatatgaaggaaatgtggaaacaatcacaggatgcttttacagacctataagtgccattgtgacagaattaggcccgcaaatccaattgtcacctaaactgcatgcatcccagattctgccagatacatcacagtgacattctgcatcgtgttcatttatattcaggagccaatactccctgaaagatctggctatttcccatctcccactacacagttaccatggtaaataaccaaagatacttctggagaaggctgggagaaagatttacaggaagtacttctgatgatatcacaaggtccttcttcaggttacctggcttcctctatattcaatgtttggaaataaactcaagtttcagaattgagtgagcagc

SEQ ID NO: 195141 - DNA, 213 bp, Homo sapiens
aaaaattactaagataattagaaaacttgcagaatacaaaatcagtgtattgcatttgaccttttctacacagccatgaataattagaaaaaaatacttttaataagcatactaattatataacaaaaaataagatcgtataattttaaataatatgtaacaccattatgaataaaattatatttaaagaattgaatgacatgaaagaaaatc

SEQ ID NO: 195142 - DNA, 446 bp, Homo sapiens
  misc_feature (355)..(355): n is a, c, g, or t
  misc_feature (361)..(361): n is a, c, g, or t
tgggtttcttagatctggcaaaagaggcttaaatcagcttcaaactatttggtctctgcttcacaactctgaaataactgctacatcttaagttcccttcgaccgctaaaaagtgtgggattctatcaacctgcacgctggaaaggctgaaagtgcagggctgacttcacatcagaatcttctctttcatgaggatcctggctttgtcaaaggaggtgaatttcaaaatgtatgatttggtcacttttgtttgtgacagggtcagaccttcctaatccaaattcaaggtttttctctttacagtacaggaaaatctgggtgcctgcttttttttttttttttttttgggggttcnacaaanccggggggacccttaaaagccaaccggagggctgtgcaggcggggacagggccgcggtaaaaaacggggaaccggattacacggg

SEQ ID NO: 195143 - DNA, 539 bp, Homo sapiens
tttattgaattaactattgagtggttccaagtcattggtgtagctccaaagtcaggtattttgcacatatggctagcttgttttctctgtgtcactttatgataaggcctacttactcatgataattgtttttgtctcaggcctttcacagacttaggatgaatataaaaaggtataataataagaaactaatagtaatgggatgtcctgttttcctttaaaattttcatactcttgggtacttacacatttggttgactccttgattttctttttaactattcaccttaagcacattcattttagtttcattaaagggatgttgattccttgtttattctatttttagcattcttattaaagtttagaaaaacttgttgagtttgttgttcatatgtatagaaagtagcaccatcaactgtggaaaatgaccacatccttttctgtcactgtcgttgagatatgttttatgtctaggtaaagatctttgtgtttcttcccttgataaatcatcagctatttggttttcagcagttata

SEQ ID NO: 195144 - DNA, 168 bp, Homo sapiens
gtaattagaagcagcaaacccccactagctgagggcctgaggcactttgtctgaaagccaatatgaccaaaattggccgtggtagatcttgcttctatttaagatctccatttctctcaggtatctcctatgaatagcagctgctcaaccacagatttgctctgtttg

SEQ ID NO: 195145 - DNA, 878 bp, Homo sapiens
aaatgttggatccctacctcataccatttcccaaaacaacttccagattaattaaagaccctgtgtttctttttttttaaactataaaagtattcaaaaaactataggaaaatatatttgtcttggggtaaggaaggcttcttaaaatataaaataaaaagttgtatggaagattaattaatttgaccacttcaaatttcttaagttgtgtatgctaaaagacaaaactggaggacaaatgatagtactggcagatatcacttattcacaaatcacacaaattaagagtacaggaaggctgttgggtccggtggctcacagctgtaatcccagcactttgggaggccaaggtgggtgcatcacctgaggtcaggagttcaagaccagcctgaccaacatggtaaaatcccatctctactaaaaacagaaaaattagccaggcgtggtagtgctagcttgtagttccagctgtttgggatgctgagtaggagaattacttgaaccctagagtcggaggctgcagttagctgagatcatgccactgcactccagcctgggcaacagagtgagaactccatggtggcatgcactttgggaggctgaggctggaggattgtctgagcccaggaattcaaagctgcagtgagctatgatagagccaccgtactccagcccgggtgacacaatgagaccccatctctaaaaatgaataaaaataagggtcgggtgagggggctcatgtttgtaatcccaacactttgggaggctgaggcagagggatcacctgaggtcaggagttccagaccagcctgaccaacatggggaaaccctgtctctactaaaaatacaaaaattatccgggcattgtggtgtgtgcc

SEQ ID NO: 195146 - DNA, 148 bp, Homo sapiens
ttccaacaccaccttcaccaccagctccaccaccatcaccaccaccacctctgtcacctccacaacctctacaacttccaacaccaccttcaccaccagctccaccaccatcaccaccaccacctctgtcacctccacaacctctaca

SEQ ID NO: 195147 - DNA, 499 bp, Homo sapiens
gcagtaatttagtagtggttattttctaatttgcgtttaactgggttcttttaatttattagagctagattcactaacttcccactagaggtctcctctttccctatagaaagcgttcccaaaggcaactgtttggactcaagtaggaataatttgcaaaatcattagcaaagttgcagttgaaatgtaaaaacctaccaatttttgttacctctattgccaaatataaatttaatttttatgtttaaaacattttaaatctaatatcttgtgtttttagagattacagcctaagtaaatttggcctttcgtttaagctaaattataagatgggccaaaatgaatcaagcaaaaatattcagttttcaaagaccactctaattcacctgcttaataacagtttaactggttttacctttctccatggaaacatgtcaaccgttgaagactattaataaacaaatatttattaaacttttgcattatgctgagaaaaatg

SEQ ID NO: 195148 - DNA, 548 bp, Homo sapiens
catttttgtatggtgcctggtccctattagtggaagtggtatttagagaccacagtttaggtggattttcattgctaatgggatatactttacttctagcccatactacagggcagagctaaaaatgacatatttttagaaagaaaactaaatcataagttcatactggtttttccaatacaacgttacgtttttatgtaacttctttgcttgttttgtttttgtatccctttctcttatgctgcaactcttgatttctaaagatattaacataattatataattgatctgtagtgtatgtttaataatttcagtagcggtactaaattatggctaataataagacaactctatgcagtttaggaatttttagagagatgtacagttataacaccatgttttaaaatcacttgaatgccaggcttggtggcttacctggctgcttgcaatcccagcactttgggaggctgaggagggaggattacttgagcttaggagtttgaaaccagcctggacaacaaagcaagatcctgtcgctactaaaaaaa

SEQ ID NO: 195149 - DNA, 860 bp, Homo sapiens
ttgaaaaacattagtccaactttattataaaattacttgtttgaagttttaagctagtcaaagcactaaaattacatgagttgcataccaaagcaaacaacaaaatatacatatcactatttaatctctatacaatccaacaagtatgaagagcacaacatacatttattcacataaccaagaaaaacatgtttcatctactattaaaatgtgccagtaacaagttgaagtccaacattatttaccaggtggtaaaatctttgacacccagattaagaagtaataaaatgtatattcccagcatttatattctgacccaaaacagttatttaatttggaacaatgatggtatacaggtgaagctagcaatagttttaacaaaaagtacactctatatttaacaagtcctcttatttgggttctaaactcagagtaggcacaaaacaaaagcagatttctcaagtccaaaagtgtgcaaacaagaaacatttatcacataacaaaatatatctacatatgtatgtattaactttcaggtatttttcgttttagctatatagatcattagaagtaactttctgcctctagggaaaaaaaaaaataagggcccatttctttcacctagttaacccatcagtaaaaggtctgatgttttggacttacccatagctaattgtgaatcagcattatctttgtattcatagtcataaaaacctatgtgtgatatttttgcttttgtctcatctttttagaaaaattcactaacacctgtaaaaatcctgacatgtttatgttatttgcccagaatatataattaccgagaaatcatgtttaaatagtatgtgaagttgcttggataa

SEQ ID NO: 195150 - DNA, 474 bp, Homo sapiens
atttgtatttccctaaaataaacgttattagtgaaaagcaccttttcatctgcttattggccaatttgtgtatcttcttttgtctgttcaaagcttttgtccatttaagaaatttataattttgtcattgaattgtcagaatatcttatatattctagacacaaattatttgtcagatacacgtattgcgaatatattctcccggttcgcagcttgacttttcattttgatgagcagttatctttaaattttgatgaagtccaatccattagaactttctttcatgttgtgtggttttgtgacctctgtaagacatctctgtctgttcctagttgtaaagatactgtcttctgttttcctctagaaactttgttgttttagcgtttatattgagatctgtgctccctctcaattgtgtgtggtatgagattcatttttcccctgagaagttgctctggcatcatttgttgaaaa

SEQ ID NO: 195151 - DNA, 543 bp, Homo sapiens
tctccaggaggggctgcctctgtgaacacaggagagagatgctggggaaaagaggctttgtgggaagaggagcattgtgcttggagcctggaagcagcagaatagtttgaaagggccccatattccaattaaggagataatgctatttcttcctctctcccttacttgctacaacaaagtcctttgagcccccttcatgcctcccttaagccctccttcaaccttggtaaacagaccggtagcaaaccacatgacctgtgactttcctccctttgggctgcacctggtttgtgcccagatgtatttatcctctgagaaggaatccgatcagttagcaagtggcagaatagtctctccttccctttggttctggctcacggctcctggcatagccactggtagggcccttggggccctaactgagagctagcccctggggaggagagcctgtatgctgcccatcctagctttctaaagttctctctgggtttggctgcaaggttcttgagggaatttctggttttagttccacctctgagcttt

SEQ ID NO: 195152 - DNA, 307 bp, Homo sapiens
tcactctgtaaatttctagcatcctataattgtagacaagtcagtatgcgcccctcctcaaggctgggcttaggatcccaagacatccctattgcctgcaccacatcgggtgccagctaaggtagaggaggggtgccaaggaagatcagagaagcccagctcctggtgcccctggggtcagtacggtccttcttcccttgtatctgcaaaggacttgtggacacagccgggggaaacatggttgctaagagactggcattgctgcactttcgaggacaccaggcgtgtagtctcatctttcatcaac

SEQ ID NO: 195153 - DNA, 330 bp, Homo sapiens
actctaaaaacttaaacacaatagcaggcacatgtattagctgataattagtgctataggggaaaataaagtagaataaaggaagaaggtggtaatagagaaaatctgaatcttgttattttatatagaatgcttaggtctatcagataactaagatttgagtaaataatttatagcaagtgagaaagaaaaccatgaagatatctggaggaccacttttcatcaagagaatatagcaaaggccttgaggtgggtagtcacagacgactacccacccttttttttttttttttttttttttttggggggaaccccaaaaagccacccggg

SEQ ID NO: 195154 - DNA, 284 bp, Homo sapiens
cattatactaccaggaaagcttgtgctgtgccagggagaggcaagaatacctgatcttccattttgagggcccaagagtcagtctgatactccctgattactctgttaacattgtagtaatggagacatcatgaagcatccttcactcacttcttagtgatgggaccctggatatcagccaccacagcttcactaaccagatcacacatgtatatgtgtatgtacacacacactctcctttaaacacaagacaaaagacaaaaatactggaaaattcccaacta

SEQ ID NO: 195155 - DNA, 440 bp, Homo sapiens
gaatgttttaagagttggaggtgcacaagaagaaagtgacctttgccctggatcttgaagcagaaaaccactgtgctctgaaaagtgaactgtctgctatgtgtatatgagtgtatagtggcactgttatgacccatttcatttccctgttctcacttctcccacatttatgtgaaatctaggtagacacctacaacattaagttctactcaccctttttctactcttagcaccttcatgtgagttacaatttatataccatacaagtcacccattgtaagcatatcgccagtgattgttagccagtgtacagagttgtatagccattaccacagtccacttttagaacatttccgtcaccccaattagttcctttgagctcatttatattaaatccccactcccacctcctgccctaggcaaccagtgacctgttttct

SEQ ID NO: 195156 - DNA, 380 bp, Homo sapiens
aggcattgagtcctgggtccagagcagtggtggcatggggcagcctggagtttgaggggctggactgctgcacttggtcattctgccaacccctggtgaggtcactgtgccccagggatacggcggtggacaattctgcagcccctgtgggtggcagcagcgaggaatgtcaggtagtgatcagcctgtgaaggcaaacagatgtggcaccattggggtgatggaaaattttgaggaggggctgccttaattaggggtccagggaaggtggcccttgaacttagacctgaatcagccagccacgggaggatctggggcaaaggagtccaggaaaagaagaacatcaagcgcagaggccctggcacaagcaagctggggat

SEQ ID NO: 195157 - DNA, 428 bp, Homo sapiens
gagatgcattcagtaaataaatgagtgactcaggagcccatagatccaagttttggccatcaaatagaaaggagtgagcaggcagaaaaatgaaaactccaagtgggccaccatctgaggtgggtggaggcaaagtttccatccatgtctagcgtggatacctaccatgcttgagacacgagttttaatagagtacataattctattttgcactgtgctagacattgagaatataaagctgaagagatacgatctacaccatcatgggctgactgactgtctagcaaaggatataggtttgctggcttagggacaagtccttaaaccaaatttctaacaatgttttgtgtgttcccttcattcatctattcaacgaatattttctaaatgtccactttgtgcctgctgttgaaataagtaaaggggtg

SEQ ID NO: 195158 - DNA, 261 bp, Homo sapiens
caaacttgcacaaccaggcatctaaggactaaaaaagtcagagatcagaagattttaaagatattcatcacagcattctttcagtagtgaaaggtacatggatttgaaatcagaaacaccgagttccagtcccggattggtcagtttttaatgatcggggtcattgacttgaccctacagaatttcagattggggataataaaatctacctaaaatgtaattgtgagctctcagttacacacacacacacacacacacaca

SEQ ID NO: 195159 - DNA, 196 bp, Homo sapiens
tatcctgaattccatttttaaactctagctgtgaatcaaaataatttgtagaactttatttatttatttttaaatacagatatctgcatctcacctaagactttaatcaatgaggaaatcactgaaggtttctgagccaggaaatgccattgattgttaatttatttattcaatcaacaaatatgataagcagcta

SEQ ID NO: 195160 - DNA, 387 bp, Homo sapiens
tcagttcctcgagaatgttatatgctgattatttcctatctttacagattctatgtctaattagccacatcacacatttgaacaaaccttcatctgataccatgatctctttgtgcttcctcatctttcattggcaaatctctggaatgggccatataaatgcagccctcaaatccttaacagcttatgattcggcttccatcactcacatttaagcttttcttaaagatcactttccaccatcatcaagaaacaactgtagtcagttctcttgtccttccatttcttaggactatcaaaatattgtgatttgatatttgactcaccctacttctctaaccttgtaccgtcacagtctccacactcttctgctgcctccttccttat

SEQ ID NO: 195161 - DNA, 458 bp, Homo sapiens
gcagaagaactcaaaatgtaaattacctgggattgacaattgtgttcactagcatcattctaccattgttattgcaagccagttagtattatttcccttttacagacaggttgatcagagtggaaggagtgttttggtgccttaaatggccaactaagcttgaacaatcagccctttttccttttatgagaggaaaaataagttttaaactgtttctttctgattgaggctattccttctcctacttgaaaagaaagtattaggaaaagagggtagactcagtggcagtgttaggcatgccacatagtgttttcttccttgtgcctttagagaaaatgtttgtatcccaaaaagcctgaggaggaccggggagaagatagtactatattaaaattgaatgcctatataataaatatgtttgatcctacataattatcaattgtataccaggagcttga

SEQ ID NO: 195162 - DNA, 405 bp, Homo sapiens
ccagtagccttcattttaaaggtttacctttacgacttaactaggaaagttgatccctgcataaataattctaatcagttcctgtttttataggactgtaaccaatccaagctttaaaagtatatgttcctcaggccgggcgtggtggctcacgcctgtaatcccagcactttgggaggctgaggtgggcggatcacctgaggttgggagtgcgagaccagcctgaccaacatggagaaaccctgtctctactaaaaatacaaaattagccaggcatgttggcacatgcctgtaattccagctactagggaggctgaggcaggagaatcgcaggcggaggttgcagtgagccgagatcgtgccattgcactccagcctgggcaacaagagcaaaactccgtctca

SEQ ID NO: 195163 - DNA, 675 bp, Homo sapiens
aaaattaagaaatcaagaaacaagtttaaaaagccatctgaaaatacacacctggggcaaagctgagacaaacactccagctgccttactcctcatgaattcgtgaatgcccaatctgtttctccatacttcctcccttactcttcagtctccaagaggaaaaaggaaaatggacctagcagacttttaattaaactaaaatccttcagaagtttattgaaaaaggagaattatacagaatttaatgtattgaaacatattaaatcctcaatgtatttattctgcatccctaaacagtcacatatggacattaaacagttctcttcctagatagaactgtgtttcaaacagaaaggaatagttccacagagtacaattaagtttctaaagcatttcgggaaatcaatgtcaaataataattataagcttgcaccggtatgttaaagtacttagctcatctatgttccacactgaataaaagaatttaccaaccaaattctccattatatttcaaatacagtaattcaagagctttggcataaagtcttatttccaaagcataattttaaaaatacacttctcagtcattgtccagctgccagttctatccttcttcattcattttcatttctcttttgactctattctctgtaacttcatataaaccacctcaca

SEQ ID NO: 195164 - DNA, 861 bp, Homo sapiens
ggaagctgaagagctcaagacacactccctgagcacttgtcacgagccagacactgccagaagctctgggatgacacagtcagtgcgtgtgactctcagtgaaccctcaggtgtgcaggaaacgtgactgtcttttctgcgtgtttcccttcagctgagtggaagaaacgtattctcagtcagttctggacttcatgccccatttccctggggtcgtgtcacagacagggcatttgcaactctgcctggaaggcgcagaaagaggaccgcatgactgttttcaggcgaaggttgccatggataaagaagcgctttgcattggctgtgtaatgcggcacagcaagttagcacgaattagaggcttaaagcagcatccgtgacctccctgtgtctgtggtcagtgcctgagccgctccctggaccctctctcagcctgcagtcgaggtgtccgtgggctactctcctccctctgcggacaggaactgcttcctcgtgcactccccaggtcactggtggggtcagctccgtgctggctgctggcctctctgcagggcaggttgcaccatgacagctgctccttcagggcaataaaggagaaaaggcaggggcaggggtcaagacgtaagtcacaggcttccggaacttcacctggaaagtgacacccatcacctttgctgtgtcctgttcaccagaagtgagccactgggctccacccacattcggggagaagaatggggcgtggatgcaggtggagggggcccagcaccttgaagttgccctacccaggctggcacatgtgtcccaggagtgttgtatgagggtgggcaacatggaaaacatgcacagtttatgtgactgtca

SEQ ID NO: 195165 - DNA, 452 bp, Homo sapiens
gttcaaataatcctcctgcctcagcctcccaagtagctaggattacagccgtgtgccaccacgcccagctaattttttttatttttagtagagacagggtttcaccatgttggccaggctggtctcaaactcatgacctcaagtgatctgccagtcttggcctcccaaaagtgctgagattacaggcgtgaaacaccacgcctggcctataaatcttaaaagtaatttgctagacgtacacccagtacttttaacttccttggttcaaacttaccctacgacaatagctttaaaacatggttttaatgcatggatgcaaaaatgagggctcattttctgtacataaaacttcatgtctaaaatcaggatcacatgtaagtgtaagcagtctaaagtgtggaaaataatcgaactctacaactgctctgtaattctgaggtacaggttatggt

SEQ ID NO: 195166 - DNA, 274 bp, Homo sapiens
aaattgtgcttctatacctaccatttctaattactgttgatattcacctacatctattgtctgatttttaggtttcacatttgcacagcacatgttaccttcacatgtataaataatcatacccgtatgtatctaaatattcaagaatacaccagagaatactatggtttgagaggctggagactagccatagaattatggtgattagttgtggatttctggtcgacgcggccgcgaatttagtagtagtaggctagtagtagtaggcggccgc

SEQ ID NO: 195167 - DNA, 200 bp, Homo sapiens
ctaggggtgatggatgctcgctgggcctccctggctctgcctgccacctgctaggatctcagggaggtgctatcttgccatgctggacccgggtgtattctcggagggtcccgaatgccatttggcctgggcctcccatccacagaggccctagcgtttagacttctgatgtcctctcaaacaaggtacacatgtttgtg

SEQ ID NO: 195168 - DNA, 296 bp, Homo sapiens
aatgtacagaagcggctgattacagttttggcctaagattttagtagttagtgcccttttaaatcagtatctgtagactccagaaaaaaatccattgagttttgagcacctgcttttctaaacaattggggtttggaacaatagtttaactctagaagtacatgtatttttcttctaagaagagtgttgtccgcatggcatttacagtccagggtccatggtaacaccacaaatctaagaattaaaagttgactctttgattttttttcagactggccagatatcaaatgaactct

SEQ ID NO: 195169 - DNA, 321 bp, Homo sapiens
tcatgacctaatcacctcttcaagacatcacctcttaatgctattcacgtttggcaacacctgaattttggtgggaacacattcaaactatagcaccaggagcattattctcttttccacttcatgggggatataatttgaccagtgttataaggttgtatagtgagaagctcactagtgtggtttttggtgtgtatatttaattgccctagtgaatattcctttgatcaacctttcttcttaacacttccaaatgtacttattgcttctagcacagtagactgtctccagcaaaaatctacttatcaggtcttttggtta

SEQ ID NO: 195170 - DNA, 727 bp, Homo sapiens
gtccctttagagaacccttactaatacaccccatacccattagtcatagggatcagagaagaagtatctttgtttttgtttgttctggagttacaaagttgcttggatgaaaatctggggctaccaggaaacctcatgccagacagaagagttggagagagacatactccaatgtcactgtctgaattatgaaatgccattgaacctgaagtcattccctggccttttcagttactgagtctataatttccgtttctgctcaagctggttctgatttttaaacaaaactttatttgcaaacaaaaatatcctatctaatatgtcagtttgtgtgagaaaggataattggaatctgacaccattagtccactgaccaacactgttcaagaatgtgggtgcttataaacacaggattggagagtttggtggggctctaggtgcaaagacgggacaagggcataggtgccagggattcagtcgtgaggaaatggataattcctgcagtagtagggtatcagacaggagttttgtaatcagtaaatcagaaggggtcccagataactggcattcaaaggccagaatgggacagtggcaaagctgatgctatatccaacttgaaacaaatgttcttccaaatgccttctgccgtgcagccagatacaaggcagggcttaacctgggattcaggaatgtagacttggggagccctgtttaggagtcccgttga

SEQ ID NO: 195171 - DNA, 197 bp, Homo sapiens
gctggcagtataggtgaaagtgtgggtatatgaatgaacgtggaagagattggcttggtgggagtccagttgcatagtgtgaagcatgaaaagtgagttgaatgggtaaagtgggttgacagctgggggtctttcaagggagctgtgggtcagttcagtcagctccatgccctctttgtgcatggtcttgtcctcat

SEQ ID NO: 195172 - DNA, 632 bp, Homo sapiens
ccgcgcggaagttatttaaggactcttcctggaaggagtcacctgagcggacctgaattccatctgaggacggaggacagattccgggccctgaccctggccctgctcttcgcctagatccaggactggctatcagtcgctctgagaatgcgacctacctgtcgccagcttccacttggttccgcgccaggacaggttttactttcatttctcccgcgcgcctccgactgctggggagtccaagtacagctaggcgtcggcccacgcccggggaaggtcccgtgttctgacttcgttccttccagtctccaccagtcctggggggtggggcgcgccgggggtgttcgttctccagagaactctgcgactgtacctcgctgccacctcgctgcctcctcgctggcctacagcaggcatgtgctgtaggccagcgtctccttcatgttctcttatatcttgctcaccatgtgccgcaacctcataaccttcctgcgagagactttcctcaaccgctatgtgccttttgatgccgcagtggacttccaccgctggatcgccatggctgctgttgtcctggccattttgcacagtgctgccacgcagtcaatgtctacatcttctcagtcagccca

SEQ ID NO: 195173 - DNA, 433 bp, Homo sapiens
aatatttaaatgtaactgtttataatgttaggtttaatctgtcattttgcagtttattttctttttgttccacgtattctgtatttcactttgcctttattctacctttctctggattaattgaacatttttctgaagattcttatctcttctgctaatttgttagctctaatgttttattttattttgtatgtaatttactataatatacctttaactggtattatgccactttgtatatataccatgtatatagtatgggaatcttacaataggatagttctgtttctccctttcctgtctttgtgctattattgtgatatattttatatattttacttttgcttatgttacaaactacacactacattgtttttgttttgtttaaatagtaaattatcttcaataataaaatatttcatatatttatcca

SEQ ID NO: 195174 - DNA, 540 bp, Homo sapiens
attcatttcatttttcaaatagagtaagtccttaaggtttttggaaactgggacttaagtaaaatggcataaaataaaacacttttttttctcatcaacgttataataaaacaacgtctaatcaaacaacattatctgagggcctgctatacagcctttcacttaaagtcacagtttctaagaacctatcaaagacttgaagacctgctgtacatattctgaaatcaccaaaaacaattaacttttctataacttccaagccttcttgtacactccaaaggtcaaaccaagaaaacacaaatttttttttttttttttttttgaggcaggatctcattctgtcacccaggctggagtgcagtggctcagtcacagctcactgtagcctcggcctcccaggtccaagcaatcctcccacctcagcctctagagtagctgggaacacaggcaaacaccaccaggactggctaattttttaatttttagtagagacggggtccctatgttgcccaggctggtcttaagcaatcctccacctag

SEQ ID NO: 195175 - DNA, 536 bp, Homo sapiens
gtaatccccccgcctcggcctcccaaagtgctgggattacaggcttgagccattgtgcccagcaatccaaaattttttgagtgcgaaaaggattgccgcaagtggaaaattccatgcctgacctcgtgtgacaggttgctatcaagacacagtcaaaatgtttttaatgcacaaaaatattaaaaatatgatgtaaaattaccttcagacaattaaaaatattgtgtaaaattaccttcatatataaggtatatatgaaacaagtgaattttgtgtttagagttgagccccatccccaagatagctcatatgtatctgcaaatattctagaattagaaaaaatctgaagtccgaaacactgctggtcccaagcatttcagataagggatactcaccctgtaagtagtagtaacagtaatagtggtgatgagaagattctagaggaaaaccattggaagtgctgcctgctttctggagttctggtctgagggatggagaaactttgcccatagtttgtttttggagtagctgaggtg

SEQ ID NO: 195176 - DNA, 1147 bp, Homo sapiens
tgaaaaagaaaagcttgagaagaaggcagtggctaggtaacaaaaggtcttacttgccaaactaaggaatttgaattttattctgaaatttagggtactaagtaacgactttaagtgatggaaactgtattgcacgaatgtgtagaggatgaatttaggagattgaagactgctgaacagactgaagcctagaattcagcctccagtgatgggtgaaggaggctctaagctcaagcaaggatagtcagtgaagaatatgttgcacatgctaatgtagtaagaatagataaggcatagtttttgcaatcaaataattggggaaggtgattgacacacagggtagattaactttacctggatggatggtggtgtgatatgccttgtaggcaatataggggtaaacagtttgattttatacatgttaaatgagtcatccaaacccaaaaggtcaatttgagctggatggcttgagttaggagtaattaagatatagttagtgaaaagcttggcacatgtaaattggccatgagaatgtacagattagaatgagaaagggatcatggatacaacccaggaaaacatcaatatacaagaagtagatgaaggaattgtgcaaagatgaaaaggaatggccctgtatgtaggagaaaaggcagaagagtgatgtcactgaacccaagggataaatgaatctcagatgggcagtagtgtcaggtgctataaaggaagtaataaggagagtaaattggtaaatgagataattgtagactttggcaagagaaatttcactgaaggagggtgaacaagtaggctgttgaagactatttcaaatataattgaagggaagaatgacttagggaccatttctggtttaataatgtatgcacatgttgagggtagattaaagaagacattgctgggaggaacaacttttgtgaaataaattggagtcatagcataggtggaggaattaaccttaatttcagggatggaaaagcccacataaagaagggaatacagataagtgatttggaggtgaaggaattttctgcctgctgactcattttctctaaggagaaagacttcattttttaagagtctcaatttggatatttgagtgcttaatgatattaaattaatgagtttc

SEQ ID NO: 195177 - DNA, 800 bp, Homo sapiens
cctcccttcatctgtagaataggaaaactttctggtagcagtgctgttactgtctgttgtggggttacttagatttgtctctgctcttcaaggtgctccagatttattgtcattatctacggggaagaaagagactcaggcactttgggcagaaattgactatttgtagaatacttgttgaggaaggggagaaaatttgggatttttgtttttggcaacggttttatatgttactccctgtgagataactgtccttctaatttggagagggaatggactactgcactctccctttcctccccagctcaaaccaaacatccctttatccactgaatcctgtggccaccatttaggttcttcaaaatctgtaacagctttaactatggtttcctattattactgtgaagtaataagagagcctgggaaggatgtttatctctctatctgttgacaaatttctattaccatggtgaggtgaggagaagggagagactgagaaagcagcttctgtctctccctttctctgttttgaaatctgttgatgtagaaaggtgtgtgatagctctttattgtctcataagagacctttcagaagcattcagaattcggaagaatatgaatgtgaatttttctttcatctctaaacacatttttcatgttctgtttttaactttgcgttgaaatgttcttgtttcacacatgattacttatttactgcttttgctttctttataatttatttgtgtcatttctctgtgactatattgcattcagttttctttatttttatataagtattc

SEQ ID NO: 195178 - DNA, 257 bp, Homo sapiens
aggagaaagagcatacttggtcttcctaaaaaatccagtaaggattctggattgaacctatttggaggtagttttcttgctccttgattcctcttaagagtgagaaatgagcagagatgagagaatcaaattaatggtttttctgcatcaattagatcgtcattatcaatagcagaaatcatgctttgttattattcctgcgggcagttgacacaactgaaatgttcaaagatgtaaactattttcaaaaattgtgc

SEQ ID NO: 195179 - DNA, 746 bp, Homo sapiens
gaaccagcggttacttgtgcagacggggtttcaccatattggtcaggctggtcttgaactcctgacttcatgatccacccacctcggctcccaaagtgctgggattataggtgtgagccaccatgcccggcctacattcacttttatattatgatagaatctgtctagtaaatttcatagtgtagtttctttttaaatttttattcttttggagacagggtcttgctctgttgcccaagctggagtgcagtggtgcaaccaatataatataaagtttcatagtgagcctgcttgtttcttggattttaatcctgagtagaaatgattccacttaaggtgggatatatccttgtctgtagccagaagaccttcatgagctcttgctaccttttcttggatttactttgtaatcagtgttgggtattatgttttactggaggtgcctagttacaaggttttattacagcagtatttctaaacatttggttagtctgtctctgcttttcccaccataattttctagcacttgtagctcaccttatctcccacttccctttttaaatagaaaacaggcttgttctgttttgaccaggtataactctttgctcagactgtctctaaagcccagaaaactattcctctagtggtccaatgaagtgttccccattgaaagtttgcctcatgtactctcaactccagtggtcttcaaaccactggaatcactgaataccgtctcctttgcctct

SEQ ID NO: 195180 - DNA, 673 bp, Homo sapiens
tctcttgaccttgtgatctgcccgcctccacctccccgtgttctgggattacaggtgtgagcccccctgccccgccgagaatatggatagtctagtaaatttcatagtgtagtttctttttaaatttttattcttttggagacagggtcttgctctgttgcccaagctggagtgcagtggtgcaaccaatataatataaagtttcatagtgagcctgcttgtttcttggattttaatcctgagtagaaatgattccacttaaggtgggatatatccttgtctgtagccagaagaccttcatgagctcttgctaccttttcttggatttactttgtaatcagtgttgggtattatgttttactggaggtgcctagttacaaggttttattacagcagtatttctaaacatttggttagtctgtctctgcttttcccaccataattttctagcacttgtagctcaccttatctcccacttccctttttaaatagaaaacaggcttgttctgttttgaccaggtataactctttgctcagactgtctctaaagcccagaaaactattcctctagtggtccaatgaagtgttccccattgaaagtttgcctcatgtactctcaactccagtggtcttcaaaccactggaatcactgaataccgtctcctttgcctct

SEQ ID NO: 195181 - DNA, 393 bp, Homo sapiens
aaaaataaaaataaaatgttctggaattagacagtgatgatatatgtacaaccttgtatttgaaataactgaaacccactaagttgttatggtatgtaaattatatctcacttaaaaagtgaaaaaaaattcaaggtatggaccactgtacttgggatacttgctgaatacaagaatggtcaataaaatgagctaatggtttatattggatttttacccccagagcaatgtgcaagtgtatagaatagtaaaaggaatttaaaaataaacacagatagactagaaaataatttatacagtagtgatgttgagtttttcatttgaaactatgaaaagtaacagctttgcttatttgcatctatccaatatcacaaactgagattccacacaaca

SEQ ID NO: 195182 - DNA, 362 bp, Homo sapiens
ctccagagttttctccctggctgtgaagcatgctctgagtgctggaacagctcaacatggcctctgttcttcgttctgagagaacagaagggaaacgtgcaaagcaatctttggtgtaggcccagtatggctgaaaatagcagcactcctatctctggattagcaatgaaggaatgcagactccttcataaaaagagtatatttcagacatatttgtctgaaacctgtgttcaaatcccagctttaagcataatgcgaatggctttgaacaagcacagctttgcagaattgtttccttggctctaagtatgtgttatttattacactcatccttgtggtggttctgtgagattttggggaag

SEQ ID NO: 195183 - DNA, 709 bp, Homo sapiens
gacatcacagcagagataccaagatatatatgaatctagaattcctgcgacaaatgaggtatggagataaagattggagagtcctagacattttggatttatgaccatgatcttaaagtgagcacagacagcctgagtggctgtttctcttcagcaatgtgtggatggttcctaatgtgtagatttacacagcaaatgcaatgaaagtaaagaaagggattattgtagtgtcagatttacatgcatgattctttaatggattgtagcatttgtggaaaaatgaatacagttggtatttgaataactattttgttgattatacctggatttgatacccaggtgattccaccctgggctcttagctcaattttagtatgatcccagaactggatttaaatacagacagtccctgatttacaatgtcttgacttaggattttttgactttatgatggtacaaaagcaatatacattcagtagaaactctactttgaatttgaattttggtcttttcctggactagcgatatgtggtacaatacttctcaagatgctgagccaaatcatctaacacagagcctattttaataataaagtgttgaataactcatgtattttattaaatactgtacagaaagtgctctgagcatttctaagataggttaggctaagctatgatgtttggtagatggtatggtttcaatacttgtt

SEQ ID NO: 195184 - DNA, 498 bp, Homo sapiens
actacttaaccacactaccagaaaggaagatgcagaaactcaagttcttgcaggctaggtgtatctggtttttagtgctactgtaacaaattactacgaactaacaggcttacaacaacacacatttcttattttaccattctagaagtcagaagtctcgaatggggtgacagaactgccttctgcaggctctaggggtgaatccatttccttaccttttccagcttccagaggccagctgcatgtgttggcttctatctccaaagctagcagctcagtgtcttcagatctcttctctctctctaaccctgacactcttgcttccctcttgtaaggatccctgcaattacactgcccctgctaggataattcagagtcatctctccatctcaagatccttaattatatctgcaaagtccttctgtcatgtaaggaaagatattcacaggttgcaggtactaggaggggaatatacttgggatgccattattctgcctg

SEQ ID NO: 195185 - DNA, 257 bp, Homo sapiens
atgtaccaccacgcctagcccttcttgactttctatagtatagtactatactactttttgattacatgactgccatctaacagggacctagtgatttcagctgtttaactacagttgacctttaacaacacatgtttgaactgtgagagttcacttatacagatttccttgccccgctgccacccctgagacagtaagaccaatccctcctgttcctgagcctacttaatgtgaagacgatgaggatgaagaccttt

SEQ ID NO: 195186 - DNA, 488 bp, Homo sapiens
gccatgcttttcacaacccacttcaaacatggaaccaccgaagcaaataatgagcatggaaaagacttccaagttaaatgtagtggagacttcaagactgaatcacactgaaaaattaaaccaggtgagagataagaatttggagatataaatatacgatgtttttaaattcagtggtgttaacactttgatctgatggaaaagttgaccttttaaaaactgaagtcattcacttatttcaaatttgactaagcatttcctatggttctgtagattagtaagaagtgagaagtggagtgaaagaagagtacaattttatcaactccacagtttccactattttctgcaaatgactcccaactcccaaatctgtatctctagttccagttcctcaccaaagttacagaagcatatttgcaatttacctcacaaatatcttctgaatggctgtccctgagcataataatcctggtatttttctgtgactg

SEQ ID NO: 195187 - DNA, 469 bp, Homo sapiens
attttaaatatttgattttgtgtccttagatgttggtttctgaattactcatttagaagaaatggttaccataaatatccaggttttaaaaaattctttaaacatttttgcatttaacttcagaagacaaattttaaaactttagattatgaaaaatttaataatttggatattaatacagaaaataatcctagtgtagccaactatcaggacttaactgagagtaatattttgccacattttacttcagatactatcatcatcatcatcatttgtagaaataagctacagatacaggtgaaatactccatcccaaatctttttctcttccttttatccccagagataaccattatcataaattgtgtctatatatgtatgcagctatactaatatgttgtatggctttttaaaaaaattttatagagatggtatcatacctctaagtactgcagctggatctcacaag

SEQ ID NO: 195188 - DNA, 268 bp, Homo sapiens
catggagcaccactctcccctgtgctgatacacttacaaagaagttcacctactccttggaaagttctggaaaaggggcttctacactgttggcctctcgaggagaacggtttttgtttctgtcttcctggaaaagaggtgactgctggcatcatctttctagataaactccttgctatgatgccattagaagcagtgttcttttgtgttttgcttttgtttttccctgtagacaggaataacattttgactagaaacttccctgatg

SEQ ID NO: 195189 - DNA, 704 bp, Homo sapiens
ccaagccttgggggtgtgaggccctgaagttgaaacttcaagaacttcaagggtaaatagcctgtggtctttgcaagtggctggcgaaggtgtcaaagagatgggactcacccttgactgagcctggaagactgggcagaatttggaaagacaaaataaaaagggccgtgtggcaggatgaacaaagacatttaatattgccagaggcctgcttggggagcccgtgagcaaaccagtccaattggacagaaacgttgcaaagtccaggtggaaagaggaaggctggaaagtcagctgaagtcagttgggggtggtgggggtgggccttgagtgtaggctgacatctgaattctatttcactagttataggagccatggatgtttattttttaaatgcagttcattgacttgaagaaaacaatgtcttaggaagattagcctggttttattgttcaaggcaatgaagcaggaggcacttacaaaagtccaggcttgggtgataagggcctaaacttaggctgttgatgaaacccaggttgtagccgtgcgaatgaaaaggaaatacctaactcagtggattttggtgatttttagagaccaagaagagaaggattccaagatgattgaggtttctgctgagtattagagaataactgtatcattaagagatatgagaaggttaagagggccagatttgaaggaga

SEQ ID NO: 195190 - DNA, 511 bp, Homo sapiens
ctaaagttaggaagttctaggaatagtaatttttccctttaaaaattaccctgcttacacacaaactgtttctcagtctggtctatccatgctttaagtagatattttctccagagctgtgagtttttctacttttggaggccatttcattgagaagcttagaaaaggcaaatatgaaacaatctagggtataagtcaaactaggaaagtatccatgaaattaagggtaaaatgctgtactttgctccacaaatcacatctctatttgatgcacatccaagaaagagtgctgttagtcttcagaggtacttgtactgtttttgttttctaaaattctgttgaacttatcattttgtacattcctgagtatgaaagtgacttacatttttaacaaatgaaaatattgaactataaaagtggaatgaaagaaagagaaattctggattttgctctcttggattccaaagcagggctaggcccggcatggtggctcatgcctataatcccagca

SEQ ID NO: 195191 - DNA, 378 bp, Homo sapiens
atcatgccactgcactccagcctgggcgatagagtgagaccctgtctcttttaaaaaagaaaaatgacaaatgatttctcattgtgatgttagtatgttacgtttgtctgatattttacagtttccaaaatgctttcatatatgttatgtaagttgatcacaggggctaggtagtagttagaaagtttcacctttgtaagaaataggcttggaggccaggcatggtggctgttgctatgttgctcaggctaggagttcaagaccagcctgggcgacatagcaagaccccatctctacaaaaaaatttttttaaaaaattgatcaggcataaatatgattgtgggtgacagggggagaccctgtctccgcccccccccc

SEQ ID NO: 195192 - DNA, 149 bp, Homo sapiens
taccacagggatggagaagaacaaaaatatttcctttcatgatatattttccatagaaaaatcaaaacactactgaaaactcttctcctggatttacgtcaagatcagtcgtcggccaggcgcagtgactcacacctgtaatctgagca

SEQ ID NO: 195193 - DNA, 700 bp, Homo sapiens
gggagatatacctaatgctagatgacgagttagtgggtgcagcgcaccagcatggcacacgtatacatatgtaactaacctgcacattgtgcacatgtaccctaaaacttaaagtataataataataaataaaattaaaaaaaaacccaactttttgaatgtcaatgtgacgccacaagtggaaaattcctcacctgacctcatgtgataggtcacagtcaaaactttgtttcatgtgcagaattattaaaaatattaccttcaggctatgtatacaagggatataataaacacatgaacttcatgtttagacttgagtcccatccccaagatacctcatcatgtacatacaaatattccaaaaaataattaaaaatctgaattctgacacacatccggtctccagcatttcagataagggacactcaacctgtgcaagttgaatgtggagaaactacaggacacgctgttttccatgatctctcctttgctgccatctagtgacagttttgtgtaacgtcaaatagaaaaagtgtcttctaacaatgaagttttgatgtggctatttcctctacttatgcagcgccctcactggactgaagtatttccaactgagcctgggaatttaatttgctggtttgcatcagcagtgacacttaatctcctcaagagcacttactaaactacactctgggtcctg

SEQ ID NO: 195194 - DNA, 389 bp, Homo sapiens
aggaccattcctggctgttctagatggcattccagggtccctaggaagactaagcctcagttgccctcatggtaacctgcttaatgacacatccttataatctacttctttcctgtcttatttcacttaccttccccgattttacaaaattctccaatttgtcttggaatcacctcctaaatcatgcattctcactagggatgctattgcattccagggggcaaaattcgttctgggaggatagagtgaaaaaatcttactctttttatactttatatagcaagcccatataaacacacagtttacaaagacgtacacagtgtatcagtactattaacatttcatgggtgagggcaattggggaaaaacgtctctaaagactcctcaaa

SEQ ID NO: 195195 - DNA, 768 bp, Homo sapiens
attctgttgcccaggctggagtgcagtggcgccatcacagctcacctcagcctcctgagtagctgggactccaagcacatgccaccatgcctggctaattgccttgtatagctttttagccacatgcttaattatatgctcttttatttatttttatttttattttgggggatggagtctcgctccgtcgcccaggctggagtgcagtggtgcaatctcggctcactgcaatctctgcctcctgggtttaagtgattttcctgcttcagcctcctgagtaactgggattataggcatatgccaccacgcccagataatttttgtatttttagtagagacaaggttttgtcatgttggccaggctggtctcaaattcctgacctcaggtgatctgcccacctcagcctcccaaaggataacgccctaggattacaggcatgagccaccacacccagccttttattttgttttaaacaaaataaaacataaggttttcaaacaaaacataaagtcctcaaattaacaaacatacccttaaatctgtgtgcattagccatgttggtagggctcatagtagctgttcacttatttagttgtcttaacaacttttcatcttggtcttttgggctgacatggtgaaaatgctctctagttgctcttgagcttatttttcacttctatcataaatgtcatagaatggagagaaggactggattctcatttaagtcattatatttaccaagagcgactacggggggtcctctagag

SEQ ID NO: 195196 - DNA, 311 bp, Homo sapiens
atcattttcttcttccggaaacaggtcagagaggctcagaaaggtcctcttccaaatgggcacaattcagatctgactccacggctggaatagttcacaagggtcagctaagccagcaaggggcaactagtcacgaacacttattaggtgcaaagagcagtgctggggatgagacttgcagggtatctccagcaagggactgtttcacataattgggaccaaagctcctacaatggagggaatggaggagggtgtgcaggggactatctagtgggggaggaaggcttcccggaagaagaaatgatgtctga

SEQ ID NO: 195197 - DNA, 321 bp, Homo sapiens
gatatattcctaggtattttttttgtgtgtggctattgtaaatgggattatgttcttgatttggctcttaggttgaatgttattggtgtatagaaatgctactgatttttgtacatagatttttgtatcctgaaaccttgctaaaagtgtttatcagttctaatagccttttggcagagtccttagggttttctacatatagaatcacattgttagcaaagagagatcagttgtcttcttcctattgcaatgccttttctcttgcctgctgctctggctagtgcttccagtactgtgttgaataggagtggtgagaggagg

SEQ ID NO: 195198 - DNA, 792 bp, Homo sapiens
tgtcagtacccacttcctccctctaatctcttccctccagttcccacccttgagggtgttagtgagtctcattagtttctagattatccttcatgtttctgtctgcaaaattaaggctatacctatttgttcaactatttccaatctttcttatgctagtagcattttatatatattcttgcacttgagtttttgcagttaacaatacctcttcccagcactttgggaggcccaggtgggtggatcacctgaggtcaggagttcgagaccagcctggccaacatgatgaaacctcatctctactaaaaatacaaaaattagcagggcgtggtggtgggcacctgtaatctcagctactcgggaggctgaggcaggagaattgctggaacctgggaggtggatgttgcagtgagccgagatcgcgccattgcgctccagcctgggccaacaacagcgagactctgtccccctgccaaaaaaaaagtacctcctagaaatcagtctctgttagttcattaaaatgtagtgatggctggaagtgtatgagggatctatgagactttttcaggatggaggtgttactatagtttgcatgctgatgaaactaatctgatcctattgaagagggagaggtgtcatcacgtttcagaaagaagcctcgaagtaggccttcaagaggggctgagacgctggacagaaatggagggttttggttttggttagtgaaaggacacttcactttgaggaaaagtgacatctgatttattagagccttgaattctaatagaaatc

SEQ ID NO: 195199 - DNA, 636 bp, Homo sapiens
agtcacaccgctgggtaggggagagtgtgaagagaccgaggctcagagagccatggggcttacctgcagacatgtagcccaaggggtgtgagtggcacaggaggcctcgtcttccgctgcgatggttgcattatcttgtgttccatgcctgtgctgggtcagagcttctagagtcccatcccaggggacgcttcacttagctcctcacctctgtgagtcaccatcatcacagttgggatgtcaagtttagtgcttcagaatgtacatgcccttggccgggagagagatgaagctggtatcagtcatccacaccttagtctgaatttacatcccgtgagggcagagatcagagggagctagggatcagcgggctattggaaaggaaggaatagtctagctccagtcagagtaggcggggcagggggaatcagagcagtggctccaaagtcacccttcccagctgtccgccactctgggcctaagtgcagatggaaggcagggaatgaaggaacttggcttgcttggtgaccagacaaggtcccaccctcacattccggggcgaggatgcttttagagaatggccctgacctgaccactgtgcactgctggtcaaatgctggttgtagctactgcagc

SEQ ID NO: 195200 - DNA, 313 bp, Homo sapiens
agtatgcattgtacctggcagaaagaatgttttctggttttcagctaagattctggtttctacacgtttttcttcaccagcaacgttagtgtcattatcttaggcttcccctttaaaactttaaaaattgatccctaaatttattttctcattcttcacataattcagaaccaaggaaatactaattaattgtgatattcttgttttcttctctagtagcttaaaagtacatgaaatcaatgtgaattttcaacatgacttttatccctggtacaggccagttgaaatgactaacaattactttttcaaatta

SEQ ID NO: 195201 - DNA, 248 bp, Homo sapiens
gcagtgagagatagagttggagcaaggcagaggcagagaaagcaatggggacaggctgggaagttccagctctgctctctacagtggaagtactctctgtcctcaaagtcccttttatttcagaagatgcacccggggacaagcagtttaagaatgtgtgtgttactaggcagagaagctggcatcgcctgagggctgtgccttgagttcttgaagacattttctttaaagggagtcaccagcaccac

SEQ ID NO: 195202 - DNA, 375 bp, Homo sapiens
acacctaacgctggatacacttgcaaatgaaattcagaaatgaactcaagattcatttcagtctactttggattcacttcatccaattctaattctcatccggtcagaaggcccgaatttactccaatctggagaaattagattacattctgttgatactgagcctaagaacccagtaaagttttaaatgtataatattatccattatagaatcctatctggaagcaaaatctcgaagaccaaattcaatgaagttaactgggattattaatgagaaggctagactaattcaccctgaccttggggtgctaggtagggggctataggaaatcctgcaacgaccaacattccagatgtcaaatactttgttttcat

SEQ ID NO: 195203 - DNA, 408 bp, Homo sapiens
ccggacaggtttttcaacataccaaaacgttatatttttttattcacccttttgtctctctccacatccaccaccatcacaagcagcagcagcaggagcatcctcaaacgaagaaaacccctccaaagtgccccgaatgtgtgctgctgctggctctgaagccgtgtagaatttcgtaatggaatgtgaactgctcgtccggatctgggctcacgttctatctcctaaccagtaaggagcgagggagggcaaatctgctgagcaaggagaaatactttcctcctcttttataacccatcacggatgcacggcggccgaggggcgcgagctgcacgcggcgcctgtcaagcggcccgggcccgcaccccgtggggtccccgcgtcccccagctccccgccccgcccgga

SEQ ID NO: 195204 - DNA, 371 bp, Homo sapiens
ctctagaacaggatccacaaactacagcccatgggccaaatctggcccacagcctgtttttgtaaataaagttttattggagcacagctacaccattcaattacatgcactctgtggctgccttcatgctacagtggcagaactgaagagctgagatagaaaccacatgggccacaaacctgaaaatatttactctctggcctcttgcagaaaaagtttgctgaccccagttccagagctctcagcatcatctgactctgttgaccactccacccttccggaaacacctcttcccgtggcttccacatcatgctctcctgctttcctcctcactctctggtttgctctgactcctctgatcatctgagccg

SEQ ID NO: 195205 - DNA, 458 bp, Homo sapiens
tactctacacttacatggtttggggtaggcagtgaaataccataggtagaaaaggtaattcagtgaagcatccaaatagacagaaacaacacaaatatttttgctggagtcaggagcactatgtggcacagaacacctcccagaaagcagaaaatttttctgcctgaaaaccaatgtatatgtaagaccccaagtaaaaaacaaaagcaaatgagccccaaactgtcttccctcagctttgcctgggagctgctatctttgcacttatttttctagcatcaggatattagccacatgagggagccaagcatatttgtctcattttaggcatcattcttttgtggttccccccaccccaggtattgttgagtctgtccaaagctgggtgagataccacacaagtcttgcttccctcagtgtgctgcttctctcggccttggtggaggctgagcctgttg

SEQ ID NO: 195206 - DNA, 913 bp, Homo sapiens
tattagcattaacatctgaacatgtcccatggcctcaggcaaacaaagacactcttaactggcaggatattccaggggtttagaggttgtctcccaaggaggcaggccagggtacctttccttgaaatgttcagggtttggatcatccagttctgctgagttaatccctttactttatactaccttctgtctaaagacctcttgcaaatcaagaaatcactattgtcaagaaaaacacaatagtggaaaaatggacagatgacacgaaagggtaatttatttaaaaaataaagctaaaatataaatacttctgtcccatatatctaagaagtgcatgttaaagcaatgattaaatatgtttatgtatttcaaaagaacaaagcctgacattggttaatggtctcatgtattggtgatgaatatataaattgatacaaccttcctggacagtgttttgccttttctttgaccctgcaattacacttttcctaaggaactaatcaggcaaaatcattcaaaaactgtatgtctaacagtgtttgctgttgtctataaaagcaagcaagcaagaaagaaaacaacctaaaggtctattaataatgaaataagttttggttattgcatgcaaaggaatatattatgaatctattaagaaaatgaatgttttgacttttgttttctgtcatgaagtgagatctacaatattgtcaattaaaatgtagatttctgaaaagaaaattatacatttaataatatgtgcatgtgtatgcctgtgtgtgtatacatggaaaaagcctgaaaggataaatcccaaaaataaggtaactagttatctccaggtgatattataagtgattttcattttttatatatttactaaaatttgtgttttaatatttgccaaaaagtaaaa

SEQ ID NO: 195207 - DNA, 144 bp, Homo sapiens
tgttctcctggaggctcccgaaaccctatttcctatggggtacactttaaggagaagggtagcttggcagagccagccgtacgaggagaactccacgtaacaaagttcctgctgccccgacactgcccaggaggcaacggggtc

SEQ ID NO: 195208 - DNA, 138 bp, Homo sapiens
ttgctccagattgtttaccctccattctcctaaagaagataaggcacagccagggatatctgttgtcctgataccatacccattcctttcagaatgagcatataattattcaaacatggagaaaggctgcccaagggc

SEQ ID NO: 195209 - DNA, 372 bp, Homo sapiens
cacttctgagtctcagtttccacatctgtaaaatggaggggataatcaactacctaagaagcctgctcagaggtttaatgagaacatgcatgaaaggtcttccaattccaaggtattctgtcatgtcccgcggtcctcgtactgacatcagaataaccagaggaacttttagaaaacataacctgccacatgccacatctacagagtcagggtggggggcaggggtggagacacatcctttttcttccagctcttcttttctgctatttccacacatggtcctgatgctttattaacttaagacctgccagcttctgatagctgaaaagaagaaaatgcagcaagaaaaatagagatcctggaggctcatgg

SEQ ID NO: 195210 - DNA, 894 bp, Homo sapiens
tctgttttctggttttggctgtgccataaacgattatttatgaaaactgcaatagtcatcatttaaagttatggaactgtgtccggaattggtgggttcttggtctcactgacttcaagaatgaagccgcggacccttgcggtaagtcagggatttcttcttggtttggatccactgctggtgagcagacagagtcttgccctgttgcccaggctggagtatagtagtgcagtggtgtgatcatagctcactgtaacttcgaccacctgggctcaaacaatccttcttcctctgcctcccaagtagctgggactacagaacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtggttcaagaatcgccgggccaaacgctctcgggagcggtggttccagaagcagctccagcagctccagaagcatcctcagcagcagcatcctcagcagcagcatccccagcagcagctccagcagcagcagccccagcagcagccccagcagcagcagccccagcagcagccacagcagcagcagccccagcagcagcagctccaccagcagccccagtagcagctctagcagcagcagcagcagccccagcagcagcaactccagtagcagctccagcagcagcagccccagcagtagctccagcagcagcagcagcagccccagtagcagctccagcagccccagtagcagctccag

SEQ ID NO: 195211 - DNA, 973 bp, Homo sapiens
gcctccctgcctgtcgagtctgcacacgggtttcacgccctcccctgtgttctggccaggagactttgcgttcggttggaattgttacagagttcagctggaggtttccttctccctgtggccttttcccagttcctctggcagccctcctcaaggacccctgtgagataagtcagaggtgactttcctggggacccagagaacccacaaggcttttcccactgcttactgtattttgctcggctctctaaattgaatcaattgcagacagagtcttgccctgttgcccaggctggagtatagtagtgcagtggtgtgatcatagctcactgtaacttcgaccacctgggctcaaacaatccttcttcctctgcctcccaagtagctgggactacagaacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtggttcaagaatcgccgggccaaacgctctcgggagcggtggttccagaagcagctccagcagctccagaagcatcctcagcagcagcatcctcagcagcagcatccccagcagcagctccagcagcagcagccccagcagcagccccagcagcagcagccccagcagcagccacagcagcagcagccccagcagcagcagctccaccagcagccccagtagcagctctagcagcagcagcagcagccccagcagcagcaactccagtagcagctccagcagcagcagccccagcagtagctccagcagcagcagcagcagccccagtagcagctccagcagccccagtagcagctccag

SEQ ID NO: 195212 - DNA, 1020 bp, Homo sapiens
gcctccctgcctgtcgagtctgcacacgggtttcacgccctcccctgtgttctggccaggagactttgcgttcggttggaattgttacagagttcagctggaggtttccttctccctgtggccttttcccagttcctctggcagccctcctcaaggacccctgtgagataagtcagaggtgactttcctggggacccagagaacccacaaggcttttcccactgcttactgtattttgctcggctctctaaattgaatcaattgcaggtaagtcagggatttcttcttggtttggatccactgctggtgagcagacagagtcttgccctgttgcccaggctggagtatagtagtgcagtggtgtgatcatagctcactgtaacttcgaccacctgggctcaaacaatccttcttcctctgcctcccaagtagctgggactacagaacagagcaggacccaggatgcaagaccctaggcatccccaaggccttccactgtccccaggccttccaaagagacagcggcaggaccgcacaatctacaactggaaacagcaggaagtgctagaaaatcactttaaggaggaacagtacccagactatgacacacgacaagagctggcggagatgctcaatctcagggagtaccaagtgcaggtgtggttcaagaatcgccgggccaaacgctctcgggagcggtggttccagaagcagctccagcagctccagaagcatcctcagcagcagcatcctcagcagcagcatccccagcagcagctccagcagcagcagccccagcagcagccccagcagcagcagccccagcagcagccacagcagcagcagccccagcagcagcagctccaccagcagccccagtagcagctctagcagcagcagcagcagccccagcagcagcaactccagtagcagctccagcagcagcagccccagcagtagctccagcagcagcagcagcagccccagtagcagctccagcagccccagtagcagctccag

SEQ ID NO: 195213 - DNA, 513 bp, Homo sapiens
cactggttttactgaaaaattgagtgggctcagtttctgcagcgctttcttccactgcaagatgaacaccattctgccttgccaagaccagtactttgtaggaggccagagctataattgcccgtattccactacaacgtcagaatctagtgttgacgtttccacggagacttgggtctctttctgggctgctggtctcctggacaacagagagctccaacaagcaccacaggcacaggtatcaacaatataaccagagaaggacaagagtctaaactgtactagatgaagaaaagaaagtaaaagtagacctgaatcattcagtgactcaaattttcctcttccggacttgtgctcatgggaagaggctcagctttcctctcagctctacagaaataagcagctgcaagataccctggtgcagaaggaagaagaactcgccaggttacacgaagagaataatcacctcagacaatacctgaattctgctttggttaaatgtcttgaagaaaa

SEQ ID NO: 195214 - DNA, 255 bp, Homo sapiens
aatgaagcctgtcaaattgtgagccagagaacctccagtcatccaggatgcaaacctcagccatcctctacttctccaaaatcctcatctctcattccagtcagacactgcagtgttccaaatgaagctaaactacatgcagaactgacataggacctgataaagtggtaggacttgagaaaaatctagtgaaaggctggaataaaagatcagagcaatgaacaattgtaaaataaatttaaatatctttataat

SEQ ID NO: 195215 - DNA, 431 bp, Homo sapiens
cctcctgaagaatccctaggccagaggaagatatggacttgtaaacaggtaaattgtaggacaaagtgggttaaatgctgtccattctgacttcctctagcaccttttacatctcttatgatagttatcacactgtcttctggtcatatgcatatattggtcacttttccactccacacacactcaggtgtaagctccatgaggctgggccacttggctagctggtaaccccgccctggcccacagtcagtgggccataatctgcaaattatctgcaaaagaaggagcaagatcattgtttcattctctcttgtttatcatgctggtttcttcccctttatcctcctcttaaaatacccactgctttcctctgttgccttttaacacatattctgtattttctgtgctcaatccccccaccccacacttcc

SEQ ID NO: 195216 - DNA, 534 bp, Homo sapiens
ggttcaagtgattctcctgcctcagcctctcgagtagctgggactacaggcacgcaccaccacaccccggtaatttttgtattttttaatggagatggggtttcaccatattggccaggctggtctcaaactcctgacctcgtgatccacccgcttcaacctcccaaagtgctgggattgcaggtgtgagccaccttgcccagccctcaacttgccatttcttacagggatgccagtcatactggattggagtccactttgatgacctcattttaatttctttacctctttgaagatcttatctccaaatatagtcacattctgataaatgggatgaggacttgcagataggaattttgtaagaaacataattcaggcccataacatgtccctggaggggaaaagcaaaatgtaggtcatggttcctggtatcccccccccactgtgtttagaggaagttcaaaactcatgacacattactggtatgagacagtactataattttatttcccagtaaaaattttaaccctaaat

SEQ ID NO: 195217 - DNA, 189 bp, Homo sapiens
agcctttctactatgctaccagttggcatagaacatgatttcattgaatctccctcattaaggtatttaagtagtctaaagtcactagaacaactgatgttctgttcagacactttaacattaatatagattcgtggagatagaggactattctggaaactgaagagcctatatttccctctgatcata

SEQ ID NO: 195218 - DNA, 359 bp, Homo sapiens
gtgagcatccttcttcctcggctgctgggaggcgagaacagcctacttcagtcagggtcactctgggttgagcccaggtgccaggtgtgaagccccaccagcacccgccattctggagtgtgctgagaggagtgtggtgcccactcaggggtgctttcaactaacactgtcctgccttcagtgggacaaggccttatggagaacataccttttaagtctggaatccagatggtagggtttgggtggcaaaggtccagaggcatgaatctgcagtgtgaaagggtgggtggtatagcctcttgttggggaggcatgaacagacatcaccccaactctcctttacacagtgtccctggggg

SEQ ID NO: 195219 - DNA, 195 bp, Homo sapiens
taaccaggttgagaaactgagtcctagagtctcttagtgaccggctgccacatcccacttaccatgcctttgtttgtatggtaatttagtttccagtgaccaaagatgcacaaaccgaatacattttcataatgtggcgatctaaggtgtcactggaattttctgtcattctgtcaattcatcatcattggcatg

SEQ ID NO: 195220 - DNA, 414 bp, Homo sapiens
taagaaagattcttctgccttgggatgctgttgatctatgaccttgcccccagccctatgctctctgaaacatgtgctgtgtccactcagggttaaatggattaagggcggtgcaagatgtgctttgttaaacagatgcttgaaggcagcatgctcgttaagagtcatcaccactccctaatctcaagtatccagggacacaaacactgcggaaggccgcagggtcctctgcctaggaaaaccagagacctttgttcacttgtttatctgctgaccttccctccactattgtcctatgaccctgccaaatccccctctgccagaaacacccaagaatgatcaactaaaaaaaaaaaactcagcccaaaatttgaccaggtttcatcacataaattaaataaaagaaagaaaaca

SEQ ID NO: 195221 - DNA, 523 bp, Homo sapiens
aactacaaatttttaaacttttattttctccctatacagaagagatcatttttccgacttcactgcctgacttcctgaggctgcccagagtttgttgcaggctctgggctcagggtatgttcaattttcctgcttggaactgagagaagaactcaggtcttcttacagactgccaaagtccggcagggctcttttagaacagtcatttcacagctagagaaacggagacccaggccgggcgcagtggctcatgcctgtaatcccagcactttgggaggctgaggtgggtgaatcacgaggtcaggagatcgagaccatcttggctaatgcggtgaaaccccgtctctactaaaaatacaaaaaataagccgggcgtggtggtgggcgcctgtagtcccagctactcgggaggctgaggcagtagaatggcgtgaactcagaaggtggggcttgcagtgagccgagatcacgccactgccctccagcctgggcgacagagtgagactctgcctcaaaaaaaaaa

SEQ ID NO: 195222 - DNA, 325 bp, Homo sapiens
gggagattatgttggaagaataattctcttaggccacacataaatatactaacactaacggtagctgatgagctaaaaaaaaaaaaaattgcaaaaaagtctcataatgttttaggaaagtttatgaatttgtgttgggccacattcaaagctgtcctgggccacaggcagcccacaagccatgggttggacaagcttgatttaaatcatctttagattacttataatacctagtaacaatgtaaatgctatgtaaatatttcttatactgttttatttagggaataatcataagaaaaaaatatgtttggtacaaatgcaattt

SEQ ID NO: 195223 - DNA, 371 bp, Homo sapiens
atatccggcccggccggaagttttaaaagtaaaacatttctaaattaattatgtaatagtgttaaggaatgaatacttggtagtcgtaaacattttggtaaaaaataaaaactttacaatatgtactaatcctgatatatgcattaggcagtcatgttattgcataatgcaacagttctaatagtactgaatgtgcttatatgttacatgaacaaacaagcactagcctaaaatttcaaaatatcaacataaagctacagtcttactaatcaataacatttttatcctttctaactctgaggaggaaaaaaaggaaagaaaaaattttaattaaaaaataaaatggcattttaaaagtttcatttctatac

SEQ ID NO: 195224 - DNA, 211 bp, Homo sapiens
tcccccgtccttctcaagttaaacaagagccatgaaagcaatagctctggcgcttaaagagaggcttggtgcagggatctcaaaagccaaacattggagggctcccctgacccccactggtatcggggtagggatttgcctgacccttttactaccccatttcttcttgtgtgcactggggaatcctgtttttccatactctttcttgtct

SEQ ID NO: 195225 - DNA, 444 bp, Homo sapiens
tagatctgagtcaccatctattgcaggcataacagaggctgcagcttgagtctaaccatgttaaatgcctgcttacaaaggaaaatattcaacatactttggatcaagataacagaaaccagaatcttacaacacagcattcaaaatgttgaacatataatctaaaattaatcctctaaaaaaaggctaagaaaatctgattcattctcaaagaaaaagacaatcaacagatgctatatagtgttctgtgtgtgtgtgtgtgtgtgtgtgtatacacacatatatataggtatatattctttcctctagcaatatagtgtacacacacacagagagagagagagagcgtgagtgcgagagcactagaaagaattactggtggcaagttgaggaatggcgttgcaagggtccattcccaggaagcataagatagaaaagaaaagt

SEQ ID NO: 195226 - DNA, 347 bp, Homo sapiens
ctcttgtatatacatcattgcatctcagcacagagacccatcatgtagggttacttatgggttattctagcccctgtgagaagaaactataggcagcaaagccatactgccctctgaccctctctcccctttccaattcttacacacagctgccttagttgcatagtgttatagtaaagtctgtatttattacattaagcctcttggtcaatgtttccttttgtgttttctataatacctgaagtgagtacatggtgtatagttagggctcaaatgtttgagttgataggaatgccaactttagtagataatgtatatgttagtaacatgttaatgtattattatat

SEQ ID NO: 195227 - DNA, 568 bp, Homo sapiens
  misc_feature (20)..(20): n is a, c, g, or t
ctctagagtatccccacctnctaccccacggtagtttagttttggacattttaggtttgagatgtctagtagaagtgaaagaatcatactggtggttggatattcaagtctggagctcaggagaaagttttgagctggagatacgccttcttaggtggagatatacacgtaatattgagaaccatgggcagtgaaagagaccacttagggagtgaatggagacagaaagtcaaagactgcgccctgggggtaatccaacagtaagaagcagtgaaaagaagaactagtaaaggaggccctgaggccagggaagagccaagaggatgtgtgctcacctaagagaatgtattaaggaaggtgtggcccactgttgtaaatattcttgagaggcaagtgcaatgagtgagaattgatcactgaatgtagcaacatgaaggtcattaatgatttttggggagcagttttggagttgccatgggggagaaagtttggaagagaatagtgatggggtggaaaggaaaaagctattcactaaagtgaggaacagcgggggaaagcagataggggc

SEQ ID NO: 195228 - DNA, 156 bp, Homo sapiens
catttgttttgtggggcgctgggcgctgctgattcatttctggcttctcgcagagcttgctggtggttcctatgcactcccctctgcggttcctcaggagcctctctggctgggatctgggactcctggggcctgagctgctgtctcatatgtcct

SEQ ID NO: 195229 - DNA, 515 bp, Homo sapiens
actgcctattctgatcttcaaagtctgtcttcttctattttcatcatcactactgttatttaagctattattaactttagatcaggttagtataaaagcctcctttctcctagattcctcctactacaatagctgtgtttctgaacctctttgtccactgtgtactctgggagcttttatatatacagatgtctgtgttccacaaagttccaaagattatactgatgtggaaccaaggctaagaaccgctatgttagtgggtttattttccattaaacaatcaaggaatctgcaacaatgcttttggtttctagtgtatcttttcaactgcaaaaagcccctaaaacgataccttgtcacaaagaacactaataataacaaaatcaaatagctaaacactaatgtacattgtatacctacatgcccttcattgaactgactatataaatggtccctttatcttttactattactgattactgaactcttttcattatttttcttctgttgggaat

SEQ ID NO: 195230 - DNA, 315 bp, Homo sapiens
gggtactatggtttgcctttaggcagcatgtgaaggtgtgaagatctcttttaggagatcttgtcagagtacctcaatggccaatcagaaaacaggtattaagggtgaagaagccactttttggaaagttagatcatgcagagaaacttaatttacactttaatagccgtttctcactattgggatcattaaaagttagactgtttccttaaatactatttaacttcactacacactgttgtgaccacgggctatttaagacattcagggtactaacctatagatctgttctcacctaatttgctcgagcatcaa

SEQ ID NO: 195231 - DNA, 286 bp, Homo sapiens
tgcccaacacctcaggaagcagcatttgaatcgaggctgggtcccagacctggactaagactgcagcaaaagtcaggaagtggggacgtgtggggataaatacgatgttatctcccaacacagtagctgacttcccagggtgcgtaacccaggagcaggagaagagagcgcacccaagatggaagccaccatgtttttaacaacttggccttggaggtgacacatgattgcttctgctatattctgtagtcacagtcaaccttggttcagtgttgagggaaacaca

SEQ ID NO: 195232 - DNA, 104 bp, Homo sapiens
tgagaagagggccaccgtccttccgaccccagaatgatagctccactgacagcttgtactgtacacctggaaaagctgcagacattcaatgccagcctgtgaaa

SEQ ID NO: 195233 - DNA, 194 bp, Homo sapiens
cggtaccattctgggcgggtcagacatgtgaatgaagaagctcgtgagatgactgcagttccagctaccatcggactgcaacatcacgggacaccccgcatgcccccccgcatggtgggtcatcctggcatggattctgcataatggtgatcacacgttccacctcatcctcagtgagttctcccgccctcttg

SEQ ID NO: 195234 - DNA, 316 bp, Homo sapiens
agaaggatggagaagtggaggggacagaagggaagaaaaggcactgatagggtctggctgcatttctacccaaatctcatcttgaattgaagctcccatcattctcacatgttgtgggagggaccatccctgggggagatcattggatcataggggtggtttccccatactgttctcatgatagtgaacaagtctcacaagatctgatggttgtataaggggtttccctttcatgtggctcccattctctcttgtctgctgccctgtaagacgtgcctttcaccttccaccgtgattgtgaggcctctccagccac

SEQ ID NO: 195235 - DNA, 635 bp, Homo sapiens
aaaaacagcaactaggattgatacaagaaaatatgaagatctctttttttcctgcatacagttggttggggatagttatattctgcaaataagaactgagtaaagacttctgcaaaacttttagaaaatctttcttcacttataggaaggagacagtggtcaagatggccacttctgtctaaaaatgtattgatacgtgaaagtgtcgcagctgttgtgcctgaggatagacccctactgaacagggcagagttaagagaaccacagaacagtggactcagagccctaaagtccagcacttggatcctgcactgctatgtacctcttagttatgttaaatgacatattttcataagatttaaagcacattaagcctggactttctgtagcccaaagcatcctagttgttactctcctctcacctccctagttttcgttagtcttataaataacatcttcatcatctacatgatcattcgagtcccgaatctaaaagttgtccttgaaatctccttccttgcctattcctcagatacctcccctgcaccccatccatcttaggtctagctccgtcttccaaatattctttaatgtatcctcttctctatatttctgcaaacacactgtagtccagg

SEQ ID NO: 195236 - DNA, 490 bp, Homo sapiens
tgcggggattacaggtgtgaaacagtgcacctggccataacatgtatttttgcaaggtcactcaccctggcttctgtgaaagaagcctgagaagggtctgtttggggagaccagttagcctttcataataatctagttaagctgtgatgaacactgacctgaagtagtagttagtgagaatggaattgagttttaagagagattcaggatgtagaattgtgggagtacaggcctaggatgtcttgaatgatcataaggtgtctgatttgatatgttatcatagtttgtggtgccatttacttagcagaaataaaaaatgtttcataacattctgagtttgagacacttacagaacatttcaagtagagatgtcccacagtcatttgaatataaggatctggaacttatattagcagttggagattcaggtttggtaaacttcagcagttgaaatcatagttgtggatgaggtcaccaaatgagtaaggac

SEQ ID NO: 195237 - DNA, 305 bp, Homo sapiens
ttaaacttttcttccttccactctaatccaaaagtaccttctaagaaatccaaagtgtattaatctctgctttctatacgtaacagtatcttattatttaaactatagcatttatcacagctctattagattgtaaatgtattatattaagagtggggactggccttggtcatttaactatggttctcagctaggtgagattttgcccttccttggggcatttgacaatgccaagagacattgctggttgtcacaaccaagaggatgctcttggcaactagagggtagaggccagaaaagctact

SEQ ID NO: 195238 - DNA, 496 bp, Homo sapiens
tttgtgacatgtacaattgctgatgacattcacatctgggagcaactttaacttccttaaatttccataaacaaaaatactaaaggtttgcatttaggggaaaaaatgcccatcacaaggaaaaactcatctatctcacatagggtgtaccttctatacaatgaccaacactgaaaagtcatctctacctcacacactaaagtaatgattctcaaaagcaggacaatttcaccccgccggacatatttggcaatgtctggagacatttatatttgtcatgactgggggtgctattggcacctggagcatagaggccaacaatactgctaaacatcttaaaacgagggccaggtgggccggctcacacctgtaatcccaacactttgggaggccgaggagggggtcaggagattgcgaccatcctggctaacacggtgaaaccccgtctctactaaaaatacaaaaaattagccaggcgtggtggtgggcacctgta

SEQ ID NO: 195239 - DNA, 474 bp, Homo sapiens
atatatgggttctggaatcataaactgagcttgtatcccacatgtcacttactagctctgtaactgaccatgaccaagttacttctctgagcctttgtttcttcatctgtcatgtgaggataacaatagtgcccatcttgtagggtggttgtgagacttaaatgagatgatggagctgggcatggtgcttcacgcctataatcccagcactttgggaggccgaggcaggagattgcttgagctcaggagttcaagaccggcctgaccatcatggcgaaaccccgtctctactaagaatacaaaaatcagccagacgtggtggcatacgcctgtaatcccagctactcaggaggctgaggcaggagaatcgcttgaacctgggaggcggaggttgcagtgagctgagattgtgccagcctgggtgacagcgagattctggtttgttttctttttttttaaaaaaaaaaaaaaaga

SEQ ID NO: 195240 - DNA, 283 bp, Homo sapiens
actctgaaacaagagaaaggaaaatattagcctacgacaagggaaatcgattgttgcatctgagtgtgacctttgggtttttgctctctacaggtttaagagtccagtatccaaatgcacacttaaacatgcctgattcatactaacactcttacatgggcagatttgactacatatatactgtttaatctcttttaactatggtatgtgactttatgtttttctcctttcatcctacgtacggttattgaaatcaagcctacatggtttagtcgaggcccct

SEQ ID NO: 195241 - DNA, 801 bp, Homo sapiens
cattacttattactgacagtatcttcaatgcaatcatcctaagacaggtcccatagaaacccaccaagcaaccaactgaggatggaaaatgttcagaaaatcatctgctttagtactgaacatgaacaaacttttttccttgacattattccctaaacaatacaacaactatttacatggcatttacattgtatgaggtattataagtaatctagagatgatttaaagtatacaggaggatgtacttagatgatatgcaaatactgcatcactgtatatcagagacttgagcatctgcacattttggaatcctggtgggaggggtggcctagaaccaattcccctcagatactgaaggatgactgtataataaaacacaaaactaccgacctaagactagctgtgtaggcctatctcacagcctgagatggggactttcagagactgtttctcttctctcagagaccataacaaactatgtaaaataaaggtttacaaatactgtactagtaattagtgaaagcaggaattcgccttgttgcttccctgtcacctcaaaatagaactcaaatttcctgaatctcttttctgcttagttgaaaagtgagggcatggccttcaagtttttagtgatccccctatcaaaagtaaaaagggttagggtgtgaaacatagattagcaaccttaaaatacttgcacatcttgtcaaaatatcacaaaactaactttggaaacaaggcacattcagaaacagaggtgcatttaaacattacattagagaataaagttactcaaatttt

SEQ ID NO: 195242 - DNA, 423 bp, Homo sapiens
ctgatggcctgccaagagatctcagtcacttcaccgcctcagtctcctcactgtaaagggggtgctgatactgcctgccttatggcatcatcatgagactgaaatgagtgaatgcttgggaagtggtagggcctggctcctgtgagtgctggagggcatcggctgctgttactggtggtgttatcgttgccctgtgttaacagctcccatgatcaggcctccccctggacctcaccctgcagtcacagactgactcagggtctcacatctgcctcaaagcctttgcatgtcctgtttcctcccctggaaaactcctattcatcatttaaggcccaggccaaatgtcccatcctctatgcagtgccctggctaggttaagagcctcctctctacctattcacaccatgtgcttccctttcatag

SEQ ID NO: 195243 - DNA, 595 bp, Homo sapiens
gtgacctctagaggattccgatagtcctcaacggtccgcctggtcctctggccccaggaccctgcttgtatcaaaatgcccacggtatttacattctgtgctacaaagaagaggtcgttatatcatacctttttgtagttactgttacaggtgtcacctgtgtctgtcctctaagagacagcagcagccagaagggccaggcattgagattctggccacccacattcgagtctcagccctgcttccacttagctatacaaccctgggcatggaatttcacctcatctttaagtgaaggggttgaaaaacatgatttccaagtccctccccggctctgacattctctgatagaagcctccaagatccatcagcctctccatggtggctggcaggccccagcgtgcaacatcccaaggttaccgacacggcggatgaacaggtcctggtcaataagcaatggattattcctatcgaacttcggctttgtgccctctgtgcctcagttctttcataggcagccttttaggcttaactttaaaaaattatgattattaatcttcattttcctctggcgcagagcaaggtgactgatgcc

SEQ ID NO: 195244 - DNA, 241 bp, Homo sapiens
cagcaaagcaactggcacatgtatacctatgtaacaaacctgcactttatgcacatgtaccctagaacttaaagtatagtaattaaaaaaaagaaaaagaaaaaggtgtttaaaagatgtataggccgtatattttgtaccagtgtaatcattcactgtgttgtttaagcaaataagctagtttaagcttataatgagtttttaatttatagagaaacgaatcagtagggcaaagaaaggt

SEQ ID NO: 195245 - DNA, 101 bp, Homo sapiens
taaacactagacatgtaaggtcagcaggctctctgtctacacacagaatgctagtctagctgtgtagaagataagctccgtaatgtttgcacatctttccc

SEQ ID NO: 195246 - DNA, 566 bp, Homo sapiens
aggagttcgaaacgagcctggccaacatggggaaaccccgtctctagtaaaaatacaaaaattagtcaggtgtggtggtacaagcctgtaggcccagctacttggaagactgaggcaggagaatcactttaagcgggaggcagaggttgcagtgagccaatctcaaaaaagaaagaaaaaaaaaaagaaaaacatatgatgctggagcatctcggcctcaatacctgcatgagcacagtcatgtccaggccagggctgctggtcgaggtccggccccatctcttccagcagaaagggagtaagcttgcagggaggctgggggacaagatcccaggatctcagcctccgctcatggatcagctctgagaccccgagtgagctgggggtgctctgtgtgcactggtttccccagctgtcaagtaaagggattggatgaggaagtcttgtcaaggtggaatgatctcagatttggggcagcagtgaatgatcccgctccctgggccatgccagtggcccggcctcggctgaacacagccccaacactctggaatggggatgagggggca

SEQ ID NO: 195247 - DNA, 413 bp, Homo sapiens
  misc_feature (3)..(3): n is a, c, g, or t
ggnccgctctagagtatcccctcgtcttttgataggaaaggagagagagagagagagagagagtctggtgtctcttaatataaggtcattaatcctaacatgaagagcttcaatgttatgatctcatttaaactttatcacctcctcatgggccccatctccaaatgcagtcacaatgggggttaaggttgaatcataccaatttgaggggtaggggttgatacaatgcaatccatagcatgaggcaactgctgcatccacaagtcaggctgcaagactaatctttcctgttgaaatttcctcttaggccccacaaactaatgggtcttgtatcatcaattaggtcatagttttccaaactgtcagttatcatatgcctgttgacctatcaaaagacgagggtaccgagctcg

SEQ ID NO: 195248 - DNA, 115 bp, Homo sapiens
gaagaggggtggtgtcacctgtggatgctgaggaaaggctggtgacaggaagaggggtgacgtgacctgtggatgctgaggaagtgtcagtgacaggaagaggggtggcgtgacc

SEQ ID NO: 195249 - DNA, 324 bp, Homo sapiens
atttttcaggcaggacgacagcagccttttgtttttaaatgcttttggggggcgggcaacaggaagcttagagccaaacagagcagcctttaatctaggaccaattttcctccatattgagatagtgtccttttaagtcctctacttgttgcttcctgtattatgaagttttgccagtggctggtaggactacaaatgattactgtccttgggtgagttccagggattgtttgtgtctgctccttttgagtggttcttttcctggcctcaagtagtgtttgcaaacatatgcaccaatctcttcaactaagactcaaggaggtc

SEQ ID NO: 195250 - DNA, 573 bp, Homo sapiens
agccaaacacagaggtcctgacagcagtggcaatctcactccattgtgcaacaggcgcctttctctccacaacaacgcaaatctcaatcactctggacaaatgcagatggtgaaagtgacaagctgagctgttaacagctttccagggtctttgcatgggacagcaacccattttcacttccctttatataggcacccacttcccttttatttcttaattctgtgctttctgctctgcttcttacaagagatgatgaacacaaagtccttatttcacgagggaaggatgtgaactcttgtgtgccacaagacccctttccaggatgcgggctggtggaagaacagctgcgagcagatgtcatctctagaccttggtctgctgtgctgcttaggcagacctgagttccagtgcacccctctgccccttttccaagctaatctttgggttaaaaaaaacagaaaagggtgctcctcatatcctctctctccaaacctgcagagcacttatgagaaagcacgctccaccccggctctgtagaacgttgttatgtgccaaaaagagtgtgcggccag

SEQ ID NO: 195251 - DNA, 536 bp, Homo sapiens
aaaattttaaaaacatatacaaatctactttcattcacgaatctgaggtttttcctctgtagcccgtatattctttttgttgattgcaatgactacttctatagtcattccaatagaactgaaatctaaaaagtctgaaaattaacattatttcattagaatgcagaaaaatagaaatttaactaacttgtatgaattatctcttcacaaagcagtcatatcctattctcctgtgaagcgcagtatgccctaggtttcctgttcattcagaaaactggaattacctatcatctctcatttctttgttactttttatttggtagtattacttacattgattgactcagcaatctctcttacacagttcttcaaaaaagatgatttatcaatgaataagatgttttagaaatattaactttttgatgtcagtcaactatatgtccaacccttttacatttcagtatgctatgacagtgtattgggtgtgttttgcgtgtgtataagctttaggaagataagcttaaaaaacttttatt

SEQ ID NO: 195252 - DNA, 1338 bp, Homo sapiens
aatggaatcctagtaactttcagagatgatctggtattaatgattgtcagtcatctttcaaaaagagaactattaatataagtgattaattattgcaattactttttattgagccctactgatgggctgtgttaagtactaacaggcatcatctcacctgatcctcactctatgaaataggtattactgtcatattatccttttccaacagatactcaggcaggtgaagtgacttgcctgcaatcacacagctgggaagcggccaagtccagtctggagtgtgtgattccaaaaccagaatgttctttaacacgccatcacaaatgttccatttggtcaacagtggatagttcataaaatattttcttctattgtgtctcacaattacccccaacataagccaatgcatagcattaccagatgagtgaaactaccatgaccaaaaatttcggttcacattacacccattccgagaaaggcacaccacacatgaccaggacgacaggattgacagtgatcctcgctaggtgagctaaggtattttggttttcaagttgtttccttgttttaaaagcactacacccagaaaagcaaactactgctgagtaatttaatgtgaactatgcaggcttatcaagtggagtcgctcaggcctcaatacttctcttgggtattcaggtatgaaggtcacttttactcaaaaaaaaaaaaaaaaaaaaaaaatcctgccagatgaatttacctttctctttaaaaaataatcttcaggttctgaggtagaggaaacaggtgaggttgtccctaacagcctccaagtgaacagaatgaacttgattctttccacaagcttccctccactaaaggcagtttatttctattaatgttccaccaacaaagctacagtactcagttcttactgcaacagaatagtcacatatacccaaataacttgtaggcagtgttacacattagaaaaatatacctatcattttattattaaaccagaaaaaccctgctgacaatcaacaaaaggtctcccagcaactgaaaagcagagaaactaagcaaagattttttctttggagacatgaaactcattcagctaagaaggatggattttatcacttattattctccaaaatggaaggtgccacatggagaccataaacgagggtacactgcatcttggagcaacgttattatgtgtcaagttacaaagcccatgaatacaaggggtgtattaatggaaagactgataccatcttactacagtggcctctctgtagctccggacaatgatctgttgagggttttccagggattttgaatgtgcaacct

SEQ ID NO: 195253 - DNA, 864 bp, Homo sapiens
aggaggtggggtacctggcagcctggcacagggcaggctctacagttcctatgtacctgggtccctgaactttgcatgccccaaacacagagccaggtgatccatcggcagcagggacgacaaagttagacaaaagaccaaaaggagctgctctgaccacaagccttttccattaggaatttgtaactccccatctccagaaaggcaaacaccgagatcctacaggctggcccaagccaggggtaactagaatagtgttgttctgagaagccaaactagtcaaggactagcaagacccatggcttggataaaaagaagattcccccaaatctggttcatttatttgctagttccctctgccttcctcatatgctgctgaaagatggggagggcatgcacacactcctgtagcacctaggtttgtcacacatctctatagaggacatcaaaacccaactgtgtgtggcatcggcgcacagctgaaaaccactcggcaataaaaaggaatgagctactgacagatgtgacatggatcaatcacaaaaacatcatgctgagcaaagcagccagatgcaaaatagcacccactgtgtgtgtctatgtggatgaaattcgaaaccaagcaaaaccaatctacagtgacagattaatgtttgccagggccagggggcagggtgggggactgacttcaaagggacacaaggaaattttggagcaatggaaatattctgtcttgactgagtcatacaggtgtttccacttgtcaaagctcctaaaaggatgcattcaattgtatgtaaactaatacctcaataaagaggaagaaggcgggagaaggaggggaaaagaaggtgagaaaacagg

SEQ ID NO: 195254 - DNA, 213 bp, Homo sapiens
aaggctgcacgaggacatgcgaaacacctaccgcagtgcccaacacagagtgggcactccatgaaaattagtttcctcttttccataagcaagtgtctggaactactaagaatataagaagtaccctcaagtaaccacagtcactagaatcttcccagctccttttgttccactgggaaagctgacacctgtgtgtgtgtgtgtgtgtgtgtg

SEQ ID NO: 195255 - DNA, 290 bp, Homo sapiens
cacatgagtgataccccatcatcagtaacatttttcattccctgcagccattcccaactaggagaagtggagggtcacagtgatatgaggccactttctccctagcttttattttgtgtagtaaatgatgcaaaaagaaagaacaaaggcatagaaataggaaagaatacagagtgttaatagaaccacattgtgtcgggaagagattcacatttatatcactttatcctgtttttgaccaatataattaagttatattctgcttgtagttaaaattatgtgaacagatg

SEQ ID NO: 195256 - DNA, 311 bp, Homo sapiens
actatggaaactgggggaatgggggcataaatggtcttggcttggccagcactctgcttccccactcccacccatcttgtgtcctggaggaccaaggtaaggcattagagtggctgccgtctcttcctgtgatgcacacttcttccccataaaggatctctggcgaggacacatccaggcaggtgggcagaggagttgtcctggctgcctctatttcccagtagagttgtcttctcagcctcctgatctccacagccagagacagagataatgagaactttaacagtcagaatacacatcagcactgggag

SEQ ID NO: 195257 - DNA, 276 bp, Homo sapiens
ccttggcctcccaaagtgctaggattacaggggtgagccacggcacccaaactattcaacaaattttcatcaagtgcttaccatgggtcacatgctattctgggtgcttgtaattcatcagtgaacaaaacaggatccttccagtggatcttacattttagacaaaacagtaagtgagaaatgaaataagtacctcttgtaaattcctagatagtgtcacgtgctgtggataaagggaaaagtagagcaggataaagggcagtgttgggagagtat

SEQ ID NO: 195258 - DNA, 373 bp, Homo sapiens
tccacccatatccacatctggcacagacctaacaacagccattgcataattaggggtttctactcccctctctcccgcaacctgtcttctctctttgctggacagaaagatcccatctcgttacggtgtggcagctctgaatatgctttacccatttcagtctacacatacgttcagggaattaaaggaagacacggcctctttcaaaacgctttaaagaactgtttaaatttatctcccagtctaaatctgcctatttctctaactggtaccataattttcaccaccataactgaaactccagaagggttatgggttgtgctgttttgttcattgacgtatcccagtacctagaccagtgcctagatgcagt

SEQ ID NO: 195259 - DNA, 246 bp, Homo sapiens
tgttcacaatgtcagaccctgaaccactgcaggttttgaaattgaatatcccaacacaaaaactaatgctcatcagcatcctggttgggatgtgaatagttacggattttaaagagtgctgcacttctgaagtattttttcaagactttctgtcttccttttgttttttgttcttcccaataagaccacttctgcttttaaaaaatgttagttggccaggcgtgatggctcacttctgtaatccca

SEQ ID NO: 195260 - DNA, 665 bp, Homo sapiens
attgttttattttaatatcacgacacacatattattcctgatttgtaatctcacgatacccgccttgctcgccaagagtcctgagtgctggcctggtaaagatgattatctccatctttcagacgaggaaaccaaagttcagagcacaggtccgcagaacagtcacagctgccagcagatgcacacccacatgcgccatcccatttgatcatcaccaacctgccggttaggttttcttgtcacccgaattttacaaaagtggaacagaagcaccgagagaataaatgagctgcctgagattcatcaactgctggtggaactgggcttagtcctgcattctttccaaagcccccatgcggtgactcagtatttggccatttttctttatcctttttgcctggtgactctgaagagagcccacctacagtccagcatgtctggatcctgtgcagcgggcagaggccagaggccatggtgggggccccagaactcaggctgggaatcccaggggctactccagctttcatgtcaccagagcagtgacattcgggccctcgggggcagactgtgcctgtggcttctcagtggggtgccttagggtcccctcagcagatggatcccatctcctggtctggttagcataagataaacagggatagtagcag

SEQ ID NO: 195261 - DNA, 354 bp, Homo sapiens
caggctgaacaccttactgaactctttaaataacaggggctctatgacactcacttcaacgttctgcttttcctttaaatgtcagctatcctgtaaatatgcatcctatgagagtagcccaaaacccacacactgtgttggaagctaggtaggaagctgaagcacattgtctacctttggaaccccacaggcctcattatgcttttaagctacatgtttctatgaattatgattttgccaactgaatcctctggcaaaaaagcctccacccacaggcacccactggagatttggacttgatgccccaatgacatggctattaagtgcatcctttttgaaaaggagctattagct

SEQ ID NO: 195262 - DNA, 249 bp, Homo sapiens
tccttcagttcatcaaagggaacagaatccaaatgtttgtcatattattaatctgggccaaagagcataccatagatctatttttgactgctacctgtccctcaggtaacacaaatttggtttcaatgaaaatctcagtttttcttcccaagtctctttataaattataatttcagtctaaagaaataaataatgacttagttgctttccatctttatacaacatctaaaatcactatgaatacaaatg

SEQ ID NO: 195263 - DNA, 402 bp, Homo sapiens
tgaagaatgaatttcatcctcccagctgtgcagcttctcttctaaatgtaagttgccttgctcaacatctgcttcccatacgggcagttttaggccttggacttcttgatgaaggtataaaacgaggactttcagcggaggtgcctcccatttatggctggaggagtctctggggtggggccgtcctgcacacttcagggtgttggggagtgtccctgggctccacccaccagcggccaggagcagcaacctcagttatgaaaagcagaaatgtctccatacataaccaagtgttccttcagggagggagggcaaagttttctccactagtgaaccactgtgatagacagacgacggacagagagagatgatagatacgataggtaggtatatgttgagatg

SEQ ID NO: 195264 - DNA, 666 bp, Homo sapiens
aaaaaaaaaaaaaaaacagttatttttctctatacccacaccacaaataattggaaatgtagctcaaaagagcatttataatagcaccaaaatctctcactatccacagataaatctggcaaaagttgcataagacttgtatacaaaagactgaaactttattggaaaacattaaagaagatctaaatcacagagattcattatccaaagacaggaagggttagtatcataaaagctgtcaaggaccgggcatagtggctcatgcctgtaatcccagtgctaggagaccgaggcaagaggattgcttgaagccaggagtttgagaccaacctggacaacatagaccacaactctacaagaaaattaaaaattagccaggcgtgggccgggcgcggtggttcatgcctgtaatcccagcactttgggaggccgaggcaggtggatcacgaggccaggagctcgaaaccatcctggctaacacggtgaaaccccgtctctactaaaaatacaaaaaattagccaggcgtggtggcgggcacctgtagtcccagctactcgggaggctgaggcaggagaatggcgtgaacctgggaggcagagcttgcagtgagccgagattgcaccactgcactccagcctgggcaacagagcaagactccgtctcaa

SEQ ID NO: 195265 - DNA, 264 bp, Homo sapiens
aaaaaaaaaaaaaaaacagttatttttctctatacccacaccacaaataattggaaatgtagctcaaaagagcatttataatagcaccgtgcctgccctttgcccaactttttaatgggtttttttgttttttccttgtaaatttgtttaagttccttgtagtttctggatctacaagaatctacaagatctggacctgacctttgtcagatgggtaggttgcaaaaattttctcccgttctgtaagtgcccgccaatcgaagg

SEQ ID NO: 195266 - DNA, 448 bp, Homo sapiens
ctagaaatgggtgtatacatgccattttggtccttctgtgactccttagctatgtgacagttggctaagaagaggggagaccttggagaaagaaactgctgggatacagaaagcagaagagatcatcagggactgaaaacttcctggaaagctactggagttcagatccagccaaatggggaaatgttggcaaacaactgagaaactcagttgggactctaaaaattctcttaggagagatgcagtatcccaggagtgaggcatatgttctaagaggaaaataaaatataattaccataacacagcttaaaactagatcttgagagcagcaagatgatctgcaagtaattacaaattctgcccagaaaaaaaattcaaaattcttgagtagttctatatcatattatccataaattcagcatactttaaaaaaaataccaaatataca

SEQ ID NO: 195267 - DNA, 570 bp, Homo sapiens
cttattcactcttcctacaaatcttaattattaagtgcctgttctacaagggattgtgatattacttgtgtaggacacgtgccttttaagagcttagtcttattaaaatgtatggtattatctcagtaatggctgacagtacttggaatgtgcttcccctggtccagcacacactggaaacattgctaatggaccatgatgatctctcctgcttcctagacacggcctcacttctcttcccaacatgacgttctaagtcagcactggccaatagaaatttctgtgatgatggaaatgttcagtgtccgggcattgagcacttggaatatggctagtgtgactgaaggaatgaatttctaactttaacttaagtagcaacatgtggcaaatggttaacatattggacagtgcagttctaggcagccactactaattgatcagagttggttcctaggataaaacccacttttcttcccagaggactaatcagatgtcacagctagctacagcgttgcattgaggtacctcatctgccttaagtcagtgtctctctctctctctgtctctctt

SEQ ID NO: 195268 - DNA, 400 bp, Homo sapiens
agatttcacagcatcagttcgaatgtttaaatttggctgatttaaactcaaggaggagcacaattattctagtcgatgtttttgataacttgagtatgtgttagggacaagaagagattatatgtgagcttgagcttatctatttatattctgggattccagaaaactacactcagggtatcatttttaaatgatggtaatattataggtaagaccattcactctgatctctgatcttttcaatgacagtgaacattttatatttaaaattaatgttcctttgtgccaacaaaatttgtttttgttctcactgtagaaaaggatccaaagcttgtctcacaaaattgaagagttctgttttagtgaaattacattcttacccaagctcttctcattgtgt

SEQ ID NO: 195269 - DNA, 647 bp, Homo sapiens
catttgcagtctatctttgtatgtgactttaggtaaatatccaattttgtttttatctatggcatgagccaggtttgcaactccttctattaatctgcccttttcccattgatatatggtacccactttactatatattaagttcccatataaacatacttaatttctaagctccttatcatgtttcactgatctttttgtcattgcaataatatcacattgttattattacttgactgtgtagtatgtcttaatacttggaagggcaagtacccattctttgcctttttcttgaaatgttgacttacctgttcgtggatctttattcttccataaaaacttgaggttattgaacttctcaagaaattcaacacaaatattttgaagtatttgtgattgtgttgaatgtatagattaatatgaactgacatgtttataatattaagtcatctcccccaagatatggaatgtcactccatttattcagataatcttctatgtcatttattagatttaaaaattttctccatggaagtattatatgttgtcattattttctagttatttaacattttttgttgctgttctgaatgatatcttatttttaaatacattttgtaattggttattgttggagagaaaagtgc

SEQ ID NO: 195270 - DNA, 364 bp, Homo sapiens
agggaattatgtgaaagcttctcttttgtccagacacagtgaactgtcaagatcatcagctgagttgagagggcaggaaagaagggggtttgaggataggacattatgaaaaaatagtagttttggagaaattgccttaaggatatttgtggaatcaaatgtatgggaagtttttaagtgctttaaattaacctgttttaccatgctttgaagttcttaggtttagtccagcaacgtggctcataccacggccggtaatatcagcccttggttgctgaggcaggtggatcacctgaggtcaggagttcgagaccagtccttcaacatggtgaaatgccgtctctattaaaaatagaaaaattag

SEQ ID NO: 195271 - DNA, 567 bp, Homo sapiens
ctgtatgactccatacttaagcatctgtcaactccctaaagtaaatccctacctattgaggcctctaaggtggtagctctcctcactggagtggttctggtgggttacctattggcaggaagacatagtcctctatcctccatcctaaggttaaattcttgatttaattagctgcagatacaaaattctattggaagagagatgactgtccacacaggataaaaacagataaagcatctgagtaaggctttgcttagcccacagattctctaattgcagctgctggcagtactatccacacaaagtatttgctggacttaaagctcaattattatgatactacaaacttttatttatattcagggattatgcctacattcagaatttgaaagaatttacacaaacagtatgtattaagacagtggtctccaaagtggaatgcataagactttccagtgaagcacaaaaagaaaaattaaaactcttattttataattgtttttaatcttaaaatataagaattatgctttaccaatgttaactgtactgactaacaatggtgccctc

SEQ ID NO: 195272 - DNA, 392 bp, Homo sapiens
cgcctgcctcagcgtcccaagtagcagggactacaggcgtgcaccaccatgcccggctaatttttgtatttttagtagagacagggtttcaccacgttggccaggctggtcttgaactcttgacctcaagtgatccacctgccaaagtgctgggattataggcgtgagccaccgtgtccggccgggccctggtttttgtacacacgtgcattgcagatctagagaaggtcatgacttgcccaagtacatatagcacatcagggcagaccctgggctcgaacccaggccttctgccaggactgggttaggcccagagttggggtactgcacgatgaacaagctgggggatgctgggagtgctactcagtctctgggtgggagccagctctcct

SEQ ID NO: 195273 - DNA, 123 bp, Homo sapiens
caagaccttcgctcgaaattcagtcctcgtaattcataaggcagttcatactgcagagaaaccctataagtgtaatgaatgtggcaaggtttttaagcaacgagcaactcttgcaggacatcg

SEQ ID NO: 195274 - DNA, 316 bp, Homo sapiens
atcaaaggagcccaggagtttgaggctgcagtgagctatcatcacacctctgcactccagcctggatgacagagggagaccacatcactgaaagataataatagggttttttttgttgttttgttttgtttttgcaaccccagagtgtgtgctctctctctctctctctcttctgcttttctgatagcaaaacagtgactacacttaccaataatttatcgcattaaaaacaacgggaaaaaccgcagtacttttccaccaacctaatacattttaaaataaataaaagagtgtaattggattgtttgtaacatga

SEQ ID NO: 195275 - DNA, 385 bp, Homo sapiens
gcaaaggcagtgctaagagaaaagttcgtagccctaagtgcctgcattgaaaagactgaaagagcacaaattgacattctaaggtcacacctcaagcaactaggaaaacccagaacaaggccgggcacagtggctcatgcctgtaatcccagcactttgggaggctgaggcggtggatcacgaggtcaggagattgagaccatcctggctaacacagtgaaaccccacctctactaaaaatacaaaaaaggagctgggcatggtggcgggcacctgtagtcccagctactcgggaggctgaggcaggagaatagcgtgaacctgggaggcggagcttgcagtgagctgagatcgtgccactacagtccagcctgggcgacagagt

SEQ ID NO: 195276 - DNA, 474 bp, Homo sapiens
tgtatagcctttccgtcagacgctgaactatgtgtgactctagtgtgtaatacagaccctgtgaggcataaaacccaaccatccttcccctctttgaagagagagcacctttgatacacactggacactttctcttcccagctggcaaagcgattatcaccagtaaaggtcttctttctaccttttagccatcgtggtggtcttttggacagcaataatcaaactgttggatcagagaggcaagcacaatgacgatttctaatattcacctgaatcgtcactaaaagagcttccaagtgcactttggaagtgccatcgaatatcttttctgggtttttcttttttttttttttgagacggagtctcgctctgctcactgcaacctccacctccctggttcaagtgattctcctgcctgagcctcctgagtagctgggattccaggcgcatgccaccacgcctggctaatttttt

SEQ ID NO: 195277 - DNA, 287 bp, Homo sapiens
tgcctcagacttctcaacacttccagtctgctaggagatcctgggtcacccgtgaacacacgaggttgaaacaggctgggaaggggaggggccgggacctatggggctacatcattgtactctgccccccaagagatggccagtgcagccgacaaagatagattagagcctggagaagggtcagaggccgggtcaggagagcaccatttcctgggcggctggggaccgggaggtgccctatcggagacgctgtggcggtcggtgtggagggcgagaagctgtgtgcg

SEQ ID NO: 195278 - DNA, 232 bp, Homo sapiens
tatatacataaaaataaagcaaatataagcaaaatgataaatatgaatgacaactacagaatttgggttaaaggcatacaactattcactgaacttttttagcatttctgtatatttgaaaatttcaaagtaataagtggagagaaatcattcacaaaactaatcttggcaaatcagtgtgttgtgaaatcctctctggaagatttttggtccaaaatgtcttttttttttt

SEQ ID NO: 195279 - DNA, 586 bp, Homo sapiens
tttttttttataactctattcctttctttattcccagtgtagcttcacctcggcgggtgagcgttattggaatggaaggcagggagtgatctgtactggtctctctgctgcctgctcgcccctctcaatctctcctttgctttttgctttaagatcgctcttctctattgcatgcagggagttttcttgagctgggtagcaggctgattccattcatttctacagtgccttgaatatcttcaatcgcccacaaagacaatgttttattctacgaacacaccttttgccaacatctcactgctttctgtacaaaacagcctttttgtcgaacattgaagtgtctacaataataactatcaatagggaaggaaacaaattaacatccaacgaatatagggaaatgtggccctgatacaagcacttggtttttgcttctaaagaggaaccccttcccagactcacctcatcgagagggagacagagaagtctatcaagcttagcaaacatctgtagtccaattactgtcaacagtttacaggtgttgagagcaaacagtcacttatacactacctcccaaatgcattct

SEQ ID NO: 195280 - DNA, 527 bp, Homo sapiens
catctaaacaatgcctggcacagtttataggccctcagtaaatgtccccgagaaagtgagtgggtagagaagtcagttgtcttatttaggacatcatacgatctgaaggatgcagaattcatctgccaggatattgttctgtcctcctgccaaacttgaaattcccacaacagtcattgaaaaggtgggagcactgtctgccaaaggctgctattagaaaataagcatgttgctaaggagaagggagctccactcttcttgaagcatttaactctcttcagaattaagatcgtgaacatgagcagtaccataactagtaatacattatttatttttggaaattaaaaaataataacagttgtaaagccccatgataggaatttttttttctcaaaagtatgagggctaggcactgtggctcacacctgtaatcccaatagtgtgggagttaaggcaggaggattgctggaggtcaggggtttgagaccagcctgggcaacatagcgggacccccatctccacaaatt

SEQ ID NO: 195281 - DNA, 494 bp, Homo sapiens
cactctggagtgaaaatgtaaagaaagtgaggctgtcagttgtgagattatccgaaagaagcacatttcaggcacaaggaacagcgagaactcctgattcaggagcctgtgggatgttcatggaggccaatgtggctgaagtgaagtgacctgggattggtggtatagtgaggtgggatataagaaaaagattaagctgggtgtggtggctcacgcctgtaatcccagcactttgggaagctgaggtgggagaatcacttgaggccaggagttcaagaccagccttggcaacataatgaggtcctatctctacaaaataaaaaacaaacaaaatcagccaagtgtggtggcacacacctgtggtcccagctaatcaggaggctgaggtgggaggattgcttgagcccaaggggttgaggttgcagcaagccatgattgcaccactttactccagcctgggcaacagagtaagactttgtctccagaaaagaaaa

SEQ ID NO: 195282 - DNA, 1189 bp, Homo sapiens
gaacagcagcatgggggtaaccgcccccatgattcaactaccgcccactgggccctcccaccacatgtgggaattaaagggaactacagttcaagatgagatttgggtggggacacagccaaccaatattactcagcctttctgagcttaggagcactaagtagctctgtagcactgtgcctgcggcctgtttcaaacaaaatctcaagcaaaaagcaaacatatatgaaagacatggcacgaaatagcccagagaaaggacccttgttgacagtaggagagctgaagcaggaaggcacagtgtcatcttgtttgacctcagcctggaatgtgcatgtccagtaactcgaattttctcccctctgctcccatgtccaggaatgaccacaaaattgccacaagtattgatttctaagtttcaaagaaattttagccagcaggtgaatttgtaaatacagatcggtgaataatgaggactgaccatacttacattctaatgttcttaactaaatatctttctccacgtatgtataaagcataaaattttctcctttccagtctaaaggtcagtgcctaaaggagtgaaatggtgagaaggggctggatccaagctgttattggctatgattgaaaatttactgctatttaaaagtgcatatttccacttttaagttgcccatagattcttctttttttttttttttctttttttgagatggaatttactcttgtcacccaggctggagtgccaatggtgtgatctcagctcactgcaacctccgcctccggggttcaagcgattcttctgcctcagtctcccgagtagctgggatctcatacattattctttagtgtccaaagggtttttacttccaatggcttatttgtggaatttataaacggaagtgatttgcaaacaaccaacaaaaagcacaccaaaataacctgcacaaagattacaaagactttaataaattaattacggttacttgtcatcatttccctgttttaagtacacccctgaacaggcctcaggcttcttccagtatgggctggcctggggatggggaggacgaaggtctaccccagccctctctggccacagaggctgcattgccccctctctttcagttcgattttgtttaaggcagtgtggcttcttaagtgacatgtctgtgatgatcacccc

SEQ ID NO: 195283 - DNA, 396 bp, Homo sapiens
atgtgtgagtggtagttaggtgtggaggtaattgcaggttgcctctgagcagaaagttaaacagctgcagtgtgggagatcaccctggaataaacacattaaaaatcttctaaaagatcaaaaaccccagctgttcctatcaatatgctagtgcgcactctgcatgcacctttaggccataaacccatttcccttgccctgtgaatcgactgaaaagatggactggtgggaaagaaccaatccagggagcacttagccttggaggtgagacactgttgggaagaagtcagccgctagagagctctcccttgaaaccaccagaccttgcctgtaacctgcgtgtgctctttagcgcacgcactcaggatcctggaactgtcatatctcacccccggc

SEQ ID NO: 195284 - DNA, 486 bp, Homo sapiens
gcctctcaccgagcctgagtcgtggccgctgcgccgccaggaggcttcccgggagccggcggggcccaggacctctcgagcgcagcaggcaaggggccggccttttggcagcgcggctgccagttaattttctccgttgcattctgcaaacgagatcgcattcagagcccagaagttgcaagctgggaataagcgagatctgaaagacccccaagaggagcttgtttgggagtgggggcagacggcgttttgcgcccaactgatggttctgtgaagggaaagaactgcacaacactcctgatattcaaatccactgtgagggaggggacctccataccctgatcatagcagaggcctttgaggacgacacaggtcgctacacctgtttggctacgaatcccagcggctcagacacaacatctgctgaggtgttcattgaaggtgccagttcaacagattctgacagtgaaagtttagctttcaaat

SEQ ID NO: 195285 - DNA, 605 bp, Homo sapiens
atctttggggagtgaggtgttctaatacagtggttctcaaaattagcaggcatcagcatcacctgcaaggcctgtagtttgctgggccccaccacagaggtttctgtttcagttggcctatggtggggccccagaacttggatttcttaacagttctcaggtggtgttgatgctgttggtccagggaccatacttgagagcctctgctctaatcgatgggaacagactggctggatgactggcctccagggggcgctccattcctgacagcacatcccgccagagctggttgatggacactctaccgggagctgaattttaccacgtaccttctttgcctgttaagggcactgcttcaatgaaacttgcaaggagcaaagaacagattaggtaatttttaattggaacactgatatgagttataggttatttaaatattttgaagctgcaaactgccccttgtttcttttcagttcagagatggaaaaggagtgaaaatccttgaaatagaacttccttttgtaggattactttgcctagaagacaatagataaattcagtgatgtgtggggattgcaaaaattcattttccactttattacttt

SEQ ID NO: 195286 - DNA, 271 bp, Homo sapiens
tgacattatcagagcctccacacaaatggtacctggtgacccactgatgcactgatatgactgcaaccctgaaagcctgcttccctcaagccaaacccctgtgagaaggaagtagacttaaggtagcttctatccaagttcattttcagtgcatagtaggccatgcactgataaatggctttcctggccttggcaatgtctgccgtctttatgctccactaaactgtttgacttccacacaaagacttcttctcagaggcactgtctgggt

SEQ ID NO: 195287 - DNA, 303 bp, Homo sapiens
acctccctgtgatgtttctgcctcattaaggctttatttgtgtgggcttaatccaaacaaagctgaaaaaaacaaaaacatgccaaaaagcccactgtgatttgcagaatgctatcaacatccgatttctaatatgttttctttacgaaaatcttttttgtggggaagtgacaaggttaaggagctggctataaactatgaactgcttatcttcacaaaaggtggacacattcttcctaaacgttcacagaaggtgctgttggtgtttttgacattggtgttataccagttatacgtaaggga

SEQ ID NO: 195288 - DNA, 288 bp, Homo sapiens
gcaatcatctagtttacccaaagactctcacgccaagcgactagctactgctcttcacctatgcaagttaaaccggaggctccccttttcacttagcgagatgccccacaaggtcatcaatgaacacttggacaccttcaaaagtcagtggtgacaatgttaagctgccagttttcaaaaattataccggttaagaaatagtgaagagtgccaaggacatactctttaagatgaaggttgggggccgggcacggtggctcaggcctgtaatcccagcactttgggagg

SEQ ID NO: 195289 - DNA, 168 bp, Homo sapiens
agcagggaacaaagaagcatatggatcccagcttgctcagcaccaagtgtgagaagacagaacctctgcacttggctccctaactagacattcaccttggccagtgctgtgttttcatctgttcaccaccatcctctcccctccacaccacaactggtgaaaaggtag

SEQ ID NO: 195290 - DNA, 432 bp, Homo sapiens
gtatatgaagtatccaattttctggggaaatattcagtgtactgaaagtaaactgcatttaaaatcattataaaccaaaaaacacgtcaaatagcattatcgtattattattatttgtgagtaagttaagagacagagtcttgctctgtcgcccaggctggagtgcagtggcatgatctcagctcactgcaacctccgcctcccgggttcaagtgattctcctgcctcagcctcccaagtagctgagattacaggcacctgccaccatgcccagctaatttttttcgtatttgtagtagagatggggtttcaccatgttgaccagtttggtctcgaactcctcacctcaggtgatccacccgccttagcctcccaaagtgctaggattacaggcgtgagctcccacaccctgccagattattaacattttaa

SEQ ID NO: 195291 - DNA, 337 bp, Homo sapiens
gagtagattttctaaaaaataagcagcgcattttaaaaggccccctaaataaggcttcagatggcacaaggccatggataggttgtcatagtgatgatcagaaatgaaaaatatttctactttacttgaggtaaggagtttgaggacagcctggccaacatggtgaaacccagtgtctactaaaaatataaacattagctggctttggtggtgcatgcctggaatccagttacttaggaagctgaggcaggagaattgcttgaacccaggaggcagaggttgcagtgagccgagaccatgccactgcactccagcctgggcaacagaccccatctca

SEQ ID NO: 195292 - DNA, 761 bp, Homo sapiens
tcagacagagtctcgctctgtcacccagtctagagtacactggcagcttggctcactgcaaccgctgcctcctgggttcaagcaactctcgtgctttagcctcctgagtagctgggattacaggtgcccgccaccatgtccagctaatatctgtatttttagtagagacggggtttcaccatgttggccaggctgttctcgaactcccgacctcaggtgatctgctggcctcggcctcccaaagtactgggattacaggcgtgagccaccgcgcccagcctggcctctccttttataataaagaaactgaggcccagagggagggcatgccttgtctaatcccaggctttttagagtctcctgggtctgacagtgctctctcttcctgtgaacatgctgaaagggacatgctgggagatttgagaagtcaaattagtagtatatgacttttttcatttccaccctactgctcttatcttggatgagggatggttttaccattcaatttcatgtatttttctttgtgggaaatgaaccacagccagcaacttaataaaatcccaccccaccccatcaccgacagtaattagaagctgtgaaggaatctgaggagttagtctattttccctttaggcatgatagaccctacctgatcctatcagatgaacacatttttttcaatcttaaaaatatccactgaaaaaatatctttcctctggaaactctgccactatctgtgctgatttttgtttactaagaga

SEQ ID NO: 195293 - DNA, 610 bp, Homo sapiens
cgaaacagtgagcttattatcattaatattaatacttcctttagtgtattcacgagtcctggaagcaatgaggcgagctttaaaaacccacttttctaattaagtggtttttaacataatgagtaaaccatacaaggttcatactgagggaaactggtttggagaggaggcatcagagtacacaggggcaaagggctgggtcccagctgcgacaaaagcccccagcaggaagggtgcgtgcttctccctggccaagcagttgtctagggccgctgcctggcagagaggaccaaaaactgacaaaggagatcacactgagaggtttccttcctgagaccgctgggcaaaggagcctgaggcacatttgcacatagtactctgggagcagaatggctggatcctccgggcccgtggcagcttgaaatgcgagctgccagcagagctgggccaaagcctcttttgtggtaggtggggactcttgacaattcctgccctcagcctgggctagtgtaatagaatcataataatatgttaggttgaatcatatgcagttgtttttgtagattaaaatggttgaatattggcaatttcgtgaggctcaatctaatag

SEQ ID NO: 195294 - DNA, 367 bp, Homo sapiens
cccgcaaagtgctgggattacaggcatgagctaccattaccaggctagccaggccattacctttaatcagggtctgtccagtgaattaacaaaggcttgaaagaaatcaggtgagctccttgcgccttcaaatgcttcttagaagacatcattagccctgaacctgccgttgagaatgtgctgtgatcctgggggtcttgatcattaatgaacagcatatgatgtgataaggaagtaactgtcaatgaaaattggaggaaccaggcatggtggctcatggcgaaactccgtctctactaataatacaaaaattagcgagtgcagtggcgtgtgcttgtaaccccagctatgtggtaggatgagttgg

SEQ ID NO: 195295 - DNA, 179 bp, Homo sapiens
ctcccgccgagccctgccctctgacctgctctcacttctctgctgccccagcccctcccagtctgtcccctcccccaccctgccacacctgacattagcgatgtctcttctcctcctccctctgtttctgatgtatcttttttttttttatatacgtgttttttaaaaaacaaaaacca

SEQ ID NO: 195296 - DNA, 410 bp, Homo sapiens
ccactccttaccccaaagggtcctctctgccttgctggctcacggttttatagttactgtgacctccaagaaagcagcaggacaaataatgcttgactctgatgtcgctacaaattcagcacacacaccaaccagcacaattacccttttctgcaactttaaaccactttggttgaggagcgttccactgtgggctcacctttcggtacatgtgtggagttaccaaatggcacagcaccgtgtaactattccaaaccgaccacaatccatttcaaaagagggtggcctcacatcaacactcaaacttgctgatggaaggcagccacgccacacaaacacgaactaatatcaaccctgtggaaagagcatcttccggccaggcacggtggctcacgcccctaatcccagca

SEQ ID NO: 195297 - DNA, 246 bp, Homo sapiens
attaatccttcatttgtttagcatgtatgtatgtatgtatatatgtatatattgtctgactgctttcttaaacaaccagaaaagcagggaatcctgttatatctcatcctcctttcatccaactcccctaccctcccatgacaaaaggccactctgaatttttaaatcttattctttcatttttaaataatatttcttataattttacttttaaattattgggtttccttttagtttttcaacata

SEQ ID NO: 195298 - DNA, 371 bp, Homo sapiens
tttagggggaatcaggtgtgaaaagtgctatattcaactatatgttatactgagatttcaaattatgttttatgttcatagcacaaagatgtaggttttattgatagctaatgtttccgcctacttaacgtctgttctgtataataataaatattcatatccgttccgggcaattttatttctagaaaagactgtgtgtagtacaggcagtcctcaacttagaaataggttgtgttctggaagtttagttgttaagaacttaaaattcattttcctcaaagcaaaagcaagggagtatggggcttccatcagctagagtgccaaagactgaagagcagaagagattttagggaaatatacatatacagctg

SEQ ID NO: 195299 - DNA, 445 bp, Homo sapiens
aaactgtcttccacagaaccggtccctggtgccaaaaaggttggggacctctgggttacattatcacatgcatttgtcaaaactcctggaactgtacaccaaaaagggtaaattttactgtttataaattatgcctcaaccattctggcttagaaaagcaaaataggcctggcatattggctcatgcctgtaatcccagcactttgggaggccaaagcaggcggaacacaaggtcaggagttcgagaccagcctggccagcatggtgaaaccccgtctctactaaaactacaaaaaattagctgggcatggtggcacgcacgtgtagtgtcagctgcttggggggctgaggcaggagaattgcttgaacccggtaggcagaggttgcagtgagccaagatcacgccactgcacttcagcctgggtgacagagcgagactccgtct

SEQ ID NO: 195300 - DNA, 555 bp, Homo sapiens
  misc_feature (18)..(18): n is a, c, g, or t
ccaaatggaatccccaangaatcccaaatggaatccatgctgaagaaaaaagatgctaacaaattcactcatcaccatgcacaaaattaagctttctaaactctaccatagaagagaataaagatcattctaccctgggaagacatccaaatgctatatatcccaactctttaaaaactagctctggtttctctgagaaacaaaatacatccaatattacatatgtgaaattaaataagcaggaggccattagcctgagactcccttggtacttgtagttcctatataacaaactgcaatctacctcagtaataaacaaaccaaaacctaacttagcagaatacttttgtaacgaatagctaggtttaagccagacagaaacaggtgagcttcagccagtcataggcagtcaagttatcaaaccatgcacaaatagggcaaatgcctagctgtaaccaatccagttatttctgtagtttacttccaagttcaatttatacttataaaagcatactctctgtgccacagaggattcattggggggaccgagctcga

SEQ ID NO: 195301 - DNA, 628 bp, Homo sapiens
cagttgactctagaggatacaccttatgctctgacccaccttagcaccttatttgtctgatctcataaagagactttggagggaagcggagttgattgggattagaggtttgcttgctgaggacggtattattctctagccaatcaagcatgcacaaaattaagctttctaaactctaccatagaagagaataaagatcattctaccctgggaagacatccaaatgctatatatcccaactctttaaaaactagctctggtttctctgagaaacaaaatacatccaatattacatatgtgaaattaaataagcaggaggccattagcctgagactcccttggtacttgtagttcctatataacaaactgcaatctacctcagtaataaacaaaccaaaacctaacttagcagaatacttttgtaacgaatagctaggtttaagccagacagaaacaggtgagcttcagccagtcataggcagtcaagttatcaaaccatgcacaaatagggcaaatgcctagctgtaaccaatccagttatttctgtagtttacttccaagttcaatttatacttataaaagcatactctctgtgccacagaggattcattggggggaccgagctcga

SEQ ID NO: 195302 - DNA, 427 bp, Homo sapiens
ttcttataatttccagtaatactctgtaagactcggtttgcatgctgtgtgtgtttgcatgagtatagaaacctaagaacataatggaaggctattaaggcaaattcattcctagaaagtggagtggatcattgggataagaaatagcctaattataaacaaatatgcaggcagagggaagtcctaatacaatgaaaacttgcattatctaaacagatgttcccaaagcaatagtttgcctaaaatcctctgtattacatgattattcagtaaaagagtaaacaaatatctaatttattttctaattgtccttcccttcattgagtattaactaggtgcataatgtagttgtatatgtttactagtaaagggaaaaacacttattttcattttgagactgtttggctattactaaagctgagaaagt

SEQ ID NO: 195303 - DNA, 716 bp, Homo sapiens
tcttggtgggtattgaggtcattagattaaaaacatttacctttctacactgagaaacaaacccttcttcctcagacgcaaaataatttgtggatcttttatctctatttcggttgtcctgctttattttctctcattataagatgccctccatcttctgtagaactagatagttactaactcattaatggcgcttaatctgcttacagcctggagaaatgagccaggaggtcttgccatttcaaataggaacaaccccgctcctccagggtttcagaagagccactgttgacggcacggcagagcaagatggcagggttgagtgtgcagcggcttttctccggggtagtgaggctctccaagactggggtatgggagaaagaacaggagtcagggctacctgaatgtgatcctggctcttctgcttgacttactgggtgatattgggctacaactgagactcactttgctcctgtgtaaagtggggcaacagcatctaccacggagggttgaagatttacggagatcatgctaagacagtttgttccaaactcaaaggaaatcatttgcaaacaacagaaaaggtcagaaaccgtatacctggccaagagagatcccttttacgctttgtttaatgtttcatgttgtattttgggttttcccatttactggattctgagctccaaaacaggaatcacattttatgttttcttatt

SEQ ID NO: 195304 - DNA, 243 bp, Homo sapiens
aaatatcttacgagagaatcccattataacactgattattttgggggctatgacatcagtgaactaaacattcagttggatgaaactcagccaaaggccagaggttctcgacctttgtgctatacatgtagtaactggcatagctgtgaattgcatgtggagctgtgggaagaaagagatcctcttgaggcttatttggaactctgcaggaagaaaagaagtcatcaacgtaagtagtctccg

SEQ ID NO: 195305 - DNA, 562 bp, Homo sapiens
cattaatccagggaggatgacaaatgtctgagcttggacagggatagagcaggggatagactggaggtgtttaggaggtagaatccttagatttggctgacccagtggaaggagaggggagggggagaagtgatggatgacttctgtctaccttatggtacatgctgttcagtgatctgggttaaagagcagatttggagaaagataaggacttcatggtggataatgaattcatttgcagtgcctgaggagtgtctaagtgaggtggtaaatggtaagttaagatgtaagtctggagctcaggagagaggcctggggtaagatggcaacataggaattaattaaaactataggaagaatgagatctcccaaggaggttttgttgactgagaagggctaaggatagaaccttttgaaaaaccacctttggaaacaccaggggtactgaggaaggaggaaatcatgaaagaaactagaaaggagtagtaagaagtggaaggaaaaccaggagagtgtggactctgcaaacagaagtgtccagaaagggatcagttgtgtctag

SEQ ID NO: 195306 - DNA, 307 bp, Homo sapiens
actgtactcagttgtatttagtaaagtgttttgtctattttggtatgatttgaccctttgcatatttattaacagttccacatactacacaaattcagcatcagtttaaagaaaagataatactttgtgaaaataacagtttcaagaacggtatagacagtagtctttaaataagtcaggattcagaaagacttgatcatcatctttgctccctgttcttcaaatatgtgtctttcttccatatgctgcatacagcttatgaattggttttttaattagacctttttttaactataacataaatctc

SEQ ID NO: 195307 - DNA, 430 bp, Homo sapiens
tacaatacgacacgacacgacacgacacgatacgatacgaaaacattggggaaatgcttcaggatgttggtcagggcaaatttttttaggtaatgcttcaaaagcacaggcaacaaaagcaaaaataggtaaatgagataacatcgagctaaaaagatcctgtacagcaaaggaaacgaccaacagagtgatgaaacaacttacagaatgggagaaaatatctgcaatttatctgacaagtattaataaccagaatatataaggagcaacaaaaaagcaagtatctgattttgaaatgcacaaatgatcagattagacatttctcagaagacatacaaatggttaattggtatatgaaaaaatgttcaacattactaataatactcagggaaatggaaatcaaaaccataataagctgggcacggtggct

SEQ ID NO: 195308 - DNA, 453 bp, Homo sapiens
tataattggcaggaaggagtaattatgattattttgttattataaggtgaagcagtacacaatcgtcccttggtatctgtggagcattcattctaagacccctgtggataccaaaatccacacatactcaagtccctctgcataccctgcataagagaaaagttggcgctctttactgggggattttgcatcctgcaatctgcatttggttgtggatgcagaactctacaagagggagggttgactggatttattgaaaaaaaaaatccttgtaaaagtggacccatgctgttcaaacacatatattgctagagccaaatgtagtgtcatttgaaagtggactaggattagttggaaatcaacactgcaaatttagggctaccactaaaagaaataattataaatcaaatgctaaaaaggagagaaaattgaatcatataaaatgctcagtta

SEQ ID NO: 195309 - DNA, 344 bp, Homo sapiens
ttcctaccagtcatttgcacaggctatcagagggcctctcttccaagcctttgataaacaggaattcaaccccaactaccctttggaagccaacggatattattataatcagtgggaaaacagacaatgacggagtcagctctggccagaagcagaaaagaacgaaggttggttcacctctcgttgcctactgcatgttgtgcacgaaatgacctcaaaggtcaacttctacgctttcctttttgcaagaactaaactcatacgtatgagccctccccttatggaaacctcaaaccctgttaggctaccctgtcacaaaccctgacttgaatagagaagtgtgg

SEQ ID NO: 195310 - DNA, 597 bp, Homo sapiens
gaacgcgtcttttaagttcggaaggccgagagcaaagtttggcctttactcgtagctacgtagtccgttcagacgtggaagtaattagaggacctgagcgagcagccagatgttgtgtgaaaggatgctgatcagaaattgaaagtttagtaaatcgaagcaatgaattctgaggactcagaccctgtaacttccatccgacatgagttatatgggaaagacactttgcttttattcagagatttgagattgatcgctccctgaattggaaacaattgtttgcttttgcatttatcggtgtctgtacctctgatcaatttttaattaacgagtctcagctgatgactttattttgaatgttaagaaaactgctaagttgaaatgtgtttaaaactttgaagaaatggaaaagacctttagttgagatttgtcttttatatgagctgttcattttactgtctgataagtgtaaggcaattttatatagtttcttagctgtatagttatgtatagtccgagtaagtagtcccttttggttctaagactgtaattttgtttcactgagtacgaaattatttctgaatacttgtataattt

SEQ ID NO: 195311 - DNA, 315 bp, Homo sapiens
gtagactgcccaagtaaaaagtagctctctaagtgagagaagatgggaactagcaggaaatccacttaaacactatgatcaatctcaactgaatgatttcaaagagcataactgaatatgatcaaaatgaaatttcccatatgttcaaatgaaattcatatgaaatacttgaaaaataaaacatagctagtatatcttgcaccatcctggaggaattctaggctttaacttgatctcatttaataatcctggctcctttcttactttgctcctttaaagcatggggccatgttttatacacattgatgtccctca

SEQ ID NO: 195312 - DNA, 410 bp, Homo sapiens
tttgaaaataataaaagaaaagaaaaataaagcaaaagccattctcccaaggcgatatcgggaagtgtcacttacctatcgcctttcttcctttctctctgatgtttaagtggtgatgctcaggactggtaatgctccaggaagtgaccctgccctcaggccctctcccctgcctcaggcagcctgactcagaaactgtcccctaatcacctcatcctcagtcacagctgagctccctggtcacctctttccaggacccacaattcaaccttatcctgcagcagccatgacattctagaaacctcacactcctgcctatgtgcgtgccctgcaatattttttgctatcctgtaaggagaccacacgcaggcttatctctgagatgctctaaatctaactcaatctagtca

SEQ ID NO: 195313 - DNA, 291 bp, Homo sapiens
agcagggacggatgggtgggtggagggatgggtggacaggaggacaaggagagccagagtgagtatgcagtcctcctagcacttctttgatttctgacaagtttccagctctctttttaacaaatgattttccattcctttcaaccaaaatgagcctaatcaaaatgacattaaaaacattacttctatatgtctaaaaattaaaataaaagtttttaaagatcttctaaaagacactttcttaatttagatttgtttttacttcttcaaatcccagttcctccccacaaa

SEQ ID NO: 195314 - DNA, 212 bp, Homo sapiens
caccttggggataaagagaagtagaagcagagagcagaatagtggttagtaagggggttaaggttggggcggagggtgttggtcaaattatacaaaatttcagataagaagactatagttaattacaaggtattttatcttgaaaatcactgaaagagtaaattttaagtgttctcattctcaaccaaaaaataagtatttgaggtaacaca

SEQ ID NO: 195315 - DNA, 274 bp, Homo sapiens
gtaatggggtccctcctttcctgccttttctggactgaggaaaatttcccatgaagacagtaaccaggaaaaattcagccacaactatttttcctatctcctgatgcttgaagatcggtgttacatatttgtcctactaggaaaccctacataatttattcattcaacaaatacttattagagtacctctatgatctggacagtcttccaaggcattggtggacaaaatggacaaaagtctctgcactcatgcaactcacatgctataaaagta

SEQ ID NO: 195316 - DNA, 666 bp, Homo sapiens
tccttgacacgaacctcttccacattcaacacattaaactcataactaagtttttcatgtccctaagttctttagggacatgttcacatttctcaaaaatccaactgtattaacagtctgagatatcatcttctctcagctagatgagctcatttatcccagctggatgacctttacagtcttaaattctctcttctaccagatttggcccctacaagctattctctacagagttgcctgagtgatttttctgaaattcaatttgatgatttaattatgtaaatcttttttttttaatttcagttggtttcagggactcaaaaatatttgagaacctggcctctatctaaaactccaacttcatctcttcattcttcacctagtcatgattaacttattttctctatatcctctcacattcaagcctttatgttttctgttctctctgcaaactttgttaatcaaagattaatgagttcagtgggggcaaaaatataacgattttctaagaaaaaagtctgctgattggggaggcacagaattcagtaaggtgaaagtacattctctgtagaaaaaaaagtgaagatctggcttaaaaggggaaagttcttactcaggttctcaatcaagtccgtttatgcaaatcaaagattcaaacttgtttgg

SEQ ID NO: 195317 - DNA, 436 bp, Homo sapiens
agacaatgaaatattattcagtcttaaaaaggaaggaaattctgtcacatgccacaatatggacaaaccttgaagacatgatgctaaaataagccagtcacaaaaagacaaatgctgtatgattccactctatggggtatctaaagtcatccaattcatagaaacagaacagagaatggtgtttgccaagggctgggtggtggatggggagctgcggtttaaagggtagagtttccgttttgtaaggcaaaagagctctgcagagctgttgcacagcaatgtgaatatacttaacactactgactggtacacttaaaaacagctaagacaataacaacaaaagccacaattctggagtcagacttgggtttgagttccagctctgtcacatggcctggggcaagttgtcaaatgtctctaagcctcagtctcccca

SEQ ID NO: 195318 - DNA, 337 bp, Homo sapiens
ctgcccatgtagctgctccaccccagggagtccagagtgtatccgctctattgggaagaattagagagaggcgagtaatatcctgacattcaggtgttcaatgccagctgtcagcctctggcccctgccagtgttaggaatgattcccctgtcctctggggtactgccctccgacgacaacttaggatcagcatttaaaaccctttctgctctcgtcttaggtaaattatagaccagaacgggtctataatctgatcaaatatcactctcctacttacaggactcaggtggtgtggctcaggtggtgtgactcaagtggtgtgactcaggtggtgtg

SEQ ID NO: 195319 - DNA, 259 bp, Homo sapiens
ctgattatgatgcagtgtcaaacagcacacccccaaattccacaggtctcaactttccctgggttgcttctcggtacccatgtggatgtcttgggtgggttgcaaagaaataagatttggttttgcccaggtagtcactgaacagtgactggtaacctttccccactgcgcgccaccttggtgaacccagacacttaagagccagcaaacctgcctcctgggagaaaaatagggcaaatgccagcccatgggggggttt

SEQ ID NO: 195320 - DNA, 444 bp, Homo sapiens
gagacagggtcttgctctgtcactcaggctggaatgcaatggcatgaccatggctcaccacagcctcaacctcccggattcaaatgatcctcccaccgtagcttcccaagtagctagaaccacaggcgcatgctaccacaccaaactaatttcttttttaaaaaaagtttttgtagagatggagtccccctatgttgcccaggctggtcttgaactcctgggctcaagtgatcctcctgctttggcctcccagactgctgggattataggtgtgagccactgcacccagcctcatgctgtaattgcgataaactgtttctcccaaatgctaatatgagcatgagagatgatatggcatacaatagcatacttatttgctatttgattttggacaatttatttgtctataccagggtttcttcatctatcaagtgggaataatcc

SEQ ID NO: 195321 - DNA, 1469 bp, Homo sapiens
  misc_feature (1430)..(1431): n is a, c, g, or t
  misc_feature (1436)..(1437): n is a, c, g, or t
  misc_feature (1443)..(1443): n is a, c, g, or t
  misc_feature (1447)..(1447): n is a, c, g, or t
  misc_feature (1453)..(1454): n is a, c, g, or t
  misc_feature (1465)..(1465): n is a, c, g, or t
agcgtctctgcagggggagcaagagctgcccttccacccctcccaggggacgggtaggggcactctgggcttttcccaccccctcacgcagggacacaggcctggtgggtctatgactgaaattggccagaccgcattctggtggttttattcggaagggaagtttaccctgttcagcagaagctgagatgggaacaggaaacccacagggcccctttattcggcaaaaatgtcagtcagcgccccggggagcagccgagggtccctgagtgtgtgagtgaggtggggaaacacagatggactttggggggctcccccttctacaggaaacccggagtggactggaatggtgcagggggagaactcgcccctcccatcgggcgcctccttcataccggcccttcccctcggctttgcctggacagctcctgcctcccgcagggcccacctgtgtcccccagcgccgctccacccagcaggcctgagcccctctctgctgccagacaccccctgctgcccactctcctgctgctcgggttctgaggcacagcttgtcacaccgaggcggattctctttctctttctctttctcttctggcccacagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttgggctaatcatatgtgtgaacaagaagaaagccaaggggtgatgtagtcaaggtgatcgtctccgtccagcggaaaagacaggaggcnnaaggnnaggccncagncattgnnggcctgcaggncctc

SEQ ID NO: 195322 - DNA, 1137 bp, Homo sapiens
  misc_feature (1098)..(1099): n is a, c, g, or t
  misc_feature (1104)..(1105): n is a, c, g, or t
  misc_feature (1111)..(1111): n is a, c, g, or t
  misc_feature (1115)..(1115): n is a, c, g, or t
  misc_feature (1121)..(1122): n is a, c, g, or t
  misc_feature (1133)..(1133): n is a, c, g, or t
agcgtctctgcagggggagcaagagctgcccttccacccctcccaggggacgggtaggggcactctgggcttttcccaccccctcacgcagggacacaggcctggtgggtctatgactgaaattggccagaccgcattctggtggttttattcggaagggaagtttaccctgttcagcagaagctgagatgggaacaggaaacccacagggcccctttattcggcaaaaatgtcagtcagcgccccggggagcagccgagggtccctgagtgtccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttgggctaatcatatgtgtgaacaagaagaaagccaaggggtgatgtagtcaaggtgatcgtctccgtccagcggaaaagacaggaggcnnaaggnnaggccncagncattgnnggcctgcaggncctc

SEQ ID NO: 195323 - DNA, 1295 bp, Homo sapiens
agcgtctctgcagggggagcaagagctgcccttccacccctcccaggggacgggtaggggcactctgggcttttcccaccccctcacgcagggacacaggcctggtgggtctatgactgaaattggccagaccgcattctggtggttttattcggaagggaagtttaccctgttcagcagaagctgagatgggaacaggaaacccacagggcccctttattcggcaaaaatgtcagtcagcgccccggggagcagccgagggtccctgagtgtgtgagtgaggtggggaaacacagatggactttggggggctcccccttctacaggaaacccggagtggactggaatggtgcagggggagaactcgcccctcccatcgggcgcctccttcataccggcccttcccctcggctttgcctggacagctcctgcctcccgcagggcccacctgtgtcccccagcgccgctccacccagcaggcctgagcccctctctgctgccagacaccccctgctgcccactctcctgctgctcgggttctgaggcacagcttgtcacaccgaggcggattctctttctctttctctttctcttctggcccacagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagttggttggtgacgaacgcccgaagctgggacaagcagtcccactggtatggag

SEQ ID NO: 195324 - DNA, 623 bp, Homo sapiens
cttcgggaggacaccttcaaatgctgaccctgggcccctaactgacctgagacttcagagcttcttgggaggagctggggtcccccagcggagcctgggatggagcagggatggctgccccagggagggggcggtggggccttccatcctgctctgccctcctcgtcctctggccccagctcagtcctgtccatctccagctctaaccatttttgtcccgacactggctctccctctaccttctgtccttgtctgccactggtctcccgtgctctggggtctctgcactgctggctgcctcccgcttctctcccctctccctctgccgtcctgtctcctttgcccagtctctccttgtttctcttctcctccttccttctctccacctccccatagccgagcttggaaaagtcagacagacctctgaggtctcatcctggagctgccaccagcccagcctccctgggacctgtcttcactgcctggggccctgggagccagggaggctccctgaggctgagtgaacactgggcgctgcacctgcctctcccacgtcctcggccccactcccgcaggtgcagctggctggtgacgaaggccggagctgggaccagcagctccca

SEQ ID NO: 195325 - DNA, 601 bp, Homo sapiens
gactctagaggaccccgcgtgagctgtggcataagaaaaataatcagtttaataattacaacagtgtagcatcaacattgtagtagtcaacactaggacattgtctgtgacatttagattaggagtttctccacacttgtcaacaggcgccctgggtgtcccagagaagtgaagaaatgattggcattaaggagtccacacaaccagggcaggcattcaaggtcccagacgcccagtgcatgtggacaagcacagacgccactgagtgtgaaggaacgagcttctgatgctacattccaacaagcgcctggctatggcgtctgttggggactcatctcgtaaactttaaagaaaggaccttttaaaaggccagaagttaaattatcttgaatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacg

SEQ ID NO: 195326 - DNA, 191 bp, Homo sapiens
ccagtttactacttttctattcagctatgtttaatctgcttttaaacgcattgtcttagtccattcaggcttctataacaaaatactacaaacgaggtagcttaaaaatagggaatggccaggcatggtggctcacgtctgtaatccaaagacattgggaggctgaggcaggaggatcacttgagcccagg

SEQ ID NO: 195327 - DNA, 706 bp, Homo sapiens
caccacaaagccctccaggcacagctcagcattttgtagaccagcattaaatcttaaaagaagtaaaatgctgccttctcgtggcccatgtacaaaactgatgaaaacagtattgttccttcctgttattgaaaagcagccaagtccaaagcagagagcagcagtatttagattttaaatgagtttgcaaataaaaagacaagagtaccttaatatgacatgagtaaacctttcaggaaataaaattttgaatcagatcagatcaaagtgttccaaaatggggcttaatactgtaattaccaccatgactctgcatatatgcagattttcccccaagggagctcaaactttgactcaaaatccagtaatcttgaatcctggtctaatccttaccatctaaagaaagcacacttatttagagtaattgttcaatagaaaatttatcaggtccttcctcatcctgcccccagccagatgtgttctcttcctgctctgaattccaataagacataatgctacatgtatatgggtctctttttctgtccacaagtaatagttttagaacctttgtggcctctaagatgggcatgacacatggtgcatgcttaagaagtgtttgaataaattaatgaataaataaatgggaattaaatgatgaataaatgtatagctgtgataaatattccctatttcccttatttaagca

SEQ ID NO: 195328 - DNA, 994 bp, Homo sapiens
aaaaaaaaaaaaaaaattagctacagttgaggttatttaggttatttccagttagaagttctgataccattaataaatattttacctttaagctcttgcagagtctgccatgttccttctactcacagtccacacagactaagcagagctaaagatgcagacagggaataaccaagttcacacttcatctaggatgttttcctgataccccctaacctggagttaagtcatcgtctttggtgtttggaagtcagatgttttctattgaattgatgcctacatagtacccataactccccactcctgacattcgtcacactgtgatgcacctggcagctttctagtcccctaagctccttgggaagggtatccattttatcctcagttcacctagcccagggcttggtgtttgtctagtacaggtcatcatatgattgttgaatttttcaaatacacagatttttcttgaaacctcttgatctctgtgttggtctcttcctgccccctcccttcctctcctttcttctccctgttcgtgcagttgaaattctgacattccaagagcatttcagctccaccaaataggacttccacatgtcacaaaacgcaagacagttattttgaatggaaactttttgtacccctttggtagaagtttattttggggtttgtctatgcatttaggtttcactgcctccagatttatctgggtggagtaatatcacataagtgtgaactaccttcctgttttgttaaaaatatcaagagcaatttctcttgatgataagaggtcaactgaagaggttgatgagcatatcctagttatcttttgaactaaaatatttctcagagaaagaaatatcctgtaatttggttagtcgtcttaattgttcatcttctaacatgtatgaacattataaagaaacttttttaatacatgaatagtcctggtctcttaatgtgatcatttttctccatcagcctagttgctggt

SEQ ID NO: 195329 - DNA, 242 bp, Homo sapiens
ttgggatcttcaggtttctaggctaatctagatgccttcctatttatcattcttttcttgagttgactttctgattatagtgaggccaggtcaacacacagtattctaaatatatggtcaggatggtttcttctgactttattcaatatctttatttgtataatgaagaactttggttgttcttatttctgctatgctctgttagaattggaattttatcttccaaatctttagaacttttt

SEQ ID NO: 195330 - DNA, 666 bp, Homo sapiens
agcagtaggtcagaagaacatgcgtctcagacaccacagaaccctgcctcagttatggaccacctagctggacttttatggaaaagacaaactttttaaaaaacttaggatttttagttactcacagccaaatctcaccatgactattagaggctagcaatgccaatttagaaatacttgagagagcagtagcatcgttattaaggacccagagcttggggtccagttggaccatgcgtggaggttcaaactcttgctaatcatcctgagtggatgcaaaagtcagagcctcccggcccccaggctggtaaagtgaggcagactcataaacgactgtgataaaatgtgatcaattaataagaatcactgccccatgaaactctgccaggcagtctgttcccattcccacctactcctgaaagccgtgaaaataaaacacagtcccttttaaaaccaagaccttttgggccactctgtgcccagggaagcaggactactgcaggagtcccctggccgccggggaggagcgtgggcagggtctgcagaggcgagagagagctcggactcagacatgacacacggcccacctgttagagcatatagctcctcatactgctgtttccaaagcatttgcacagtgccagattgtacagaccacaaagaaaa

SEQ ID NO: 195331 - DNA, 200 bp, Homo sapiens
aggaaggggtgagtgaacaaaaactagagcttggaagaccagttaggatgctgttgcagtaacttgaacaagaaacgtctggccaggtgcagtggctcacatctgtaatctcagcactttaggaagacaaggagggcagattgctttagctcaggagttcaagaccagcctgggcaacagggcaaaatcccatctctacc

SEQ ID NO: 195332 - DNA, 101 bp, Homo sapiens
cttagagcacctggaatgtcaatcatattcccactggagagatgtgggctcaggcagaatttacacacagcagtcaccaggcagggtattaataaggttaa

SEQ ID NO: 195333 - DNA, 352 bp, Homo sapiens
cttagcctcccaaagtgctgggattataggcgtaagccaccatgccaggacttctctgccttctttagttattgttcctgtacccacttaaccttttgtaaatatcattattctcttttgggagggagggagatttctttctttgttaatgtagtctctaggaatagggatatacactctttttaatattactattttgattcttgaatgggagccaagagttcatgttgatgttatactgtgctgttatggccactgagtaatattaataatagtcaccaattccatgggattgtaaaacaaattgaaagctgtaaactctccattttcaagaattagagctggagttagt

SEQ ID NO: 195334 - DNA, 401 bp, Homo sapiens
ttatctctctgatccttatctctctatccttagtctctctatccttaatctctctatccttaatctctctatccttatctctctatccttaatctctctatcgcttaatctctctatccaaaatctgatgcctactgtactcactatgccctctggatatctttttaaaagacttaatccctggatcaaatagccatttagactatttcaaaagctctaggtcccaatcttaatgttaggtaagccttccctatctctccaaatgtacatgtacctcatgttagataactgacaaccaccaacctccagcttcccctagatatgctagggacattgtcaagacttgtggttaccagacctgagtaagtttactgttaagactcaccagaggatatcctaag

SEQ ID NO: 195335 - DNA, 149 bp, Homo sapiens
ccttcaaacaagagcttttcagaagctggggaggtctgctcctgcacctgtccagccatgacaggatggagagtttagggatgattctccagctctgcacccacctgatcctctgatggagggtccagtccagcttcacatctgcgcct

SEQ ID NO: 195336 - DNA, 169 bp, Homo sapiens
agattgagtggtaccggattgagatagcacggtgccaggtaaccagcccaggcctcgccctccagctcaaggcgggacaagagccctagagtggcctgagtccaggtacaggccccagcagggtgctgacgcatccacctccatcccagatcaccgtgcttatctcaat

SEQ ID NO: 195337 - DNA, 487 bp, Homo sapiens
gacagtactgacatttcatcttcccgaggcacgtcccctggctccgtgatgtggccgtacaacaagcctgccctttgttacggtgtgtgcacacatgtaagtgctctcgacaaatctgtgttcctgcctctcctccagtgcttctcaggcaacgacgttacccttggcctcaaggaaaaaaaacagacaccgttggttggagattactgagtaaacctacaacgtcctcatgcttaaggccccgtctgtgattccaccatgaaggtcacatatcctctctcctaaaaagacctcatgtctccatttaagtatttgtttgggaaaatgctgtattgtattgaaattattgtataaagatagggccttggtacaaaatctaggaatgtgaggtttaaacacagttggataaatttttaaaaatcacattgcaaattttaattaaggcgagggagcttaatttaaacaaataaatgattagtgttgacta

SEQ ID NO: 195338 - DNA, 402 bp, Homo sapiens
attcatcctatattcgtgtgaagagttcctctttttctcatcacttccagtttttaaaaatctcttctgtttccatggtaattgtatatatcaacaaggactttgaacactctccattttcttggatttattgaatctgatgtggttaataatgcttgggaaaacttctcaaaaaaaactctcacaaacacagcaaatgcattgatggtgaacagcacagtttttgagttcaaaaggcagcagtgtacattccatatcatctgctgttaccatgtagtatgttctcacaggagagcttgggattttatctgtgaatatccataggttgaaagttggtaagcaaaagaacatctgtaactaacctactctttttctgcaggtttgttgttgggataaaagtta

SEQ ID NO: 195339 - DNA, 167 bp, Homo sapiens
ggaagatgagaaggaaagagcatcctgggcagaaggcacagcatgagccaaggcccagtggtgtttcaggacagttgaggaactgtaagcagtttagttggggggaatctgagagaggagacagagaagcgaggaggggtcccttcatggaggccttggggccacag

SEQ ID NO: 195340 - DNA, 287 bp, Homo sapiens
agtgaacacatgcatagctactactttatgcaggccttgttgtaagttctttacatatattcaatgtttttctcatagaaagacattcttaagactgtgaagagagaagaaaagcaggaaacagaattaaggtatttaaggtacttagtccagggcctggcacatagtaggcactcattattgttgttgccaacaaaaggtctcaagagaacattcagtccccttcctccccctagataacgaccctccatattctgaagcattcactgaatcttgctccactatcg

SEQ ID NO: 195341 - DNA, 371 bp, Homo sapiens
caatgaagcttctgagaatgcttctgtctagagtttatatgaagacaatcccgtttccaacgaaatcctcaaagctatccaaatatcctcttgcagatattacaaaaagagtgtttcaaaactgctctatcaaaagaaagcttcaacactgttagttgagggcgcacatcacaaataagattctgagaatgcttctgtctagttttcaggggaagatatttcctttttcaccataggcctgaaagcgctccaaatgtccacatccagatactacaaaaagagtgtttgaaacctgctctatgaaagggaatgttcaactctgtgacttgaatgtcgacgcggccgcgaatttagtagtagtaggcggccgc

SEQ ID NO: 195342 - DNA, 280 bp, Homo sapiens
ccgtctctaccaaaaacacaaaaagttagctgggcatggtagcgcacacctgcagtcttagctacttggaaggctgaagcaggagaaccgcttgaacctaggaggcagacgctatagtgagctgagattgcgccacttcactccagcctgggtgacagagaaagattccatctcaaaaaataaataaataaacaaaaaataaagaaagtataaataaaactaacccatgataagagcactacaggaacactggcctgagcagcagtcagcagacggccag

SEQ ID NO: 195343 - DNA, 305 bp, Homo sapiens
ttattttttgtagatatgtggtctccctatgttgccctgactgatctcaaacccctgagttcaagtgatcctcctgcctcagtctcccaaagtgctgggattataggcgtgagtcactgtgcctggcctgtcatctggatcttgactcagcttttcctctgtatgaaggcttccagcagcatcagggaggttgtatacacaacccccctgcccaaacacacacacacacacacacacacacacacacacacacacacacacacatgcttagaacgtgaatgatggagccagactgcctgagacca

SEQ ID NO: 195344 - DNA, 251 bp, Homo sapiens
gatgctggtgccatgtttcttgtacagcctgcaggattgtgagccaaaataatctctttataaagtacccagcctcagaattgtttttatttttataacagcacagatggactaagacatctcctttgagtgtgctcagaggtatgttcaaatctctcaagatcaaaacactcaagtcacatagtggcagggcgtctcttccatttctgctaatagtgatgtctcccctggaaaaagcagcttgcttcatg

SEQ ID NO: 195345 - DNA, 686 bp, Homo sapiens
tggagcattggtgttccctgatctgtgctccttttgcccacctggtttaatgctgttggtccctgactgtgattcatccttgagttctttctttgctgcatggtggctcagagatcagtttaagtcatttaaaaataaataaacatttcacactgaatgagtagttttgctctttgcataaagacaagtttcccaagacttcctgcttgatgtgtgatgagttccatttctagaatttttaggcgctctttcatattatagaaataacatctaatagctttgctaggaggtgattaatcttcctccctttctccctcctttcttctgtctttgtctctctgtcagtatttcatctactcagaaatgtttattgagcttctacttagtgccaggtactgatcacgacagagttggggaggcgctggtgccagtgcaggagaggcctgggggaagtatagtggcggatgtgaaagggttcactaacttgttgagagggtttgggaagcttttggagaggagatacatttcctctgagccttggagcatggacagatgattgggcaaatggaggataggcaagggtggttagaccaaggaaatggcgaggaggcaggaaagaacatggcaactattggggagcaccgcacacttacgacagctcaggtatggggtgtgtggtgagatat

SEQ ID NO: 195346 - DNA, 484 bp, Homo sapiens
tggagcattggtgttccctgatctgtgctccttttgcccacctggtttaatgctgttggtccctgactgtgattcatccttgagttctttctttgctgcatggtggctcagagatcagtttaagtcatttaaaaataaataaacatttcacactgaatgagtagttttgctctttgcataaagacaagtttcccaagacttcctgcttgatgtgtgatgagttccatttctagaatttttaggcgctctttcatattatagaaataacatctaatagctttgctaggaggtgattaatcttcctccctttctccctcctttcttctgtctttgtctctctgtcagtatttcatctactcagaaatgtttattgagcttctacttagtgccaggtactgatcacgacagagttggggagatgttatgcagaatccttagccgggaacgtggccgtttaccaggaagacagatctttgggcaattg

SEQ ID NO: 195347 - DNA, 314 bp, Homo sapiens
ataaaattggagcataggaagagatcagtaagactttaagtttttaaaaactttttagaaaaattcttactctgaggaatacacagatcctaacctgttggggttttcctgtcagaaagtagtgctgttcaaacagattgtgttttttcaaacttttgactgtgatccacaataagaaacattttcatttattttttagagactgggtcttgctctgttgcctaggctggagtacagtggtataatcagagctcactgcagccttgaactcctgggctcaagtgatcctcccactttggccttccaaagtgctg

SEQ ID NO: 195348 - DNA, 586 bp, Homo sapiens
tggaaccttggaacttcaaaccttttgagttttccttctttccagtgcttagctgatacaatcaacattgagttgttttctttgtccctttctgagatagaatctaattcttgcacttatgaatttgagaatctttaaaaatattttctcatttcataaacatgattagctcgagaatctatatgtttaggggctacatgcaccttgtcaaattgttcctttccattcttgatttccggaaaggtcactggaattcctgcaagtgtggctctgctgttctagattgacattgtcgaccctgaaggaagcgatgttgatgttcacagagacctgcagagtgacctctcctccaaatgcctcaaaataaatgatggcatgcctgagactacatttagtgccatttggctaccaggcttttctaaaaccttaaagttaatatttaaagtctctttttaattaccagtaggtaatagcttgttctaaattaatgctgattgactaaatacatgactgaatgattgattgggtcatcattgaatagtatggaaattttaatttgcttttatagatgaatgctcagtttgtg

SEQ ID NO: 195349 - DNA, 264 bp, Homo sapiens
tacagtgagccataatgcaccagtgcactccagcctgagagacagagtaatatctgtctggggaaaaaaaggtgttttcattggcttcgttttagatgctgctgcaaaattcaagttaaagctgtctctctcaagaaacttcatttaaaatgcattcctatgaaatttatatccttattttccgagtcagaaacaacaaatttcattttataacaaacataaataatcctcaaagtattcagaaatgcttttctgagccactgt

SEQ ID NO: 195350 - DNA, 264 bp, Homo sapiens
ctaaagtatacacttagaaaggattatgatacatttcacgttacatgtatatgactacaattcaaacttttaaaaataacttaatagagactgtgttagccgggtggatcacgaggtcaggagttggagattagcctgaccaacatggtgaaaccccgtttctactaaggcaagagaatcacttgaacccgggaggcggagcttgcagtgagtcaagattttgccactgccctccagcctgagagacagcgagactccatctca

SEQ ID NO: 195351 - DNA, 282 bp, Homo sapiens
cacagcacaggctgcgagggaaggaaaattcatcaagtctaaactatcttctctcttctggcacaaaagtaagtgacatcaacaggatgtggggtttcaggatgagccttgagtccgatgaaatgaattaaacctcacaactctttggaacaggaacctgttttcatgtgagttccccaacagcttttgggggagccttgaaacaaatggatttagcatctggagatttttggtaggtttgatttgcttctctaacatccggtacttttgcaaaaatctttg

SEQ ID NO: 195352 - DNA, 241 bp, Homo sapiens
gaatctgcaaagaatctgctgtgggtcagaccttatttctaaggtaaacattaaaaattctcccttactgggccgggcaaggtggctcacgcctgtaatcccagcactttgggaggccgagatgggtggatcacctgaggttaggagttcgagaccagcctgaccaatatggagaaaccccgtttctactaaaaatacaaaattagctcggcatggtggcgtatgcctgtaatcccagcta

SEQ ID NO: 195353 - DNA, 258 bp, Homo sapiens
aatctatcaagaaaatttgtataatcacagaattctataaacatgtttcggattcactaattcattcaacaaatatttattgagtacatactatctacccgaatgccaaatttctgctttagaaaaacatccttcaattattgtgcaaaaaaaggaaatgttaaagtgacttatggtctttctgctagaatcatacatttacagaagaaaaggaacagcatccaaattaaagaaatgtaaatttggatctgtccatcc

SEQ ID NO: 195354 - DNA, 193 bp, Homo sapiens
acagaaaagacaaatattcgaagtaatgatacttgatcattacacattctatgcgagtaaacatcacatataccccataaataggtagaagcattatgtatcaataaaaaaaggtaactaaaagaccagggataatcagacattgtgtgtgtgtgtgtgtgtgtgtgtgtgtgtgtgtgtgtgtgtgtaattt

SEQ ID NO: 195355 - DNA, 225 bp, Homo sapiens
gtagtgtaggaagcaggaaaaaatttgattaaataattttaataatctattttatgcaacctaatgtctttttaggcagataatactgaatcttccactatgcctatttttttttttttttttggtggggggaatatgaaattcctaaagttttcacggtattttctaataatggtcttcttggagttgttccaggaatatatgtgtttagctttaataaccccc

SEQ ID NO: 195356 - DNA, 204 bp, Homo sapiens
tgagacgaccttgtgttttctttagattttgccattcttgcgtagtttcttttctttcgtgaccaccaatgtaatttctttatagattattagatcatttactttcagccttcttttctgatgatttaaggcttaggtttccatctaaacataattttaactgcctgtcacagtcttgtttgtggcaaatgagggttgtttaga

SEQ ID NO: 195357 - DNA, 250 bp, Homo sapiens
acagtgcgtgatggtttcaatctgtaaacaagcatgctaatttctttttaatgggaaatggttttaaccttcctgttacaattctgtccaaaagatttatagaatcctgaaggtggaatgaaacataatggtcatttcatgcaagttctactctaacccaatagaggaattccttcaccatcttgtccaagagtaaccgtcaaaccagtcttctcacagacatctaaacatcatctaatgatccgttgac

SEQ ID NO: 195358 - DNA, 514 bp, Homo sapiens
tcatgatcttaggggaaaaacattaatgaaccctaatgttcattatagggttttgtttggtagatgccttttattaggtaagaagattcccttctattcctggcttgcttaattttttttttaacaatcaggaacgaatcttggattttgccaaatgttttttctgcctttaatgaaatgatctgatcattttaattgtttagtctgttaatacagtgaattacactgattgattttccagtgttaaagccactttgcagtcctaggagaaatcccactggttgtgatgtacagttgtcttcccttatccatgggggatgtgttccaagacccctagtgaatgcctgaaacctcagatagtaccaaaccctatatacactatgttttttcctgtacagacatacctatgataaagcctaatttataaattaggcacagtaagatattaacaataactaataataaaatagaacaattataacaatatactgtaataaaagttatatgaatgtgg

SEQ ID NO: 195359 - DNA, 262 bp, Homo sapiens
gtttgattacattccatttgattccattccattcaaatcaattacattgcattccattacatacgattccattctattcctgtccattccattcctttccattccatttgattctattccattagaatccattccatactattgcattccattcgattccattctattcgaataaattccattcgggaccattcctttcaagttcattctatttgagtccattgtcgacgcggccgcgaatttagtagtagtaggcggccgc

SEQ ID NO: 195360 - DNA, 169 bp, Homo sapiens
gatgagttaatgaaaaaagaaaatactgtttatttcataatactttattgttgtattttggaattaaggtggaattcaaagaatcccactccaaagttatttgtttgtatacttatagtatttgtgtgtactttacaatgctagggtagctttgcggcctttccaaaag

SEQ ID NO: 195361 - DNA, 200 bp, Homo sapiens
gtgaggaagccaaagagaggcctatgaaagcttatgacgcattttccaagtgcacaccccagcaacttcaaatgctttctgaagtaaggatggggatggatggttggataaatggatgggtgtatgggtgtgtgaatgggtgagtgggtgggtggatggatggacagatggatgaatggatgggtaggtggatgaacagg

SEQ ID NO: 195362 - DNA, 440 bp, Homo sapiens
gatacatgcacacttaccgtacgcttggcccagcaatcttactcctagatatgtacacaaaagaaatgaatacatatatctacacagacttgtacccagatattttgagagatttattcataatagccaaaaatggaaacaaccccaatatacatcaactggtgaaaggataaacagatagtgatatatatctgtttatatatcagatctctataaaagcaatataataatagaaagtagatcattggttgccaggagttaggagctaaggaaggtaactgaaaagagccactgtgcccaaccaatttaaagcacttatagcaacaaatattggtgaggatgtggagtaacagaaagctcatgcattgctagtaggaatacaaaataacatcttggcatttataaagatacatgcacacttaccgtacggtacggtgtcg

SEQ ID NO: 195363 - DNA, 245 bp, Homo sapiens
caccactcctataatcagtactgtattggaggttctaaccagggcaattaggtaagaaaaagaaataaagtgcatctagattggaaaggagaagtaaaactaactctatttgcagatgactgatgttgtacaaagaaacccctaagaaatccactaaaaactaggttgggcacggtggctcacgcctataatcccagcactttgggaggcggaggcaggtgaatcactgatctataggagtggtg

SEQ ID NO: 195364 - DNA, 383 bp, Homo sapiens
tcctcatctgtgtcagtattttccaaattctctataatcactatgaattatttgcaatctccctctacaaaaaaaaaaaaaaatatatatatatatatatatatatatatatatatgaactactttcacttaccatttatacaatttcagtgaaaaagtcttaacactaacaaagctttcaattatgtctgctccaggccttagaggcaggagactgtggtgtaaatgtgaggcagaacattctgaccaggaaaggctgatgagcctgatccagagactgcagagcccatgacttccattccataaatacgtcatcatcatcttgcttagcaagtgtggatttttacacacattctgctagttaatcttcctaataaccaagt

SEQ ID NO: 195365 - DNA, 245 bp, Homo sapiens
caataaacatttagatggatgactatggatgaatagatgggtggatcactggacaaggtagagcaggggttctcaaccttggtaccatggacattttaggccaaataattatttgttgttggggtaggggtgctgttctatgtgttaaatgggaggtttagcagcatctctggcctttacccactagatgccagtagcatcccccaaaccccctactgtccattatgacagccaaaaatatctct

SEQ ID NO: 195366 - DNA, 286 bp, Homo sapiens
cagaaaagagatgctcaggatacaatcgatgcgcttcgagagtgactggaggtggggcactgtagaataagtgacatggagagatctagattgacctctgggcctacagctcaggaaaatgggtgggaggtggcattcagagagaccaggagcactccttatctttcagagcccaacacataatcaccaacagctgacttatgaataagatcttggggtccttgaaacaccgaaacactggaatttttagaattttacattcttactgcccaagaaaaccccttgc

SEQ ID NO: 195367 - DNA, 758 bp, Homo sapiens
aaatcactgtgacccttggaggctggtatcttgtatcaatatgattatgactatgctgagcattcatcactgttgactgaagttttatgcttctgttagcctggattgagctatattgggatatacagtgtggatatgttcagcagagttagtcagataatgttgagagattctttttggcttctcgtgaactgggtactccatgcttcatttctctctgccacaactggggaatgaaagtgggaagagaaatgggctgggatgctgtgtatttgtaggggatcagcaaatcatcaaagaatttctccttttcctcagaccttagaatctaggctgtgagcctcaaaaggaatggggcatgaagccactggcaacattaacttcatgcttttcccccatttgaatcagatttttggaaggtagagattttgcaagattgtgaccaaaaagccatttcatttttcaataataccatttgtagtttacatatatataccattggtagtgtgtatatataaatatatatatatatatatatatctctttacaaatacatctgcctgatagactttgtgtgcagtcttctgtcctggactgccagggaaagtacgagagtgtggaacccacacagatctgtcccaaaaaatgactatatattataattttgcatgagtttcctgaaaaatctgttcacaaaggaagaacctagagggtaaaaaccacttgaaattctgttatgaggtgttcatacgatcaag

SEQ ID NO: 195368 - DNA, 424 bp, Homo sapiens
atggtatccagtgtctagcagcagccagtgccagtatggtcagacagatgagaggacaatattgcggcattcaggttaaggcaactcaagagacaaatggagactttttagggtgggtttatgggcaggattccagtaccagaatgaaggtagatgtattacagcaggaacatgtcagacggggtaggatcttggggtgatcaggtacaggttacaattgagtactgagcacaagttggctctgtgggaataggacataagccttttcttgtctccctccaacccctaactaagggggttgctaagttcacaaggcgtgctaggttttctacagacatcaaaaatggtcattgagaactgggacagcctgagtatgtaggtttgtcaaggtgatcacagttgtggtgatgctcaaagatctttg

SEQ ID NO: 195369 - DNA, 472 bp, Homo sapiens
atggagtcatagttttgatggagagaacagagaaacaagtgttaacatctttctactataggtttttttcatttttaggctattttacttgtcaaaggcccctgagaacctgtagctaaggaactcttagctttccagtgataataacaataataacaacattctgtacttactttgtgccagaaatgctccaagtactttacatgtgttaataatgctcacagcaatcctaagaggcaggtgctgttattatccccattttacacatgaggaaactgagatacaaaagttaaataattgtcacacagctagtgatagaactgggattcaaacctggggagtccggcttcagagtttgtggtcctgcagagacaaaacagccgcttttccagtattttcccagtatggtcagagaagacctgggtgcttgccaagatcctttgacctttaggaatatttccctacagcctta

SEQ ID NO: 195370 - DNA, 693 bp, Homo sapiens
ttctgagattacaggtgtgagccactgcgcctggtgccaaataaaagccaaaacacatctaatactaaacattgaaataaacgtgagctgtgcatacgtttaagaaaagttgaaaagctatatagttctttacccagttacttaagaagagttgaaaagctatctagttatttacccagttatttcagttcagagtctcaggaaactagaacctgtctagccagctcaaggccaaggtgggaaccgatcttggccaggagaccatcccattgcaggacatgctcacacctgtaatctcagaactttgggaggctgagagaggctcctcagcctccgaagaggtgaggccctcctgagagccacactctaacttgatgaagtagttggtccccgcgaccacctgggtcttgaatgagacgggcttaaacacagggacctgcttgttacctttctcttcaagctgggacctcagctagacagaagggacagaatgaggatgtctcagtggcttcttggattccctcctgctagagtaattgcacgcatgtgagcacgcacacgattctgacactggttcttcacacaattgtctcttacaactgaagggacatttaaactgtcagcctaatagtaaagtagacaaaaacagttccagctgagtacggtggctcaaggatgtaatcccagaacttt

SEQ ID NO: 195371 - DNA, 331 bp, Homo sapiens
ttctgagattacaggtgtgagccactgcgcctggtgccaaataaaagccaaaacacatctaatactaaacattgaaataaacgtgagctgtgcatacgtttaagaaaagttgaaaagctatatagttctttacccagttacttaagaagagttgaaaagctatctagttatttacccagttatttcagttcagagtctcaggaaactagaacctgtctagccagctcaaggccaaggtgggaaccgatcttggccaggagaccatcccattgcaggacatgctcacacccacattcactcagatcggaaccattcagacttgcaagtttac

SEQ ID NO: 195372 - DNA, 370 bp, Homo sapiens
tcctgccagccagccacactcactagatattttgagaggagcccgggacaaggggttaagtggactgtgtccttccagcccagcctgcctcttgaattccctctgagaaggtttggccaacagtctacttttccaaaacagagaccagaaacacccctcacactttcttcagagagggtgtaagcatctccagggatcagatggctcacttctacagacctaagatgataaatgctccagggactcaccagcagtagccagagcagcccctttaccttccaggaatggggaggagggcttcccagcagcactaaggtttgctttcggattcaaagcaccagcttccccggcagagacctgggtatagaga

SEQ ID NO: 195373 - DNA, 325 bp, Homo sapiens
gtgcacttacagaaagtgtttaaataaaagtgatagttattcaaagagatttccactttgaaaatagtcttcaaagccagtgtcatttacacagacacatttggaattttcccttttcatgattatgctcaagatgtatcattttaaactgaaatttgacacactttctatatggtgatatgtggttggggctgccaactaggcttagaaggtgaattacacatagctcgtattctctagtattctccttcctgctaccaaatgttagtttgtagctgcagactgcattcattgttttgagtagaaagaaactcccatccctaat

SEQ ID NO: 195374 - DNA, 461 bp, Homo sapiens
tgagaccagaagcatgaggaggaagtgttggccaaataaagatagaaaaaagcacaagggcgcacaggtgcccaagaagatgaagtgacccaggaactgaagggggtccgtggctgatgggtagtgagaaagggtagagcagtggagtgtgagagtaagcagtggtcagctggggtcagtggcctagatttcattctgaatgcagcgggaagcctgacatgacccttgtacctccttcaggccatggaaaatgtttctaagctcctacttaaagcttttcaagcatcagagaatcctcttaacccagagagggatatgatgttgacagagcaggtttactccaaaagtcggcttgaggtcaagtcatttaatcttcttactctatatgggatttggaacagaaagggaagaagcagagtcctcccatccatctgggaattcacccagcctgcttcctgtag

SEQ ID NO: 195375 - DNA, 442 bp, Homo sapiens
cagccaagagtgagaggtctggggtatgagagccagggcagccttctgtttggggaacacccagagacgactgggaagtcccagtctgcacacagttgaaggggaagtggaagagggatgtgttgacttctcaagtttcgaataggtgaggacggtatggctgacagttggagggttcagagcaccagaacacactcaggactctgaaaggcaggccccgggagataacttcagagggtgactagcagcagccagcccatgggcctgagaccaccactattcccaatccctggtttcccccaaagcagtctgagcagaaaaaagacctgagtccgccccagactagcctgggtcagccccaccatttgtgaggtccaaaatcctgtgtttgggggacatgtgtggtgagtctccagcacgaaggtggaagggagggagcaca

SEQ ID NO: 195376 - DNA, 170 bp, Homo sapiens
agaatttgcttgctggatctctcttctcccatctctcctcctccttccttccagcacctcctgcaacctgggcctcctcccccatccccttcttggacagcagctagagccacctgggaagcttcaagaatggctgatggttatcgcagccaggacagggcgagctgctg

SEQ ID NO: 195377 - DNA, 389 bp, Homo sapiens
cccaccccaactgtgaaatcttatcagatgaactgctatcaaattgagtatcccctatcatacccatgtactgtttgtgtttatggctaaagcagaattttataactgctgttaattgatcttgttttcatctcaatgttccagatcttttctcttgattctgtcatccttctagaattgaaggtagagacaaagacagaacccctatggccctccattagagtctccctcaagaatgtttccaaagcaccgactttgttactgtttttccattagttacaaatccatttaattttcattttaaccagttcacattttaatatctcatctgaaatcaagttatactatgtctatatcatgcccaaaccagtgtttgctaaccataaaaa

SEQ ID NO: 195378 - DNA, 169 bp, Homo sapiens
ccccgggtcatactttttgtcttggtaaatcagaatggaccacacattttctcagcctcgaatattttagcacccttttcaaccataaaattatctttattaggtgcatttgcccaggattgatagggttggcaaaaagtagattttcacagctttcccccacattctg

SEQ ID NO: 195379 - DNA, 420 bp, Homo sapiens
ttactaatattagaatgctatcacccaaaacttcacaggagtataaatggtacaattagatgcttttgtgtaatgggtagtcaacttagggaattaatactcagttgaaaatgtgaagaattctggaaaggtctaaatataaatatgaaagactgatccatgatgtcacggtaaggcctagatttcaggtgttgacaacatgagggacaactgtcacccacttcactcctttcaaactcccactgcactctgaaagaaactctcacactcacacacgcatgcaataccatttgggtctgactcagtataaccttgctttttttttcttttaacataggaacactataatatataggagatgcctcaaagggagaggctacataaatgtaagatattatatatgtattgaggtgataacaa

SEQ ID NO: 195380 - DNA, 269 bp, Homo sapiens
tttttacttctatgcaatgcaatactgaatgtttataactttaaaaaaagatgtgtaaataaatagtgtattttggaagatttatgtcaaatgtgatttaaggagataattggaggcacttgtcaactttctggaaatttaactcacataaagcatgacaatctctgtttaagagtaaattaagaattattgattttattggggaagcagccaagatggccgaataggaacagctctggtctacagctcccagcgtgagcgacgcagaa

SEQ ID NO: 195381 - DNA, 557 bp, Homo sapiens
tcttttcccgttcatttcaagctttgcctgctccccacccacaacaaagatggttcagatggttcagtagaaactggttatgtggaatgtaaggtaagatcatgctttctcattaggagtcataatcactttcctcattcatattaatatattcatatataataccaaaatcaccaccaagaaaagaaaattagagtaaggtaactttcaatatttggaaaataatacatgtgcaagacttctggtgatagctatatgattttgaagagaaagtaaaattttttataaatcaaaaagtataaaccattaatattacaaataggagggaaattgcaaagcttagcgaaaggcactggatagattgtggcatacaaaagggggtccacgttggatgcagtggcacaagcctgtagtcctagctgctaggaaagctgaggcaagaggatcacttgagtccaggagttccaggctattgtacccaatgatcgtgcctgtgaatagccactgtactccagcctgggcaacacagtgagacccccatgtctaaaaaaaaaaaa

SEQ ID NO: 195382 - DNA, 119 bp, Homo sapiens
gttattcaggacttaatgtgatgcatgactagatctgtcaataaactatcatgaaaccataagaacccctaacaggaggatccaacgtagcctttgttgatcttagtttcttacaattc

SEQ ID NO: 195383 - DNA, 220 bp, Homo sapiens
agtatgggttggcactgtgccaagtgttagataaacaatggtgagccagacaggcagagattagagtttatttcagtatagtggtttgtgctaagttaggataagtacaaagattcagagaagcacccagaaaatttggggagggatagggaagacttgctagattagctagattagggaagattagctagatggatggggtgggaagaatgttccagac

SEQ ID NO: 195384 - DNA, 698 bp, Homo sapiens
atagtttgagcttactactagatattgatttcaattgtttatgcaaataatttgcatctttgtgactctttctttgcaaggtgacggaaatctattcagactgacttaaccaagagagggactttattgactgagtaactagtaagcctagaagtagttctacttttagacacagctagacacagggaggtaaattatgtcattaggactcactctctccccctttggctctgcttttctttgtacggtgtcgctatagcgacaccgtacggggggaatagagttattctgcagagattcaaagttcaaatgtgtgaaggggtctcttaaacttttactttcccctcctgttatttacttttcaattacagctctttattgcaaaaatgaaaacaaacttattacattgagcagctgttcatcagagcttgaactgtatactttctaactatagtgcttgtgtattgaatcatattgtgtaaatggatattatagtctgttagaaagagttgtttggtgtttttatcctcctccccagagactgaatcagtactagcttaagattcaaaagaagctggttctgaaaccttgaatctttggtgtgaacctcaaacatacctgttgaccaggaagctgagggagtctaggcaggtcagaccaaagtacggttacgtgtcgctatttgcagacacgtccct

SEQ ID NO: 195385 - DNA, 720 bp, Homo sapiens
catgagtttgagaggattttattttatttgaaccagcaaggtcatagactacctttgggaagacctatcatcaaccaagatcgtttgaaaaacaatatatacctttttttaagttgtacatttatgtgcattgtaaatattccttcctgatggtgtggttaagagtacattacatcaattttatgtatatatagatctgtgacaaattactctcaatctaacaaacatttacagagttcccattttatacaaggcattgagacatatactagatagaagatatacgaaataataaaatacagttttttttcctgaatatgtttacagtctaaaaggagaaacaagaaaaaataaaactataatagaaaagagcaaactaaaatctggcatggaagttgtttacacagttatgatggtgcagaggaaaaactgatcgcatcttgtttagaaaaatcagaaatatttcacaaagaatgtatctagaacacatgtcaaatacacagcactggggcaagaaaaatggaagagcacactccaggttgtgacaacatcaggatacaaactgcaccatgcaagtatttggtggggcatgttcataaatagcaatgagtttggcaactatttagagcaatagaggaaaaggatattaaaagaaaaattgggcatttttgtggctgactttgaacgtcagaaaaaagtctacagtcaattttattgctg

SEQ ID NO: 195386 - DNA, 400 bp, Homo sapiens
tgaccatggaactgatttcttaattttttatgtgtttaattaaagtttaaaatgaaattgccgcatgtggcaagtggttgtcatactggacagcacagggccactaagtcagtgtctgagtacctgcacagcctagcatggctccacaccgaccttctctagcctcgccctcacactgcacttgtcatgttcatgaaccccggtaggtggtgaagtcctcaaaggtaacatttccccttggttcagtccacatcagagacgagtctcaggcactgcttgatgtgatgtgtaggctggttcattcaaccctcgctgttgtaagactaacaggacagcgggagcatgcccatgtcatgcgtatgttatggtcaagaggtcacacaactgactgatggtccag

SEQ ID NO: 195387 - DNA, 295 bp, Homo sapiens
tgccagctctgacattctgagttcagagttcttagaaggctttatgagcaaaggccgattcaaaactgccgtttccttacaccaacccatcatgtgatgacaggtggcctttttgcttgtgctttcaaatatgtctagaagaaaacacccacttataaaaattaacctttaccactctaaaaggcattcacaattttaaagttttttctcctttggatagagaaaaagtatggttcagtacctgcattttatttcgaagaagttcagagtatgagtcatctgcagtgaatgagaa

SEQ ID NO: 195388 - DNA, 669 bp, Homo sapiens
gaggctggggtaggactggaatcctggggctgatggagaggagagtggggccgaggagagagtggacagctgggtcacagaaccatgcagcctcacagctagaaagagcattcccagttgtagttcagcaccatcatttcttttcttttgttttcttttctttttttaattatgatgggcaagctttattttgtatgaacttgatttcacaaaattagaatggcaattccacttaaaattaactgtttaaaaagtgtaaatgtcacggtatagatctgttatccaaaactccaaaaggcagtgaaattggtaacagatattcctcctcatctttcgacccatacaacagcagaattgatgaaactggttcccaggcaagtatgtgccacttgctcccgtgcctcagggaggagaggatgttatgacacaggcgtttttgttgcagtgacttgtggataattgctccttattaacactgctaaaattatgttcacatgttttactttgtgtgggagccgatgactcttgtcctttcgttttttgagtattatctttcaaatgagcgttggcctcaaacccgctcattccaaaatgcatcacagatgggaatttaagcctcttcacaaagcaaaccactggaaattcataggtagtatgcaacattggtct

SEQ ID NO: 195389 - DNA, 428 bp, Homo sapiens
ataccccagttaaaatgtacattctgtaccccagagggggagaaagccccacaagtagagagaaatgctttcttccctttattgttaacacattagcctggatagatttagccactcttcagtctgaaagtcacaaagccttcaagaaggtgagacacaggatgggtgtattcaccagtccagggacctgcctgggactatggcctgatcaaagatggggcagtgacaggacagagcgaggacctggggccagaagcatccctagaaggggcaggagagtcatttgctgtctcagatatcttgccaaggatcagccatgtccagtctcatttcccctgggcacaggatccacttgctctcttccagaaactccctggggcctctggcccctctctggacttctccagagaccatagacactaattggg

SEQ ID NO: 195390 - DNA, 363 bp, Homo sapiens
gtttagctaaatggaggtacaaatggataggtatagaaataattatagataggtgtggatacatgtgttagtatacatatttttttctagctctgtgctgagtgggagtagaagcagtgacacccagtagatagggatatgccccacattcagattttgtttttaatgccattctccaactaaaggagccagatattcctggagaaatggctgcttctaggatgaaacaatatacaaaaatgagcctggaacatcttgtcccttaaagtaaggaggtgcctaaaagaagcccataacgatggggataaagggacacaggagccaacctgaaagagttcccaatggccaaagctggaacagttt

SEQ ID NO: 195391 - DNA, 605 bp, Homo sapiens
caaggcttttcccaatgactttgagggatggaacctgaaggaagcgggaggaggcaaatagggaggaaagtgaaatgatttataaatgacttgctaattttgtccaaagggagtaatgataattagggcattcttcccacacgaagatgacacaattgacccaatatcattgaggctaacagtttgggctgtttttccagtagtatgacagtgacggtgtgtcaaccgcaggacctcacccacatttctttgggacctaggagtgtgggaaatagcagccagatttgaggtacaaatcatggtgtccagcctgcaaagcctttttgcagcaatctaagcctgactgctcctgttgtatgctcaaagtcattttaatctactttagcttattgtaaaatgttcaagaattgtattttgtcttgaaaaccatgaattttattgtttagggggagttattttttaaggagtgcaggatttcagttttggatgatgaaaaagttttgaagatgggtagtgacagtggtcacacaacattgtaaatgtacttaatgccattgtacacttacgtgactttaaagtaaacatgaaattttctacatttgttt

SEQ ID NO: 195392 - DNA, 133 bp, Homo sapiens
atgacactatcaactgatatctgaattcctgccctgttccattatgcatactgatcaagagacagactcacatatatatacaatccaccacactgtaagtccaggggaaaaggcaaggaacgcaataaactcc

SEQ ID NO: 195393 - DNA, 100 bp, Homo sapiens
ggagcgccacgcacagactcacagaggagctcagtgacgctgggcccttccttcccccactcatcgagttctgcaacaccgaaaatcccgttcactcaaa

SEQ ID NO: 195394 - DNA, 343 bp, Homo sapiens
gcgtcgactaaattagtatgctgaacttaataaataattggaaaatgtggagaaatttatgtatgtatttatttttaattgggcagcccccaaaccaaaataggttcagagaggctccatcattttttaaataagctataattttcagcctggggaacatagggcgaccctgtctctacaaaaactttaaaacttagccaggcatggtgctatgcacctatagtcccagctactcaggaggctgagatgggaggattgcttgagcacaagagttccaggctgcagtgaactgtgattgtgccactgcactccagccaggggcacacagcaagaccctgtctca

SEQ ID NO: 195395 - DNA, 107 bp, Homo sapiens
gcccaagttatatttttaaaatgttttattatatatataatgacataagctactgctgactaaaggatattactacataaaccccctcctgggcttgctttaaagaa

SEQ ID NO: 195396 - DNA, 543 bp, Homo sapiens
ccctaatgagtaataggttctacctgagacaagggctctccagagcgtcaacactggagtggagttctctagccttttagagagggcacaggacacgtacaagtgaagacatatggcagaaagagcacgtaatgctcaggaactggcaagaatttggtgggaggtaaatttatgtgaaaatggaacctctcaaagttaatatatattttggatgcctaggagagcttcaccatggtaatctgagagagcatcacttcccaaaacaatgctttacccctcaggaaaaatgcttgttcataaataaaacaatgctatgctcatttataataggagtctctccatttccagaagtccaccatttcccattcagatttcaaatgcagaatctttgacctgtgactctgcaaaaactagcatcaaagtagagtacaggggaatcatccgtttgcaattattaacttattttcctcttatttacaccacctggtatcacatttactttttcttttacttttttttttttttttgaggcaggtcttactg

SEQ ID NO: 195397 - DNA, 642 bp, Homo sapiens
tcatagagacaggatcttgctatgttgcctgggcttttctccaactctaagcctcaagtgatcctcttgcctcagcttcccaaagtgctgggattacaggcatgagccactgcacctcgcttaggctatttttttaaagagcagtttaaggttataggaaaatggagaggagggtacagagatttcccatatgtgcatgtcttcctccattatcagcaactccctgccagagtggtggatttgttatagttgatgaatttatgctgacacatcatcacctagagttcatagcttacattagggttaattcatagaatgttgtatattctgtgagtttaggcaaatttacaatgatctaccattaaaatatcatacagagtagtttcactaccctaaaaaatctatgccccacctattcatcccctccttccccgtaatctcaggcaaccattgatcattttattgtccccatagttttgcttttttttttggacatgtcatatagttggaaccataaagtatgtagccttttcagactagcttcttttgcttagtaatatgcatttaagtttcctccctgtctttttatgacttgatagcgtatttctttacagtgctgaatgggattccataaggggcaca

SEQ ID NO: 195398 - DNA, 873 bp, Homo sapiens
tccgaccctttctctgcttttctggtgggcaagaaacccccaccccttctccatgtctctactcttttctctgggcttgcctccttcactatgggcaagcttccaccttccattcctccttcttcttccttagcctgtattcttaagaacttaaaacctcttcaattctcacctgacctaaaatctaagcatctcattttcttctgcaatgccgcttgaccccaatacaaactggacagtagttccaaatagccagaaaacggcactttcaatttttccatcctataagatctaaataattcttgtcgtaaaatgggcaaatggtctgaggtgcctgacgtccaggcattcttttacacatcagtcccttcctagtctctgtgcccagtgcaactcgtcccaaatctcccgcctgtcccctcagtcccaaccccaagcgtcgctgagtctttctaatcttccttttctacagacccatctgacctctcccctccttgccaggccaagctaggtcccaattcttcctcagcctccgctcctccaccctgtaatctttttattgcctcccctcctcacacctggtccggcttacagtttcgttccgtgactagcccttccccacctgcctagcaatttactcttaaaaaggtggctggagctaaaggcatagtcaaggttaatgctcctttttctttatcccaaatcagatagcgtttaggctctttttcatcaagtataaaaatccagcccagttcatggctcgtttgacagcaaccctgagacgctttatagccctagaccctaaaaggtcaaaaggccatcttattctcaatatacattttattacccaatctgctcccgacattaaataaa

SEQ ID NO: 195399 - DNA, 545 bp, Homo sapiens
atacaaaacaaagtatatttggaggaataagactgtttgtctttcattctattctctccctcctatgtcgctattaaaaatttttaatttatactcccagtttaaaaatttatatttgtacctcgctatttcttttcacaattgaacaatgagataatagacatacttgcttgttcttaactttagcaggaaagcctctagtgttccaccattgagatcttcctttaaaatcctttttgtaaaatttgggctgtgctatccattctatctgatgttccacagcacttcctggaaagataaaatgaacaatgtggaaactcataatgaaaagtggtacacaaacgtgcctgttgactgagcatcaatcaattccaggaaagcttcaagattcctgaacctttttgaagcagtttggagaattaaaaaaaaaaaaaaaaaaagagtaagaaaggattcctgaacccacttccacttacattctacacaaaaaatgaaaggagacttgcagaattgaggggacctgccccaagtaacctaaggagcag

SEQ ID NO: 195400 - DNA, 419 bp, Homo sapiens
agtgatctgcctgcctcagcctcccaaagtgttgggattacaggcatgagccaccgtgccgacctccttgctgctttcttttgcctttggagaaagaaaaaatgactctcctcctctcatccctggcagtgctgttggaaagcagtgtgttatttaatgagttttatgtagttaattgctttgcctaggttgctaagtgagaatacccacacggtggtgttacacttacactcctgctgggcaccttaccccttgcccagttgtattcgaaacaaggatcactgcctgcagactggggtccacacatatactccttgagagtgtgagcattcactcaagacagcagaaccactgtcctggctgtgtctaggctctggctaactttgaagtggctttgggagcctgaggaggacaaacag

SEQ ID NO: 195401 - DNA, 863 bp, Homo sapiens
tccccacagaggtgagcaacaagtgggcaaggaccatgacaggtgacatcccagcaccagcacaggtgccaggacaccggacgggggctccccctcagcagagtctcctcccttccaccaggccctaggaggcacctgctaatgaaatttgatcagtgccccaaccaccgccttggccagcctatgccgagcccttaccatggaccaggccctggggaagcatgtgacatcaaccaagaggtcacaggttttgcagagggggacacaggtcatttgcccacagcaccaaggaactaggtgatgaggcctggactccatcccgagcctgtggattccagagtgagctgctcagcctggacctgttgcctctcagccccagccctctgcaggccagaaaaaccacggagcacacccagaggtgctcagttgcttccacctgagaggcagggctgcacaggagcaagagtggaggccctgggtcaggcagatctagattcaaactcccgagaagggtggagggaagtgctccaagcagagcagagactgaaggcgggagagcctggtgcaccgcggacctgcagggggaaggcgtgagagctcggtgcactggggacctgcatggggaaggcgggagagctcggtgcactggggacctgcatggggaaggcgtgagagctcggtgcactggggacctgcatggggaaggcgggagagctcggtgcacctcggacctgcagagggaaggtgggagagcttggtgcaccgcagacctgcagggggaaggcgggagagcttggtgcaatgcagacctgcggggggaaggtgggagagcttggtgcactgcagacctgcggggggttcca

SEQ ID NO: 195402 - DNA, 362 bp, Homo sapiens
acaagatcctccaaaagttcatgagtaagagctgatgaactctttaatttcatggtgttcccctagagttttagcattttcacttgttggtttgttattcttccataatgagacaaataatgagatgattggactcagaatctggaatcagattgtgggagtttacattgtgctctgtttagctatttaattagatttcttaaactctaagccttagtatctcctcagtgtttgctacatcataataggcatttcaataataagaatttgagaaaaaattctacagaaaaattaagagaagcacagccacttactatttgtgcttccattcactggttttacttacttttttcctcaaacct

SEQ ID NO: 195403 - DNA, 270 bp, Homo sapiens
ttttccttttactacttcataggaggtgtgtgaatcatgtggaactcatctttcagactgaaatttccctgtgaccacacctcacaacagcagcacagccctcataaagctgtggggaaatcattatgatagtagacactgagccaactcaggagaatcaacctttctcctcccccatacccctcttccctgggcaaacacaccctcccccacacaactattttcctctttccctcactttctaatcggacgtctaagtgcacagtgaag

SEQ ID NO: 195404 - DNA, 193 bp, Homo sapiens
tgctgactcctacacagccttccctgattccctccgctgagtcatcttccctttcgcttggaacctagtgaaccagcaactgaaaggttggtctcacacaacaccctcctccaccccttccctaatgggggccaccagcccctatgttcagtcatttcatggaaacttccaggactgggcagctcatttcccc

SEQ ID NO: 195405 - DNA, 225 bp, Homo sapiens
atctcgtggcacacaagaccctagaagggagcaggccacagatcctcagggcttgatttggcatgccaaggaatttggccttcatattatatgcagagtagaaattacatagcattatacctgtgaacacaaacagaggttccattctccaggacacgaaggtatagaaatgctcaacattttgtcattgttgaatagggatggtatttttgatagcaaataaca

SEQ ID NO: 195406 - DNA, 371 bp, Homo sapiens
ccccacacctgtgtagatcagtccccaaagacttgagggaatctctaatggtctatgaggctttgtcgctttctctctctctctccccatgcagctcttgcttctccagcactctctcccacaaattctagctgtcttcatgtccttgaactctaaaccctgtctcctaaactcagtgagaccacggggctctgtttgggtactccatgtagcactctcttcactgtctccacgtagtaagctggggctctggtgaggctgaacttatttttcttttctcagagatcttagtcttgcattgcctgctgtctaatgtgtgaaaacagttgtttcatatattttgtttaatttactaattttgggtgtgtgtg

SEQ ID NO: 195407 - DNA, 612 bp, Homo sapiens
ttacattgcctttaccattgatgggaacctgggtaataaagaaaaaagaaaaaaattgcattccctaccacctcctccaaaacaatgtcaaatgttagttataatgataggcatcttagtatgctatcccaatttaatggaactgttgcagatatttaatggttaactgttggtttgagacctttaatgtgttgagtatattcacctatttcaattttttttctgtttaagttttttttttttaaatcagatatggctattatatttggttaaatgacatcttagcatcttttaagatgatcatatagttttcctccggcatgctacatattaattacagtagtgtatattcatagaattatattagtagatcttatatggattcacccttacattctggcagtgaacctctctggatcatattattttttcatgtacggttggactttatttatttagtttggagacagagtttcgctctgtgtggcccagggtggagtgcagtggcgcgatctcagctcaccacaacctccgcttcccaggttcaagcgattctcctgtctcagcctcctgagtggctgggattacaggcgcccgccactacgcctggcg

SEQ ID NO: 195408 - DNA, 522 bp, Homo sapiens
cacttccaggcagagccactgggtacacggagcaaacagaaagcagatggagtaagcacacactatacacagtacagcattcttgtattgctgtgtttggctatcctagtatagtttgtgtttaggcttcatcacaaaatagtaacatgcagggaaaaatcaatgaaccaacgtgattccatgttatattgatgccattcccttatttactaatttcacatgagctcaatcacatcgcagaaacacatcctttcacaaaataaactgtatacttggatctacttatttttttctatatgaatgtagcatgtcagttctgtgttaatgaacaactatgtcttaaattttgtattttagaaaatgtaatgagcaacttattcatatctgtgataccttgccttcccagggtggggcttcagttgctgcttttagattcaactaagcagtcaaacccacaggacctaatcaggccatattgaggatagattcccttagagacggatgttagaaggaacacacagc

SEQ ID NO: 195409 - DNA, 270 bp, Homo sapiens
tgccaggggctgggagagaggggcatgggagttagtgttcaatggatagagattcaacttgagatgagaaaaaggttctggcgatggatggtggtgatggcagcacgataatgtgaatgtacttaatgatgtccacttacttggttaaagtggtcagaggttttgtttttttgtttttgttttttttttgagacagagtcatgttctttcactcaggctggagtgaagctgcacgatctctgctcactgcaacctccgcctctcaggttc

SEQ ID NO: 195410 - DNA, 561 bp, Homo sapiens
tcatctccgattcccaatgtttccccacctcatggggctgctgggaggattaaatgcaaatggcagacatcaatgcttgtgagctcactgaccatcctccctggtcctctggtgtttcgataatgtcatgtactcacaggaatatgagatttctcccctactttttgctatctcataggtacaggaagccaatgtgagaaggggatcctgacaccaacagctgagatttttcttgaatttacactttacttttttttttcctaaagcattgtcacatatattcttaaagttaagactcacaaagaatctatgaaataggatttgaaatcttattttcattttgtagatgaggtgaactgaggctcagaaagcatgagtgatttattcacaaccctgtgacttgccaggcaggagcctgtttctctagagccacattcagctgttctctccagcatcacttgctatacctgccctcccagctcgctccacctcgctgacaccctaagtacaaccagcaccagggtactgctctgctgcaaaaccttcaatggctcacagctg

SEQ ID NO: 195411 - DNA, 622 bp, Homo sapiens
tcagttgcaacagcttgttcacatagatgaacttccaacacagtaactataggaataagaataaaagccgtgtttactttcatggagttaattaagaatcaatgagaacatggaagttaaaacctttgtaattaaaatgtaaagttccacgcaaagttttaaagtgagcattttccagaggtgcttttctaagttcttgaatgcccctcccttttctgaggaggctgcttcatgggctattggtgtctttggcagggggtgagtctagggttcctgttgtgggtcctttgttctcacgagggcagtgcccgttttccccgtctcctgcttgcccagaatgttcccgtgcaccgagactggcctgtttgacctgcaactgtgctgtttgagctgcagctgtgtagcctgcgctggcccgtctggctacactcaacaccgtttgctgatcagcacttgaagtgtatccatcatagctgagacactgaatattttatctgtttaatttttattaattaaaatgcaggtttaaaaacttgattccgttattaggaagcacttaagtatgtttagaatcacttggccatgtgagtctacttcgtcaactgtgtattttatgagtcta

SEQ ID NO: 195412 - DNA, 157 bp, Homo sapiens
gttttctcatggctcgtgggttcagggtttcttttattttttccatgcgtcacaaatactgtttaatgtgggtgggggacggcttccctctccttcccctggagacacatcatttggttaaaccgcacataaatttaacctctctccaaagaactat

SEQ ID NO: 195413 - DNA, 406 bp, Homo sapiens
ccccacacatctgacataatgcatgcggttccctcctgtccctcctgctagaaaccgtgccctatccttttgccacctagagacgcctctttgggttttcagcttagtcactacattttatcaaagcttttatgactttccatgctgatatgtaagtgcttttttcaccatctcattgtaatgtaaatttcaagtgtgtttttcctgtatatttaatgtggactatttatttatttattttgagacagggtctcactttgtccaagctcgaatggagtggtgtgatcatagctcactgcagcctcgacctcctgagctcaggaggctggggagggaggatcgcttgagcccaggagtttgaggctgcagcaagctatgggcaacagatcgagaccctgtctcttta

SEQ ID NO: 195414 - DNA, 1750 bp, Homo sapiens
cttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccaggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagccaaggagagtttcgggggcatgcgcctgctgcgtcgggcagacttccacgtgggtgcccacgtgaacacgttctggaggaccccgtgccggggggccactgaagggctcagcaaaaagtcggtcgtgtgggagaataagcacatcacgtggtttgccaccctggacggcggcatcgggctgctgctgcccatgcaggagaagacctaccggcgggtgctgatgctgcagaacgcgctgaccaccatgctgccacaaccacgctggtcctaacctttttgcctttc

SEQ ID NO: 195415 - DNA, 1339 bp, Homo sapiens
  misc_feature (1234)..(1234): n is a, c, g, or t
  misc_feature (1250)..(1251): n is a, c, g, or t
  misc_feature (1273)..(1273): n is a, c, g, or t
  misc_feature (1275)..(1275): n is a, c, g, or t
  misc_feature (1280)..(1280): n is a, c, g, or t
cccccgcccagaaatagccctgttcccctaaaccactgaaccccctccccagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagccaaggagagtttcgggggcatgcgcctgctgcgtcgggcagacttccacgtgggtgcccacgtgaacacgttctggaggaccccgtgccggggggccactgaagggctcagcaaaaagtcggtcgtgtgggagaataagcacatcacgtggtttgccaccctggacggcggcatcgggctgctgctgcccatgcaggagaagacctaccggcgggtgctgatgctgcagaacgcgctgaccaccatgctgccacaaccagccggctcaaccccgcgccttcggatgctgcacgtggacgcngacctcagaatgccgnngcagtgctggatgggagctgtnancggtnctgtactgacacatgagcgcagatacaaaaatggacaacaaattatctggaatgtgaag

SEQ ID NO: 195416 - DNA, 1871 bp, Homo sapiens
  misc_feature (1766)..(1766): n is a, c, g, or t
  misc_feature (1782)..(1783): n is a, c, g, or t
  misc_feature (1805)..(1805): n is a, c, g, or t
  misc_feature (1807)..(1807): n is a, c, g, or t
  misc_feature (1812)..(1812): n is a, c, g, or t
cttcccgactggcggctggtgttcctggtgaagaacttccctgtggggcagcgggtccttgtggacagctcctttggacagcccactacacagggcgaggcccgcagggaggaggccacgcgccagggggagctgcccctcgtcaaggaggtgctgctggtggcgctgggcagccgccagagcaggccctacctgctggtgcatgtggaccaagagctgcttatctacgaggccttcccccacgactctcagctcggccaggcaatctcaaagtccgctttaagaaggtccctcacaacatcaacttccgtgagaagaagccaaagccatccaagaagaaagcagaaggtggcggcgcagaggagggggctggggcccggggccgcgtggcgcgtttccgctacttcgaggatatttatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagccaaggagagtttcgggggcatgcgcctgctgcgtcgggcagacttccacgtgggtgcccacgtgaacacgttctggaggaccccgtgccggggggccactgaagggctcagcaaaaagtcggtcgtgtgggagaataagcacatcacgtggtttgccaccctggacggcggcatcgggctgctgctgcccatgcaggagaagacctaccggcgggtgctgatgctgcagaacgcgctgaccaccatgctgccacaaccagccggctcaaccccgcgccttcggatgctgcacgtggacgcngacctcagaatgccgnngcagtgctggatgggagctgtnancggtnctgtactgacacatgagcgcagatacaaaaatggacaacaaattatctggaatgtgaag

SEQ ID NO: 195417 - DNA, 1506 bp, Homo sapiens
  misc_feature (1401)..(1401): n is a, c, g, or t
  misc_feature (1417)..(1418): n is a, c, g, or t
  misc_feature (1440)..(1440): n is a, c, g, or t
  misc_feature (1442)..(1442): n is a, c, g, or t
  misc_feature (1447)..(1447): n is a, c, g, or t
cctgcgcccgccgcttctcccgccctagcctctccgcacgcgcacctcatctatggctactcaggggtcttcatctgcggcccctcccctcactggctcttggtgaccggccgaggggctctgcggctacaccccatggccatcgacggcccggtcgactctttcgctccattccacaatgtcaactgtccccgcggcttcctgtacttcaacagacagggcgagctgaggatcagtgtcctgcctgcctacctgtcctatgatgccccatggcctgtcaggaagatcccgctgcgctgcacggcccactatgtggcttaccacgtggagtctaaggtgtatgctgtggccaccagcaccaacacgccgtgtgcccgcatcccacgcatgactggcgaggagaaggagtttgagaccatcgagagagatgagcggtacatccacccccagcaggaggccttctccatccagctcatctccccggtcagctgggaggctattcccaatgccaggatcgagctgcaggagtgggagcatgtgacctgcatgaagacagtgtctctgcgcagtgaggagaccgtgtcgggcctcaaaggctacgtggccgccgggacctgcctcatgcagggggaggaggtcacgtgccgagggcggatcttgatcatggatgtgattgaggtggtgcccgagcctggccagcccttgaccaagaacaagttcaaagtcctttacgagaaggagcagaaggggcccgtgaccgccctgtgccactgcaatggccacctggtgtcggccatcggccagaagattttcctgtggagcctgcgggccagcgagctgacgggcatggccttcatcgacacgcagctctacatacaccagatgatcagcgtcaagaacttcatcctggcagccgacgtcatgaagagcatttcgctgctgcgctaccaggaggaaagcaagacgctgagcctggtgtcgcgggatgccaagcccctggaggtgtacagcgtggacttcatggtggacaatgcccagctgggttttctggtgtctgaccgcgaccgcaacctcatggtgtacatgtacctgcccgaagccaaggagagtttcgggggcatgcgcctgctgcgtcgggcagacttccacgtgggtgcccacgtgaacacgttctggaggaccccgtgccggggggccactgaagggctcagcaaaaagtcggtcgtgtgggagaataagcacatcacgtggtttgccaccctggacggcggcatcgggctgctgctgcccatgcaggagaagacctaccggcgggtgctgatgctgcagaacgcgctgaccaccatgctgccacaaccagccggctcaaccccgcgccttcggatgctgcacgtggacgcngacctcagaatgccgnngcagtgctggatgggagctgtnancggtnctgtactgacacatgagcgcagatacaaaaatggacaacaaattatctggaatgtgaag

SEQ ID NO: 195418 - DNA, 432 bp, Homo sapiens
aagtgagacactcatacttgaagtcgaggacagtgtatcgaaagttgtaatcttttggagatatagacagaaattttacagaaaaaaatgatatggtatttgggatgacctcaaaatgatcggattagggtgggatatgtggtagtagcgaacagatgaaacaagagtagccatgaattagttagttgttggagttgggggatgggtacatgagtgtttgtggtacagccttcttttgtgttatgtttaaaatcttgtataataaaactttttttaaagtttgttgggcaacagataaagtagtttgaaccctcgaggcaagggaacgcttatacactgttgacagaaatgtaaatttgtacaacctctatggaatatgtggagacttctcagagaaccaacaacagaactaccatttgacccagcagtccc

SEQ ID NO: 195419 - DNA, 100 bp, Homo sapiens
gggatttgaaatattttaactctttggttcaaatacgtggctcgtgaaccgggaggttccatacagttacataacaagtaatctgtcaagtcaatagttg

SEQ ID NO: 195420 - DNA, 588 bp, Homo sapiens
ttctaactttttgataaaacttttttgagcatttttcaaaaatttgtatgtttgtggtaatggggaattaaacaccttttacagctgatgtatgttggaaatcattttatgtacatttaccaactggtacttatcttcaagttggaattttcacatccataaaagggagacttgcatcatatataattttcagtatactttgctgtccagccttttaaacaattacagtaacattttgagttctgtgatgaatagttctaggggaagggatggaactttcgacatgtaaagtccattgttttaaatgctaaccccatccccaatatttttgtggaacgtgaggctttatgaaaggtttatcagaaatagaatattctaaagtcacttttatggcttatttcaaaaactagtgtgaaagtattttcatgcttttttgtttctcatcttttagcaaagcttctttaccaagttttgattaaattgcaatataaaattaagttttttcacggtgctatattttgtggaatatgggtagcactcaggtttctttcttttttcttttctccttccttcttccttcattccttc

SEQ ID NO: 195421 - DNA, 527 bp, Homo sapiens
ttctaactttttgataaaacttttttgagcatttttcaaaaatttgtatgtttgtggtaatggggaattaaacaccttttacagctgatgtatgttggaaatcattttatgtacatttaccaactggtacttatcttcaagttggaattttcacatccataaaagggagacttgcatcatatataattttcagtatactttgctgtccagccttttaaacaattacagtaacattttgagttctgtgatgaatagttctaggggaagggatggaactttcgacatgtaaagtccattgttttaaatgctaaccccatccccaatatttttgtggaacgtgaggctttatgaaaggtttatcagaaatagaatattctaaagtcacttttatggcttatttcaaaaactagtgtgaaagtattttcatgcttttttgtttctcatcttttagcaaagcttctttaccaagttttgattaaattgcaatataaaattaatcaaaacgttctagatcgcgagcggccgct

SEQ ID NO: 195422 - DNA, 459 bp, Homo sapiens
cctatcgacggaagcatagtattagaagataaactatttttgtgtaggtgctgggtaggtttaaataatttttttgtagctgtttaacaagaaggtatatgcctctgtgtgtgtgtgtgtgtgtgtgtgtgtgtgtctgagagagaggggtgggggtggcagacagcgtgcttctaagccttcctgaagatcctcccttgcctcttgtctccttctcatataaaaaggggttggctggaggcaaaccttcccttttgttgccattgatctgacactaggatattttgtagtccagtgagtagaaatgtgtcccagctgtaagattctgattgtggatttttcttcagtaggttactgatctttctttatgcctaaattcacattcttctaagtggaggatttacatttatgatttcatctgggtttaaaatctggccggaagcatggttatgtgtttaa

SEQ ID NO: 195423 - DNA, 228 bp, Homo sapiens
aatatagaggttagggatgtgggagtacagggataggaagaaatattcagaatctgtgacacagaaaaggtaattttcttgcctttcacggtcatagaaggaaaatacatatatgggtccctcaggtattactttaaataaatagagaaagaaagaaattactagagtggccctggtttgagacctcagtgcttagaatcacggtactggtttttaaacaataaattg

SEQ ID NO: 195424 - DNA, 563 bp, Homo sapiens
cagccccctgagtagctgggattacaggtatgcaccaccacacccagctaatttttatatttttagtagagacggggtttcaccatgttggccaggcttgtctcgaactcctgacctcaggtgatccacccgccttggcctcccaaagtgctgggattacaggtgtgagccaatgcacccagaccaatgtattgtattcttgagaatcactgagagtagattttaagtgttctcaccacagaaaacactaagtatgtgaagtaatgcatgctaattagttcaatttagggattccacaatgtgtacatattccagaacattatgttgtacacaataaatatatacaatttttatttgtctattaacataacaaataagatgcgaatattggggagaatatcttcattgagtatcagctgagactaacgtagttgaggtagagattaggacgggatgcagaacatgtttttgggttctgtctggaaactctgaggagtggccttgcttaaaaaccagcattggtaggatggccctcaatggagtctttagggtcccggccttta

SEQ ID NO: 195425 - DNA, 466 bp, Homo sapiens
tgctgactaaagattcaggagaagcattgccaagatttgctgactaaatggtaatgagggatctcatatacataaggtgttatggtagcctttgttctcctgagcaaacaccatgccaacatgtaatcagctaaaaaaaatctgttcagacagttctacagaatctcatgatttttccattttcagtgaaactgtttttaaagtacatttaattccagtttaaagtcatcagtttaactttaatacatgctgatgttgggcagacaagattttaggagaacataatagaactccaggcacttgtctgacttaattctgccattttcacaaatttggaaaatctccatccttacagtgatggagaggcaggcaggatgccaaggaggcttgtcataccttaggtccttccagttattctgccacttgtttttcttcttcttcatcagtcagccagactgtgagagac

SEQ ID NO: 195426 - DNA, 205 bp, Homo sapiens
acagggtttcaccatgttgcccaggctggtctcaaactcctgaactgatgtgatctacccgccttccaaagtactgggattacaggcatgagccaccataataatttaattattatttaaataatttttaattttaaaaatttaaaaattattttaaaatttaaaaattcctttgcttatttatactcaatggacaacaaaatgt

SEQ ID NO: 195427 - DNA, 375 bp, Homo sapiens
ataaagggagtagagacttgggggataaccagaggcacaacaactgtcagcaaaaggaatccagtgaaattctggaacctacaaaccaagaatgggtgaccaagtttaaggacctgacctaattctaagctgtaggtacagattatcagtgggcttgtcttgggggaaatggggaaagtagatgaaaaagagatgaaggccaaaatggttatgtatagattatttgtcccttacgggcaggagacaggctttatgcctcatttctatcctccacaccagttagcaaaataaatatttactgattatgtaaaaaaagaaagatcacagagaatttggtattacccaatgatgggaagtatgccaagataaccttag

SEQ ID NO: 195428 - DNA, 587 bp, Homo sapiens
tatcaatcacatttaattaaaaagagcatcttgtcttcttcacattttaatacagcacctgatattaggatgctaagttactatgagaaggtcagaatacaatggatttagctcattgccaaatgcaggaacaaattcattaacaaatgaatttgagctaaattttcagagtaaatttatattttttaaaaactcatagtttgtcctcaaaacagtaacctgcagcaaaagttgtaacaattctgtaacacgtatatctaaatactcattacagtctctcccatatctctatttctagtttcatttactctttaggcagaaaataggttcaagggtctagtaaaggaggcaaatgggcagaaaacaacctcttgtttgctatcccactgcacttgaaatggacctctataattcactaccatttataagtgtctcgcatatcaacatcacattaggtaatttactgcctccaattcctggtccataactattccatcctgaaaagtcataatacaatgttattggaacaatctattcatattgtaaatgacatgttttctaactatttttttaagccactagggagg

SEQ ID NO: 195429 - DNA, 472 bp, Homo sapiens
ctcatctcttcgagagctaccatctccttccagacccacaaaggagttctacattttctgctccccccaacacatccaatcagttctaccaattgctccttcatgaaccatctgttttgcactggtcctctccctctgtggacccccaactagtcccctaatctaggcctcatcctctcatgcccagatattgcaatgactcttaactagttgcagggtttttttccccatatttttttctttctatgctctaaaatctatcactatattaagaagtttctctttaagctatccattctgtgtgtattccctgccaaaacttctggaaacacagctaatttcacatccctctcaattaatactaacagttgtgtttattgagcacttacagtgtacacttcacacaaataatctcctttggtcctttcaacaatcctgtgaggtaggttctattatccccatgttataggca

SEQ ID NO: 195430 - DNA, 319 bp, Homo sapiens
aacaaaaaaaccctctcattttaggtttagtttgtaactgaatagaacattttatatctaaacccttaatggaaaggctttcctatttcccacaattttcttttctatttaatgtattctctaaatttaacacattatttaaaatgccatccatatacctgatcaacttgaaaagatggagaaacaaagaagtaaagtttgttatcttttcacattttattctgtttccattttcataatcaaataaatgtagactgtaaaatacttatttacaaatctgtctgatttatataataaactctgaggaaactgaaatgag

SEQ ID NO: 195431 - DNA, 209 bp, Homo sapiens
acgattcaccggcagcattctgaaaccatgaaaagttaaggttaagaaaaaatctgcagcaataacgataaaggcattaagaccatgttaatgatgtgcagttattcattgttgagaagatgaaaatctaccatcaactggtctagaggaaaacaccaaggtcccctgtgatcagtcccccaggcctcccaactacatgcctcaaaagt

SEQ ID NO: 195432 - DNA, 846 bp, Homo sapiens
atgtgcaggtgagaggtacaagctaagacccagaagagaccaaggtcccccaaggaaaaagtcctcaggcaaggtgacatgtgagcagcctgagacgattttagtaggcagagtttttgatgagctggggagcatatgggaacacacagggttgatttctgcttcggtttttattcagattgtttcttctaacctagatagaataagcctcccctcctccaagactcagctcatccagcatggtggctcacatctgtaatcccagcactataggaggccgaggtgggaggatcgcttgagcccaggaatttgaggcgacacagcaaaaccccatctctactaaagattataaaaattggccgagtgtggtggcacacacctgtagtcccagcggctgaggtgggaggatcacttgaacctggaggcagaagttgcagtgagctgaaatcacaccactgcactccagcttgggcgacagagtgagaccctgtctcaaaaacaaagaatgtgagtacacaatcgttaagtgccccacctagttttagttctggctagagcatatgctctataaccctgttggactcttaaggcaaaggagaggtccaggcaatgactgcatccaggcaaggaagcaggcacggcagcttgggagccaggagtcaagccccgtggcgagggcatctgactgcaagccttagcacagcccaagcagggttatgtgctctctcaagaaacggaacaggaaggaggaggagacagggtctggtttagctttcaggcttcaagtgccacctgctggcaagaaggctccgtgcaagggctcattggcccagagccagagaaggg

SEQ ID NO: 195433 - DNA, 169 bp, Homo sapiens
acccttgtagctcagacagttatattgaattctaatatcttatatattgaaaattataatcatggtggttaatgttgtgacttatttaaataatattaatgattactgcattgagaaaattaccatgaaattacaaaagacctgccacccttctaacttaactgtcatt

SEQ ID NO: 195434 - DNA, 417 bp, Homo sapiens
caattggtaattttcttctacataaaaaaaaataagactagacaaaattgtaaaaaaaaattacttcagggcactaggaactgactaaaggcagacaaaaaaaatgagaagcatttacttttgaaaaactgctagagctttgggtaaaaataagaactctgtggtactcttgtctggggtttctcccctctttcttccaccaccagactactgggggaaacagtaggtttttcggcctggaattgactaccaagccttgcagctttactgccagaagcaatgaattcaatttggggaaggaagcaaaaacttatcgttttgctagctaaaatggcagacttagttgggactggatggagacaacccacagcactgaaagaccaagactgccattccaatttgggttgactgacagac

SEQ ID NO: 195435 - DNA, 618 bp, Homo sapiens
ttagatatgccagtggagtaatcatggcaggaataataaatgacttttctctttactgttcccacagtcattcgccctgtgtggctggctacctgtccttacaaggctgcttctgttgtgggcaaaatgccacagttggtgaagccactatgggatctgtggcctctaacacaagcactgtgggttatttacaaatgtgccctcctaatttctggttgtgggacttttgggagcaaattatccagtccatgaatccacaggccttaaagtgctagcacttcggatgctgtcagtgccaagatggcttagtttctgggactaacctgcttagttcaccttttaggtgctctcttagcagctggcttctctcaaataaagtgaagcaaattcaaacgcattccttctctgtgatgaattcagccagtgtgttttatgctgctttctttcctcttgagggaaatcagatagtgggcagtgccagtctctccctcttgtggaaaacaagcccctagttggcctggcagtaattgtgcctgggcagacaaaggctgtcacagtgactgtcctgttcttagacttctgggtgctctagagccatcagtggagcttataaagact

SEQ ID NO: 195436 - DNA, 457 bp, Homo sapiens
ctcccttattgcccaggctggaatgcagtagtatgatcatagcccactgtaaccttgaattcccatgctcaagcaatcctcccacctcagcctaccgagtagctgggaccacaggcacatgccacaatgattggctaacttatttttatttttctgtagagacagggtctcactatgttgcccaaggtggaaaggcaatattttttaaggtactatgtgctaggcactatgtaagcttaaatcttgctgagcttcatatcttagctacatctcttttgatccttacaacaatcctatgaagtgagtaatattaacatccctattgacagaatgaggctatgagaaactaagtcactccagttcacatggttagttactgacacagccagggttcgaaaccaggccaactgagttttaaccactactccaattagctttctctgggcttatcatgtct

SEQ ID NO: 195437 - DNA, 284 bp, Homo sapiens
ccttttcctgtgtcaccagtagcttatcagtgctcaactctctatcgttacaaggcctttcatcatctgaccaatcttatgcatttcccccaccataaatctaaagctgcacttgtactaatacgagcagttaactgaatgagccatactgtttcctgactcagagccttcacatatgttctctccactatttaggatgtcttaccttctcttgtcttgctggcaaagtctactgatttttaaagatacaacgtaagcacgtgtctgcttatatttttattttt

SEQ ID NO: 195438 - DNA, 420 bp, Homo sapiens
caatggctagggaaattaggaaaaataagtaaatctatacaacagataaaaatttaacagtaaattatacagatcagatttccttcctgaggctaccaaaaataccttttatcagcaattattccttggtccagcttaaaaaaatatatagcaaacaaagctaagactttgtgaaacctcatctaaaatgagacctgggtacagaaactttaatacattatttattagggatttacaagggaaaatcagagacccacaaataggaccaagaatctcaaatgagttccaaatatttcagcaataaagtaacgaattgcgtattaacagcactgtaattactccttttgtttggtttctttgtaattacttttaataaattattctgcctccccccatcactcaagtaagttgccatccaaa

SEQ ID NO: 195439 - DNA, 600 bp, Homo sapiens
acagtatgtacaatagagtcacattacagagttagcaaatgttaacgaaacagaacagaaatacgtattagatgctcttaatctaagaatcataaatcacctctttacgtgttccggatgatcaaatgaacaattttctaactctcttatattctctcagtgagcaatcattgtcacataccgtcgagcggcggaaagaaaagcagaagagcaggctggtctcgaactcctgacctcgtggtctgcccgcctctgcctcccaaagtgctaggattacaggcgtgagccaccgcacctggcctgtcactcatgttttaataatggttttaacttaattttataaaaaatattattgaaaaatgcaactcttttcctcttgggccgtaattctggacttcttgacagcctataaaaatcttagatctgacagatactacatacactagagaaagtactactaaatgctctgcaaattgccaaataatggtaagaatggaagattgtttagtcttccctaaaacagctccttggagtttgtgttccaatagcaaaataaaacttgggccacaaaatttgccaccatttagcaacaaattaatt

SEQ ID NO: 195440 - DNA, 472 bp, Homo sapiens
atagagcagtgaggaagcttttggtagcaaggcattgatgttggaagctattgatggatgaggttgatagtttagattaaggtggtgccatgagctggagagaagtggatggatatgaagagatactagaaagtggaatagtgagccagcaatagtgcaaaaagtgtaccctcccggtgttctttcttgccagctgaaattaattaacagtgtttaaacatttcttggtaaagttggcatttaaagcacttccagcccctttaatggagtcttcaaaggcatcctaggtagaggaaaataaaaagttttccctcttagaatttcttggggagaaaaaaccaggtgcagtgacccattcgtatagtcccagctacttggaaggctgtggtgggaggaccaccttgaggccttgagtttgggactagcctaggcaacataacaaggcactctctctatttaaagaatttctttg

SEQ ID NO: 195441 - DNA, 371 bp, Homo sapiens
tcgaagtcagctcagtttctgagtatacacagaattcaaataagaattgagatagttaagagatacctatattttaaaaattgaattaaatccattgagtgcctatggactgtatccttcagatcatgtagttaaaccgcctcattttagaagtgaggaaattaagtttcagagaagttaaatgacttttctaagatcacccactaccttacgtggtataagaactaggactgaattgtagatctcatccacatctagtccttttttctctacacactgcttcctgtcaatcaggtgatctgaagccggtgacctagattagacaagcggggtgggacctggggttggcttcagttaactaggaggacaga

SEQ ID NO: 195442 - DNA, 412 bp, Homo sapiens
tcggtactgatgatggaaaatggagtcatttttatttaattaccttgaagagattgaactcaggatgtttaaatatggtgaagggatgctttagtagctttcttgcagtatttcttaggttaaatgtagctggccgggtgcggtggctcacacctgtaatcccggcactttgggaaactgaggtggtcggatcacctgagcgcaggagtttgagaccagcgtggccagcatggtgaaacacatctctactaaaaatacaaaaattagttggccgtgatggcgagtgcctgtaatcccagctactcgggaggctgaggcaagagaattgcttgaacccaggaggtggaggttggagtgagccgagatcgcgccactgcactccagcttggcaacagagtgagaatttgtctca

SEQ ID NO: 195443 - DNA, 110 bp, Homo sapiens
ggtaggtaggctagaacctagaggaggggagcagagcgtgctggggtcttttatcgctctccgcgcagtgcgtgggtctgcggatccgtggaggtgcggagcctgactcg

SEQ ID NO: 195444 - DNA, 704 bp, Homo sapiens
aggaccaggcgaagggttctatagagaaggggcagttcactgacagtttctgagtagaggatgataccatcagatgtgtatctttagaaaattaagggcagcaaaaaaaatgtataggtgaaaaatgcactgggggcgggagacaagcttggtgccgggggtctaaattagagcaatggaagagaagggctcatacaggactgtgaagcctccggaggcagaatctacatccttcccagaacatgcctttgaaggcacatctgcggggtgaaattggtactaaatgcttataagatggttcttcatcatttctatgttaacaattaacacgtacgtctgacccggtttcatctaacagaaaaaaagccagggggtgggtagttacaaaattagtactaaagtgatataattctttttttttcccctgtatggacttatttctgtaccagctattaatacaaaccaaaaatatatgtttacaaaaggtagtatttcctttactaatagtttctgtttatcctacaaatatcctaggttccactgtaagtagaatactgactgaatttataaacacctaagtagtatcttcctaaagcaacacaaaacttggtattagaaatggaggaaggccagatgttacacaggagtgatcaagacagaggtcaaatgccaactgcaaggaacacatccctgcgactgatgag

SEQ ID NO: 195445 - DNA, 161 bp, Homo sapiens
ctatttctctttccagtagagattgatgaaatatacagctagtgtgtaaccatggaaaaattaataggtctattctaattagtaaaggaccaactgtatagttttcaagtggcctgggacccttggtcttcttgtccttactgacttttgtgcatttttgg

SEQ ID NO: 195446 - DNA, 662 bp, Homo sapiens
ttatagcccaacacattggtgaactagaaggccaggcagggacctgtaactcttgtaggctgtgattcagggagttctgcaaggctcaccagctgggtgcctaatgcccaccatggaagtttcccttctgtgtaagcactgttgctagaaaacttgtgtataatgcaaatgtaagttgaggtcatgtgattggtttccaaaagctatgtacaaaactcactgtaagtcattatattaatatgctgaaaaaattcctgctattaatattacctagcagagcaagatctttacagatgggttatgggatgggtttctgagagtggaagtagaagtcagggtatcattggcatgccacaagcctcatcgctgctctctgccctcatgggattttctttttaaaagctttttggcatcctgtatcaaatttagagaaaaattgaaacagcgagaggtgttaggtgacagaatcacagcttgttaaattttcctaagttaaatggaacaagattaaactcaagaggataatggaaaaatcctgcattgagattaaactatccacttacaggtaaaggacatcagggacctcagtttctgttttagctgacagcatattgattttgagccagttgggtaatgtatagctgttgagaacaaaaagtcag

SEQ ID NO: 195447 - DNA, 447 bp, Homo sapiens
ctgtcacccaggctggagtgcagcagtgtgatcatagctcactgcagccttgaccccctggactcaagcagttcttcaggtagctgggactgtatgcgagctccatgatggctgactaattttttaattttttgcagagatgggacttgctttgttgccaaggcaggttttgtttctaaatcctggcctcatacagtcctccagcctcagcctcacaaagtagtgggattataggcttgagccatggtgcccttctgagaccctgtctctacaaaagatgtaaaaaatactagctaggtgtgatggcacacacttgtagtcccagctacttgggaggctgaggtgagaggatcgcttgagactgggatgttaaggctgcagtgagctgggatcacaccattacactccagcctgggtggcagagtgagaccctgtctcaaaggaaaa

SEQ ID NO: 195448 - DNA, 301 bp, Homo sapiens
gcatattataaggtgctgacagtaaaggaaataaatgctacaatttatggagtgagatttaggtcataaaatgtgttttggctgcttgtctgcattttaaaatttatcatcaattatttttgtaatctgcatatttaaaaagatgtacatatttgtttccgaaacaatattaaatgttgaaattttgagaggtctaagtttcatcgatttttcttctccattctttccttgataaaaaaatgagaaaaaaaaaactttttttcaatagttttacttacaaaacaaattgccacaaattaaa

SEQ ID NO: 195449 - DNA, 390 bp, Homo sapiens
  misc_feature (9)..(9): n is a, c, g, or t
gggccgagnggccgcggcccctgcaggacgggaggcctgtgtcgctatgggttcccccgccgccccggagggagcgctgggctacgtccgcgagttcactcgccactcctccgacgtgctgggcaacctcaacgagctgcgcctgcgcgggatcctcactgacgtcacgctgctggttggcgggcaacccctcagagcacacaaggcagttctcatcgcctgcagtggcttcttctattcaattttccggggccgtgcgggagtcggggtggacgtgctctctctgcccgggggtcccgaagcgagaggcttcgcccctctattggacttcatgtacacttcgcgcctgcgcctctctccagccactgcaccagcagtcctagcggccgc

SEQ ID NO: 195450 - DNA, 622 bp, Homo sapiens
  misc_feature (9)..(9): n is a, c, g, or t
gggccgagnggccgcggcccctgcaggacgggaggcctgtgtcgctatgggttcccccgccgccccggagggagcgctgggctacgtccgcgagttcactcgccactcctccgacgtgctgggcaacctcaacgagctgcgcctgcgcgggatcctcactgacgtcacgctgctggttggcgggcaacccctcagagcacacaaggcagttctcatcgcctgcaggttcgaggggtggggcctggggcggggccaaatgggaaaggggtgggaccacagggccgttgagagggaatccgaagccaagtctttcagaagcaggaggcggagcgtcccagaattgggggcggggtgatagtgaggaggcgggactttttcagggggcggggcttcctgaagctgcgcatgtctcccttggttccccagcccccaaaggacttatctgctctctctctagtggcttcttctattcaattttccggggccgtgcgggagtcggggtggacgtgctctctctgcccgggggtcccgaagcgagaggcttcgcccctctattggacttcatgtacacttcgcgcctgcgcctctctccagccactgcaccagcagtcctagcggccgc

SEQ ID NO: 195451 - DNA, 539 bp, Homo sapiens
caagggagcgagggtgtcgtagagggcagaatgaacaagaagaattaggagggaggctgcgtgtgccggggctaggggctggaagtcctggctctagttgcacctcggaaggaaaaggcaaacagaggagggaaggcgtcttaggactgcctggatccagagcactttccacggcctctacaggcctgtgtcgctatgggttcccccgccgccccggagggagcgctgggctacgtccgcgagttcactcgccactcctccgacgtgctgggcaacctcaacgagctgcgcctgcgcgggatcctcactgacgtcacgctgctggttggcgggcaacccctcagagcacacaaggcagttctcatcgcctgcagtggcttcttctattcaattttccggggccgtgcgggagtcggggtggacgtgctctctctgcccgggggtcccgaagcgagaggcttcgcccctctattggacttcatgtacacttcgcgcctgcgcctctctccagccactgcaccagcagtcctagcggccgc

SEQ ID NO: 195452 - DNA, 680 bp, Homo sapiens
tatcgcccaacacactacgtgagtaaatgtcctctcatatgtatgatagatggaatgaatttcaccgatagggagttttgtaagtagaaggaagttcagtacttatagggtagctacaaacctaaagcactgtgccaggcatattccttggaatcttgcatttaattccatggactctcaggcttgtaaggaggtaggcacacactcacatatttgacatggttaataacaagaagtgttgagagtaaaattactattgtgagaagagaggagagaaattgtgaatgaaggaacttgagaagttcatgcagtgttggggataacatgatttatcgcccaacacgccccacacttctataaggtagatactactgcatcctcattttacgtaagaaaaaactgattcataagagggttaaggaacttgtacaacatcacacaagtaaacggtgaagctaagatctaagcccaggcaatctggacccagaatccaaactcttaaggatgccacgctgcttaagaaatgtcttaagcaacaagcaacttgcaaggaggataaagctagttccctaaattataggaaaaaacaatgattgtcaatcactagtgactgtcaatcactgttgttaaatttgaatcctaaaatctcattgctggtgttggggataacatacgggtac

SEQ ID NO: 195453 - DNA, 524 bp, Homo sapiens
  misc_feature (5)..(5): n is a, c, g, or t
gatangctgctttcttgaaggctattgggtatcttattcctcttatggatgcagaatatgccaactactatactagagaagtgatgttaatcctgattcgagaattccagtctcctgatgaggaaatgaaaaaaattgtgctgaaggtggtaaaacagtgttgggcgataatgttatcgcccaacacgccccacacttctataaggtagatactactgcatcctcattttacgtaagaaaaaactgattcataagagggttaaggaacttgtacaacatcacacaagtaaacggtgaagctaagatctaagcccaggcaatctggacccagaatccaaactcttaaggatgccacgctgcttaagaaatgtcttaagcaacaagcaacttgcaaggaggataaagctagttccctaaattataggaaaaaacaatgattgtcaatcactagtgactgtcaatcactgttgttaaatttgaatcctaaaatctcattgctggtgttggggataacatacgggtac

SEQ ID NO: 195454 - DNA, 392 bp, Homo sapiens
ctatatggttggacgatcagcacagttcttccttttccttctcaattcaatgattatagatttgcttcttgcccatttcttcccttttctgttttcttcccccacaaacctgagatcaggttgctgtctgagaagaagccgacgcagcatcccctccttggcagcatcccctccttttgcggggctctttggagtcttctcaggatggtgcctccacttcttcctcagcggctctcagtttgctttcacagttcctgttcttccacaccagcttcctggtctcctcctctctgaaagccatcgttgactggatgtctcaggtatctgccgttacttggccacatgttacgaaaccccttgttttatgtctcctttcctcgccagcctgcagt

SEQ ID NO: 195455 - DNA, 699 bp, Homo sapiens
aataaaaacaacaaaagaagccatgggtagtatgtggtgaaaacaaaaagcaattaattgagattctccactcaaagaccttgaatttggcttagatggttcttcatgaactgttttcctaagacagatgagatgggcaggcctctaaagagtatacagttagtgacagacatgaagatctgtccttcccacagtacatggcaggcttcagaccagaagacctgaaaggtgctcagtttcactgcagcttctacacttctacctatagctaaagggatgttaagaaaccctctactctaaaccacttattttatactaaagagctaaggtgatggtggcccctccctccccaggcacttgtggtcattcttgagtagggctgtgctagggccagttggagtcaggctgctcaaatgagtgaggagatggtacttccctgcatacttcctacttaaaaaaaaaataaaaaactggctgtaggggcacctatgtggggttcagagaaactgtagcatctggcattctgggttcagaggcttgattggaatcacatatagcacagaactttaaaaggccaactggaacaaacatactggagtgtcctgggcctaccttccttcctttgtgcctcacacctcacagaccacttgcagatgcattagtgcactgaatgaatcctcagcataaccctaaaaagta

SEQ ID NO: 195456 - DNA, 260 bp, Homo sapiens
gaaaaatttttatttgatattcaagaaaaaatttccaatcttatacaacctatttaagagtataaacagggcatggtaggggtttgggggtggtgctctccacctgaatgaagcataatagaggaccatatgagaaaggaaatcacttgcaggtctcactcatgaagatagttgcaaaaatcctaaacaaaatatcagctaaccaaatctagcagatataaaaaacttaccaagttgagattatcccaggtctgcaaggg

SEQ ID NO: 195457 - DNA, 421 bp, Homo sapiens
ggtctcctagattcagtgttcagaggcagtgtccagtagttcccaaaagatctgattattttcttttccctatgtttagttactgtagtagaaggctatatgaacctttgggaaaagttagaaggaaaattaacagtgtcaggcctcagtaacatatattaagtttgtttctcaaggagatctgtcctcgctttccttaaacatgttctggatctgtaaaataggggattcttccatgaaggcaaaagggttgatttagagagaaaagtttaagcgtgggaattgattgagaggccttcactctctgtttttatggttgagttatatttttgttcacttgacctggaacttttctgcttatctagataagtatgaatttagcagacttcctatctgtttcacttctaggactaccacagtt

SEQ ID NO: 195458 - DNA, 510 bp, Homo sapiens
cgagtgtacagggacggaggagaaggcgaacggagagcgtaatcagcaggcgggtagtactgggacaggttaaaaaatcattattttagcaagtaaggtcttttggcaaaactgcccaagttctataacatcaaaactcttaaggagcagaacttgatacgagaatccaaactagtaccctttctctatgagaatataaaaacacaacaggacttctaccacactctatctgtagaacccaatttagaatgccaagggcatgtaattactaactagaagataatttagtggagaacacaataaaacagccttacatttttatgtgaattaaacctttcttgtcaaccaaattttccgtgatggtgtatctcaaacatcatctatttaactatcagaaatctcaagccacttcacatttctgattatttactacgaacgtatatagggtagaagagaggggaacccaggctttataatcattgacctaaatttgacataggctctgccact

SEQ ID NO: 195459 - DNA, 370 bp, Homo sapiens
cgcaccactgcactccagcctgggcaacagagtgagactctgtctcaaaaacaaaacaaaacaaaacaaaaaaacaaaacttctgcaaatctacagtaattataacagtgtgctactggcataggatagacatatagaccctggggtagaattgagagcccagaaacaagccctcacatctattgccaattgatttttgacaagggtgctaagacctttcactggagaaagaatagtgctccaaaacctggatatcacatgcaaaagaatgaagttgaacccttaccacataccatatgccaagactaagtgagaattgatcaaagacttaaatttaagagctaaacttagaactattagaaacatcagt

SEQ ID NO: 195460 - DNA, 185 bp, Homo sapiens
ctgaggctgcgtctaagctcggtgaaagagaactatgagaatgggagaaaacatctgcaagctatgcatctgacaaacaactaatatccagtatctacaaacaacttgaatcagcaaggaaaaaaaaaaatcccatcaaaaagtgggcaaatgacaggaacagacatttctcaaaagaagatata

SEQ ID NO: 195461 - DNA, 482 bp, Homo sapiens
gtataagctatggaaacaccatgcattatggccataaaatccaagcaacaatcagctagtacccttcacccaagcctctctcactttaagtcaccactgctcactgctgaactgcccacatctctgtcattaccaaatctaataacgacagctctgctgatatttattctacaaaagctggaccctatgtagcagacatcagctaccattttgtttgaagatgatatccaaatcaatatgcccaaaccaaataaaagaaatattttgctaatgagctgccgaatttcatggaaatgtattcagaatgacaaatggtccacctatttactgacctcagtttgcttcaacatgtaccatggaatcaaaacagtgcaagtttcttgaggataagcaattggggacctttcttttgtgccaccctccccacctggtaaagtgataggttccttgcagctgctgagtaagtgcctgtagatgcgatg

SEQ ID NO: 195462 - DNA, 838 bp, Homo sapiens
aggccatgtcagccgagagagaagcttctgggtcctgccttctccagggagcctcttgaggacataggctgagtctgcctcaacctggggcctggctgggactgccttgtgtgcagccgcgtgaggggctggtgggtccctttgaggagatggacctgggctcctcccctctgtctggtgagggagctccacacctgaggtccgtccttcaggttctggggggaggggtcccgtcaggaggctgtgggctgtgggggaagaagggcccagaaatacaatcccaccactgctaagtcctgttgctatcctcctgggcccactgcagatggggccaccctgccacccgcggatccccctggcacagccctgctaggacctttctatggggatgaaagggggtctcagagggtgtggccactcaccaaggcccacgtgagaggaccctggatcatcctagctcctttgaactggatgctccggggccacctccctgttaggaatgaaaatgccgccctttgcatgacacgaggagccaactgcttccgccaagggctcaggcatggctcttaggggattcgcacgcatctgcgtagggctggacttctcacagtggactcccacttgctgggttaggaaactgagtctgtgcgggacaagctctgcgggacggtgccccggccgggatccaggcggctggctgcccaccaccctccccaaccctctgtctgcccaccggaatgtggcccttcctgggggagccagtgactgcccagcctgggatcctggagccccggccctcctggcagagctcacactctggcagggtccgaggagcttt

SEQ ID NO: 195463 - DNA, 283 bp, Homo sapiens
cactttccagaaccttgaaatgtttttccatgttctaacatggtgatctaccttattcttttaatttttcttatttagttgtctttacacatgaaacacatgaatacatccttgtgataaacattttcagtaacataaaagtataaatgttacaaagccaacgtgccctttcactcaactccctgtccacccagtctctcctgtctgctgggagaaccaccgcattgacttgtgtgttcacccttccaggctcttttctgcacgcttatatgacgtactacat

SEQ ID NO: 195464 - DNA, 366 bp, Homo sapiens
tgatcccctttatgtgaggctctgaaccgaaaaaaccactctgtggtgggagagatcagaacggtggttgccccagggtggggggcttcaaaagggaggcacacaaggacatttctggggtaatagaaatgctctgtatagtgattggggtagtggatacatgagcgaatccatttgtcaaaactcatcaaactgtgtgataagaattttcagtaacataaaagtataaatgttacaaagccaacgtgccctttcactcaactccctgtccacccagtctctcctgtctgctgggagaaccaccgcattgacttgtgtgttcacccttccaggctcttttctgcacgcttatatgacgtactacat

SEQ ID NO: 195465 - DNA, 322 bp, Homo sapiens
acaaaaaaaaattagctgggtatggtggcatgctcctgcagtcacagctacttgggaggctgaggcatgagaattgcttgatctcaggatgctgaggttgcagtgagctgagatcatgccactgcactccagcctgggcgacagaaatttttttgtttcaaaaaataagataaaatcttaagaaaaattaaaactagtccgggcgcagtggctcacgcctgtaatcccagcactttgggaggccgaggtgggcggatcacgaggtcaggagatcgagaccattctggctaacacagtgaaacccgtctctactaaaaataca

SEQ ID NO: 195466 - DNA, 623 bp, Homo sapiens
aaaagatctcagacttccgccctccagaagcataagagaataaatcggtgctgttttcagccactgtttgtgctcattgtttatagcagcaataggaaactaaggcactatgcaaacatatgccgcgtatttatctccattagcactttcagctactctgcaacttatttttctaggcctcaaaatactattcataaagcatctatggaagcttttgcctcctgttacacaaagtgagagtagaataatctacttttgtcttggcacagaaaatttgcaatgaaatgcaacacattttaattcttacacaaggctaggaaacattattagtgatattgcaaaaacaaaaatacacttccaattcagacccacaaaatgagcactcttcgattataattctattcacctccctgtgagtaccatgctattggttttcttctgggtgtggcaggaagtttcagtgaaagagaaagaaaaattaacagataagcccaagtacctggccactcaggctgaaaagggagtggtaggggaactgaaggctagatagtcaaggaaggttaactgtatgctagatggccaaggaaggccaaggaaggtgatcactgatctgcccgcccccg

SEQ ID NO: 195467 - DNA, 614 bp, Homo sapiens
cagcctcccaccagctctcaacttgatgcttagacaagtcccacaataaagttgtttgattacaagttaactgatttcaatacacgtatattatgggcccactctcagcaggaagtacatgattgtgaggacaggggctggagtagcaacccagcagcatctacagggagtcgggcctcatcatctccactaaacaacaagtttatctaagcttttattccctttagtaaacaatgtccacctatcaaaatttaccacattttagaagctatactaatgttcacattctttgacccacaattctattcctgggaatgtagctaaagtagtccaaaagaggaaaaagggacaacaccatgtacataaagtgttcatttgcttaacaaatgtttattaagagcctaacttgggccaagtccagtagttagcactaagaatacagaactggatgagatctggttaattcctacctctgagatattcaccgcaagcaaacattttcctttatgccaacaataaacagtgggaaacaagtttataattacaatcaacataaaatgcctaggtatccaattaagaaatccagaggccaggcgcagtggctcatgccagta

SEQ ID NO: 195468 - DNA, 215 bp, Homo sapiens
gctacagtgcaagttcccgagaaaggtaaacttcaggtggattagctgtcagcaaaaggaggtgggctgagcccaggttggggtgctgactgtcccagtgcaccaggtgggtttcatctgagtctctccagatggcaccacttcagggaggacctgtgcagagtggtctgggcagggctgccccaagcctagcctccagccaccactcccccacc

SEQ ID NO: 195469 - DNA, 481 bp, Homo sapiens
acagaaaaaagattatacaccatgatcaggtggtattttcccccagggatgcaaggatgtttcaacctacaaatatcaataaatgtgatacatcacatacatcacatcaagagaataaagaacaaaaccttgtgattatctcaatagacacagaagtagtatttgataaaattcaactcctctttgtgattaaaaaaaaaccctctcaacaaattaggtataaaaagaacataccttaaaacattaatgttcgtatatgataaacccacagttaacatcgtactgaatagggaaaagttgaaagccttttctctaacatagaacaagacaaagatattcactttccctaagatccttcctctaagatctagaacaagacaaggatatttactttcaccacttttattgaaaaatggtcaatcacatcgttttcttttattgaaaagtggtgaaagagtcctagacagagctattaaaaaag

SEQ ID NO: 195470 - DNA, 498 bp, Homo sapiens
accctcacctgtgcttttcctcatacagccaccaggctctgcctcagggcttctgcccttgcttctcctatccagaacattcctttcctgaatttcttcaagcctcactccctcctttacatctctgtccaaaggtcaccctttggacatctttcttacagaaaggtcacactttctgtaagacattccctgaatgtcatttgaaattacaggccccttgtaataaaagtgctgggaaaatccagcactttgggaggccaaggcaggtggatcacttgagctgaggagtttgagaccagcttgggcaacatggtgaaaccctgtctctactaaaaatacaaaaaattatccaggcatggtggtgcatgcctgtagtcccagctactcagagtctgaggtaggagaatcacctgaacccaggaagtcaaggttgcaatgagcagtaatggcagcactgcactccagcctgggtaacaagagtgagaccgtgtctcaaaa

SEQ ID NO: 195471 - DNA, 141 bp, Homo sapiens
gacagcatgactccagaatagtcttttagtcatagttgtgcaggacacacatagttgtacaggacactgaatatatattttgcccccatgttcttcatataccatatgttattggctaatgagagctagcacaacaggcta

SEQ ID NO: 195472 - DNA, 423 bp, Homo sapiens
caatagggttgaaagtagagcagaaagggcaagcagagaactagacagagaagacagatgacggaggagaggaggggaatgactgccagggccaggtcccaggagagtgggaaggtattattacatcaagcataccaaccaacaggttagcactggctccttggagagaagggcgaaagaaacaaggaaaggtgaaaatatccagaaattagagatgataagaaaggatgctggggaagcacttgttagggagtaggggatcttttcaggaaaatgagggggagaggggagtcttctgctatgatttcagtgagacaccaacagctgggacttaaggagattgctatgggctatcaactgcacagtcattaaaaaaaaacatttactcagggccttctctgccccaggaactgtacatattta

SEQ ID NO: 195473 - DNA, 649 bp, Homo sapiens
ttccctagtaaaacttcaattaccttttttgcagaaatggaaaaggtgattgttaaattcatagggaattgcaagcgatcctaaatagccaaaacaatactgaaaaagaactctgaggactcatacttactgattttaaaacttactacaaaactacagtgatggagatagtgtggtatgagcataggatagacatatacattaatggaatagaattgagaatccagaaataaaccaatacatctgtggccaattgatttttgacaagggtgctgggcattcaggtggaggaaaagagtagtctcttcaacaaatggtgctgggacaaatggatatctacaggcaaaagaatgaagttggtccccccctacatcacaccacatacaaaaactaactcaaaacagattaagaacgtaaatttaagacataaaattataaaacttctagaagaaaacacagaaaaaaattgtcatgacctgggattggcaacagattattacatgtgacaccaaaagcatgagcaacaaccacaaaaatagataaattggaactcataaaaataaaaaacttttgcacatcaaaggatattacctagaaagtgaaaagacaacttataggagaaaatagttgcaaatcatttatgtgataa

SEQ ID NO: 195474 - DNA, 328 bp, Homo sapiens
actgtccctgcgtcatgaagtcccaaaataaactctaacatggtttagactgctgattatataccatgcttattactactgacaacgtattattttggttatagcctatagataccttagattataatctatccatcctattaatgtttgaatactttctacattactgacttttcaagcttaaaactaacctcaggaataattcagtccaggggtcagcaaactatggtccacagaccaaatctggttcatcacctgtttttgtaaataaagttttattggcacacaactacatgcatctgtttacctgctggtgatggctgctttc

SEQ ID NO: 195475 - DNA, 493 bp, Homo sapiens
atataataatataatatttttcagcttttaagaagttgaagatactgccatttgtgataacataaatgaatctggaggatattaagctaagtaaaataacttagggagagagaaaaatactgcataatttctgttacatatgaaatctttaaaaaggtttaatacatagagacatgatagagtgatgatttgggggataagagacacaagtcaacgtttcagttatataaaataaatgaatctagaggactaaagtacaatttaaaggttatagttactatttttatattatatactagtgatttttgaacagggtaaactttaggtgctttgacaccaaaaggaaactacatgagttcatgtatatgttaaattgtttgaccgcagtcatcattgatatgtatatgtatatatatataattatgggctcattaaatttaaatgctataaataggtaacaaagaataaagttaattgaaaaactgcatcatta

SEQ ID NO: 195476 - DNA, 260 bp, Homo sapiens
tggcaaaaaaaggatcaagacatagaagtactttggatcaaattctgtagaatcagcctatttgagatgcattaaggttaatgccaaaaccaatacggtgttctgttcacagtttctttctagaggttttaaaagccgaaaaacattaaaactcagagtttgaagtggaaagtttctatctgtaaaaacaagccacttttaggtactataagctattaagatttggtaattctaaattaattatgtattttttaaaccct

SEQ ID NO: 195477 - DNA, 301 bp, Homo sapiens
ccatgtttagataagaaggtaaaatcagaaacaggaatcagcaaaaaggaaactgaaaaggaagtcagagaaataagaaaaccaggaaaatgttgtgtcttgtaaattagagaagtcagtgttccaaaaaagagacagtgatcaactattagtatgtcagttgctgctggaagccattaaccttcatgtgagccatgtccagaaagaggcggtacccatgtctctaccttgggaaacataaaacatggaagtcatgtgacgggctgaggttcccgaggagagcaaaacactaagcttagtg

SEQ ID NO: 195478 - DNA, 502 bp, Homo sapiens
gtgaatcaggtgcctgaattgtgtgccaggcacaataacaggcacttgggaataaaagttatacaagacatgacaccttctcttcagtcttttacagtctggtgggagcgacacacaaacagatgattataaacctattgtgctgtaaatcagttcaccaaaagtgccacaggaccatagggaaagggcttcaactcagaatggaaaaagcaaggaaagcttccaaaacgaagggatgcttgaactcaggaaaaaaggagaggaagagtcttctaggaaggaaggggagacaggagaaatgacagtggaaaagcagacagggagcaggccatgacagaccccgtatatgatactgacaaatctggactttgttagaaaccagaaggaggtcttcaaggataggagtgctatgccaggcacagcagcacatgctagcattcccagctactaggaaggctgaggtgggaggactgcttgagcaagaccttgtcttaaaaaaaaa

SEQ ID NO: 195479 - DNA, 271 bp, Homo sapiens
tgctgggattacaggtgtgagccacggcgcctggccttttctttgattttaataatttggtttactaagtctgttccctgtccatttgctctgcaaggagtcatcagagcctggcgcttgcagtacccccaggtccacgtttagatgatcttaaaacattgccataatcttgcacgatggccttgcacttaggcagtgccagtattcctatggtatacagtgaaggggcattcggtttcagtaactctgatttgtaatcgtcctacgtgga

SEQ ID NO: 195480 - DNA, 941 bp, Homo sapiens
aggtgctcaataaatatttgttgaggcagggcatggtggctcacgcctgtaatcccagcactttgggaggctgaggcaggaggattatttgaggtcaggagtttgagacctgtctggtcatcatggtgaaaccccatgtctactaaaaatacaaaaaaatcagccagctgtggtggcgggcacctgtaatcctagctactcaggagattgaggtaggagaactggtggaacccaggaggcggaggttgcagtgagctgagattgcgccactgcactccagcctgggcgacagagtgaggatccatgtcaaaaaatttaagagatgggtctctgtatgttccccaggctgatcttgaactccctgcctcaaataatcccctcgccttggcttcccaaagtgttgggattacaagcatgagccaccttagcctgcctattttacttatttgcttacgatccatctatcttttcacatgaggatgtgaactccaggagatggggacttctgcttgcttcactgcttcgtctccagccccttacatgggaccaggtacacaatagacgctcaataaatagttgttggataaatggacaaattaatcccaataggtggctcctgggaaggatgctgggccttgttataaatggagcctatggtcgggcgtagtggctcgggcctgcaatcccagcactttgggaggctgaggcaggtggatcacctgaggtcaggaggtcgagaccagcctgactgacatggcgaaagcccctctctactaaaaatacaaaattagccatgcgtggtggcatgtgcctgtaatcccagctactcaggaggctgaggcaggagaatcgcttgaacacaggaggcagaaggtgcggtaagccgagatcgtgcccctgcactccagcctgggcagcaagagtgaaactccatctcaaac

SEQ ID NO: 195481 - DNA, 288 bp, Homo sapiens
tttctatgtatatgaattgcccccacctccagactgtgagacgggattaaatgagatgatgagaaagtgcctggaaaactgaagttcttcaaatataagggctgctattcctctaccttgattatggctactaaaggcctaagattaaacggaaatcgtgtttatttttacaaacatatttcaagtttgacaactctttcacactagggatgctagtcaacactattatccactaacacctacagtataagcaaagcaaaaaaatctttcttccatagaaaatatctg

SEQ ID NO: 195482 - DNA, 164 bp, Homo sapiens
tgcgcccggacaaggcagtgcaatttttaaaaattctatttgtgtttaatactgccagaatcagatttttcttcttcaattaagtgactgcattttgtgactaatacactttgaaataactgtataccacattaaatatggtaatacatcggctcaccaatata

SEQ ID NO: 195483 - DNA, 389 bp, Homo sapiens
gacatcatttttgatatttgactgccaagagctttcaagctgtacccctttcctcagggcaagctaataagaaagcccaagtgagccatcctttggaacaggtgggaagttcaaaccaagacctggctgaaggggcatataaggaccttcactccagactcagcaacttatcaccataaaaggagagccagtatccttttcctgctttctcaagccattcttgtacctgcatgggaagcctgccctgctctccccaaaaagcctcagtaagtgagtcataaacccttttcgtaccgtcctggtgcacatatggtatcatcagtttccacatcttaaccaaattttgcagtggggggagaagtagtggatccatccgcctctgcggagta

SEQ ID NO: 195484 - DNA, 339 bp, Homo sapiens
cttcagtaaaaatttacgatcatacacccaaaccagaatgacgaaaagtaaaaagactggcagtaccaagtgctgtgaggtgccgtgcatcttgctggtaggagtgtccatgggtcatctggggcttgcaggctgcactgccacagccacctccttttctcatttcacctggggaaggctgttgggtagcacctgctagaatgaagagtgtgtatgcgctgcacagcagctctgctcctgggtgtatacccaacagaagtggatattaatgtctctcagaagataggtacaagaatgttgtatctttattaccttataataaaatttggaaacaataaa

SEQ ID NO: 195485 - DNA, 590 bp, Homo sapiens
ttcacggaaatttagaaaatctcccagcccctgaacatacgaaaatattttatcattgaaccttaatgagcaaaagctccacatttctagctatcatcctatggcctcacaatagttagaaaaaatgcctttttccttcatcagcatatatgcaaagagtaaactggtatgagctggcactcagatgggttttcatcagtaacatttggtgagtggtatttcctaggatcataaggcaacatgaggttcgtgcaggtacatagtcttctagatcctgaccagggccaaggagggtctagaatttcactgaaaagcttttgcaaagctcatgatcaaggtttgcccttcatctgctccagaaatgaaatctgaaatactgcaacggggccaagaaggaagggggccacctgcttttgtactttgctgctgcttgcttccttgagaattctagaacttttttctcccctctccttggagcctagaagcccctaccagaccccttagtttactacatatggattttttactaacattaacaagaaaaaaaaaacctcatatatatgaactgcaagtttgcagaagcaggaaga

SEQ ID NO: 195486 - DNA, 1197 bp, Homo sapiens
tcgtagttaagggccagtcaggatcagacatcttgccctgatggaaaagaagatgaacagatacctcctgacctggatagcaattaattctggggacctagatccccaaggactttaggatgaggcagcagtttggatttaggatcaacatggtatttaaaatataaaagcattgtagtgttggggaagcatcatttaaaagaacttgtggggtccctgtcaggcccctcttgagacaggccagccccacagaagagaaggcctagggctggctccctagggttgtgagaaactccagaacagtgttgacttctttcttcccctagggtcacaccagcatgtagcatgatgccttgcacacagtaggtgctcagtaaacacttttggaccactgaatgcaatgaccaatggataaaaacattgttcttcccttgaccagataagacccgcttccctgggcgtccacaggccgctggtgatgcacactcttctctgtgtggcctctgcctgccgggggaagccttgtgaccagtttctccccgctgagtcaagggagaatgagggggagcatgaacatttgcttgtttcccttatggcttctgaatctttattttattttttttaatgaaaatgtctacttgaatttaggtaaggaagaccttgctcttagtttttgaatttgtgaactagaaaaaaaaaaaaggtctttcaagtgaacactagcagaacagtctaagcaatcatgataaagacctaattcctgcctctttctcctgctctgatggagctgatgacagcacaaatgggagagggagaatgtagcaaggacactgaaggacagagagttgtccaagccaccaggaaggtgaaagtgggaattcattttctgtgccattgggtggttccttaggaaaaaacgtagacaaagaaaaatattgtattatttgtggaaatcaagttcgtattgcaggtgtaagaaatgtctttgtgggttgacagcatttattgaacatgagcctttatttttggagctcctccaacgtaccatgcactgtcaccttaacagttcctcacagtgaccccatagagtcaagagtcaactgcatttttgcagaagcgaggctcagagaggttgagggttgtcctaggtatccaggtagcgagcaacagagcaagaatttgaactcgggttgtaac

SEQ ID NO: 195487 - DNA, 462 bp, Homo sapiens
aacacacgtgaatttacactaagaaatccactgaagtttttgatcgagggaagatacaggaccaagagttgaattctaaacataactttgagagtacttgtgagcttacttagtagagactatatagaacttataatgtgcatacatggttctaaacattataaatattaattattgcatcagatattttctatgaacacaataagcataggtttttatttgtctctgtactcataatacacaaagaatttgtgagtctggttttcttttattctattcattgcttctgttgtttctcgcatcacattttgtttccctgtacgctttgttatttctgactgtactgctcattgacccttgaaaattaggaagaaggtgccctcctccggagattcatctttgattctgccaggtatctgggagtggggttaggaacctggaactggttctaccttaaacttg

SEQ ID NO: 195488 - DNA, 762 bp, Homo sapiens
gccacaagaggctaaggaagagcaaaataaacgtcgcgattcgcttctcacagttctcagcccttcgcgctgaactattgctgagatggtgggttttgccagcagccattgtagcccccgggcctggctgcattgctcacctccctcagccttgttctgtccctgtccatgagatggaagtggctttctccagtcagctgtgtgtgcagagaccgggggctccgggcagagccgagtccatcaggactggaggaagtgctcacagcaggcaggctccctgggccctgggtgggaggcctcagggatccccgtacctccttgctcaccagccaggctcgacctactgccctgtggggcaggtcaggctttttccacagctccctctctgggaggagggtccttccaagtgagggtgtggtgtagctggagaatccctctttctaggggatttaaataagcagccccagccggacgcggtggttcacgcctgtactcccagcactttggggggccgaggcgcacagatcacgaggtcaggagtttgagaccagcctggccaacatagtgaaaccccatctctactaaaaaaaacaatacaaaaagttagctgggcatggtggcaggtgcctgtaatcccagctacctgggaggctgaggcaggagaatggcttgaacccggaaggcagaggttgcagtgagctgagattgcaccactgcactccagcccaggtgacagtgcaagactctgtcgcaaaaaaaaaa

SEQ ID NO: 195489 - DNA, 391 bp, Homo sapiens
agctaatttttgtatttttgtagagacagggtttcgccatgttgcccaggctggtctcaaactcctggactcaagtaatccacctgccccagcctcccaaagtggtgggattacatgcgtgagccaccacacccggcctaatgtagacattttttatgatttttggaaaagggggccaggcaccaaattctaacaatttgggaggctgaggcagatggatcacctgaggtcaggagtttgagaccagcctgaccaacatggtgaaaccctgtctctactaaaaatacaaagttagctgggcatggtggcaggtgcctgtaatcccagctacttgggaggctgaggaaggagaatcgcttgaacctgggaggcagaggttgcagtgagtcaa

SEQ ID NO: 195490 - DNA, 427 bp, Homo sapiens
atgtccaaacaaaagttaacaagcaatctcaaacattataaacagaccaggcgcggtagctcacgcttgtaaggccagctactcgggaggctgaggcagaagaattggttgaacccaggaggcagaggttgcagtgagccgagatgacaccactgcactccagcctgggcaccagagtgagattccgtctcaaaaaaataaaataaaaaaaagtactgtctacttgctgcaaaaacttatttttctacttataaaactttaaatttgaaaactgttgattagcttttcagcatctgagggttatttgttttaattttactttaatagtttaatgtgtaaaacatattggcaaaacttggtcatgaagaatccaaccatgattacattatgagccctgtaagttattaatatcaatgtaactgtaatt

SEQ ID NO: 195491 - DNA, 741 bp, Homo sapiens
ccagccaatgttacgacttaggcagttgtcagattccagagcctgtcttattaatgatcacctgcgccacctcttgagtaaattaatagtacttatttttatcttaaaatgtcaattcctagtattttgttactcaaacgttttaaaaatgctgactgactcaaagaatcttactagaccaatgagttagattgatttctaagttaaaaatactgtgaggcagggagcggtggctcacacctgtaatgccagcactttgggaggccgaggcgggcggatcaccaggtcaagagattgagaccatcctggccaacatggtgaaaccccatctctactaaaaatacaaaaattagctgggcttggtggcgcccgcctgtagtccttagtcccagctactcgggaggctgaggcagaagaattggttgaacccaggaggcagaggttgcagtgagccgagatgacaccactgcactccagcctgggcaccagagtgagattccgtctcaaaaaaataaaataaaaaaaagtactgtctacttgctgcaaaaacttatttttctacttataaaactttaaatttgaaaactgttgattagcttttcagcatctgagggttatttgttttaattttactttaatagtttaatgtgtaaaacatattggcaaaacttggtcatgaagaatccaaccatgattacattatgagccctgtaagttattaatatcaatgtaactgtaatt

SEQ ID NO: 195492 - DNA, 196 bp, Homo sapiens
caagtctcaacacatttctgctctcggattcatgaggctccctgtatcttagcccaagtccccttccctagcgaggccacttgatactggagtcttaactggcagagatgagaaacaagactgagcacagacccgctgcctcgtgggagcccacgccagagggcccacacccaagacagacccagacagcatatca

SEQ ID NO: 195493 - DNA, 413 bp, Homo sapiens
gttcttctaccatttcatgaaaagattatccttctctactgaattgctttggtacgtcttcaaaaatcaattgatatgtgtggggctatttctgggcactttagtttgttccatggatctatatgtctagctatatcatattatcctgattactatgccctataataaatattaaaatcaggtagtgtggtaacatggaaagatatttggtctttgttcccagttattggtacagagctcctaaaactcttgtgtattagtccattctgtgttgctaaaataaattcctgagtctgggtaatttattcaaaaaaggtttatttggcccatgattctgatggctggaaagttcaagactgggcatctacatctagtgagggcctcaggctgcttctactcatggtagaaggtga

SEQ ID NO: 195494 - DNA, 385 bp, Homo sapiens
catacactaaccatagagtagcttgggggatgtttttacaggggatgccttatatgtgctacattagaaaacaaaaacttggtagtatcaaataaagcaccaacagaaaactgaatgaacttatttgcatttaaacacaagagcagagtgaaaaaatttagactgctatctcatcaaaaacaaagaaagcatataatgtttaaaatgcacagggatagctttagaagatatacctgatgctaaatgacgagttaatgggtgcagcacaccagcatggcacatgtatacatatgttactaccctgcacatcgtgcacatgtaccctaaaacttaaagtataataataataaaataaaataaaataaaatgcacatacactatggca

SEQ ID NO: 195495 - DNA, 431 bp, Homo sapiens
ataatctgtggcagaggggggcagagtgagctccattccctgtggactctaacccatatctgggtttgcagggtgttgtctatcaaaaggaggaattgcccttcacagggagagtgttagagccactgaggcagaggtagccatctcgctaagtgctcacaagctgcttctgtgaaaggccctcatcagagtccctgcagaccctgagagaatgcagccctggcaccttgttttggtgacttaaagacaaggcagaggttctaacatgacagggcacaaaaataaaactcagaggaaggtggggtctattctgttctttttttttttttttttttttgagatggaatctcactttgtcacccaggctggagtgcagtggcacgatctcggctcactgcgacctccaccccctgggttcaagcaattatcct

SEQ ID NO: 195496 - DNA, 407 bp, Homo sapiens
cttggatctgaaattaatgtttcccactaaatttggaaactttttacccattatttcttctttttttttcttgccaaacattttctgtcttcttctgagattccaattgcacatacgttgtaccacttcatattgtcccacaagtttccaagattctttttgtttttctttaatcttttttctttctgttttttgcattgaataatttctcttcctatagatctatcttcaatttcactgattattttgccatgtataatgtgttattaaccctacctagaaattttaaatttcagcattgataatttttatctctagaatttcctttttttttttcttatgcttcaaataaatagaaaaatggttataatatggatcttcaaccttgccattcatgcttttatgca

SEQ ID NO: 195497 - DNA, 331 bp, Homo sapiens
gcactgaggttgacagagctgaaatgtgacttgtggagccccaggatggacactggacactcaagagcaaaggccacatttgaaagtagagttaaagcaaaatagcgtaggggcccattggttgtttttatggccaggtgaacatggggccactcacctggtctgtggaatctgctcaggtacttatgcccttggctccgcaaaccttccaggaaaataggaaccataccttggccaagatcaacagcttttaaagatttcagaggagcaacaatccctggaggggtttaggaggccctgagcttggccatgcacagagttccaggtgtga

SEQ ID NO: 195498 - DNA, 205 bp, Homo sapiens
taggagaggcagggaggccccttcctgagagcccccggagggagcatggtcctgagacacctgatctcagacttttggtctccagagccagtagaggatgaattcctgttgaattaagttccccaggtgtggtcatttgtcacagcagcctcgggagacgagtagagacatagatcgggcaggaatagaatatctagttgcattg

SEQ ID NO: 195499 - DNA, 297 bp, Homo sapiens
ctggagagaggatggcccacattctgtaggagaggaaaaatcggtaaaactgttgcccatggtaactcagaaggttaagaaatccacctaataaacttgtgagtctggcaaaggggatttaaaagcaaaatttgggagaatcagttggcttttttttttttaagctgtgtatgatgcagcatggaaagaaaaagataaacaaaagaattgttcagtttgcaagtcaaatttagagaaaaaagagctagggtgttctagatcaggaaagaaaactgttcagtatttctaatatctcca

SEQ ID NO: 195500 - DNA, 293 bp, Homo sapiens
gttggggcctctgcagttgttccagctacccagtgcttttttattattcttcttgtccgaaaacatagagtagaaacagtccatactcattccttaatcttcctgtgttcataacgagcaagcaccctagatgagtaagaatctaccttatttttaagaattagcagagaaccatatgagtttcccttttcctcccctagaaacgtcctcaggttggctaactttcctattgagcaattcctcacagcaatcactccgcacacctctcatctgagaggctgtcttcccattcc

SEQ ID NO: 195501 - DNA, 760 bp, Homo sapiens
tcacagcacagctagggaggagaggggtgtggcctctgggaccagacggcctggattcaaattctagctctctcagttcctcgttgtgtgacttcaggcaacttacttcacctctctgtgcctcagtttccccctctatgtcatgggctgatagggttagagcctctagaaccaggtccctcaacaggggtggcacccacgctcgggctgggtaagtctttgttttaggagctgttgggtgcattgtgggaggctcctcggcatcttcagcctccacccagcagaggtcagtagcatcacacgccccatacccccgactttccctgccaattagagaaccgaaaacctctccagacagcgcagatgcccactggggagcacaggtgcccagctgagaacactgctcaggaacagtggctttcaaccctgtgcatgcaccagaatccctgggagcgcttgttaaaacacagcttttgggctgggcgtggtggctcacacctgtaatcccagcactttgggaggccgaggcaggtggatcacccgaggtcaggagtttcagaccagcctgattaacatggggaaaccctgtctctactaaaaatacaaaaaatcagccgggcctggtggaatgcatctctagtcccagctactcgggaggctgaggcaggagaatcgctagaacctgggaggtggaggttgcagtgagccaagatcgcgccactgcactaaagcctgggtgaccgagcgagactctgtctca

SEQ ID NO: 195502 - DNA, 302 bp, Homo sapiens
tccagctggtctcatatctacggggtgtaaagagaaaaagggggggatttcttcagtaatggaagcacacatcccaaaaacaaggaattaatattagccccagcatttgtcagagaaacatcagcagaagcttctgccgcactcttcagctgttttttgtacttcgccctttgcaacagattattataggactcactgataagcctctagatctcatacccattaaggatttaaactttccaaataaaacattcctccttgagaaatagaatctttgctgtgtgtctatatgtgccctcatt

SEQ ID NO: 195503 - DNA, 409 bp, Homo sapiens
gaactccctttttacaactgatattttccttaaaagctgaaaacacaatcacattctgcaaaccaaattccattttcaaatgaaagttcaactgccctataaatggatattactgtgaatttttataaagggggcaatcctatcattgtaaagcaaatgaccactccttaatgtattaatgtaggatatttagatgtttgtgtttggttttgattaaagctctgcccatattcttgtagccattttaccataaaactaagacagtaaaaccaagctccaaaaagacctcatgtcttgtccaagaacgccctaagactaactccacactatcatgactcaaatcccttccctagtcacccagtttcacagcctagatctctaaggaactaagggacttgatctgatctct

SEQ ID NO: 195504 - DNA, 108 bp, Homo sapiens
aattgttgagccaattaatgaaaataaatttcttggacaaatatcagagaaacattgtttatgatttatttatgtttactagaaaaccatctgaaataaagctgtcag

SEQ ID NO: 195505 - DNA, 497 bp, Homo sapiens
atactataggaagaatcctaactgatggacatttggttcatcttccctctttgaatgtaaccttgaatctattgtaagatcatgataggaatacatagactaagagtttgctttatgccctcagtttgctttctgtgttctattatatttgcttttcacatctaactggtaaagtaggcaagacaagtactattaatgttatctttcattttacagaggaggaagctgctcagtaaagatgagtaagctatctgggcacagtggctcatgcctgtaatcccatcactttggaaggccaagataggatgattccttgaggcaaggagttggggcaacatagtgagacctcatctctacaaaaacagaaaaaattagctgggtgtggtgatgtatgcctgtggtctcagctacttaggaggctgaggaggtaggatgaattgagctcacaggttccttgcaccatacactctagcttgggtgagacttgtctcttaaaa

SEQ ID NO: 195506 - DNA, 588 bp, Homo sapiens
atgaggtgttacaatgaaggtggtaatctggtaatagcaatcatcagatacaaggcaatagtcttattaagggcctattatgccgacacggtggcttacacctggaatcccagcacttcgggaggctgaggcaggtggatcacctgaagtcaggaattcaagaccagcctgaccaatacaatgaaaccctgtctctactaaaattacaaaaattagccaggcatgagctaccacactcagccctagcctacttgaaacgtgttcagagcatttaagttaccctacagttgggcaaagtcatctaacacaaagccctttttatagtaataaaatgttgtatatctcatgtgatttattgaatattgttactgaaagtgagaaacagcatggttgcatgaaaggaggcacagtcgagccaggcacagcctgggcaacagagcgagatcccgtctctctctctttctctctctctctctctctctctctctctctctctctctctcacagagagaaccatctctaataaaaacacaaaaattagacatgtgtgataacacacgcctgtactcacagatacacgagaggctg

SEQ ID NO: 195507 - DNA, 232 bp, Homo sapiens
ctatttattctactcttaactatgggtaaggcactggatcagattctagatatgttgctgaccaagtaaacagaaagcatagtcgataagtgcaccagtaacaagttcaaggtgcttagagggctgatttgaaggacactaaatttagtcacatgggagtagggaaaggcgaatgtggagggaagactaggagttcactaagtacagaggctgagaaaatagtgttcactaa

SEQ ID NO: 195508 - DNA, 636 bp, Homo sapiens
aaaaaagcaccgcctttactgccagttaccaatcctgcttctgacaagtatgtatttgttttgttttagttaaagaaaaatcataagtaacatagaatcttccaatctggaagctaaggagtataaggtagcaggtttaagcaaacaaacaaaaagctagtactctaaatgagaaacagaacaagcagcagaattagttggagttcatctaagctatacaagaagcatacatacaacgaataaatcacgcaaacaaaatcaactttgacagaggatgtggtcacttatcttagaaaaaaggatactattgtggggcaaattaaaccaggcaactatgtttcttcagggagtcatcataaatggctaaaaagcctagaacgtaaaagtttagcattatatagacactgtatactgccctatacaccgccaccataactgcactgaatcatgtagctggagtgccagcgaaatacagggcaactccaagtacaaactgccaaataggcgaattctaagttttagctcaaggtcagtggtgtattatgtgatttaatgctcagtacctcggttttaaaatacattagatttttactttaacgtagagtgatgataaagataagtctgccactactctgc

SEQ ID NO: 195509 - DNA, 466 bp, Homo sapiens
cttagcacccactggtattttaattatgtgtttacaccccatgtctccctactagactgtgcacttgagggcagggattgtgtcttgtttatcactgtagcccacccacagcctggcacaatagacgcttgttgaacaagtgactgaatgaattaataaaatggaggcagtgagagaataataaatcaaacagacatgtgtacttggtggaaaactagaaatgggagaaaaagagttctttagcaagagctgaaaggctcagggaatggaatttagtggaccagaagtttaccgaaacttgacagctagatcttaaaggtgaacaaaaaagcaatgcttggactgcctgaagagaggaataatatataaatcacaaggcactaaaagctaagaactccaagccagatatagatacatcccttagctagagggcaagaccagacagaaagaaatcagtgagaatctg

SEQ ID NO: 195510 - DNA, 330 bp, Homo sapiens
cggaaatttcggagactgtagagaaagtcattcttccacccagacctgtattgaatgatgtaagtgctgcattacagaagctgtgtggagaagtatggttaagttatccagctggaagggaattaggtcctggagaagtgaacccagaatttcctgaagcagtacagccagtatgtagccccctaaatcctccaggagtgatatcaccatgggctacgatggacaccatagttccagacaggaaggatttttattcctccaatgtagttcctgataaaactcatgaagttggatcttatttagctgcccaaatgtctccatcagaccaga

SEQ ID NO: 195511 - DNA, 339 bp, Homo sapiens
ggcaccctctcagctcccaagtgctgggatacaagcatgagccactgcacttggcaggttgaattttaacacagatttcaaaatgctaaaccaattctacactcctagtcatgatgaattactcttttaatatattgttcggtttgatgtgctaaaattatttgaagaatttttacatctgtgtttatgagggatattggtctgtagttttcttgcaatactttgtttttggtatgaaggtaatgctgacctcatgaaataagataggtatatttctccctcttcaattttctgggacagtttgtatacaattggtactacatctttctgaaatctgtg

SEQ ID NO: 195512 - DNA, 387 bp, Homo sapiens
acaaaccctgaactgtaaataattgggtcacatatgagctcatgatgtcttcatattagtatctgtcacagcaagttggacagtttcttatgaaaattggagtctcggctgggcgcagtggctcatgcctgtaatcccagcactttgggaggacaaggtgggtggatcatgaggtcaggagttcgagaccagcctgaccaacatggagaaaccccgtctctgctaaaaatacaaaattagctgggcatggtggcgcatgcctgtaaccccagctactcgggaggctgagacaggagaatcacttgaacctgggaggcagaggttgcggtgagccaagatcacgccattgcactccagcctaggcaaaaagagtgaaactccatctca

SEQ ID NO: 195513 - DNA, 185 bp, Homo sapiens
tctcaaggtattgggattataggtgtgagccactgcatctggcctcaattcacttttaaaatcaaaattaggttacctactttttataaggtaatgtatagaattattcttttaaaaataaaaccgatttggacagtgtgagattcacattctgtaaccaccagtgtgacatgggtagtcacaga

SEQ ID NO: 195514 - DNA, 406 bp, Homo sapiens
aagtttccaagatggtgtagaacatcagagaggggctcttggagattatctggccatcgtcaccccacctgcttatagatggaaatgcatagactcagagaggttgggggacatatgggcagctatagaaatccagtggacctcaaatcccgacatttctaacctgaattaaattctctcacccttgtatggaggtcctagagtcctattttccaaactttgcctctgaatgtctccatgtcaaagggtttctcagtgtgccagagggcaatggagaatggagcagaaatgaccacagaagaacaggtgggaagattcctgcaacagcaaaaattctgctgcccggttcctgagacatgaagaatgtgttgtctacacaactacatggccagctgcctccttaatt

SEQ ID NO: 195515 - DNA, 634 bp, Homo sapiens
gaggctccccgactagtccaaccatacagaggaagagtgaaatgctacaaagtttaaatagaagggggagaaggaagaaaaaaagaagagaaaaaaaggaagaaagaataagtgtaatttgagaagggagctaaaaaaaggtctgtaactggtagagacatagttaacaagtggcacatggggtgagaagcaggtaatggtatctgatagtgctagatattactataagatattttgggcagttctaaagaaaatgagattataaaactttccttgagcaatccagcgatagtaaggaaattcagtaaggttttaaggaaatccaataaggttattatcttccatgatgatgatttttgtcattaacattcacctttgtatctctaatacctaacactaagttagcactaaacaagtttctattgaacaattagattttgaactgtgaagatttagtggaaatttatttggtaattcttaaccattgcattcataaaagattgtgcttcaatttcctttagcaacttttaaaattataatttggacctaattttttaaaagagtgaaattgtgaatttttagttattctactaaaccagcatttgaaaaaaaaataataaataacacttggaag

SEQ ID NO: 195516 - DNA, 524 bp, Homo sapiens
tatgacggttgtttgcagggctcttggtctgggccgggtgctcgtcggagtggccagtggccttcgggggtggccccacagcggcctggctgtccccgtagggcatcacacatccaaggacatggtgaggcctgcggcagccctggaggtcagaatgcctcttcgccggcacagcagccatgaagggcagccacgggccctcatccgccacgaaaatggcggcggcggtggcggctgcggtgttggagccagcagtgtggcacctcagcgcggcgctgccgcagggagacgcgtcacaggagaaggtgggacagaagcaacaggatcttcattcccggtcccacagccatcaccggaggcaggggcagcctcattgttctgccttccgggcactgtgtcctgctactgcatctgctctttctccgagccaccccgccagtccctgcttaccgcagaggtgcatccgggccaagccctgccctcaacgctgtggcaaccccccaggccctgcccttcgcggccgc

SEQ ID NO: 195517 - DNA, 347 bp, Homo sapiens
atcctaccttactgttcttcaagacccatttctaatgttaactgctttgtgaagcttcgcttactctcttccatttttgttcttgtagaatttttataaaactcttttatggaatttcttacactttgtagaaattatttgtttttatatttgtctcctctactggaatatgtgccccttaagggcagagaaaatacctttcatttgtatctccagtgttaccatttttcacagcttataatagatactagtaaatgtttgcagcatgaatcagggcaaagagaataggataagatggaagaaatggagtaaatgcttgtcaaataaatttgttctgtgcccattcc

SEQ ID NO: 195518 - DNA, 198 bp, Homo sapiens
aagctattgcactcagtgagagcccgatttgttcgctttgtgcccctggaatggaatcccagtgggaagattggcatgagagtcgaggtctacggatgttcctataaatcagatgttgctgactttgatggccgaagctcacttctgtacaggttcaatcagaagttgatgagtactctcaaagatgtgatctccctg

SEQ ID NO: 195519 - DNA, 248 bp, Homo sapiens
actctagaggatacccccttccgcacagtgagctatgatggtaccactgcactctagcctgagtgacagagcaaggctctgattaaaaattacacacagaagtggcagatagattcctggtagcctataatgtcagaacataagtgctttgtgggctggaactttggcttgcttaccactctaaaccccagctgttacagatctgatggatgaatgaatgattgtaacaactgctgattaataagcca

SEQ ID NO: 195520 - DNA, 271 bp, Homo sapiens
tccacctgcctcggcctcccaaagtgctgggatgacaggcttgggccactgtgcctggccatattatgtatatttttaaaaaatttatgtagggtgactattctagggggtaagaattttcattaatgatggggtcatttaagtggcagtgggaaatgtgtagtccatactttaatgaaaaaggattgttagtgatattaaggcaaaaagactaaaagggcagtacttctgtttttgcttttgggaactataaagggctccatatgtttta

SEQ ID NO: 195521 - DNA, 543 bp, Homo sapiens
ctctgctaagccaagtgataaagagaaaatcttaattgtaaaggaagggaactagagcaaaaataaattttagtagctctgttgaacattaaaaatacaccataactatgtatatttagcctacagaactgtgactttttgggaaggtctcacagaaaactcttcactgtgcactcatttgttcatttatgcaaaaacatttattaagcatccaccttctgccaagcaagtggtttgtggcacttcagagacatcagtgaataaaatcgccaaagcccttgggcagcttaccaactaactacaagtgtacccaaagagcaaactactgagtgtctttcctgcctcatttatataatttttcagaaacacagagcaccccacataatcatccttattcctcagaacatcagctctaggaacatccctgggcacaggctgccagggtgcagcagcttagctgagagctgtggtcctgacattcaaactaggccaccgggctctggtcccacccaccaccttgtgcttggctatgcgcagatcaga

SEQ ID NO: 195522 - DNA, 384 bp, Homo sapiens
atctttcttgcctgctagctctgaagagattggctgatcctgatgagtgggattcccccagcacagccaacagcattgctaagggacagactgcctcctcaagcaggtctctgaccccatgcctcctgattgggtgagacctcccatcaggggtcaccagacacctcgtacaggagacctctggctggcatcaggtcagtgctcttctgggatgaagctaccggaggaagaaacaggcagcaatctttgctgttctgcagcctccacaggtgatacttaggcaaaaggatctggagtggacccccagcaaactccagcagacctgcagaagagaggcctgactgttagaagaaaaataaacagaaagcaacaacagcaatggca

SEQ ID NO: 195523 - DNA, 409 bp, Homo sapiens
agcatatttggaggaagaagatcaggaaattatttgggacatcataagaccagtaggcaggtggatatatgcatcttgtattcagaaaaggaatcttggctggagatctaaatttgagattctccagcatgtgactgaatggcaatccaagaagaatgcatagatgatgaagagagccctgggctgagccctaagaccttcttcttgtttaacgtggaaggagccaacaaacaaggtagcagaagtacagtcagaggcaagaccacactggagggtatcacattctagaagttaagtaaagcaagtatttcaaaataggacatggtcaactgtgtcaaatgccactaatcaagaaatgatctcctagtattgccatgggatttggcggctgtagagcttgatgaaactt

SEQ ID NO: 195524 - DNA, 1012 bp, Homo sapiens
tccgggctgcaggaattcggcacgagcagctgtctgtacacctacccacacacgtgcttgtccccacccacacagcacactgcttccccgcatcccacccaaccacaatctgcatacatctccacacacatacggacaccccacacccacctcccaaactcacttatgtgccgtcacacatgtgcccacccatgcataaaccccccccacccccaacacctgccccatccaaccccagccctcaccaactcacccactgccacccatgccttacacatgcacacagccacaagccactcccatatgtccccccccaacacaaacatactaacctcccctcgacacaaacataaacttcttcccacctggctcgcccaccagcacacatgaatgcacctttgctgaggctacttcctggccagggttcctgcaaggtgaggcctccatttgtgtagagccccacttgggggatacaggctctgccttgggcatgacacccctgaggatactggggttctaatcaggcttgtactggcccatgagcggaggaccaggcagggagaggcaagttgcgaagacccatgtctactgcctcctcctttccatcagagattaggtcctaaaacggaggtgtcacttacggagaagtatcccattgtcccgacccccagctccacagccttggctcagtgatttttgcccaggggagagacacaccataaaacagtgagcttcacacctcatcacaaagaaaccgatttcatttttaacagagcaaagacagtttcaagcctaatgttgagaggcatttggaaggagattggtaaattcactggagtaacagactaaactatagactggctaattgctagagaaaactaagaaaagagagacaggagaagccttcctgtggtcataacaagtctcacacaccccaaggactgatctaaagagcacacagcatacaaagaaacatttattcaataaaatcttttaaaattcagtaagaaca

SEQ ID NO: 195525 - DNA, 130 bp, Homo sapiens
taaaacaagaagggtgacatgttggtagctgttgaagatgggtgttagagacatgtgggttcattacactattttgtctctgtgtgtgaatttctgtaaaaaggtttttgtttttttttctttttttttt

SEQ ID NO: 195526 - DNA, 649 bp, Homo sapiens
tctcaaactcctcagctcaagtgatctgcctgcctcggcctcccaaagtgctgggattacaggtgtgagccagcgtgccctgccctaggatatactttttatttggttgtaaaaagtatgtggtagttaaaaaaatagatttgggacttaattctgagttaggttactggccctgccatctactagcctaatgattttatgcaagttttaactctgagcctctgtttcctcatctaccaaatggacatgtttgaggctacttgcctcatagagttgtaagaacttgaggtgatgtatgaagctcttagtgtagtactggagacaaggtcaagtgcttgcagtctctgaaatccttggtgaaacaggcaccctttaccacggtgtcagtgctaatggaaatgataggctggagtttgagaatgtagctgaacctccattgcctgtgtcagtgctaatggaaatgatagggtggaagtggagaaggtagctgtatctccattgcttgtatctggtattgttatcctcatgctgctttgtcacatcctcctcgcttgtactttcttcagtctcaagatatctatgcctctatgacttttatagtgaggtatagtttacgaagtcacttccatacatatcttatttgacatga

SEQ ID NO: 195527 - DNA, 530 bp, Homo sapiens
  misc_feature (41)..(41): n is a, c, g, or t
tcgagtcgtgaccgactgcaatctgtgctcgtgaattcagntgcttgttcggggcagtggaaatgttctaaaactggattgtggtgatggttgcacaaccatacacatttgttaaaaataagctgagtcgggcgtggtggcaggtgcctgtaatcccagctactccggaggctgaggcgggagaactgcttgaacctggaaggtggagattgcagtgagccgagatcatgccactgtactctagcctggatgacagagcaagactccatctcgggaaaaaaaaattaagaaattaacgttgatacaatattactttgtaatccacagatcccatttaaatttccctaattatcccagtaatgtcatatgtaggtccaggatgcagtctagagcatgtgtgctgcatttagctgtcatgcctctttagtctccctcaatggaaaaagttccatagtcttttttatttctgttgaccttgacatttttcaagagtacaggtttgtggaatgtgcagcttgggttggctgatg

SEQ ID NO: 195528 - DNA, 469 bp, Homo sapiens
agtgcaattacttaggccctcaattccaaattaaaaagaaattccttaatatctgatcatttattgtaagtcataattttaaccttatgtatatttttatgtatcctcaaatcagttctaaaattagcatcaggaaatagctaaagaaagagaaagtgtcagcagttagtaccaggtaattttatcactttactgtgtactctgagagagaagctttttgaatggaagtaagagtcatgatgatttagattggactaaagcccaaatgctcatagaacttttatactagtaatatgtagatacatgcgtgtctttcttccagaagaaaataatctataggaaaccatctaaatctcagagttcaagagaaaaaacttcaagactatcaaaaattccttaagatgactgagaaaattgagctaaatttatttgaattatttaaccaaaagagcactcctctatttttgac

SEQ ID NO: 195529 - DNA, 241 bp, Homo sapiens
tctgctcttggaacccagctgccatgctgtgagaaccgaaactagtccacattgggagaccacatggagaatacacaggtatgttttctggctgacagaccagctgaggtccctgctgacagccagcatcaactgccagacatgttagtgaagactgctggagatgattctaatcctcagccgttgagtcacaccgtcctctccttgccttcaagtcttcccagctgaggcctctgacatc

SEQ ID NO: 195530 - DNA, 292 bp, Homo sapiens
acagacaaattggcacacaggaagtgcccaataagtaatcaccaaggctcttcactgcccatcctagctgcttccgaaacaaaacaagccaaagggctcccagcggcagccctttttcctgaactgacctacgcaggaaagagtccttgccacaattaagaaaaatctttaatcaatacagttgaaaattgaaacattatttcacaaggaacagccattaaagccagtggttaccaagaagtgagtaagtagaagaccagccccttgttgaacgtaacaaactacatgtctc

SEQ ID NO: 195531 - DNA, 403 bp, Homo sapiens
cctgcacttggttgacagctctgctgtcacgttcttgaaatcttcaacaattttctctttgaacttgtattttgtaagggagccagaggagcatgaggatgagcagaggagacaggcggaagaagggagagagctttatattttagtaccttcagtggcacatctcccctgccttttgaacaaaagacccacaaattatgtagcaggctgtcagcagtcctgatggaaccccctcccatgtaaccagccaccgcacaaaggagggagttaaagactaacaatcaagctgggagcactggctcacgcctgtaccccagcactttgggaggctgacgtgggagaatcgcttgagaccaggagactgagaccagcctgggcaacatggtgaaactctgtctctaca

SEQ ID NO: 195532 - DNA, 477 bp, Homo sapiens
aacctattcatgtaacaatatctgtattcaaggaaatctggaaaacaatctttttttttttcccctgagttgccatacacctgcttaacatgtctacttttatagcaagggagaacaattattgagagataagtagcagtctctgtcatacttttgtagaatcttaattttgagaagctgtaattaatcttgtaattaatcatttgtatactttttcaaaaaacattcattgaatatctaacatctcactaccaagagtagatcaggacctcctgttccactcttatagattctaatacctttcatttgtaacattagttaataatattatgattttgaaatttgattaaagcttatctttcccacaagactttagaccccatgaaagtggatattgttgttcatcattttatctctaatgcctggcacctactatgtgattgatgtataatttttgcataaataaataagtaaata

SEQ ID NO: 195533 - DNA, 213 bp, Homo sapiens
tgaatataggataaggaggaggaggaggaggaaaaggaggggttagtcttgctttctcaggagtggcagaggtggaagaaaatctgtgtgtaagtggatccatgcaggtcaaaaccgtgttgttcaaaggtcaactgtactcacttttaccaaagagctgctggacagggagagggaggaatgtggaaaggggcatgttgatgaaaaagtgca

SEQ ID NO: 195534 - DNA, 362 bp, Homo sapiens
gttcctggcacagttcctaaaaccattggaatttcctgagtagtagtatcttttgttattcctaatgagcccctttgaactatctctgagtttaggctaataaagttactattggtgggctcctagatagcttcaggatggaggctggtggccagaggaaccagccatgtgcttagagagaaggggagagaagttgaattttggataaataactcaggatagaagtctaggagtcatcacaggctcttcgtgccttcccaccctccacatctgcttggccatcaagaaccactggtctgtctcctcactgtctcttggatccatttcctcttctccatatccatagccatttccccaaatca

SEQ ID NO: 195535 - DNA, 504 bp, Homo sapiens
tggcagtgattctgaagcctgtagaaattatcaggttttaagggattgagagttcaccagtggtccactcttggtgaagtaggatgccttgcttggtattgttaactcccacatcatctctgtgccaagaaaaagacagcacaatgccaccaacatctaaacagtggcatctaattgatttcaatcttagttcaacagtgtgaccagaaggatgtttcaattaccatcaccatatgggacactgagtgtctgattagtagggatgctcctgttcttcattctttaggcaactactcattattgcataagatgttgtctctgatgatgaaattgtatcccaatggactcaaatagtatgcatagaaacttgaaggtgtttcgcttacagccagagtgcaacagaggttttggaacaagctgggtcctaccagagccagaggtgtagcagctgcagacttccactctacccgcacctcacatattagttgtgaatttgataaatgc

SEQ ID NO: 195536 - DNA, 398 bp, Homo sapiens
gcaacggttttgggagcaaaaccttgataccaagttttactcaaaacagaaagtgccaggtagggaacagaaaaggaaggcctgccggtgcgtggcttttcccagagcttggcaaaggccttgttaccttaaatttctagcctcaaaaataaaatgctggtgccacactccccgacacagagccggcctcactgctgagtgtgagagtcaggcttgaaacatctgccttcccttgaacgtgctggtgggcatcgctgtgcaaagcatgacacctgaccccgtaggaaaccccttcttactcatttgcagtgtcactgaaagaaacttatctcctgtgcctgttaactgtcaggtatcactaaagttaaagcaataaagctcacttaagataaaatgga

SEQ ID NO: 195537 - DNA, 301 bp, Homo sapiens
taatactggaccggaaggtagctgttactgaaggaaagagcggtagggacaaggtcaaagaggctggggtgggggaccaagttctgtagggccctaaggatttggtttttgctctgagtggtgccgaaggctactgggggttgaacagaggagggaaaagtgacttctggatgtggtggtgagaataaactgcaggaagcaggggttgaggcagggagcacagtgagagggctactgcctaagccaggaagagggcacacagagcttggaccactgggcacagtaacagctacactggggg

SEQ ID NO: 195538 - DNA, 275 bp, Homo sapiens
agcactttctccacggaagtctctgactcatcgttcactgttcccatgggtgactgatgacatcccaaactctgaaggctggtgacaatccaagtcaggaatatctatcacccactacccacatgtgtggaggaagcattggctctgatgccagaaactcaaattagcttttgatatttaatgtcatttaatcttgtctgtttacttatttaaaataactgtgactttcttagttttcagtatgcattaaagtacattttgtacttgatggaaga

SEQ ID NO: 195539 - DNA, 415 bp, Homo sapiens
atggggtttcaccatgttggccaggctggtctcaaactcctgacctcaaatgatctgcccgccttggcctcgcaaagtgctgagagacaccatacccagcctaaagggagcgattctattctactattcttccttctgctaatccttccattctttaatttaataacgaagattttttgagtacctgtcatataccaggtgctgttctgggccctgggaatacagctgttaacaaaatcatcaaaccacttccctcgtggagcccacattgcagtgagagagacaaacacgacacacactctcaagtccttgaagataaagaaaactgggtaacggagagaagaggccagggtttgttctataatcattaataacacgagcagtaagaagtaaaatttatctaagtaacaactta

SEQ ID NO: 195540 - DNA, 166 bp, Homo sapiens
ggcagaaagcaattgcaataatccggatgagataattgtggtttggaataaggtgttaacaacgggagataaacagtggccagattttatgtgaatcttccctttgatctgtggaccaatataacaagactggagagaacacacaatttcctccctggatatacat

SEQ ID NO: 195541 - DNA, 450 bp, Homo sapiens
tacagagaccgaggtagctgcctctgtgaaaagacattgacaacccccagccccatggaagagctgcctgggaagccagggggacgctaggggccctgcttccatttccaagtgtagcaattccaatcacagcaaaattattttttaaatgttaggcacactctcatctggaaattgtgggaggtgaatcccatagctgtaacacgtaggcaggaattctgcttcttcgatggctcactttcctctggcaacatacgtggcactgagcctgccccatcaagagtccaggattgtggagagacccagggtcacactctccagtgtactcttcaaaaactaaaatgtgttatgcctgcacagtgcttgtgtggtttgccgttggccaatgaaccccagactgccttcctcgtatacacatcctgcaccaatagttgcgctatccttaaagga

SEQ ID NO: 195542 - DNA, 390 bp, Homo sapiens
aacctcagaaagagaagccttggagtgaaagggcagagctggctggaaagtggataggagttgggagacagcaaaaacaacaacccttctgagaatacactctaagctttcaaaacgtcagcttgccgatgataggtcctgtacttgaacttcgcctggtgaaatcaccgtgccttggaccaagtcaatagagcctgcctggccaccagccaagggttcccctgttggagtttcacctaactggagaaaggacctctctgaggccatctttgtggcttctgtactgaacccagtgtctggtgtgaaatggcattcaaagacaaattgatcatgttaggggtgaaggagaaaggactcagggaggggaggagaggctcaaaagggcttaca

SEQ ID NO: 195543 - DNA, 186 bp, Homo sapiens
cttaagtggaatgctccgtatgcacagccaagtactggaagtcagacatcccctgaaatttgttagcattttgagtatttttattgactctaatgtcattttagagcatgtttatgttcatttttactttctactggtatttgacagaatttagtaatctctgtattttaaaatactggtaattga

SEQ ID NO: 195544 - DNA, 385 bp, Homo sapiens
ggaccattgttttctgcaccctaatacttttagtagccatttctgtgctacaaaaacacctgaaatggtgtttcaggtaagcagaaaaaagctcctggcctctagctttcctatttccaaagctcagctagggctctttcttgggttctttctctgagctcaggcaggggatagttaagcctacagttcagttctctgagattcagtcataagtcactcttgctacaatcttctgtgattttgcatttttctttgggtcactgaagcagtatttacctaatgtgcctgtgaacactgtccactttccataaggtcacagtgctgctggcttctgctggtagccttccctgcaggtgactgctcctgactgagctttaggggaatg

SEQ ID NO: 195545 - DNA, 520 bp, Homo sapiens
tcaagctcaggcccttctctctgccttaagctcagagacgcagagcaatttgctggatatcataaaacagtggtgatgcacccggtctgacagtggatcccccagcctctgtagcacctcaagcctctgccggggcgctccgatccacattcaccaagggcaggtctgtgcaacctccagacaagctcctggcctctcttctagcccagccatggtaagtctagctaaacgtggctgggcatgtctccactgtgccagccaggaggaaaactcagaaatgtctttcttggtcaccccagtgaactggtacaagcaggaaagaatacatgggaagaaaagtaggatggagtctgtccctcagatgtggacctgaggcaaggctactgcattcatctccgggtctcagttctcacctgcaaaatgagtggactaaatcccaaccaataaagctcaaaggaggcaacagtaaagatttattcatttaggccaggcacgtttgctcgcatctataaatccaaca

SEQ ID NO: 195546 - DNA, 634 bp, Homo sapiens
tacctaaatggctgtcccagacattccgaatgtgcccgtatcttctgatgtgcgattctacctcaaggcacttgtctcaagtcactaatcattagatgtgcacagatatttagctaaaggatattcatcacagcacttcagcctgcagagtacaggtctcacgaacaagcccaacaacagggaaataaaatcacggtgcctcactgccatgagccactaagaggctgctaaaaataatgcagacatggcaatgtctgtgaaaattgaaaatgcacataccctagtggaaaatacagtaggatttaaatgaccatcaataggggattctttaattaagctgcacccacacactggactacacagccattcgagagaatgaaccaactccatatggtagaaaaccgactgaggccaagagattaatcaagcgaagcgcaaaactacacgactgtgtgtgtaagggaaagtgagaagcacagccatataggtgaggatcgtgtgcacacacacacctgctccgagaaaactaaccgctgcttcaggagagaagccgggcaacagtgaacgtggtcgggcaggaggcctgctttccagacttagtacctttgaatttttctaccgtgtggttctctgt

SEQ ID NO: 195547 - DNA, 352 bp, Homo sapiens
gttgaagatgaggagtctcggagagcaggatggtggtgacattcctcatgtcagctctcgaatttttttgtatttttagtagagatggggtttcaccatgttggccaggctggtctctatctcctgacctcgtgatctgcctgcctcggcctcccacagtgctgggattacaggtgtgagccaccgcacccggccgattgtcttcatttttaggaaagttttaggttcatggcaaagttgaatagaaaatacaaagaatgcccatgttcccctgttcccacatacgcatagcttccactgtcaacatcccgtatcagggtggtacatttgttagaactgatgaacctacatt

SEQ ID NO: 195548 - DNA, 344 bp, Homo sapiens
caatgccaataacctcctccaaagaggagtttaaggtgtaccatcgcaaattattggcttgtgtgggagattctaattttctgttggtttgagtcatcctaaaaaatggttcatttaatcattcattccttctgcctttgctagtttgcccgaagttattaagattatctttgtgttttcatcctcaaacacaaatgtgtattgcgcatagccagtgtgttttaaaagatcaagacttttcttaaaatgatgtcgataacttccaaaggcaactgtgaggtttttttgttttgtttgtttgtttgtcgttttcttttgttttggtctttggaggttattgggat

SEQ ID NO: 195549 - DNA, 462 bp, Homo sapiens
attgtggtctggtcttagcatgaatacacggttaaacttctacaggcacggtatatgttagagtacccgatttcaatgacaattgttcaacagctgtcctcgaaaaagatgcagtttgcagttcttcaccttccgtggttgtctccgctagaacactgaataatagatacactggcccttatacatttgcactggaagagaactacaagagagaatatcatgaaaatcctgcaaggattttaccattgaagacaccgtcattgctacagaaaaggccatgaaagctaccgagcctgaaacaaattcccgccagagaaaatatttgaattctagttctgcccccatactagctgatcttgggcaaatgattttatatctttgggtctcactttctttatctgtaaaatagggaatgatgttattgccaacaccttgttgttataaggatataaatatattgca

SEQ ID NO: 195550 - DNA, 148 bp, Homo sapiens
caatttattatgacatgtttaagcttataaaagtatattgtaacgtgtttggtttgaaaggataatcataacacaaccaaccaccactcaccttaagtcgattatcaatatctttgaagccactctgtattcctcctttatctcagct

SEQ ID NO: 195551 - DNA, 128 bp, Homo sapiens
agctggacttcaattaaaaaaaaatgtattcatattgttgtgcatccatcatcacaagcaattttaggacattttattaccctaaaaagaagccccattcaccttagctgttactctccaattcccct

SEQ ID NO: 195552 - DNA, 306 bp, Homo sapiens
tatacctgcaggagttgtttcaacgtttaaaaatgccatatctgctaggcacggtggcccacatctataatcctgacactttgggaggctgaggcgggcagattacttgagcctaggagtttgagaccagcctgggcaaaatgaccaaaaagaaaaaaaagttgccaggcatggtggtacacgtctgtagatccagctactcaggaggctgaggtgagaggatcgcttgaactgaggaggtggaggctgcagtgaaacatgattgtgctactgcactccaacctgggcaacaacaagactgcctca

SEQ ID NO: 195553 - DNA, 508 bp, Homo sapiens
ttatcttgggcagttcttaggctatagatacagatactgcataaacatgaattggtagtgtgcatcagcaagtacagaagctcgtcaaaaggatgacaacagcttttctaggtttattttttcattttactgaggaaactatttaaacagttttttatttagccagagattgggctttccagtcaagtgagaggagaaaccatggaaatttgatgtatattgatttgagaatcattattggttaatgtattccaaactttttaaggggggaaatggtttggaaaatcaaattgaaatgaaatctgtttgcattgggagtttgaaggtttcagccttaggcgagtacggtaggaactgagagtaaaatacctctctctaggtcatatgatctccaattattagattcattttgaagagaaaagacactgccctaatttaaaaagctgaagtgacttgtgtgaccattttctttaagatgtgattaagtacagaaggcaatcatggttat

SEQ ID NO: 195554 - DNA, 608 bp, Homo sapiens
ggggtaaggggtgagtgtcagccaagtcatcagctatcagaacaggaagccatcaggtaatatatcaagttgatatattgagaaggagcaggatctacctattatataatatagagataagcactcagatatatagattagaaatagtttagaaaatttagacatttgattattcgggaagtagatctgggagtattggagaaacagggtgggggagtagactgcatggaaagctctttcttagtttgtgatttttcatttatgcacataggtttcttacataacatggaaaattcaattaaagaagaaacaacattgtgttctgaggtcccaaaggtgtagtgattaattagaaagactcacaaaaccgagtgaagctgttttactcatagtttattacaacaaaaagatacagattaaaatcagcagcagaaaaaggtgcacaggtcagagtccaggagagacaaagcacaagcttccagttgtcctctcccagtgacatcgtgtggacagtgcctaattcacccagcgatatgtggcaaacagtatagaatatactccccaacaaaaagcttacctgagccttggtgttggagcattttactgga

SEQ ID NO: 195555 - DNA, 425 bp, Homo sapiens
tctagaaccttctctccaagtttggggctaggggcaaggcaccaacaaataatcatacaactacagtaagagaggtttggaatcaaggagacgaaaggtgatagggaccaacccagtcctgggctaccccagcagttagtgactaagaggaggccgggcttggcggaccctctctatggagcgctgtgcctttaagtgcggagaggactctgggttggacttctggggcactgctctgggatgggtgcagtgcggaggacaggctgggggctggggccagggaggagcaccaagtgccagaagcagggcctgcttggtttggggccgagggcccaaaggcatcaggctggacaagatgacctcacagggagcccttccagcttcaggctctttcccctgatggcacagggctaaccctccacccg

SEQ ID NO: 195556 - DNA, 599 bp, Homo sapiens
gaacaatgggaaccagtctttaaaattgggaaaatggctttgtcgacctcaaatagctgctttattagatacagtgaagcagaggacatagaagcaaaaagtaaaacagcaggagaagaagaaatgatcaaggctctcctaatctctgtcagcccttcacctttatgaccttgccttgtctaccagaacacagacccctcttactaaagattagatcctgtgctgaaagagaaaccaagaaaaaagatgacattccagaagaagacaaaggaaatgtaaaacaatgtgaaatcaattatgtgtatgtatgcttttccttttagacctacagatttgacagtgaagtgcttctcaaagtgctttcaaaataaattacctaattagctggggatggtggtgcatgcctgtaggccccactacatgaaaggctgagacaggaggattgttttagcccaggagttcaaggctgcagtgagctctgatcaccactgcattccagcctgggtgacagagcaagaccctgtctgaaaaaatgaaaactgatggacaagaagaggcaacacaatgtagcctctaggacagagcactgagctaaatgc

SEQ ID NO: 195557 - DNA, 833 bp, Homo sapiens
gaacaatgggaaccagtctttaaaattgggaaaatggctttgtcgacctcaaatagctgctttattagatacagtgaagcagaggacatagaagcaaaaagtaaaacagcaggagaagaagaaatgatcaaggctctcctaatctctgtcagcccttcacctttatgaccttgccttgtctaccagaacacagacccctcttactaaagattagatcctgtgctgaaagagaaaccaagaaaaaagatgacattccagaagaagacaaaggaaatgtaaaacaatgtgaaatcaattatgtaaaatttcagagcttccaagaccacaagcttaaaataagtaaagaagacagtaaaattcttaaaaaggctcagaaagatggatttttgcatgagacgcttctggacagagtctcagtcatagtctgccttcatctctgaagggaccaggcgacccacggagtgccttggcagccgcgtcattgcatgcaatcttcacagacaagatctcactgcaaccacctttctacaggagcacaggtgtgatattatactgatgacatcattctcagagaaaattcattttacaaactaaggacacacagaacaaagaaggcttacacaaagggaatggacctttcccaacacagtagtgcaaggccctgccactttgcttcaattcctgaaaattccttggtaaatatggggctgccctattcctgagactttcaaaaaatagttattcatcctctcagcgtctaaaatgttaatacaagcctaatattctttaatctgtgttttgttttttggatgacagagtgaggctccatctta

SEQ ID NO: 195558 - DNA, 512 bp, Homo sapiens
cctttcttattccaggtatccctaggactggagtcatgatcagtcttttcttctttaatatataaatggtgatgagtgtctgggaatgagatgccagatcacgaatgccatctgtacaaggatcttgggaagaagctcagttgcttagatctctaatcatcgatcaggtttaggaaaactgagagtcatggcatttgtatgccacaccagtaacacatccagtcccatcaagagctacatggtcgctccaagcaccgggagcggggaggtacttctatagaggtgcgtaggaaaggcaaaggcatttttgttcactggactggcacgtgcttccccacagaagctgttcaaatgcatactgtactttctggcaaaatcttgtctctcagagttgatgattaagacttttctcaaagaccagagtcaagagccaaaagaaaaggccacagaagaaaccagaatccttctcttggaagttcaaagtcttgttctacccaccagcttacattagt

SEQ ID NO: 195559 - DNA, 932 bp, Homo sapiens
tagtaagccggtgtaatcggcgaggagccacagccaggtctagcctcgccggttcccgggtggcgcgcgttcgctgcctcctcagctccaggatgatcggccagaagacgctctactcctttttctcccccagccccgccaggaagcgacacgcccccagccccgagccggccgtccaggggaccggcgtggctggggtgcctgaggaaagcggagatgcggcggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaagctaatgggatttgttgcagaagaaagaaagcattacactgtttatccacccccacaccaagtcttcacctggacccagatgtgtgacataaaagatgtgaaggttgtcatcctgggacaggatccatatcatggacctaatcaagctcacgggctctgctttagtgttcaaaggcctgttccgcctccgcccagtttggagaacatttataaagagttgtctacagacatagaggatttgttcatcctggccatggagattatctgggtgggccaagcaaggtgtctccttctcaacgctgtcctcacggttcgtgcccatcaagccaactctcattaggagcgaagctgggagcagttcactgatgcagtgtgtctgggtacatagcaactccatgcctgtttcttgcccgggcgtctatgccagagaaggcggccctgtagaacgcccctgtcaccgcggcacccccctgaggaaaggccggcattccttcaacacccg

SEQ ID NO: 195560 - DNA, 927 bp, Homo sapiens
cgccaattgctgaccgccacagccacagccaggtctagcctcgccggttcccgggtggcgcgcgttcgctgcctcctcagctccaggatgatcggccagaagacgctctactcctttttctcccccagccccgccaggaagcgacacgcccccagccccgagccggccgtccaggggaccggcgtggctggggtgcctgaggaaagcggagatgcggcggccatcccagccaagaaggccccggctgggcaggaggagcctgggacgccgccctcctcgccgctgagtgccgagcagttggaccggatccagaggaacaaggccgcggccctgctcagactcgcggcccgcaacgtgcccgtgggctttggagagagctggaagaagcacctcagcggggagttcgggaaaccgtattttatcaagctaatgggatttgttgcagaagaaagaaagcattacactgtttatccacccccacaccaagtcttcacctggacccagatgtgtgacataaaagatgtgaaggttgtcatcctgggacaggatccatatcatggacctaatcaagctcacgggctctgctttagtgttcaaaggcctgttccgcctccgcccagtttggagaacatttataaagagttgtctacagacatagaggatttgttcatcctggccatggagattatctgggtgggccaagcaaggtgtctccttctcaacgctgtcctcacggttcgtgcccatcaagccaactctcattaggagcgaagctgggagcagttcactgatgcagtgtgtctgggtacatagcaactccatgcctgtttcttgcccgggcgtctatgccagagaaggcggccctgtagaacgcccctgtcaccgcggcacccccctgaggaaaggccggcattccttcaacacccg

SEQ ID NO: 195561 - DNA, 217 bp, Homo sapiens
ctctaacataaagccttccaaagtaaaagcaagcataatctaagatttttaactaccacaatcaaccaaagcaaaattttttcacctatgcaataaatgttttacaattttatttttcaacaaatgaaacaaaatgatcaattttttacttttaatagattaagaaaaaacaggtttttctggccgggcgcagtggctcacacctgtaatcccaaca

SEQ ID NO: 195562 - DNA, 300 bp, Homo sapiens
taatgtcggcaaagattggtagagtcctcaagtttttggagaagcaagtacaatttattctggagaaacatcaaaataaacatcatgataacttaaaataatttcttcaaataattttctaaggaaaatgagaagctcataggactaaaataaaagcagcacaagaaaatgaggcatatgagcaagaaccatcagaaatattattaattacagctctacaaatattttatgttaaattctcagatgtagaagatagtgcattcaatatcttgaaaaataaaggctaaacataaaaataat

SEQ ID NO: 195563 - DNA, 458 bp, Homo sapiens
taggaggatggtatgatatgtgtatcatatctcaaaaaaaaaactgttaaaaaaaaaaaagaaaaaagaaagcaagcccacctctaaagctatggggaaaaggaggagtttggcttagagcaggcagatgagtgtcatgggcctagcacagccaagaccagggcaggaactaagggctggccatgggcctagcaacagaaggaaaccacagtgatctacttccagttcaccacatatgaccgctcttataacctctggatcaaccttacaggctcctggccaggagcctggcttcagaaggctcctggcccaccttgtctggcaaatgccaatttctcaacccacctgagaacactgagcagcagcccagttccaatggagtgagaacgagaccaatgaagcagttcctccaggtggccatccaacatccctggaggccctatttctgacacaagggc

SEQ ID NO: 195564 - DNA, 280 bp, Homo sapiens
ctttttgcagagggttaaggagctccaaaatgtttgctgaaagagagattttacagttagttagtgaaaaataacccacgactgagagtcagtttaggtgtaaccttgacccgagtgaggacatttgggtccagccctgccatattagtttgaatcccatagcttctctgggcctctggttctttgcctataaaatgagggggaaaataactagtttgaggaattcatgggtcttgatgggatccattgataaggttcttggatgaggaatccatgaatt

SEQ ID NO: 195565 - DNA, 212 bp, Homo sapiens
tgaagttggcccactaccactgccagttaatgaccatctacatcagctataagagcctagctttaacacatactgaagtttttgagttcattcaattgtcatttagtctacagatagcataaaaacagaaggaaattttacttcaagtgactgactcacacctcatattaaaacgactagtctgtcctgccctttacatatggcaccagcat

SEQ ID NO: 195566 - DNA, 276 bp, Homo sapiens
gaaaatgcctatcatcaagttcttccctatgtctatggcctagatggggtgggtgtcggatggtgctgaggcaggaagaggagaggagaactctcagtaagttgctaatgagaagagatcccagaagctagttcctgtgttccattctgcagtaacatgtcctctctaccatgagtgatacaataggagaatgggtgaacactcccactgtggtagatcctaagcaaagcatgacatggccctgccctccaagaaattttgtccataagataagtc

SEQ ID NO: 195567 - DNA, 704 bp, Homo sapiens
aacgttttctaggtgtcatgaaaattagacaattttgtatcctctattttcacaaggaaggagattgcgtaaatcaaactatgctaaagaaaaacatgaaagactgcagctacttaaaatatggaaactaatcaagaatgtctaaaccactttctgtttacccagcacatactgtatttagaaattcattcattgcttagcagtgatgctaccccatcaagttgagacttttcccaagtcctctgttctgttcctccatcctcatgtgagtaagggttttggcctttgccaggcagcctggtacaggcagtctatgttgaactctgggaggaacggtcgtcatgtgggctcccgtcagaattttccgtctctccctcggagattgcctgcatgggcgtattgtacagccggcagcggacactgtagcggctgctgctggctgcaggaggggcccgagaacgtccaacccttgctgatgctgaggtggcaaagctcttcgaggaaaagccttctgcattaactcgtggggagcatggagagagtggggacaatgcctcagccccttgtgacccctgatgggcatcatcggtgctctgaggggactctgctgtgagctccccaggaggtttgggcagtatggggctcttcaggatctcagtggcagacatgcggtaactagaatctgagcgactgcctttcttgag

SEQ ID NO: 195568 - DNA, 388 bp, Homo sapiens
gtgtgtttgctcagattacaccctgtctgtgtcattgctgctgctgttctccctctgccagacgacagcactgaaagagtggctgttactctctaacttggggtttgcctgcatccatgcataaacatttcagctcattatcttaagaaacggaggaccagagcatttgggaaccactgaatactgaatcctttaaggtttgttttctgtttgtttttattatgattgatgagattggggattctaaattaaaagtgactcctaaggattcagttaaaggatggtgtcataatgagaatgatggttttacctgggaggcagaggttgcagtgagccgagatcgagccactacactccagcctgggtgacagagcaagactccatctcc

SEQ ID NO: 195569 - DNA, 278 bp, Homo sapiens
ttaagaaaatgaacaggggaaggaagagtgttctgggcagggggaagagcatgtgcaaaggccctggggtaggaaggagcctggtaagtgtgaagaggctgggaagagggcccacatgcagaagagagatgatatatataggtgtggaggatgaccaagtcagcaggggtcagaccttgtcttttaaacttctaggaagagttctgcctttatcctgagagctacagagacaagctcaatggttctcatgaaaatagagaaatcaggctgtacagctg

SEQ ID NO: 195570 - DNA, 435 bp, Homo sapiens
caatgcccatttacaattaatcctcattccttcctccaaccccaagcaactactaatcaactttttctcttttagatttgcttttttggacttttcacacaaatggaatcctacaatatgtgggttttctgtctggcttctctcacttagcatgatgtttttgaggttgagcatccatgttatcacatgtatcagtattttgctcctttttgttactgaatagcattccgttacatggatcctgtagcagtttttttgtttgtttgtttgtttgttttggtttggtttttggcttaaatttagatggcccaaaagtatagccacttcttactgtgtgtcagatgtggctatgaaaatgtgtggtagatactaatcaaatatggcctccaacaattcgtcgacgcggccgcgaatttagtagtagtaggcggccgc

SEQ ID NO: 195571 - DNA, 276 bp, Homo sapiens
agtcccagcactttggaaggctgcagtaggcagattgcttgagcccaggagtttgagaccaccctgggcaaaatggtgagaccccatctctatttttacttcttaaaaaaagtctgaaactcaatctacaactcaaggtctttaatccagcaaagcccacattgagagtttctgagtctccaactataccacatttattggcagaaaaaattcttttcctctctgtttagagtatattgaaaggacaatatttgccatctttcctctgaattccta

SEQ ID NO: 195572 - DNA, 413 bp, Homo sapiens
gctctgctcgggaatgcggggaacccacttacgctggcatccaagacaccccacatgcccgggaccagcagaccaagctcagctttgtcagagtttcacttggcacctttagttttagccacacaatattatagtgcaggagctaagttttgatttcatgaaggacttcagaggtagaagatgcctggaaggggtgtgtgtgtgcttttggcactgtgagatgttctctctcgatttggaagacagcaagaaaaagcacagcaatttgctcccccagggttcttctgtgttttgaaggtacctgaagcttattgatttgctcacggttgccaggccattgaaaaagggtatttctttctttgcataggtacttctgggttcttggcaatcagttacagttcgtttgactccca

SEQ ID NO: 195573 - DNA, 407 bp, Homo sapiens
caaacacgcattgaatgcttagtgtttaagacactattccagggtacagtggcccacacctgtaatctcagcacttcagaaagatcacttgagcccaggaatttaagaccagcctggacaacatgacataccatctctattaaaaaaaaaaggttggctgagtgtggtggtatgcgcctgtggtcccatctacttgggaggctgaggggaggattgtttgagttcaaaaggtcaaggctgccatgagctgtgattgcaccactgcactccagcctgggtgacacagtaagacctcatcttaaaaagaaaaagaaaaagacactattcgaggcactgtgaaaaagactaaaatatactctccttgctgctgctcagatgagggagatcagatctacgtatgtggggga

SEQ ID NO: 195574 - DNA, 360 bp, Homo sapiens
tcttgtatatacatttgagaatctaattggaaaaacaaaactcaaatattaaaatgaaaacaggccgggcgtggtggctcaacaaatgccggtattgcctaagttgaattcagctttaactggcatttgttgagcccctactaatagctcattgtctaggaagtattgttttcctcctgctctataagtaaagaaccagaaactcatttacccaacattactcactagcaggaaacagattggatatttgcaatttcagtatcacatattcttaattaatgaaatttatgaatgaaatttcctgttgtacatcatctatgataagtatgcagaattttgtgcttaaaacctatgtatatg

SEQ ID NO: 195575 - DNA, 641 bp, Homo sapiens
taccattcatgagagttctgcctaatcacctcccagagactctacctcctaatactataacattgggaattagtatttcaacatatgaattttggaggaggggccccatggttttgctaggcataaccctagtggcaactctctgtgttggctccaaccttacgatagcccactgcttgagtcttgagcctgaggctctgcctggcttcattcttcaaaatctatgtgggggtagccatacccccatggtttatgcattttgtacttctttggagatggcaccacatgtaccctgccaaggtttatcatctgtgctgtgtggagggcagaccaccatgtcctgtgctgcacctgggcacactggagcctgggtgacaagagcgaaactctggctcaaaacagaaaaaaaaaattctttgttttcctccgggtcaggaagatattctcctatgttatcttccagaagtttgctttcctttcagatttacattttaatctttctagaatttgttatatttttgcatggtactaaaggtaaaggtcaagattcttccctggccctcttccccaaggatatgtcgattgcctggcaccatttattaaaaagatggttcttttctttattgcactgcagtggtacg

SEQ ID NO: 195576 - DNA, 486 bp, Homo sapiens
aagattgcatgtgtccagaaatttattcttctgttttccaatttgttggtgtatagttgttcataatagtctctgattctttgcatttctgtgctgcctgtacttatgtcttcattttcatttctaatttgatttgggccttctatatttttttcttagtgtagctaaaagtttgtcaatttatttatcttttcaaatagccaattttaaatttcattgattttttgtattttttttagtctcaatttcatttgtttctgttctggtctttattatctctttcctgctaataattttgggtttggtttgttcttgcttttctagttccttgaggtacatcgttaggctgtttatttggaatctattttttgatgtatgcatttattattataaacttcctcttagtcttgcttttgctgtatcccatagattttggtatgttgtatttccatttttgtttcaataaatttttaaaccactttctta

SEQ ID NO: 195577 - DNA, 142 bp, Homo sapiens
attaatgttagtttggagcctatagttacagatttccacctttgatttccatggaaacagggaggttactatacctacctatgctctgattgtcaaacatgcatgaagtttttgaaagtgaggctcttccttcttgaccaag

SEQ ID NO: 195578 - DNA, 274 bp, Homo sapiens
atggcggccgtgccggggtcggtggccgcggcggctgtggggctacgcgcgggccgggcccactgaggcggcggcgcagggagcggggctgcgggttcgcggcggcggcggcaggagagcggcgggagcgcgcggcgcccctaacttctagtcgggggagcgcgccggcatccgcccgccgggccggccggccgctatgtccggcgccgaggaggccggcgggggcggcccggccgcggggcccgcgggctccgtgccggccggggtcggggtc

SEQ ID NO: 195579 - DNA, 537 bp, Homo sapiens
ggattacaggcatgagccaccatgcccagcttttaaagactttttaaaaaacctatcttaagttctagttactgagagaaaatccatattgaggcaagggctttgcatgtaggtagtttattttgggaagtggccccagggcacaagagtgggatactgggaaaagtgaaattagaggaaaagaatacagtgaagtatgactactgacctagtcactgctgtgggcaaagtgggcttaagtcttttggggtcttttgaggacctgtatagaatgcctctcagtgttcactacctgagtatcttggttatagaagtggataacatttattcaccatttaccatctctcattgcttaagactcttttttttttttttgagacagagtcttgctctgtcgcccaggctggagtgcagtggtgcgatctcggcccactgcaagctctgcctcctgggcctaacactcttgtacttctggatttgcacatgtgtggtgccaggatgcagatgtcttgtctcttggtgtcagagaagttgtag

SEQ ID NO: 195580 - DNA, 355 bp, Homo sapiens
gatcgcctgaggtcaggagttcgagactagcctggagaacccccgtctctactaaaaatataaaaatcagccgagcgtggtagcacacacctgtggtcccagctacttgggaggctgtgaggcaggagaatggcatgaacctaggaggcagagcttacataagccaagattgcgccactgcacttcagcctgggcaacagagtcttgctctgtcgcccaggctggagtgcagtggtgcgatctcggcccactgcaagctctgcctcctgggcctaacactcttgtacttctggatttgcacatgtgtggtgccaggatgcagatgtcttgtctcttggtgtcagagaagttgtag

SEQ ID NO: 195581 - DNA, 268 bp, Homo sapiens
gaaaccaatattaccataggctaactgatactaaacaatagttaagttcctatggcagattacagaaggacaaaaaatgagatggataaacaaatgaggacaggccaggcatggtggctcaggcctgtaatcccaggattttgggacgccgaagcaggcaaatcacttgacgtcaggagctcgagaccagcctggccaacatggcaaaaccccacctctacaaaaatacaaaaattagctgggcatggtggcgggtgcctgtaatccc

SEQ ID NO: 195582 - DNA, 1054 bp, Homo sapiens
ccttggctggccctgtgattattaaactctttctttgctgcagcacctgctgttctcagtgcattagtctttctgggcagcaggcaagaagaactcgttgggctataacactgttgtcttttcctagaatcctatgcatcccaatcagttctgtagttctcccaggggtgatttagggattgagagtggcagccatcttggcaggatgttgccacacctcccattctcacatctgacccaccagtccccaaacttgatgttgtgctttgtttcctgtatggactgatcttggtattccctcagagaaaaatctggctgtgccgtctatcagacttcattcccacacagctgcccagacacagggcagccttcctctcagaacatcttctgtatcctgaaagcctccagtgggttcatccttcaagttaatggacaggaaaactaagaccagtgaggaatcccaacgctcatcctgccaggatagaaaggaaagcccagaggcattgcaaagagtgctgaagagcagggatttgctgtatggggacaactcttgctttgtgtttcaggacagggaacccaggagtgcaaacctcagtcaggtgcagtccagagcctgtcttgagcataatggctgctctgctctgcccccgaccctcaccacctccagcggggttcatcatcccagtttatggacagaaaaactaagactagagggggagggcttagctcctgctcggaggagaccttcaactccttcacctgcctggacttggcaccctcccaagagactgcaaccaaggttatgaaaatagcatctactcaccatccttcctcagcacacccccaaccaatccacccctcagtcccacccctgtctcaaggagactgagccccgagaagcacagcctcctgcacctcctcacctcccagcctgccttcctggtctatctgcaatgtcctcaagtcctttcccctcctcctcatccaaactccaagacctgcctcacctcaccctcctccaggaagcccccttcatggtctgggttcactccct

SEQ ID NO: 195583 - DNA, 317 bp, Homo sapiens
taaagctagagattactgctactaaaaaatttgggaatagtatctacgtttatgaatggttcagtaaaataacctcatcatttccattagatcactgatagagatgctctcaaagagttgaaggagattaccttatgctgagtattcacaacataaaaggaacagaatggagaatatttattttggaataactttgagtaatggaggaagaaacctttcaaagagagtatctatgccactggtagcccccaaataatatagctcagtgtctcaagatattcgccacttgctcatgctagaaacaagaggtctttaca

SEQ ID NO: 195584 - DNA, 580 bp, Homo sapiens
tgcatatggcaggccaaggaggtgggacgaaattttgaaatgtgctatcaaaccaagaggaaactgtgattcaagaagggagtggccaactattaaggtggcaagaggaggaacaaaaagtatccattagactagaaggataatatctgaatgttaacagtgattcactctgagtggtgggatgacaagaaacttccactttcattacgctttcctgtactttcctcatatcttgaatgaatatgtatgtatgacttttataatcagacaacagcaaactgacatttcaaaatatgttcagatatacaggtaacaattttctaaagtgggggagtggagagggaagaagtttttcatgccagtgggtagaaaaattgactggcaagggaagaaaatggggacagcaagtagagacttccttcttaataaagagaacttagactttcagccggaactgccatcttccagtaattcaccaaaaacaaacacaaagggaaagaggagaggcacccgatatatgttctctaggtcttttagaaaagatggagttgttcctttggccatgcatatgcgaatctat

SEQ ID NO: 195585 - DNA, 319 bp, Homo sapiens
actgctcagcaccaggacacagagctgcattgcttgattctgcaggctgcacatctaagaccagatgttgtcctcatacataccagccctgagaaaaaagtttcttggatttgttttcaagaaaaacaagatattgagctttgttcccttgtcaaagaataagaaactctcctattagcctttacaaatcaagacagtcaaacagatctgagatagtaactcatatctagggatcaaccaaagtaatcccctaaaggtattaggagaattttcccagatatttaagtttcattaaatgcaaagttagttcactggtacc

SEQ ID NO: 195586 - DNA, 680 bp, Homo sapiens
  misc_feature (63)..(63): n is a, c, g, or t
cctttcaggagtcttctctggcactcaagacaggagaggggcccttccctgcctagggtgtgnagggagtcttccaatggaagagaaaaataaagagaggcggatgctcaggcagctgacagaacggagggatgagggaccataagagcactgaaggcagcccaggaagatttccaatgcaagcagcaagttggtccaggttgtaagggggcagagaagggcccctctcctttcaggagtcttctctggcactcaagacaaaatcttacaaaagaggacgttcagagggaggaagagattggggttgcctttcagtttccatttttcatctctgcctctgtcttgatcaggctgctgattgtactaggactactgcaatttcttttcatcatgccgtcattgttacttccctccaatccattctcctcattgctctaggtgttgggaaacacttagtaaaatctgaatgcgacatactgtttcacgcttccagagcctttgcacctgctttctttgcctagaacacctttcccgtcttcatctgacaatatcatgtgcgttcacaggaggcccttcctggcctggccttttccgtgctcccacagtgctctgagcttgcctctgtcagcgctcactccagaccacgttactttcactttctggctcctccacacaaagga

SEQ ID NO: 195587 - DNA, 278 bp, Homo sapiens
accctaaattttcaaacccgttccaaactggcctcgttgccctctacaccggtgtgcaggatcacctctctcctgtgtcccttaggcaaccatttgtctgtttctttttccttcctgtctatgcccaccttttggtgaaactcaacctccagaagcttcctcagaaagaatataaagacaatattttttctgaggtcttgctttctctgagatttttattctacctttttttgagatggaatttcgctcttggcacccaggctggagtgcagtgacgc

SEQ ID NO: 195588 - DNA, 341 bp, Homo sapiens
cttgtagttttccatccagattttttcctaaggactccaaatgtggaataaaagttttgtcactttcaagggcaaccactttggcaccaatttcaagtaatgcctgagtcaggattccaggacctggactgcactgcagcaataggtgtggaggtctattttgttttctccatacgatttgcgccagggtctcagccaatctccgattggttacgtaacgcttaaagtctaagatggagtttaacaccctccttggtgagttcctgaaatccggatccggccacagctgcggagaggagtcagacaggccacggcggttcctcgccggcaagtgctttcgc

SEQ ID NO: 195589 - DNA, 193 bp, Homo sapiens
ctcattcttttcccctaacaaatcccattaaattatctctgtcttcctcttttgagctgctgattgtctttataaatctagtgatttttgctccctgcagtctactcacacctacgaaaggcggtttacactgttcagaatctgtggcaagtataggcccatctgacaagtagttttgtgttgggggattctt

SEQ ID NO: 195590 - DNA, 386 bp, Homo sapiens
ctgctgtgaaggctttggaggagacagaccatgaccagacacaggccctgtttctgatgctgagaagagaggaactaaataaatcctggttaacaagtgcatcagaaagctcctctaactgtaaatgcagagccctagcatgaagtggtacctgcagcctgaatgcatcgcatctgagttatgggcaaaggcagcactgcctgatggcctccttcccatgtcatctcctcaccgatgatctgttacaggtctggtcttccattttcaaataaggtctatcatttttttgtccttaataagataaaaatgaatttatcgagttttattataagggaaaaactatttgccaaatgattattcttcaataaataatttatctgagaaat

SEQ ID NO: 195591 - DNA, 343 bp, Homo sapiens
ccaggaaaaacttaaagaactagatgcacttagctaattaaatcctgttttcccctcggagttagatgatgcagcagcagtatctaatagaactagagtttaaaactacatttttgtagcataaccacagcaagaagtacagcaaaatgacaccatcagtcctgtcaccatgggcaactgctcacataatacgtcagtgtttaacttatctctcagtctatactccaattacagttctatgaccttgaaaatgataaatattggactgtaaaagatgttaaagtgtcaggctaaggctttaatactatcttaataaacacaagtattcacgtgttactttact

SEQ ID NO: 195592 - DNA, 239 bp, Homo sapiens
tctcaaagataatgttaacatatgttgggataaaccctttctgctttacctcttcttgttatctttttcttattttagattgtgtagtgttacagatatatttgtataaccagtggtatattttatgtactctatgaaatttctcttctctcaagaaagttgtagactagccatatttatcttaggttgaagatcatatgttctgttttgccctggacatttctggttgtcatagggta

SEQ ID NO: 195593 - DNA, 189 bp, Homo sapiens
tggctggtacatcatccctccttatgctcatccctccttatgctcatccctccttatgctcatccttcctttcgtgaagatttctttcattctttccagaagcctttcttccttgctaataagagaaaatgcagaagtcctacccacaggcctttgctaccctatcaagcagggaagcctacctgcctt

SEQ ID NO: 195594 - DNA, 183 bp, Homo sapiens
gcagtgtggtggccaagggcagcgtagaaaaccagggctcttgtcccaaaagaggagaggaaagagggttttgcagtcaaggaaaaacagaatcaaaacccaacatgatcgaagagaagccctgaatctgcatcagagggaggggccgtgggcagtgtcgcaacttggctactgcggcggcac

SEQ ID NO: 195595 - DNA, 568 bp, Homo sapiens
aggaggtgaaggttgcgagcagagattgctccactgtactctagcctgggcaacagagccagagtccgagtccgtctctaaaaaaaaaaaagaactgaatccttaactgtgattactaacagtactggaataagtgaactatctcccaaaaaaagtaaaactactggggaaaccaatcttaataagtccaaaagggaagacaaaactactactactcattttcacacatattggagagttggtagtgttaaaatatactggagcccaatttcatttttcagaactctgctgcgtacttgggatgttttttgagacggagtttcactcttgtcgcccaggctggagtgcaatggcatgatctcggctcaccacaacctccgcctcccgggttcagttgattctcctgcctcagcctctcgagtagctgggattacaggcgcctgccaccaagcccagctaatttttgtatttttagtacagacagggtctcaccttgttggccaggctggtcttgaactcctgacctcaggtgatccacccgcctcagcctcccaaagtgctgggatta

SEQ ID NO: 195596 - DNA, 209 bp, Homo sapiens
acgatcgagctcgctacccgtcagacgctgaactatgtgaggcagaggttgcagtgagcctagattgtaccactgcactccaacctggatgacagagtaagacttcgtctcaacaacgacaaaaaaggcttttgaataggttagcctttctattccagcaaattctagtatcatggtcagcaaaattaaacacatagttcagcgtctga

SEQ ID NO: 195597 - DNA, 129 bp, Homo sapiens
gtgtggaccttagtcccaacaccatcagtaaagcaaatcgagtgagcagcttcccgatagaaattcaccaaagtgtgaccagcattcctccctgtctgtctggggtcatttattagtgttggataccct

SEQ ID NO: 195598 - DNA, 492 bp, Homo sapiens
atggggtttctcatgattttggtccgtgcctaccgtgcagtgcttcagtgtgtgcttgtcttgctccataactatttcagtcgtttttattaacagaaacatcatctcaggaccatgtcttgggcttgccttacgtctccacataaataggacattatagatgctttatctgtgttttcagttagcttttttttccccaacagatccaagtaatataagttgatgtgaataacagaaatcatctgaggcgcttgttgaaagcataaattccctggctcctctcctagagattctgttcctgattccgagcatctggaataggactggagcctttaacgttcagcaagggccccaggtgattcttataatcacacaagtttgaaaacatggtgctaagtgattcactgcagtaccgtgttcaatgatctctctggtacttttgatatttgagaccctaatgaacctaaataaaaaataatccgctgacaaaca

SEQ ID NO: 195599 - DNA, 532 bp, Homo sapiens
cttgcccagagaaaaggggcacaaccagacaagggctagcatgggccctgggaagcacggagttcagggtggggcaggcttgctgtgtcctggcctggcaacatacctgcactgtgttgtggtagaagaacacaaagctgggaggcagagaactggttctaatcctagctgtaccctgacaagctgtgtgaccttggccaagttactttcctctcctggacttcatatatggtttttccattctttgcatccctgaagctccatgacttaggggccatcaacttggttgtccctgagtgtttccaagaataccaacagtgcccagggttttactcagcttggagaggaggcctagagcctccctgtggtgaggaggaaagaggttagagcaagtttgggtctgcagtgctaggattagaggtggcctcacaagccaaaaccgctatactcacagccttaggacagtgactccctactcgctgcctcagtgtttccagctgtaaaaaaggacccttggtaccttcgacagaac

SEQ ID NO: 195600 - DNA, 412 bp, Homo sapiens
aaaacaaaggaagccatctctccctggaagctgtcagtaccacccctgccccctcctatgactctccccacccaaagtccttccacctccatgtcactgaggttcctcggagactgtcaatactggattgacctgactggatctgcacaacggatgtggtgatgtcatgcctctcccctgggtttcttcctggacccagcaagggaggccttcacagcttgcagtggaatatctgaggcaaaaccttgaaacagaatttcatagtatctgtcacattctcatattttctttctttaaaaatttagttgaataatttcaacttatttcactggataaagtaaataaatattttacatttgctaaaactttatactttgttccaagttttttaagtggaaaaaaatgcatgtaa

SEQ ID NO: 195601 - DNA, 231 bp, Homo sapiens
tcttgccatctaattgaaagtataatgggtttcaggtttttaggagttctaaagaattacgctttccatagagaataagaggaagaatgttctacatagtggggagagaggatgagggttggcagtgtggttaaagagcaaaaccaccaagaaagagtcagagccctgaggacgtctctgtccgcgtggttcttgattctgagccagaaggtgacttggtatagcacggga

SEQ ID NO: 195602 - DNA, 277 bp, Homo sapiens
cagctgcttgctgttggtgactctagaggaccccccgctcagagcatttcttccgctagagcctcctgagtacctgagactataccatgcccaagtaattaaaaaaaattttgttttataaagacaggatctcactatattgctcaggatggtctcaaactcctggcctcatgcaatcctcccacctcagcttgggagtagctaggattacaggcacatgcaatcacgcctggctaatttttgtatttttagtagagatggagttttaccatgctgg

SEQ ID NO: 195603 - DNA, 1240 bp, Homo sapiens
tactaaatggttctgtgggctaaggtacaaagctactaatataacaagatggaaaatgaattccttaacactactaatattataacaataaagatttttgtagcagtaaatgagtgggtattactgtcttccccagaagcaatcaaaagagtattttaaaaggaagaatcttacagtactcccagactgctaacttggacatcatctgagaagacatctggtccacctacacctgtcctaagattggcgcaagatgtagaaaacttcccacagcaactgttaaaggaactgcagctgaggattctcaaccaccacaagcatcagcaattatttctgcccacattaagaagaaatgtggacctcagactgagggcttttctggggaccaagtactactccacagctccagctcttggtggcatggacctggcttacaatcaccgtatgcgggacacagctcctcttctgactgcagcgcactcggcccgacgtgacctccacccctagtgcctgcgatctgactgcccgacgtgacgacctccacccctagtgcctgtgatctgactccgtcctgggtcttaggctctggctgcagccctgcccgcaggctccaggtcctctgcaaggacctaactgctgaggacaagcccacaagtgaggaaacagatgctcctctagctgacactaaagataagatgcctctagaaaaacaaactcctgttatacaggaacaggatgataaatgcgataagctccatgtttgtggtaatttcctacttagcaattttctcttgctgtgtcttttacaaaccatataacatagataaacctcttatttctttcttagagcctttaattttggtcatttttctctgggtcgaatttcctcaatagtggacaaaagtcacctttttttcttttttctttttttgagacagggccttgctctgttacccaggctggagtgcagcttgtgccatcttggctcattgcagcctcgacctcctgggctcaagtgatcctcccacttcagcctcccacgtaactgggactatacaggtgtgcatcaacacaaacctggctaattttttattttttgtcgagatgaggtctcactatactaatttaagtatctgacccaggctggtctctcactcctggacttaagtgatcctcccaccttgaactcccaaagtgctggaattagaggtgtgagccaccttgcctgcccacctttttt

SEQ ID NO: 195604 - DNA, 1195 bp, Homo sapiens
tactaaatggttctgtgggctaaggtacaaagctactaatataacaagatggaaaatgaattccttaacactactaatattataacaataaagatttttgtagcagtaaatgagtgggtattactgtcttccccagaagcaatcaaaagagtattttaaaaggaagaatcttacagtactcccagactgctaacttggacatcatctgagaagacatctggtccacctacacctgtcctaagattggcgcaagatgtagaaaacttcccacagcaactgttaaaggaactgcagctgaggattctcaaccaccacaagcatcagcaattatttctgcccacattaagaagaaatgtggacctcagactgagggcttttctggggaccaagtactactccacagctccagctcttggtggcatggacctggcttacaatcaccgtatgcgggacacagctcctcttctgactgcagcgcactcggcccgacgacctccacccctagtgcctgtgatctgactccgtcctgggtcttaggctctggctgcagccctgcccgcaggctccaggtcctctgcaaggacctaactgctgaggacaagcccacaagtgaggaaacagatgctcctctagctgacactaaagataagatgcctctagaaaaacaaactcctgttatacaggaacaggatgataaatgcgataagctccatgtttgtggtaatttcctacttagcaattttctcttgctgtgtcttttacaaaccatataacatagataaacctcttatttctttcttagagcctttaattttggtcatttttctctgggtcgaatttcctcaatagtggacaaaagtcacctttttttcttttttctttttttgagacagggccttgctctgttacccaggctggagtgcagcttgtgccatcttggctcattgcagcctcgacctcctgggctcaagtgatcctcccacttcagcctcccacgtaactgggactatacaggtgtgcatcaacacaaacctggctaattttttattttttgtcgagatgaggtctcactatactaatttaagtatctgacccaggctggtctctcactcctggacttaagtgatcctcccaccttgaactcccaaagtgctggaattagaggtgtgagccaccttgcctgcccacctttttt

SEQ ID NO: 195605 - DNA, 1653 bp, Homo sapiens
tactaaatggttctgtgggctaaggtacaaagctactaatataacaagatggaaaatgaattccttaacactactaatattataacaataaagatttttgtagcagtaaatgagtgggtattactgtcttccccagaagcaatcaaaagagtattttaaaaggaagaatcttacagtactcccagactgctaacttggacatcatctgagaagacatctggtccacctacacctgtcctaagattggcgcaagatgtagaaaacttcccacagcaactgttaaaggaactgcagctgaggattctcaaccaccacaagcatcagcaattatttctgcccacattaagaagaaatgtggacctcagactgagggcttttctggggaccaagtactactccacagctccagctcttggtggcatggacctggcttacaatcaccgtatgcgggacacagctcctcttctgactgcagcgcactcggcccgacgtgacctccacccctagtgcctgcgatctgactgcccgacgtgacctccacccctagtgcctgtgatctgactctgcccgacgtgacctccacccctagtgcctgtgatctgactctgcccgacgtgacctccacccctagtgcctgtgatctgactctgcccgacgtgacctccacccctagtgcctgtgatctgactctgcccgacgtgacctccacccctagtgcctgtgatctgactgcccgacgtgacctccacccctagtgcctgcgatctgactctgcccgacgtgacctccacccctagtgcctgtgatctgactctgcccgacatgacctccacccctagtgcctgtgatctgactgcccgacgtgacctccacccctagtgcctgtgatctgactctgcccgacgtgacctccacccttagtgcctgcgatctgactctgcccgacgtgacctccacccctagtgcctgtgatctgactccgtcctgggtcttaggctctggctgcagccctgcccgcaggctccaggtcctctgcaaggacctaactgctgaggacaagcccacaagtgaggaaacagatgctcctctagctgacactaaagataagatgcctctagaaaaacaaactcctgttatacaggaacaggatgataaatgcgataagctccatgtttgtggtaatttcctacttagcaattttctcttgctgtgtcttttacaaaccatataacatagataaacctcttatttctttcttagagcctttaattttggtcatttttctctgggtcgaatttcctcaatagtggacaaaagtcacctttttttcttttttctttttttgagacagggccttgctctgttacccaggctggagtgcagcttgtgccatcttggctcattgcagcctcgacctcctgggctcaagtgatcctcccacttcagcctcccacgtaactgggactatacaggtgtgcatcaacacaaacctggctaattttttattttttgtcgagatgaggtctcactatactaatttaagtatctgacccaggctggtctctcactcctggacttaagtgatcctcccaccttgaactcccaaagtgctggaattagaggtgtgagccaccttgcctgcccacctttttt

SEQ ID NO: 195606 - DNA, 235 bp, Homo sapiens
tgttgagctactttctggttttatcatcttattcttcttactgtttatttaagttctgtacatgtttgcccagagatttgactctgttactcttattctattcctttaaaagagaggtgattttcatttttttctctccctctttttcttttttcttttttgagacagagtctcactctgtcatccaggctggagtacagtggcacgatcttggctcactgcagactgcctccca

SEQ ID NO: 195607 - DNA, 388 bp, Homo sapiens
ttttataaaacagaaattaaagaagatgtgacatttggttgaatttggaagaatgactaatttactcaaaccagtatgtctggtaatgttgtgcatgtatgtccagtacccatgcatggctggcagagagagcggggctgaatcccaggccatgaagtgatcacaaacctaatatctttgcttggattccccatgggggaagtgccaaactccaaatttacttcatgacaaggtattggccaaagaggaaggggttctgacactccgttagaattaaagtatagcacattcccagttaatagaactggagataagtctacttctgattgctttacactgcctattgcaacatgatgttggaaaataagcaaagtgagtatctggcagg

SEQ ID NO: 195608 - DNA, 229 bp, Homo sapiens
cagcactttttgcagttgtgaaattgaaaaatcaattgtttagtttttaccaaaggaaaattagagttttgtatacatatttgatgaatacagtaaacaggttaaaatttagcaaatagaattttgtaagcatttttaaaatgtgtgaattctgtgataagggggtggctttgctacaatttattacaaagctaagttatatttcatacttatgtaaaatagtgttctt

SEQ ID NO: 195609 - DNA, 409 bp, Homo sapiens
attcgtaacatccaccaaactcttaggattaattcaagcttataacatagtccttcctatttgacagacttgagaaggcaggatcttttaatactttcaatttgctttttattctcttataccctaaatatttgatgaaatattcaacccacccattgctaatggcagcttccactttctgaacatctacatatgggtcagggatgttatataataatatctctacaggcatatggtctcaaaactcctgggctcaagtgatctgcccacctcggccttccaaggtgctgggattacaggcgtgatccaccacgcctggctttttgatttaagtgtatgatttattggttcttactctattcacacatttgtgcagctctcaccgctgtctaattctagagcattttca

SEQ ID NO: 195610 - DNA, 659 bp, Homo sapiens
atgctgacagtaatctgttatacaatattttctgaatgggaaaaatattggacttgaaaggcatctcttggtatgacagaattttgttctttgaaataggtttcttgatggagtgtcatttgacaggcaggcttagtattcattgctgcaagacacagcggccatttgctttgattagttgaaagttgcatcacactgaatttggatttgtggtaggcactgatagtttttattccattgtaaatgatcattaagctttattatagtatcttccaattttatcttctggaaaagttagagctgctttattgtatacagaataaacttttgacacttttgttacttattttaagttagacctaagtcttttacctgatttgtgcccagattgacagtttaatttcctgagggcagggagcaggattgttgaagttatcacttgtgtaaaggattaacagtttatcacaaatataaggctttctcagttttattttataaacccagttgctgccttttacctctgagagtttatatatgtccagagttaattctgaattatcttccttcaccactctctactaatccatttaaagattgattaaataaaattatttgcagttagcatatgttgaataagaattagggcaagattgggccaa

SEQ ID NO: 195611 - DNA, 491 bp, Homo sapiens
ccaagaggaagataaggacctagacggaaggatgctcttcatcctatgggggagttgaggccttaagcaagacaatattaatgggcttaaatttaagagatgagataaaaggtatttaaaaattattagaatgagcactttacaacattgtgtatgcggttgaaaagcgaagtcaccaactttagtggaagaggaagaaaggaaggggtgggatctggcctaggaaaatttattgtctagaccattctggaaaaaaaaaatctatagaacctgttatccttcaagtccaatgtacattatttgaatgatggataccttaaaagccctcacttgaccactgtgtaatcaatgcatgtaaccaaattgcacatgtatctcataaatgtgtacacatttcttttaagttttgagaatcccttgtctaagccacgacatagacatgggtatattttgctggagatcaaaaaataaaaccaggtgtttctacatgt

SEQ ID NO: 195612 - DNA, 561 bp, Homo sapiens
  misc_feature (7)..(7): n is a, c, g, or t
tgccgcntgcgcacactctatattcagcaattaaaaagcaaaaaaaaagagaaggaaatggcggatcagacatgtattgaagaatttgtgatccacgcattggcattttgtgaaagcttatatgatccatatcggaattggagacatagaatttcaggacgaatccttagtactgtggaaaagagcagacagaaatataaaccagcttctctcacagtggaattcgtccctttcttttatcaatgttttcaggaaagtgaacatctcaaggaaagtcttaaatgttgcttattgcatctctttggagccattgtagccggtgggcagaggaatgctttgcaagcaatttctccagccactatggaagttcttatgcgagtattggcagattgtgattcctgggaggatggagatcctgaagaagtgggtaggaaggcagaactaactctgaagtgccttacagaagtggtacatatccttctcagtagcaactctgatcagcgtcaagtggaaaccagtactattctggagaactattttaaattgctaaattcagatcat

SEQ ID NO: 195613 - DNA, 403 bp, Homo sapiens
tgctaacatactcagtacaccatcagaaaccatcaatacacctcagaaactgaggcacagacaagttaaacagttttccttaagttatatggctagtaagtggcagggctagaatttaaatctgaacctacatctgtttgaaagttgattcttgctctctacactgtgctgtctttaagtcctttctcttcccactcacatccaatcaatttctgagtcttgtccattatattattgtagtgtttctttcatttgtccctgctgttctgttcctgctgtcctagtttaaatttccattacttttggatagtttattgtggtaatcttctcattggtcttcccacctatcttttcaccctacacagtgcttcacaatatgatagttttcttaaatacagatcag

SEQ ID NO: 195614 - DNA, 285 bp, Homo sapiens
cacagggtacagccctacaaccccggtacaacagagcttcatgcttaacctaaccgcgtatcaccacgccatagtaacacactccaacaacacagggtacaaccccacaaccctacaaccccacaaccctggtacaacagagcttaatgataaacctaacctcagctaagcaaactcaatcaaggatgatttcctgcagagaatataccataattattcaatttttccctttgagaaacacttccttaaaggtataaataaaggaagcatttgggggtttgtttc

SEQ ID NO: 195615 - DNA, 484 bp, Homo sapiens
tcagcctcccaaagtgctgggattataggcgtgagacaccacgcccaggtgaacagaatagttttccattcaccacagtttgtgacagtctctacattgtgaagtgacaagttctcttctattttccttctgcccctcatcacctttttcttcctcatttcttttttgaattttgctgtcttgaattgatgtctaaaggatgacatagcagacaaggggactgacacatgaactctcatgagttactgaggagtttctcagtgctctgtctgcatcatctgctcactctctccttcctaggtgctagcctgccaacctgctttgagaaattggaaatgaattggggggtaatcagcctccccttgtacatgtagggaccgcatctccaatgccttgctttacataatgacgaatggtgttttgcttacctacttccacacaaactgctgatatggttaggatttgggaaaggggaagaagggaa

SEQ ID NO: 195616 - DNA, 842 bp, Homo sapiens
gggctaggaggaaggctgggtggtggtagtgaataactctcacaagatctgatggtttgataaggggaaacccgtttcacttggctttcattctctcttgcagccaccatgccaccttccaccatgattttgaggcctccccagacacgtggacctagcaacacatgttctaacatgtgtgagactgactgcctctcctctatgaagagatgccagtgacagccaggactggtgtaggctctattgagcatcacagtcatatgtgagtgcccaagagaagctattcactttctcagatgcggtttgcagagggaacttcacaggctctctgggattgctcacatttggcagctaaagtggaatcaccaatccaaaatactcaccccaggcgtggggtcactcccagtggcggagatgccctgcatttccattgcctggactgaggaacagatgaaaggggaaccacaccagggtggtggcctgggatgtgcctactccctaagccaagcttctctgtcctgagtgggcttagggtcccctgcagcgtgggtgttaaatgctgcttcctaggcctcaccctcagagcttccagttcagtcgagtccaggtccctaacctgtcgtcgtccaattgattttgatcaggtgccccatggccccactttgagaagcagatcgagtccacctgtgcatcttccctgttgtccctaaaaataaggctaaaaaaaggcaccagttcaaaaatccagtttatttgtttgaagttcaggtttacagttcctccaattctcagatcgcagaagaagcatctggaaggaaatgacccctgcacccaccacaccc

SEQ ID NO: 195617 - DNA, 229 bp, Homo sapiens
agaggcttccataccacctggccctcactgctcttcagaccccatcttttcctccctcatggagctctggccacaggggctccttgctgttccttgatctggcagccaagcttccatcccagggtttttgtatttgctgtgaactatgcttggaatgttcttccccttgacaaagtcttccccttataatgtcacctcgcaagagatcttctctgacaccttacataaa

SEQ ID NO: 195618 - DNA, 115 bp, Homo sapiens
ctttggagttggaatggaacttggagatcaacccttgtacactttcatttcataaataaggaaattgagacccaacaaggtcagtccctaagccctcaacagtttgttctaaaac

SEQ ID NO: 195619 - DNA, 178 bp, Homo sapiens
acccaggagggagaggttgcagtactggagatcacaccactgcactccagactgggcacagggcaagacacagtctaaaaaaaaaagaaagaaaagagaaaaacaagaataaatcaattatttttctataatacttgccacaatcaattgaaccatgaaaaattttaaataccattta

SEQ ID NO: 195620 - DNA, 366 bp, Homo sapiens
cttctccttgtggtctttccccaatttcactggcagccctccccaaggatacctgagagacagagtcagaaatggcttccctggggatggaaagttactcacagggctcttcctgttgcttcccctacccctgtatttggctcagctctctaaatttgtctcagctcccaggcaaggtcaaattcttctgtgatctggaccttcaggttccccaatgaagatgtgtgtttgggggcaaatgatccccctttcacactttcacaccttgggcactcacagttttctggctgtctcccagagcctgcagcctgcctgtttgtgtactgggttctaatgtaaaatatatttcttcccataggttacagt

SEQ ID NO: 195621 - DNA, 135 bp, Homo sapiens
taaaagttgagcaatatcctttgtaagacagtatactgcaaatacctactctttagagcaaatactcaaacagtgtaatggctaaaaaaccaagctctgggccaggcatggtggctcacacctgtaattccagca

SEQ ID NO: 195622 - DNA, 359 bp, Homo sapiens
tgggggctggggacacagcccctgcccacctggtaccctctaaactgctgatcatgcatgacagccttgaggcagaggggctcacctgcctcagtttccccatctgttcagagcgggattaaaggcagtctccgagaaccctcccagctctgtcatcctgggagcccaacaactacattttttttgttttttttttttctttgtttggagatgggtcccactctgtcacccaggttggagtgcaatggcgcgatctcggctcactacaacctcctcctcccgggctcaggtgatccttccatctcagcctcttgagtagctgggaccaaaggcacacgccaccatgcttggctaatttc

SEQ ID NO: 195623 - DNA, 353 bp, Homo sapiens
tggtggttggacgacactgtgaatgtcctaaatgctactgaattgttcattttaaaaggttaattttatgttatatggatttcacctcaatttttaaaaactcttatagcaacaacaaaatcatacctcattgtgagatccaccagaaaagctaaaatgaaaaaagacatacaatatcaagtgttgtcagggtgtggagcaacagaaatcctcatgaactaactggtggatgtataaattggttacaattacttgggaagactggcaacatttaccagacgtaaaccatatgcataccaagcataatgcttggttaggtgctcaataaatatttattgattgaactcgtccaa

SEQ ID NO: 195624 - DNA, 791 bp, Homo sapiens
gtcatgtcttgcattttcctgcttctgccttagctccagcttatcaccatcctcctcatccatacctgttcatcagtttctgactttaagaaggttaccctcttcaggaatcagaactctgctgattcctactttctgttcccagcctgatcacctctgccttatgttctttggtgcagggctgatagtttgtgtttcttttatgaccctaaatagattgttaacccttgtgcctgatgtcagatttgttaactaggacttaccacactatcccaaggacattcaactacacttacttggtctcaggcactgtggttcaagtaacaaggaattcctggtgctgaggaggaggcagtacatctgtggccttgcaggaaaattcagaagtcaatacattcctccatccacctcatttacctaaactcattcatcaccgtgtcaaagatatatgttcctgctctcattcccttgagtaggaaatctccaggtgacctgatggtcattctgtggtcattgcttctgaccacacagttcattaagttgaccatccttgaatgacacattccgaccagggatggcggttgttatgggctcagttgtgttcttttccagttcatacgttgaaattctaaccctcaggaactcagagtatgaccgtatgtggagatagggcctttaaagaggtaattaaggtaaaatgagataatatgagtggcccctgatccaagatgactggtgtcctgataagaagaaattaggacacatacaacactgactaagggaccaccctg

SEQ ID NO: 195625 - DNA, 459 bp, Homo sapiens
aaacaccaattcaagcgatagcagatttctcatcagaagccacagaggccagcaggaagtgtcctgacgtctttcacgtgctgaaagagcagaactgtccgcatgaatcctgtgttcagtgagatatcctgcagagctacccgtaaggaatcttctccaaacagaaaggaaatgataatagaagaaggcttggaacttcagaaaggaaagaagaacgtcggaataggtaaaaccggggacaaaacataatagccctcttcttggaaagaatcatattcttatatcacattggatggttgaagcagaatttctagcaccatctgatacgggtgctcaggggaaacagaagacgtccctgagactatcatagtcaaagtggggaggataaaatggccttcgcggaagcaaggtttccacctgcatgtgaagtggttaaaagttgagaccggtcggcggcag

SEQ ID NO: 195626 - DNA, 407 bp, Homo sapiens
ataaaattatacgtatgattgcaactatgtaaaatatgttaggagaagtagaaggtaataaaaataaaacggttgtgaatagaatattgatgataggaaattgatttttttctcctattcagttttaatataatattgtggtacaaccttttagtaaaactaaattatttcatgttcatacggtttcctgtacaaagaccttcatgcacttattattttctcagagtacttattttcaaaacagaattaattcaaaacattctattttgttaattagaaaaaaaaaaaatctgctattaagattaccactagagggagggagagatcaagactatgaaggaaaatgaagacacttggttgctggaaattaattttcttttcctgggttggggtgggtatatgtttta

SEQ ID NO: 195627 - DNA, 316 bp, Homo sapiens
agcgtgtgtgtgtgtgtgtacagggagagtaagcatgtgtgtgtgtgtgtacagggagagtgagagtgtgtgtgtgtgcctgtgtgtgcgcccgagtgtgtgtgaggatccaggtggccagcagcattgagccaccccacaccacagcccctgtcccatctgggagggacactcctgtcctgcagggaagcaggagaggctgacagaggcaatgtgagctccctgtggtcactaggccatggcattaaagacacactcacccccagaactgagccctggggacggtgcccagggtgcccagagcacgagggccatc

SEQ ID NO: 195628 - DNA, 689 bp, Homo sapiens
  misc_feature (449)..(449): n is a, c, g, or t
  misc_feature (455)..(455): n is a, c, g, or t
  misc_feature (520)..(520): n is a, c, g, or t
  misc_feature (539)..(539): n is a, c, g, or t
  misc_feature (551)..(551): n is a, c, g, or t
  misc_feature (625)..(625): n is a, c, g, or t
  misc_feature (628)..(628): n is a, c, g, or t
  misc_feature (657)..(657): n is a, c, g, or t
gtgactatttctcgtactgttcgccaaatactctctgcgtggtatttgttagattggaagtgtcctgaagggagggaccctaagcatctctttggctcattgctgtttttttttgagacagtttctcactctgttgtgatctcagctcattgcagcctccacttcccaggttcaagcgattctcatgcgtcagcctcccgagtagctgaccaccctgccggctaatttttgtatttttagtagagtttttgccatgttgatcaggctggtctcgaactcctgaactcaagtgagccgcctgccttggcctcccaaagcactgggattacaggcatgagccacctgtgttttatttgtatctgaatcaatccttgaaaactttgatagctcattccagcacagctcctttctctcaaaacagcaagcaccttaatgaggacatctccttngttctnggctgagaataaatttcagagaacttcttactgtctggttttcaacctaccaggatccatccttngccttagttctaccttctngttatacggttngtgcaagtcaccatttatatcccattagtattttattaatggctgctgatggaacttgggtgacccacttgtanatnacatcccagccctgcaatgaccgcagatncgggctattctggttggtagcgaaatccattg

SEQ ID NO: 195629 - DNA, 242 bp, Homo sapiens
tgtaggccttgaaggctgacagctctagatgagcagtgaacccaaattaatttgctgactatgaagaacagtgtcactgtttgactggttgagtcagttatgtcattgggcatgaagatgtagccaaaactaaatatgatggctttagtatgaaggactgaggaaaggggcagaaaagaagcctttctttatcttatttttattattattattattattttttctgagacggagtctcgctt

SEQ ID NO: 195630 - DNA, 391 bp, Homo sapiens
atcagattttccaaatagttgccatttagcaaatgcttctgtaacaggattgtaactggtattaatacatctaatccacacaaccaccctctgtgatacatacatagccaatcttcattattcatgaatcccatatttgcaaatatgtctactcactgaaatttatttttaaccccaaaattaataatcatggtactttcgcagtcatttgtggacatgcacagagcagcgaaaaattgagtcacccaacatacacattcccagctggcaacaaatgaggacacgcagccttctgctttcagcccttgcacagagatgaccagagggggaaactgtagggagcagcacagtgtagcgtagtgtgttaacttacaccaaatttggcctgagg

SEQ ID NO: 195631 - DNA, 420 bp, Homo sapiens
aacttttggacgatgatgtgtttctaacctgtgaccatttcacatagccactcaaatatggtaaaggtatggtaaagatgatgaaacagttacttggcatcattttgtaagtaatgagtttttagtgcgctttggaccttgagaccacttcataagctttagattttgagaatttcacagcataaagctcatcgctgatgcagtaatgaaggaaatgttctacaagttaatagatgagtgagaggagagggcattcatattagatttatttacttactgaactcagagccttgggttactacttgacccccactgttatctagtttaagggtccttttattttttgttttttcgaggtggagtttcactcttgttccccaggctagagtgcaatggcccggtctctgctcactgcaatct

SEQ ID NO: 195632 - DNA, 189 bp, Homo sapiens
tgctgggattagaagcatggaccaccatgcccagccctcattcatttcttgtactagaagtggtgatctttgacaatttgttttaatatgaagttgttttaatgaggggcaaatatttggagcaattagctaatcattacaacgttttttttttttttcttgttttgtttttctcttttctttttttcc

SEQ ID NO: 195633 - DNA, 512 bp, Homo sapiens
gcaaagctacccatatgttgttgttgctgctgctgctgctgctgttgttgtttctgaaacttgggcttcagaatggctccaaaatatgactcagctgccattgtaattggggaaagtcagaagagaagagaaatttgttgccaaagcatgttttctttactcaacattcatcaggcacctacaatatgccaggcatcatgacaggcatttttatatgtactatatcccaacaactctgtgaaaaaggtagaattactcccatttctaaaggggagaagactgagatgcatagagattaagagttctgccaaaatcacacagcacattagcagcagaactgggggtctagcccagtttttctgaagccaaaggcactgatcttctccattaatcctagatgctcattggtgactttgtttacatattatgattaagggacactgctatttaaatacaaatttgtcttgatcagttgggcaaaaagatagacatcaaatgatcttaggaacttt

SEQ ID NO: 195634 - DNA, 757 bp, Homo sapiens
gaagtataggccccaggtgtgagaagggactgtccccatggctgccctctgcctggtggttttccaggctccttgactagtggctctttgcttcccagaagtggagtctgtaaaagctgtacccctccacaggacctggggcagagggacagactggtgatctattattgaaaaggatttggggctggacatggtggcttacacctgtaatcctagcactttgggaggctgaggtgagcggatcacctgaggtcaggagctcgagaccagcctgaccaatgtggtgaaaccctgtatctactaaagatacaaaaattagccagaagtggtggcaggcgcctgtaatcccagctactagggagggtgaggcaggacaattgcttgaacccaggaggcagaggatgcagtgagccgagattgtgccactgcgctccagcctggtcaacaagagcaaaattgtgtgtcaaaaacaaaaaaaaaaaaaaggatttgggcctcaagccatggaaacccagtttagagtggctggaactagtgggcttggcttcctcacctccagagaagtcagctgggaggtttgctgctcccagaggtcctgagccagacctggggatttgaacttttgtgtgtagctggggaggggagaagatgaccagctgtggcaggactccccccacacctgagaccagatggagacactctccctgggaaatgcccgaagtcccttctctcctaggggtttcttcagaggccacct

SEQ ID NO: 195635 - DNA, 122 bp, Homo sapiens
gaaagagagggagagaaatagaattcgagaaaaaaaagtctccaaaatataaacaatagaagaaatacttcaaacccaagataatgaaactcagtggactaattttagggcaccagaaaaaa

SEQ ID NO: 195636 - DNA, 418 bp, Homo sapiens
gggacaacctattaaggctcaaatctctctttctaacctttgcctggaaaaagaatttgaagtcagagtttttacctaacatttcaaaccctacagtgccacctactaggatgggagttttctctgtggggatcctttttggccctttgcacaaaacctctagttccctgattcctttctcttttatgtccctctctgtgatgaggctccatgccctgtttgtagacaggaaaattcccctttcaacagctgggaggaagctaccctagcaagacagaatttgtttcagtgctatccccatcagaggaaagacagccattcaattcttacattcatttgaggcacctgttcattatccagctactttgacatctaagcaagaaagggatcttatgtttagaagtcaattggttccatt

SEQ ID NO: 195637 - DNA, 409 bp, Homo sapiens
gcttggtttgggtagaagggtcaggactctggatgcagacaaatctgggtgtgagcacccgctttgctgcataggacaggaccacctgttgtttggtctgctgcagatctcagccacagcacctcccaccgtgagaccatgaaagggcatgcaggggagtatgagaaggctgatgttgaaggcttcgtgttgcttaattgatacagtgtgcagtatttaggtgaaaaagcccagacttcaccactgtgcaatatatccatgtcacagaattgcactggcaccccaaacaaaaggccccagactagtgaatttcccagggggccaatcattctctttccctttcaaattaaaacaaaatatatggaccaggcacatatatatatacaggctcacacctgtaatcctacta

SEQ ID NO: 195638 - DNA, 556 bp, Homo sapiens
ctgttgtgggaaggcgaagctagaggaaggtaggatgaaagaaaggagaggtagcccttctactttgttttggggtgggtttggaggcaaagggaaattgactgtcatgtgggtggacgtacatgtgaaccttaaagaacttttagcttcagtcaaaaaagacttcagtaagccatcttcttgggtccaggccagctaccagggaagtagtctacttgagggactagaaaaaccagaaaagtttctaggagagtcatatcaaattccagaaaaaattaaatgggaaaaagctgctggatgaaggaaaagatgaagctctatgaacattggcataagaattgggttcatgctaggcgcggtggctcacacctgtaatcctagctcttagggaggtagaggcgggaggatagcttgagcccaggagttcacgacctgcctgggcaatatagcgagaccccattttccacagaaagggggggaaagacaataaaaagtgtaagaattgggttcatgaggccccctttcctcaagtggggtgataggggatactcagttc

SEQ ID NO: 195639 - DNA, 407 bp, Homo sapiens
aaaaatagaggggtaaaattcagatcatgcatgacctggaagaccatggcaagaagtttggatattaacaaatagaaatatatataacatgggagtgggtggtttccaagttataaagacttaagcccctctaggagaataaagcattaattttgccatggacttcatggcatttattttgcctctgggaccatttttgcttcctttttttattataagttaaagtttcctggatccatgtgtttaaaatagaagttctttcatcactaagagctctggaaaacttctagataatgagatactagatagtagagttccaggtcagtttcctggatagctgtgttttgtataggtgcagtttctgaagctaagttagggtgtataagaaatattccagactgactgat

SEQ ID NO: 195640 - DNA, 478 bp, Homo sapiens
aaatgtaccaaattagtcaattcagtaaacttagcgaagaacaacaacaacaaaaggaacaagttggattttttggggtgaagataaaatactttgctgaatttctgacttccccaggttttgtgcatgttaggctaaggggtcacaatcaccacgcaaacaagatcggcaaacacgttccttcttcctctacctgtctggcctgcagtgatagatccctgaggggacaaactaaactctgactgaattagaggttcctttaaaggctgtttccctgtgatgaactaagtctagggtcacttgagtggggattaggggctctggcaggctcattaattctctgaaatagactggcaggacctggactaggcaaggaggctctgacagtgagggagagagagagccagctaagagttttactacgtaaattaaccacagagcaacgccttccctcttcggtttgtttctttctctccac

SEQ ID NO: 195641 - DNA, 486 bp, Homo sapiens
atgagcaattataaacaggttagaaacaggaaaaaatagtctcaacaaagaaataagacatatagagaggaacaaaatggaaattttagaattaaaaaatataaccaaaacaatatactcaatggattggctgagcaacagaacatagagagacagagaaagaatcagtgagctggaagacagattagaaattatccaatctgggctgggcacggtggctcacgcctgtaatcccagcactttgggaggctgaggcaggtggatcacgaagtcaagagatcgaccatcctggccaacatggtgaaaccccatctctactaaaaatacataaactagctgggtgtggtggtgtgtgcttgtagtcccaaatactcgggaggctgaggcaggagaatggggtgaacccgggaggcggagcttgcagtgagccgagatcatgccactgcactccaacccgggtgacagagcaagactccatctcaaaaa

SEQ ID NO: 195642 - DNA, 200 bp, Homo sapiens
cattctttctttttctttctatatcacaagtcgtcaggcaacatcattaattctttaggaaagaggttaatataggctaatgtaagttctttgtatgcattcaagaagtttgctagctaaaattttctgccaaataccttatttccttcaggcagtagaatttcatgtattaacttagtacaactgttgtttcccatggc

SEQ ID NO: 195643 - DNA, 361 bp, Homo sapiens
gcagggagggcgggtgtgcgacctttggttagagaggaggcagcgagggagagccagctatgtggcagggaatggagagaacctttgttggcctcggcttccaaaccacagacaccgagggctaattggtagcagtttctagaatgtcctcgggctactcggtaggtggagcaggactgtgcttcaccggaatcttcagaagctcaaccccaggcctgacgcgtgtggcgccggagctctgcgttcactgtgcagctgaacatcaggggctgcgtgctgccgggagcttctgtcccaggtgtggttaacactaggatgtttctaacaggaagtccactgttagaacagacaccatcgtcct

SEQ ID NO: 195644 - DNA, 258 bp, Homo sapiens
tgctgggattacaggtgtgagccactgtgctcagcccccttttgcaatttaaagagcaaaataatctataaattttaaaatgtattttatatatgtataaactgtatctggaaggatgctcaagaagtggataatttttgggaaagcagcttggggaagtggaagtcaagagatgaagggaagcatgtctacacactatacctgttggtactattcagatttttacctcgtcactatgtctagaaaatggaagaaata

SEQ ID NO: 195645 - DNA, 352 bp, Homo sapiens
tgatccaccagcctcggcctaccaaagtgctgggattacaggcgtgagccaccgcacctggccgcctccttgctaatctttaaatatgttaagcacactcctgcatcaagacatttgcacttactttctggtctctttttaaagacataacccttttcatatgataatcatttggctggtttcacttgtttggggtctctgtttaaatatcacctcctcaggaaaatgttccatgatagccgcatctaatctagcagacctgtttagttgcagtccctttaccttgcttattcttttttacagcttgtatcagtagcttggatgctacatatgtatttatcatttatctatt

SEQ ID NO: 195646 - DNA, 140 bp, Homo sapiens
aagagcaatttagtgttcagttaaataataaacactggtactgataatttaaaaaatactttttagacattcatataccaaccttccttccccaaattagcttcctaaagagaaaaacagagatttctctaccatttcca

SEQ ID NO: 195647 - DNA, 480 bp, Homo sapiens
gctgtgaagaaccacagttgattgggataagggaagggcccaacagtggcaggtactgatgggagaacgtgcatcccagatgtggtctgtgcttctttccaaagcttgacaatgcttggccagtctgtgccaaagataagggggtgagtctctgcttgggcttgggtggtgctggtggccactgtcattcccaaggtgaaaggttataagagatacacagccaaggatgaggctcaactaagttgtagtatcagggtgttcagagcctcctagctgtctggcatctcctgagatggttccaggagattctcctaaaatgaagcataatgtgctgagcttttcaaggtgtcagggacatcaaacaccatgacgatttccacactctcccactcagttaagcaggacagggattggcaaactactgcccataggctgaatttggcctattcctgtttttgtaataaagttttgttggaacac

SEQ ID NO: 195648 - DNA, 605 bp, Homo sapiens
tgctgaggtaacttacaggtaattttttctccagtgattttattatttttgtttggtcttgctagcttttagtgccttcagtgtaaataacacaaaatttatatttatttttacatccagatagtacaacttaatcaagcttcaaagactatggaagatcctctaaggacagtaaactactgccagtattaggaatttatgtcagcatccagaggtgcaagctttgaacggacaaggggtgggggtgttgtctagtgtttgaagctccagtgacttttgtttttggtactcatattcctacatttatgtaactcagaatgatcttccagggctgttggaaaaggaacatagtgattacagcttaattatctgagttccttaaaggagcaaagactaagagttcagcttttttgtttttttttttaaaagacacagggtcttgctctgttacccagtctcaaaaaaaaaggaaaaggaaaaagaaaaaacaaaaaagcaagcaggcaagcaaaaacaaacaaacaaatgaactaagatctgctcccatgttaccccaccttgctcctaaaggttggatgtagtttcttttatcaaggagcaggttt

SEQ ID NO: 195649 - DNA, 197 bp, Homo sapiens
tcaaggggcctgctcttacctgacgtgctacttactactgatttgggcatacactctgtggggttacatgttaacttgtagattttggtccagtagaaaagataaccccaaaggttgtggcttcactaccctataggacattaatggtcttgtattcagctcaacaatctttccttttttttttttttttttttaaa

SEQ ID NO: 195650 - DNA, 520 bp, Homo sapiens
aacgttatggtttctaaactgaatctcaataaagctgtttttaaacagcagtagtaagtaaagttgcatggaggttgggagtgggtgggggacagaaggaaggagaacggtgactgctggagtcagatgacgggcacgcgggttcttcggacaattttgttgactttgtgtttgaaactttccatcataaaaaattatttaaaataaagttgcaagaggctgtggtccactgagtgcaatcttccccaagcacagaaacattcaggcccccatttctgagggagggcagggagctgatgtgacagtttgcttgccactattcttcagccagatttggcaggtcgctagcaagatccccactatcaaatgctttgaccaattttcagtctccatccctatgagctctgctgaccactccctccttcctgaagttgtcccctcccttgatttctgtgatacctcaggcctggcctttgtcttacctctgaaaccacttcttctccatttccttaccacacca

SEQ ID NO: 195651 - DNA, 530 bp, Homo sapiens
cagattattttgacaaaatcattaagtataaggaaaaaagtttaattcaactgaaagataagaacttctcattcataaacagataccgtaaagagaaagaaaagacaaaaccacagagtggtagaaaatatttcaagtcataattactgaagaagacattagtatctggagttaaagaacaactgtgcagtaaaagattatcataggaagcctaagactgctatccttagaaactaagtcctgctagcaatgtttgcccttggctgttgccttgaaacttgggttgcagaaatgtccccatggatgcctaactgctgaggctagtttactgtgcttgtaaacaaccaaagtggtttatgctgaacacttgctttccttcttgagttcttgaatttttgtacatgccaggcagagagtgcctgtgtgacaagtcccaaataaaatccttggattttcaatgagcttctctggccagaaacatcacataacatttgttcttcaagattggaaagaagttaaaaaaaaaagaa

SEQ ID NO: 195652 - DNA, 503 bp, Homo sapiens
tgtgggtgaagggtggtaagagggagaggagcagaaaagataactatgtggtcctgggcttaatacctgggtgataaaataattgtacaacaaacccccatgacatgactttagctatgtaacaaaccttcacatgtacccccaaacctaaaagttaaaaaaaaaatcccagacaggaagtagggcatattttgcctaatttgcagcttcatcctcactccctaacttacgccactcatgtctcctccatcatcagggacagcaagagtggggaggggacgaggcctgccacatctccattctctgatcttatttcctcttgcctcttcaacagcgctttgtctctcctctccagcttgaagcccttactctggtatgtgatttcaaagcgatgaaaaactggtttcgttagtacttcccttggatctgcccttgtctcccatcaagcagtgcaagtaaagaatccaagatatttgttttgttggtccactggagggtagaga

SEQ ID NO: 195653 - DNA, 421 bp, Homo sapiens
cttcaattagataacataccatatgacaaatcctagataatgaaaatctattttgccaaagtattgctgctagtacatgctattttggcgactgctgacttactaggtacctcagtagtggtatgctggtaatctgcctctagaaatggtggaaccaccccaacatttctccaaaatagttttcatttcttttatagttgcttgaattccagctctatttgttatattaggaaaaacttaaaatgctatgggtgggtgcatttttctagcatttcagaaaatgcaccttttaaaaaatatttttttctcaccatttattctttacataccattgttccatttctgcctgctctttttgcacaatttacaggttgatccactctccttaggaaagaaagcattgggtattttgtctacagat

SEQ ID NO: 195654 - DNA, 405 bp, Homo sapiens
ctgagattgcaccactgcactccgcttgggtgacagagtgagactccatctccaaaaaaaaaaaaatgagtcactgtggaaattcagtgaggtagtatatgtgaggcatctagatcagtgtctggcatacacttgacatttagtaaatgttctcttccgttttcttagatcagttttatcagtttgatcaattaattgtttatttgaataggtattgattgcctaacttctctgtgtctcacatctgcaggttcttaattgatggctcacagtaattactattagtaatggctcatagtaattactattacagtaatacagcaaaagccttttagagagtagtagctgtgaggattttgagaatgggatggatctggaaaataatcttaagtggtgaaatggaca

SEQ ID NO: 195655 - DNA, 426 bp, Homo sapiens
gatatcttcctacaagagcaggtttctcactttcgatattaagcagaagagacagaggctggacgtctcaagccaaccaaggactcagctgggttggggctagattgcagttttagtggaatgtagtcttccccttgtttatctatacttgtaagccatgacactccctggattttgactgaaagcctggtatatctttatcttctgggccctgaaaaagttctctttcagaagttttcagctcatttctttatcttagggccctaacagctacaaaatttggtaaatatcttcaaaaagagttcaatggtatgtttgagtttggtgtctccaggctgccaagtccttttgtttgtttatttcctactaaaattctactgccttttggaagctctgcctttggcttcctatgcagcctcaaaacac

SEQ ID NO: 195656 - DNA, 671 bp, Homo sapiens
taagatttagggatctggaaaaagcctcttagacataaattcatttgaatccctggtgttattagtaaccattgatattttacgcttggtgcttttactcagcaaatatttatggagaacttactaaatgtcaggcttgttatcgtcactaaggacccagggatgagtataacagtacgagtccaggcctcacctcctggagctcacattctaattgttcttagccttttatgatggaggttattcatcttcaggtggaggaaaacctccagcggagcagcaggcttctgtaagctctgggaagttgccacctctgcaggggagggaaggcaggtggcccctccaaacaaccctgtgtggtagctcctgtagccagagcctctaaggaaagccccttggagcgggtggcctgagctgagcaaagccctctgccaggttcctgagccctctgactagtgcctttgtggggccactgaagtccaggtgagagggctcagagcttgtcaggccaatgagagtatgttcatttgctccctgctcccggcctaagttccagtgtggcacagcagcttgcagagaggtagggatatgggcacataggtggacaggccttgggcctgcttctgacccctggtctccagctcagagggccacagaactcgtgtggtaaa

SEQ ID NO: 195657 - DNA, 467 bp, Homo sapiens
ctgttttactacattcatcaagaaacccaatgatgctgcctcttctgctttgcaaattatcttttcacacgcgtgactccccttcttaggcagatggtttaccaagtgctacttatttggtttgcgttttgactattttttgaggatgacgtcattaatctattgctggaatctgggagagctgctgttttaaagacttactggagctgccacgtctcgagcagataaatgtggagagccctccgaggaggaacggaaagaaatctatttgcgtgagccgttatggattccgggggagagttggccgtgctcctgggtgggaaccgtgaaggagaagtcgtcgaggggtggtcgcttctcatgggttaacatcagctctaaaaggaacgtgggtttccctgcatctacaaaggccatgtttgcaactccttttattccatggagagtggtactggaaaataattctt

SEQ ID NO: 195658 - DNA, 252 bp, Homo sapiens
cctgtgctcaacccaagcctgaagcatatttggttcatagaggtctacaatgcttgaccacactgacatgacagcaagttgccagatgacactgcccagaagtatgtggctgtgtgtcctaagcatgcttggccacggagtccagaaaataatggggctgggcattgcctgtgcacagggtgcttgtggggaagggcggcttcaacccattttgtcgacgcggccgcgaatttagtagtagtaggcggccgc

SEQ ID NO: 195659 - DNA, 316 bp, Homo sapiens
tggagatattacctgaaatgggtaagatgggaggaagaggagactgcagggaatgacactgagtcgggctttgaatgtgcctcatttaaagctgtaagagttaaggatctatgagctcttagagacacctgaacaggcgaggacatggcatagtgagagaagcacagaggagaagaaccaggcacagaaggtgggtgaggccagacaactttggagtggagatgggtggtgagagaggacactggcatgtctgggggcctatacatctaagatactctctgtcaccagtcaagtagtggcctagtcctccggccta

SEQ ID NO: 195660 - DNA, 147 bp, Homo sapiens
gacagcactggcaaagatgtaggtcccatatgttaaacatcgctgatttcccagtactaaaaatcatgttcacaaataactcagaataattcctttctctgtgtttgagataattgttagcccttttcctttctgacttttttgtgt

SEQ ID NO: 195661 - DNA, 461 bp, Homo sapiens
tagccaagaagggtaagccatttatattttaggtatactattcatagtcttttaacctagttcttctgattgtaaaactaatttctgcaggtagattaaataagattaagaaacttggatttcagaaacagttgcagatattattgattagctagttggcagtgggtacctaggagataatctttgtctgatcttggtggattcaacttctctgcagatggtcataggcattgttttcttgtttacagtttggtggtgatcttttttatattttccttcagttttgttgtatctgactcttttcagaaattaaagtgttgtttttttatttgtaagaaatgtgaaatgactacatctttgtagttatttatttcctttgggagttcccctcccccgctaattaaagttactagtttccttgaagaaaatcttcaccatctccttctaggaaaatgtggtta

SEQ ID NO: 195662 - DNA, 471 bp, Homo sapiens
tcatagttaaacttctgaatactaaacgcaaagaaagtcttgagagacaaaaatgaaaccttacctacaggggaataaaacacataagaacacaatggatttctcatcagaaaccagggaggctagaaaaaagtggcacaatagttttcaagtaaagaaagaaaagaactgtgaacccagaatcctatacccattttctgtcatttgacaatgtcatttccctttcattatgaatgaaaaaaattttttttggctaaaaatctgttgctagcagtatggctaaaggaagttctctaaacagaaagggaatgattataacaaaaataagaaatctaaaaatgtgcgtaaatacgatagacttcccttctctttcaaagagttttctgaaatatgtttggtggttgaaagaaaagttgtaacactgtctaacgtgattctaaatatatgtagaagaaatatttaagaatgata

SEQ ID NO: 195663 - DNA, 554 bp, Homo sapiens
acatatttcattgcagaatattagtttagggtgatcaataaaagactttcaagcctaatgttaagcaaaagagacttttaatatattccacaatgataaaatcctgtggaagaagggcagtgggaatgcagattccaggagcaagtggaacgaagccagctgtccagaagagctttttttgtggggtttgaaaacaggtgccaatggtggctgtcaaatcatgatggcatttaggttctactagctacattggagagaaagaaaaacactatgctttacagagtcaaaatctacaatatgccagactttacaccccttgcatatttaaacttgggcttaaaaatgtagaagctggctggttgcagtggctcatgcctgtaatcccagcactctgggaggctgaagccagagaatcacttgagcctaggagatcaaggctgtgtgagccatgatggcatcgctgccctccagcctgggtgacagagtgatattctgtctctataaataaatagatgaaaaataaaaaataaaaatgtagacgtcaacttcacatt

SEQ ID NO: 195664 - DNA, 427 bp, Homo sapiens
caattaggtgcattcatccagtaagcctcctaggtaactgctctaggtgcagggaataatgcaggcagcgggacaggaatgggcgctgtcagctccccctagagctcagtgtacatacacccttcctttcctgggagggccgttccaggcccccaggagacaggacacgctgagctgggtggggctggggccaacgtgggcaggcctgtgagactctgcacttgggagctggttgcagtggctcatgcctgtaatcccagcactctgggaggctgaagccagagaatcacttgagcctaggagatcaaggctgtgtgagccatgatggcatcgctgccctccagcctgggtgacagagtgatattctgtctctataaataaatagatgaaaaataaaaaataaaaatgtagacgtcaacttcacatt

SEQ ID NO: 195665 - DNA, 452 bp, Homo sapiens
acactttcatgccccagtcaaggccactccatctgtgtgcaccaacctgacaatttcagttccccaaatgtgccatgctctagctttccttcctcatcttcctacttcaggtctcagtttagatgtcacctccttgatcctcacctccaattccgctcagatgaggtgccactgctatgagttcccttgacaccctgtgtttcccccatgactgcactgattcctgctgaaattaaccagtctatgcctttctccggctcttgcaagaaactgtatgtgagccagggcttgtctctcccattctttagagagagatccccagcactcaggacagtgcctccccagggcagctgcatgaatggcctaccgtggattatcctactctctactgcttcacccagcaccgaactcataacaaatgcacaacagacattatcatggacccattctgt

SEQ ID NO: 195666 - DNA, 356 bp, Homo sapiens
aatttgtccacttttttatttatcacacgtctaacacctactaagtggcaggcactgtctcaggtgctagcattatggtgctgaataagacaggcatgatgcctactctctctctctgggaacttgcattctagaggaaaagacagacaataaacaaataaatgagataattatagattgtgttaaagtgctgtgaaggaaacaaacagtgggacaagaaggaggataactggaggtgggggaggggagggggctgctttacccagccagggaagcttccctgaggaaacctgaaggttggccagtgtactccagcctgggcaacaaggtgagaccctgtctcaaaaaagagaaaa

SEQ ID NO: 195667 - DNA, 493 bp, Homo sapiens
aaagaatctgtagcagactatgtgtagccttcaaaatctaaaaaatttattattagccggtcgcggtggctcacgcctgtaatcccagcaatttgggaggccgaggcaggtgggtcacgaggtcaggagttcaaggccagcctggccaagatggtgaaaccctgtctctgctaaaaatagaaaaaattagccaggtgtggtggtgggcatctgtaatcccatctgcttgggaggctgaggcagagaattgcttgaacccgggaggcggaggttacagtgagctgagatggcgccactgcactcctttacacaaagtttgccctactctagaacgtgcaagactatacgatgtgcacatgtattcactcttctctcttgtacagagaggctaccactcatgagcttcaacataaatataagaatagtttctttggcctgtttgttatttaacaactgggctttggttctccagggatattggagctgcttcctt

SEQ ID NO: 195668 - DNA, 917 bp, Homo sapiens
tgataaatatgtatggaaatgaaaaagtaaaactggtattgatgtagtatactgtaatgtaaaacattagatgaaaggctcacacctgtaatcccacactttgggaggccgagacagacggattgcctgaggtcaggagttcgagaccagcctggccaacatgatgaaaccctgtctgtactaaaaatgcaaaaattggctgggtgtggtggcgggcacctgtaaatccagctacttgggaggctggagcaggagaatcacttgaacctgggagagggaggttgcagtgagctgagattgtgccattggactgcagcctgggtgagaagagcgaagctccatctcccaaaaaaaaaaaaaaaaaaatcagaagaattgagaattaaaaacaaaaaaaaaaaaaaaaaaaaaaaaaacaaaaaacaaaagagagggggcgagacgcacaaaagacaataaccatcggaggaggcccaaccagaaacacgatcacacaagattatgagtaaaccaaaaaggcgccccccacaaaggaggagacgccgctatctccacacgccgaccgccggagcgccccgcctcacacacaaacagtccgttcggtcgagaccgagaacacaacttgcccctcttaaccgctgacaggaactaccttgtgagataagcgagccaccacctatacctcgcacgggtgcgggttagcaaccaatagtctggaccaacaaccacttactactgacagaaggatgaatatagcgccagctaccagagcgaggacagactccacaactacctgtcagccagtctaaacagggcgtgacacgacacaacgctactactattccctagtcgccgtaccaagaaaaatttcgtcaacatgagatattgcttatagtaacatctcttcaaacagaggt

SEQ ID NO: 195669 - DNA, 690 bp, Homo sapiens
tgataaatatgtatggaaatgaaaaagtaaaactggtattgatgtagtatactgtaatgtaaaacattagatgaaaggctcacacctgtaatcccacactttgggaggccgagacagacggattgcctgaggtcaggagttcgagaccagcctggccaacatgatgaaaccctgtctgtactaaaaatgcaaaaattggctgggtgtggtggcgggcacctgtaaatccagctacttgggaggctggagcaggagaatcacttgaacctgggagagggaggttgcagtgagctgagattgtgccattggactgcagcctgggtgagaagagcgaagctccatctcccaaaaaaaaaaaaaaaaaaatcagaagaattgagaattaaaaacttatcaggagtagtttgaacagtgcttgtcttcttcatcttgtcatacgatataagatgggcctagcatcttttctatgacttggtgaatttccatactcctttctaagtttggatcagtttcccgtatttcatcctttgtgctttcagtgagtttcattaatgtgaagtttttttgctggcatcacttcctctgggacgtctttattcttttgctaatttatgtgaagctgccttcaccaagctcctgtggctgcacatcattgtctcttagatgtcgttagtgtctcttagatgtcgt

SEQ ID NO: 195670 - DNA, 283 bp, Homo sapiens
ttggcaagaagtcacattgaaaggctcacataattatgttggaagtgtacttgctgcagcttctcaaatgttggagtgttaacagaaaaggagccacatgtttgcatttgcctctttccctgttcctagcataggatactggaagtcatcaactggaaacactctaaggatggacaaaaatagcttattgtgtgactcaaataaaagttaaacagttgtaaaaataatttttcccaaaaagtcaaatatatgattacatcagtttaatagaggaaaggttgat

SEQ ID NO: 195671 - DNA, 807 bp, Homo sapiens
ggctctgagacttggtttccaccctcccggaggccatctaggcccccgcagcggcacttgctgcgcccttgggtctgccggtcccggttccaacaggctgagggcctgccctttgtcttgtcctgggtacctggctactgccttgtgataaatggagatttagtgctcactgaccatatcaattagggcctgtgtgtattttttatgaagacaggcagacctgtgcccaaaagccaggacaggaagacctaagtaccagcagtttgtctcagtctgtcttgtctgtgttctttgggtaatctctgaatgtgacaagcacagactgtgggtgcttttgggctcacagcttgtcaggaacaggtggaaggagacgggctgtgggaagtcttgaatggcattgtgttggatgtggttctgggacctctgccacctgggttaatgggtcttggctctagacagaaacatgcacgtactcctcctcttgttgacgtggggttgcgtcttgctctccagaagccagtaaacctctggcctgttagtgacagaacaacccactatagattgtgccagaagaaagttgtcctttttggcagagtctccatggaaaatgctacacagccacatttagcaggcgaactcacttatctggcaggacgctcttctgctcacggtcctggcgcgtcgtaggaacactgccctacatgaatttacagagtctattacagtgatgtggacattcctctgggcagctgggataagcacgttgtgctcaaaataccggttacgtccgtcttctcctgtgtagac

SEQ ID NO: 195672 - DNA, 238 bp, Homo sapiens
taggatgaatgagtctagagatctaatgtggggcatgtggaataaaattaataaaattgtattgtattagagacttgtgttaaataagtagatatcagctgctcttgttacaaaaaaagtaactatgtgagataatggatgttaatcttcttcactgtagtaaccatcttactatctatatgtatccgataacatcctgttgtaaatctcaaatgtacacaataaaatttatttttta

SEQ ID NO: 195673 - DNA, 518 bp, Homo sapiens
caggggcacattcttgtcacacggccaagcttccattgcaaaatgactacattacaatggatctttatatgagtgtctagcacattgttgcaattatttgatgaactatcattttgaatttgttcagctgcacttgtggaggaggaggggtaggagatgaaaaagaagaagaagatgatcatcgattatgtactcactctgtatcaagcactgttctaagtacttttgcatgcatcactacttcgtccagtttttatgataaccctttgaggtagatattttgttttacagatgaggaaacagaggccccaagaagttaaataacttgcttaagatcacagagctaatgagtggcagaacaattattctagctctgattttaagggatttacttaacttttacttggaattcatggagtcattgggctttatttaataagtatctcatcatattctagttatatcatctcctataagtgttcaaaatttgataaaattcagatcaaaggtgttttggg

SEQ ID NO: 195674 - DNA, 255 bp, Homo sapiens
taaaaaacactgacaaccaaatacaatcaataatgtttaaatggatcccggatgaggggaaaatagttttttcttacagaattaataaatgtagaaagaatgagagaaatagaaaatcaccattaaaacaccacagtaataatttctaaaggaagatccacccatggaagctcacattagttgatgaaaccttaaaaggggaaacagggtatctgaatagcctcaaagtacctccactaaaatatttattaaaaa

SEQ ID NO: 195675 - DNA, 1610 bp, Homo sapiens
ttttttcttttttttaagagatggaagggggtgggtcttactttgtcacccaggctggtctcgaactcctgggctcaggcatgagccaccatgcctggcccaatttttgaattttttcaaaggttctcactgtattgcccagaatggtctcgatctccagatgtgaagtgatctttcccacttggccgcctaaagtgctgggattacaccgcacctggcccatgcttttctttaaggaagatagattaccttatttctctcagtttttatgatagccgtatacctgcaaagttccatcttccatttcagattattttgtttttatttttaattctttcagtgtatgctgtgtctgttaacttgaagtaaggataataatttcataccttgcttatgctctccctttgtggtgaaatcattatactacttttctttcttttgttttttcttcaacttttattttaaattcccgggtacgtgtgcaggtttgttacataggtaaatgtgtgccatggtggtttgctgcacagatcaacccatcacctaggtattaagcccagcatccattagctattcttcctgatactctctctccctctgcccctttgtactacttttcaccattatgatttttaccatatccacctgccagttttacagttgataaatgcaaggctggggaacaaagtgagaccccccatctctacaaaataaaaatttctaaattagccatgtgtggtgttaaacacctgtggtcccggctgcttggggctgaggcaggaggattgcttgagcccagaggtcgaggctacagtgagctgtgactgagccactactccagcctggctgatgaagcaagaccctgtctcagaaaaaaaaaaatgtagctcgggcacagtggcccacatctgtaatcctagcactttgggaagccaaggtgggggaggattgctcaaggccagaagttcgatacctgcctgggcaacatagcaagaccctgtctccacaaaaagtttagaaaattagctgggcatgtggcacatacttgtagtcttagctactcaggaggctgaagccagagaattgcttgagcccaggagtttgaggctggagtgcagtgccacgatcatagctcactgcagcctcaaactcttaggctcaagtaatcctcctaccttagcctcccaagtagctgggactgtagacacatgccaccaggcccagctgatttatttttaaattttttcaggggaggtgggatcttactgtgttgcccagactggtcttgaatttcctgcctcaagcaatgctcctacctcaccctcctgagtagccaggattatagctgtgagctaccacacctggcccattttagtttttaaatgccactatgtaatgaggcatttaaatttttttccgaaaagtcaggaaagaaggacttggagcacatacctgttacgggtttaaagcctactttagtcttggccgggtgcggtggctcacgcctgtagtcccagcactttgggaggccgagacgggcagatcacgaggtcaagagatcgagaccatcctggctaacacggtgaaacctcatctctactaaaaatacc

SEQ ID NO: 195676 - DNA, 449 bp, Homo sapiens
gaaaacagagaggtcctggcaggacttgtgccccacatggctcagctacagagctactgaagtggagacactgacggaggtcttccgggatgaggtcttctgcagtagggctcatggtgggtggggtaaggcggagcacagagggctactcaggaaagaaggcatctaacaagagctttggttaaaaaatataaatatatatttaactatgtatacatactgcagaaaaaaaaagagaaatttttttaaaaataggctgaagttggagtaggagtgatccagagggtcccctgcaaaaacactcctggagaatgtgactgtgatccaggccctgatgccatcagggagaacggtcctggtgagagagacagcaagtgctgtggccgcaacgcaggcaggtttgcatggctggatctatgtgactgagggaagtcacagttcacccagag

SEQ ID NO: 195677 - DNA, 577 bp, Homo sapiens
tcaggacctaattcctgagattatttgaaaagaatggctttcatagaaggcaacaccctcacttgattttacaaagagtcaaaggtttgtcactatctgcaaccccgctgcatctaatcaccaactgacagatgagatcctgagtcatttagacacagatgggaaaaaatgctggttttatattggtcatatgaaaggctatattctattgtcatgctattctacttggcaacaaattttattttatagttttatcctgatttcagagaacttgtcattagtagaggtgcacctgaaaggttttgtcttcctgtggtattttgtgcttctatggattgtgtacgagcatcacactacactgctgttcgccctgtctgctcattacggctctcctagctgtaaatgctgatatctgcactatcagttcaacgctgaccattcagtgctgaagacaggttgaagtcagagaactgcccgttctctaatcggattagccagctgtgtggacatgccagtgtttagcttctttgtgccagccatctcgttctgtatgagtgtgtggcgaaagaagcaggtc

SEQ ID NO: 195678 - DNA, 302 bp, Homo sapiens
ctgggaagggtggtgtcatgctgcctcacttggcttgcccggaccctgaatctgggccatcttgcccctgtctggtgctgtgttctcaaacttcacttttctcttccgcactccatgtctgaccaccccagcctgagctcatgggtttaaatattggctcacaggagctgatagacctagaggcagattgcatcagagttttctttttgccagctctaccaaatcacagagatcactgtataaaagatgaaggcagcccatcagttcttcctgaacagtgaggtccagcacacataccccta

SEQ ID NO: 195679 - DNA, 194 bp, Homo sapiens
aaagggataatggtataatctatgaagtcaaagggtaggcagaggtaaggcagtcattgaggattataatgaaaggaagaaaaatagcattaaaataatgaaatttatgtaaatgcctatatgttgtgactaattccaaatattagaagtatcaaactttgttttcaacttttttttttttttttttttgagac

SEQ ID NO: 195680 - DNA, 498 bp, Homo sapiens
tcattaagggtaaactccatctcaaaacaccactttttgggctcatccataagaagcaaattcccattcattcaacactgatcatgagattgtagcaattcggtcacatcttccacttcttatttctcttgttatttctagcacatctttagttaccacctccactgaagtcttgaacccttcaaagttaaccatgaagtttagaatcaacttcttccaaactcccgttcatattgttattttggtcccctcccataaatcgcaaatgttcttaatggcatctaaaatggtaaatcttttccagaaggttttcaatgtactttctccagatccatcagaggaatcactgtctacagcagctatagcccatgaaatgtatttcttaaatggtaagacttaaaagttgaaattactactccttgatccatggcatgcataaggggtgtagcaggcatgaaaacaacattaacctccttgtatatcttcatcagagctctt

SEQ ID NO: 195681 - DNA, 212 bp, Homo sapiens
tatcttgggaagtgctgacagaaccaaaatcaaataacaaaaatttttttgggaattttatttaattatcatgaatgtgtagatcaactgagagagaagtggcattgtgtctttctatccatgaacttggtatgtctttgtatttatttaaatcttcaatgtctttgaatacaattttataatttactctgtaaagtagcagtccccaacct

SEQ ID NO: 195682 - DNA, 426 bp, Homo sapiens
taaataataaagtgataataatggctgcctgtagaaagagttatatgagagagaatttttatcctatcaccttttgaattttgtgttatatgcatatttaaaaaaaaatttttttagaaagttcctaaacttcacgaggctgagaaactaagatgtattgctgttgcctggtcttaacagcccaaatacaatatagaagacaatgtgtggtgcaaaagcatttggttttgttataaagacaaatagtacagcatctatgtatatccttctggacttgtgggtgttgggattttaagcaggagataataaattatgccccctttgttccccttcagtgtgctgcaacaaatcagatatacccaggatgcagacagaaagggagcaaaatagccatcactaccaatagtgctggatttgacaactggg

SEQ ID NO: 195683 - DNA, 450 bp, Homo sapiens
acgcctggctaatttttagtagaggtggggtttcgccatgttggccaggctggcctcgaactcctgacttcgtgatccacccgcctggacttcccaaagtgctgggattacaggcatgagccaccgtgcccggccaagctctgtactttaaataacatatcaaaataaattctggaagtcttaaagcattaaatataaaaccttaaattaatagttgtccagtctctgggtggagaagactttcgtatgtatagcatcaaatatagacactataaggaaagattggtggatttctctgtcagttaaacagaccaaaactgccacgtctgcctacaagggtgcagtggtagttcgggcggcaagggaatggagaagagctggccatagcgctctgaccaggctcttgtagcctttcttttctttaaagtctgattgcctttaatagggtta

SEQ ID NO: 195684 - DNA, 332 bp, Homo sapiens
agggagacaaagaaagacctatagtaaagtagaactttaatggtggtacaaacaaaaggccagctagctcagaaaggtagaccgcagatcaaaagaggaagcagaggaggcaaaatcaacctaacaccatgggaaaggatgcagagcacatatccccaaggtgtcctcaaaagaaaagatgactgaacaaagatgggtcaataaacaggatggctggaagtagaaatcttttaaaataaaatgccttaccacttaatgctaataagttttattgagaacttgtaaggtgtggctcacggccctctgttttgttttttttttttggtcacctg

SEQ ID NO: 195685 - DNA, 446 bp, Homo sapiens
agattgtaggcttgtgcattttttattctgctgagcacaggacatagggtttaaagcaatttaggattgcaaaccccaagattttgtgtttaaaatattggatgattaaaacgagtgggcttcttatgtatccagtgttatactttggtgtgatcttctatacatagctaaaattatttttagttcttcctattaatatttgattttaaagctatttctaatgacacttaggaccaactaatcttaacaaaccaaagatggcttctacaggttgtttgatgttttttgatgaaaaaaaatccaagctggttaaatgaggctatttccagctgttctaactgggaatcattctcaagctaaagcagtagtgctttaccatcttatgaagctttagcttaaatccctttcaactgcttctatttattaaccacctgctgtgtcttttt

SEQ ID NO: 195686 - DNA, 305 bp, Homo sapiens
ccgtctcatttcctaaagattgtggaaagttgagtttattctaatatgtgtgtgtctatgcaaacacacatgcataaatgcatataaattatatgaaatagaattcctgttaagctagaaaacctcatctccctaacacacagtagaacacattattaactttttggttgtcagcttgacatgatcaaagtggttatctaaaatcccaaaccttaagtttgtgctttcttttcattgaatgcaaccaagaccagggaagttacttcactggtcagtaactcaatttatctatttgtataagaaga

SEQ ID NO: 195687 - DNA, 619 bp, Homo sapiens
ctcaaaggcatagggcatctcttaggcctatgtatccccagcccccaaaccatggccaaacataagcagctctcaatattttatctttgctaatatttgcattgtcaccagttgctctatgaataagaacataagtaaaatcaaagaatttttaaattaacattaggcatacctaaaataacaaatataattttttcctgaaattcacgagcagtttctaagttagtttctctgtagtaaaaaaaaaaaactagactttgaaaacctgtaaggtcaagagctggccaggagtggtggttcatgcctgtaattccagcactttgggaagccaaggcaggcagattgcttaagcccaagagtttaagatcagcctaggcaacatggcaaaactccatctctatcaaaaaataaataaaaaacaaagaaaacaacaacaataaaaaaatttgctgggcatggtggcgcacagctgttatctcagctgcttgggaggctgaagtggaaggattgattgagcccaggagtttgagaccagcttctacaacatggctaaactttgtctctacaaaaaatgcaagaattagctgggcatggtggtgcatgcctgtagaaggaggat

SEQ ID NO: 195688 - DNA, 125 bp, Homo sapiens
gcattgggtggaagttaccaggaaaatcatttcagtttaatgtaagttagatctttttgaaagagccttcagttagaattgaaactgctctgaatttctttctacatctgtcaagtctggaatca

SEQ ID NO: 195689 - DNA, 813 bp, Homo sapiens
tgttgggattacaggtgtgagtcaccgtgcctggccttcttcttattttttaaaaatgttcctgccctttatgatgtaagctccttgagggtagagattgtttcacatcaccagtgtatcctcagctcctaacactgtgtctggtacacattgtttgatggttttgatgtttcagattcgttatatttcacaaacacaaggcttgccagctgaatatcttctcagtgccggaacaaaaacaaccaggtttttcaacagagatcctaatttggggtacccactgtggaggcttaagacacctgaagaacatgaactggagactggaataaaatcaaaagaagctcggaagtacatttttaattgcttagatgacatggctcaggtgaatatgtctacagacctggagggaacagacatgttggcagagaaggcagaccgaagagaatacattgatctgttaaagaaaatgctcacaattgatgcagataagagaattacccctctaaaaactcttaaccatcagtttgtgacaatgactcaccttttggattttccacatagcaatcatgttaagtcttgttttcagaacatggagatctgcaagcggagggttcacatgtatgatacagtgagtcagatcaagagtcccttcactacacatgttgccccaaatacaagcacaaatctaaccatgagcttcagcaatcagctcaatacagtgcacaatcaggccagtgttctagcttccagttctactgcagcaggtgctactctttctctggctaattcagatgtctcactactaaactacca

SEQ ID NO: 195690 - DNA, 1391 bp, Homo sapiens
agctaatttttgtatttttagtagagatggagtttcaccgtgttgaccaggctgttctcgaactcgtgacctcaagcaatccactcaccttggcttcccaaagtgctgggattacaggtgtgagccactgcgctggccaagggcaccatcttttagtagttatgtagccttgggcaagttactttaacctcttagtgccagtttcttcatctgtaaaatggaggtaatacttttattgcatagaatctaacatgccattgattataagatacattatttttgtaccacttaaaaaaggaaaagcgctgccattaaactaaaatataccatcatttgtaagaatcttcttaatttcagaggtgctaacatgtaaaaagatgtgtatcttagaattgatgacatcataataatactttgataggattgttgtaaggattaagtgactcaacatttataaagaacttagaacagtgcatggcacatagtaggcaatatttatgtgtcatttattattattgctattagtgttacctattattttctttttgaacccacttattgcctaattagtcatagtttgacaattgcccttgtattccaccatgtcaaatataaatttacatagatgaagctcctgaaattattcttgggttaccattttgtgaagctattgatatgtggtcactgggctgtgtgatagctgagctgttcctgggatggcctctttatcctggtgcttcagaatatgatcagattcgttatatttcacaaacacaaggcttgccagctgaatatcttctcagtgccggaacaaaaacaaccaggtttttcaacagagatcctaatttggggtacccactgtggaggcttaagacacctgaagaacatgaactggagactggaataaaatcaaaagaagctcggaagtacatttttaattgcttagatgacatggctcaggtgaatatgtctacagacctggagggaacagacatgttggcagagaaggcagaccgaagagaatacattgatctgttaaagaaaatgctcacaattgatgcagataagagaattacccctctaaaaactcttaaccatcagtttgtgacaatgactcaccttttggattttccacatagcaatcatgttaagtcttgttttcagaacatggagatctgcaagcggagggttcacatgtatgatacagtgagtcagatcaagagtcccttcactacacatgttgccccaaatacaagcacaaatctaaccatgagcttcagcaatcagctcaatacagtgcacaatcaggccagtgttctagcttccagttctactgcagcaggtgctactctttctctggctaattcagatgtctcactactaaactacca

SEQ ID NO: 195691 - DNA, 778 bp, Homo sapiens
gttggccaggctgggtctcaaactcctgacctcaggtgatccacctgccttggcttcccaaaatgctgggattacaggcatgagccaccgcgcccagcccccaaatttttaatgacaagaaattgtttagctttcttctaccactcaatttagatgaagattttaattaaacagcataaaaagagcttcctcctctgaaaatgattagattttcataaaaagaatttccccaggtttctcttttgattacatatatacacacacacatagtttggagggaaagcagctatgtagtgtcagtgccaaaggttaagtgaagaagtataattctgaattttctttggaaggtgaatatgtctacagacctggagggaacagacatgttggcagagaaggcagaccgaagagaatacattgatctgttaaagaaaatgctcacaattgatgcagataagagaattacccctctaaaaactcttaaccatcagtttgtgacaatgactcaccttttggattttccacatagcaatcatgttaagtcttgttttcagaacatggagatctgcaagcggagggttcacatgtatgatacagtgagtcagatcaagagtcccttcactacacatgttgccccaaatacaagcacaaatctaaccatgagcttcagcaatcagctcaatacagtgcacaatcaggccagtgttctagcttccagttctactgcagcaggtgctactctttctctggctaattcagatgtctcactactaaactacca

SEQ ID NO: 195692 - DNA, 498 bp, Homo sapiens
gaaatctgttcttcctttttttttcttttttagagacagggtctcactctgtcacaaaaaataaaaaattaataatgagcacaccatatatctagtaagaggtgaacatccaaaattcagtccattgactgaatatatgaaaaactcaggcaactcaatgccaaaagaactgaataatccaatttaacaatgggcgaaggacctaaagagacatgtctcaaaagaggaaattcaaatggctaacaggtgctcaaactcgctaataatcagcaaaatgtaaatcaaaaccacaatgagatatcatcttaggatggctattatcaaaaacaccaagagacaacagtgctcaagagggtgtagggaaaagggaaccctggtacattgctaatggactgtaaagtacagccattatgaaaaacagtatgagagttcctcaaaaaattaaacatagaaccaccatacggtccagcaatctcctttctaggtacatgcccaaag

SEQ ID NO: 195693 - DNA, 282 bp, Homo sapiens
ccactctagagtatccccctatactgaccagcctaagagatgaattaggtaatgcaaggaggtgaatatgttggcttgcaatatgaacaaggcagagagctgggagagtaagatgtaagttgctaaggagggatgtgtacttgagtttggaaaccataaagggaaatcataggtaatgttagagatactgatcttagggagccttgaataacgtgatgactaaggtaatctttatttgaaggacagaagggccaggacaagataggtcaggggtaccgagct

SEQ ID NO: 195694 - DNA, 1394 bp, Homo sapiens
attatcaataatttaaaagacatttttatgtggctttaatttattaatatttaacatactaaagattaaaactgagttgtttttaaaataaaagaaatggaaacatgttttcccctggctgtcagagccatgatatcacataccatataacctctggaaaactccactgtatacttgtgaaagaatgaaagtgaggccgggcatggtggcttatgcctgtaaccccagcactttgggaggctgaggtgggcggatcatgaggtcaggagttcgagaccagcctggctaacatggcctaaccccatctctactaaaaatacaaaaattagctgggcgtggtggcacgcgtctgtaatcccagctactcaggaggctgaggtagaggaattgcttgaacccaggaggcggaggttgcagtgagccgagcacgagcaagagtttgagaccagcctgggcaacagagcgagactctgtctcaaaaaaaaagaaagaatgaaagtgaaaaaaataatgtttctgtattactgtgaatagttttaactttagggaatttctggaccatcctttgggaactgcttctgtacattatcagtttctcacttacagtggttggacttatgatttttcatctttacagtgatgccaaagcaatatgcatttagtagaaattatacttcaagtacccttacaaccattctgttttcacttacagtatagtattcaataaattatatgagatattcaacactttattatctgagcatgtttaaggtaggcccggctaagctgtgatgttcagtattaaatttaaatgcatttttaacttacagtattttcaacttacgatgtgtttatcaggaagtaaccccatcataagcagaggagcatctgtattgcgtaatttgactggcacagtttattaggttctgttcagtgttttccgtcaacaagatgtttattgtgtgagtaaacaagttaagccctgtgacaagctgaataagaatagtctctcctcagcagcttatagtaaacaagggtacgtatctctaacattagtggctagactatcaaacgaaatatataacatgtaagaacactaaagacagaattactgtggcatagagatagttagaattgcttcagcctaagagatgaattaggtaatgcaaggaggtgaatatgttggcttgcaatatgaacaaggcagagagctgggagagtaagatgtaagttgctaaggagggatgtgtacttgagtttggaaaccataaagggaaatcataggtaatgttagagatactgatcttagggagccttgaataacgtgatgactaaggtaatctttatttgaaggacagaagggccaggacaagataggtcaggggtaccgagct

SEQ ID NO: 195695 - DNA, 1448 bp, Homo sapiens
attatcaataatttaaaagacatttttatgtggctttaatttattaatatttaacatactaaagattaaaactgagttgtttttaaaataaaagaaatggaaacatgttttcccctggctgtcagagccatgatatcacataccatataacctctggaaaactccactgtatacttgtgaaagaatgaaagtgaggccgggcatggtggcttatgcctgtaaccccagcactttgggaggctgaggtgggcggatcatgaggtcaggagttcgagaccagcctggctaacatggcctaaccccatctctactaaaaatacaaaaattagctgggcgtggtggcacgcgtctgtaatcccagctactcaggaggctgaggtagaggaattgcttgaacccaggaggcggaggttgcagtgagccgagcacgagcaagagtttgagaccagcctgggcaacagagcgagactctgtctcaaaaaaaaagaaagaatgaaagtgaaaaaaataatgtttctgtattactgtgaatagttttaactttagggaatttctggaccatcctttgggaactgcttctgtacattatcagtttctcacttacagtggttggacttatgatttttcatctttacagtgatgccaaagcaatatgcatttagtagaaattatacttcaagtacccttacaaccattctgttttcacttacagtatagtattcaataaattatatgagatattcaacactttattataaaataggctttgtgttacgtgagtttgcccaactttacgctaatgtaagtgttctgagcatgtttaaggtaggcccggctaagctgtgatgttcagtattaaatttaaatgcatttttaacttacagtattttcaacttacgatgtgtttatcaggaagtaaccccatcataagcagaggagcatctgtattgcgtaatttgactggcacagtttattaggttctgttcagtgttttccgtcaacaagatgtttattgtgtgagtaaacaagttaagccctgtgacaagctgaataagaatagtctctcctcagcagcttatagtaaacaagggtacgtatctctaacattagtggctagactatcaaacgaaatatataacatgtaagaacactaaagacagaattactgtggcatagagatagttagaattgcttcagcctaagagatgaattaggtaatgcaaggaggtgaatatgttggcttgcaatatgaacaaggcagagagctgggagagtaagatgtaagttgctaaggagggatgtgtacttgagtttggaaaccataaagggaaatcataggtaatgttagagatactgatcttagggagccttgaataacgtgatgactaaggtaatctttatttgaaggacagaagggccaggacaagataggtcaggggtaccgagct

SEQ ID NO: 195696 - DNA, 200 bp, Homo sapiens
tgtcgtggattcgcacttattttgcctgggattcttccaacttaacctttttccttgaaccttagacatttcttacctaagagcctaaaggaaatcttgaggcttcagcagccaactcctgtccttccttagcaacaatcttaacaggagtgcacagggtaactggtttagggtgcttgctttgtcttaaggggaaaaac

SEQ ID NO: 195697 - DNA, 143 bp, Homo sapiens
ttctcagcacaaacaatgcaagccagataggaactaatctttaagtttcaaatatacttcaagaatatgttcttcaagaataaaagcaaaacgaatactatttctttttttaattatactttaagttttagggtacatgtgca

SEQ ID NO: 195698 - DNA, 661 bp, Homo sapiens
atgatactatgaagcattaagttgagactaggagattaacagtagggtgttaaatggacaggactgatcacaatcttatatggtgaaggaagaaccaattggacttagtgacacattaaatgtgattagacatgaattggaaactattttgaggtaatgttccccaggatgccctctccaaaacactagttgctgaggatgggaatagatgttaattgaaaaaaggtttctgaaaagcatttgggaaatgctaacttcaccaggtttctttcctgcaggacttctctgattctttaatatgcccatatgcatgatgattctgaaattggggaatgtagtcatagtaggaagcatttctaaagcttatttcttcatggaatcagaattatgttgcacccaagtagcatcttacaggaccagtatttcatggaaaatactctgtgaagtgctgctctatggttttaaaccaagaatgaggtacaatataggggcattgactcaacccagtgaatgtgctgagcactgacctcgcaagatcctgtggagggcggaaatggataagatcccacctctgcaacaaggctggcaataagccattagtggtggcattgtctacatggctaatagcagggatgccttgggggagacaatatcccaccga

SEQ ID NO: 195699 - DNA, 1263 bp, Homo sapiens
tggagcaatgcagagtgagtacatccactccacattcattctgctggcgtccttctgaagcctgctgtccatgtgtgaacccagtcccttcatcatcttccccctggatggttgtatttttccagtcacttctcccccaaatgtctgcctgctgcagcccactgcatcttttgaaagcctgtgccaccccatctctcctgctgctcagttggagagcaggctccaggctcaggcttccctaatttatctgttcagagcctgtgggattcagggtcagtttgtttcattatcacatttgtaggactttgtgttgttcccagcactaggtgagatttgaaagatgaggtgtgctctgttctcaaggattgttgagatggagcctaatgattgcacactcacgtgctgtgaagagttaagggtaaaaagtacaactctgactctggttcctgagatcaccgaaagaagaggcaaatgaagttaggtggggtggggtggggtttattgttttgaactgtttattaaaaacgcaacctcttcaaagactcagcactgccacatcatatgagtggacttgtcctcatcagctaactgataggagaacaatgccctaaagtaatggatttatccacctactcaggccagtttcatgcaggagggaactttccagatggcacattgccccatttccaagaccttccgctgacaaatgcatcatattaattatgatggaaaacaagtaagaaggcatgctctacaaaaattaggtcacttgcccaggtgcggtggctcacacctgtaattccagcactttgggaggctgaggtgggcagatcatgaggtcaggagatcgagaccatcctggctaacacggtgaaaccccgtctctactaaaatacaaaaaattagctgggactgcaggcgcacattaacaatccaagtaatttataaaccttaaactttggtagagatggcatgtcacttggtgccccaggcaggttatgaaatccagggcataagcaaggctccgcaagcccaaaggtctggaatgagggtgagccatgggcggataggactcgacagtgaaggggaccccctgaagcacaatatgaggcgaccatacacgggaggcggaagggacgaaggggcaaagagcaaggcaaacacgaggcggaacacacaaatggcacaaagggcaagacacgaagagacagtaaacacaagcgacgagcagaggacgaaggagagagaacaacccgaccacag

SEQ ID NO: 195700 - DNA, 242 bp, Homo sapiens
cctatttggcctgtcccccatcccgcattgctgcctctaaagcaatggaaccacctatgtggttgcatggaaccggtctaaatatgattacatgcaaagcagctaatactcgcccctcctactgtctgttaatgactagattaagaaaatgttgtgggatctttcaccttctgcctcaactaaatttactttactgatgcagacagacagaaggcacaagcatcaatcataggttccagaag

SEQ ID NO: 195701 - DNA, 409 bp, Homo sapiens
atgggagactggggacatacaagggaatgaggctctggtcctgcctcaccactgtgcaggtgggggcgtggggaccgaagtcgggctggcaggcaggggcttacagcacagagggagggcatggaaggggaagcctggggccagggcagccccaaggagggaactgatggagacctggaggggaggtgggagaagggtggaggaggagcccgtggagctgaggccaaggctgaacacgctccccagggaagaatgctccacacagagggacggtgcgtgcagaggccctgggtccgagacaacctggctgcttggggtaactgcaggtaattccagaatgagtctcagtgggttttggtttttgcatttggtgtgagcagatcagtgaggtgccatgaggtgcccccac

SEQ ID NO: 195702 - DNA, 117 bp, Homo sapiens
tgccgggattacaggtgtgagccattgcgcctggcttgtgtgtactgttgccagtatatatttctgtgtaataatgttcagggttgtaaacagaaaaccacatataatgcactttaa

SEQ ID NO: 195703 - DNA, 434 bp, Homo sapiens
taatattaaagggttctttgtacagaaatcaatgatgatgtgaattcagggagaatcacttgcattttacacatttctctggggtaggttttcagcaacaaggatgccagcgtgaatctagagctaaaaagtaaacactagtcagttccatttaatgctgaaaattatatcatgagccaactttgatagggaattgaatgtaaaaattgggctttagatttggagaagatcctagatcctcgtaggagaagaaagactggaaatgtggtctggctggtcaggagccgggacagcaggtcccacgctataggtgtacacagattctccccgctggcttctctgttctgtggcatcttcctggtttcctggagtcagggcagctccactggcctcagtttccagagaacaaacctgactgaggtggacttgccacc

SEQ ID NO: 195704 - DNA, 650 bp, Homo sapiens
ggactgtcatctctcctgtcccaagcctggactggaaagactgaagagaagccttaagtaggccaggacagctcagtgtgccatggctgcccgtccttcagtggtccctggcatgaggacctgcaacacatctgttagtcttctcaacaggcccttggcccggtcccctttaagagacgagaagggctgggcacggtgactcacacctctaatcccagcactttggaaggctgaggctggagaagggctccagcttaggagttcaggaccagcctgggcaacatggtgagaccctgttttgttttgttttttgtttttttgagatggagtcttgctctgtcgcccaggctggagtgcagtggtgcaatctcagctcactgtaacctccagctcccaggttcaagcgattcccctgcctcagcctcccaagtagctgggactacaggcttgcgccaccacgcccagctaatttttttgtatgttagtagagacaaggtttcaccatgttagccaggatggtctcgatctcctgacctcatgatccgcccgcctcagcctcccaaaatgctgggattacaggtgtgaaccgctgcgcccggcctggtgagacccagtttctacaaaatattaaaacattagaggccagggct

SEQ ID NO: 195705 - DNA, 370 bp, Homo sapiens
ggactgtcatctctcctgtcccaagcctggactggaaagactgaagagaagccttaagtaggccaggacagctcagtgtgccatggctgcccgtccttcagtggtccctggcatgaggacctgcaacacatctgttagtcttctcaacaggcccttggcccggtcccctttaagagacgagaagggctgggcacggtgactcacacctctaatcccagcactttggaaggctgaggctggagaagggctccagcttaggagttcaggaccagcctgggcaacatggtgagaccctgttttgttttgttttttgtttttttgagatggagtcttgactccagcctggggaatagagtgagactctgtctca

SEQ ID NO: 195706 - DNA, 250 bp, Homo sapiens
tcatcctcaggaaagcactgaatgaggaatgatgctgtgacagtaagcaatgtagggaaaataggtggcactcgaatcttcagctctcactaatgtcccttcaagaaccattgccatatatgtggctcttgggtggaatacttgagatgtaaactattacagatttagtcattaggaaaggaatgcagggaagagactattatgaaggtcatgatttaggaaaccctgcagggcattttacattttttac

SEQ ID NO: 195707 - DNA, 386 bp, Homo sapiens
tatttatatgagcatctccttacaattttaattaatcctgtgtacatgtctgggtttttgtatgtacttacacttgcttcacataatgttgccttccctcacttaggcaggtaaggcttctcctgagtgaaccattcctcttcacatgccacctgaaaagggactgtgcttattctgtttcttccctaggaacgtccagccccatcactttatcttcaaattgacttcccttttacccaactcaaatgtcacctcctcctgaattcatccctaaccacccatcttcaaataacctttcatgactttaagcccaatgacacattcatctctaccttttttttttttttttttttgagacagggtctctgtttgttgcccaggctgga

SEQ ID NO: 195708 - DNA, 485 bp, Homo sapiens
gcagaattttcttttctttaagggtcgtagaaggacatccaaagcatgcatgaaaaacagctttactgaaacattgatgataaccatgattccaggtgctattcctgtatgtaactttgactctccatgtccttgagatgacatcaagattacctctcaatagtggtgactgaaaaaattctgcattcagcactgtcactgtctagatttgtaatctgatatttgatcttccattggaaagtctgaaaaagcagagctcacatttaccaaaatctctgcctgttctaattggctaagctaaagagaagacagaggtattttctttgtttgtttgttttctcacatgatcatccagtcatctactcaagagatagtgcctcccatgagccatgcctagagttagatgctgagggcctaagagcaattaaaccaagcaagatctttgccaaccggcaatttctcttttagagaagaggcaacctaaa

SEQ ID NO: 195709 - DNA, 472 bp, Homo sapiens
tcagaatttagcttcttatcatgcatcttctctttttgcttttgctattgatataatattcaggttagtcacttctcaaccccctaacaaggtaaggcagctcacacatgaaaatcttacttacttctaatgccaccaaaaagaatcctatgtcctaaaaaaatgttttaatcaagagagctgtggcagtcaggcatggcggtgcatgcctgtagtctcagctactttagaggctgagccaggaggatcacttgagctcaggagctcgagaccaccctgggcaacatagggagagcctgtctttaaaactctgagagagacagagagacagatacagggagagacagagacagagagagagacagacagagacagactcagctctgtaatatatgccaattacagacaaattactattattgctcaaggatttatcttgagctccttacctgagatacaaaggaaagtataa

SEQ ID NO: 195710 - DNA, 498 bp, Homo sapiens
aagctcatcctttaattaccttgtacgtaacagaagaggttgttagtgtagtgaacacgccagaacaggggtgtggaagccaagtgttctctattccagctatggaaagttcaatggcaggtgtggtccgaagccaaccagaggacgcaggagattggagaagagctctccttccgttcaggctcacggcaaagcacgttgccttctttcttttgcaaaataaccacaggatacttctcagagagatgctacggagatgcttcagccttgaacaccagtgagtcacggtttgtacaactcaagggtgctgccagcccgcctctgctctccctcacggtttttgttttcttggtatgataattagttgttggctccatgaatgtgtctcccaaggaagaaaaatgtgggcacctgttatttctggaatgagtgttctatgcgttctattgaggtgagctattcactcagagtccaagaggcggctggcatatggtcacc

SEQ ID NO: 195711 - DNA, 210 bp, Homo sapiens
gggtgtgggaggggctcagttactcttctcctcacctggcacttagagaaagcaagtctcaagagtctcatggtatgtggttggtggacccaggggcctgtgcccggtctgtgctgtccagctttgggctctgcctggagcaaaaacaagagcttgcctgtgccgtgttgcggtccttacatggtagcgaatctcagagaacacaggagc

SEQ ID NO: 195712 - DNA, 585 bp, Homo sapiens
ggagtcagtgtgtaaaggtgtgcagaagaaggtatcctttagttccagaactgtgaaccatttagtcccctcagatggagtttcactgtgtcaccaggctggagtgcagtggtgaaatctcggttcactgcaacctccacctcccaggttcaagcgattctcctgcctcagcctcctgagtagctgggactacagcttccttgtgtgtccgcaagctcctctgtaagatggctgtcattgaatttacacaacttcctaactggaatagataatcattatcaagggacagtggatgatgggcaacctaacgatccagtgtgttgtgcaacatttcacctcacctgacaatgaaatccaaaaccacttggaatggaaatgacatatatgttaatgaagacagataatgtatgtcagtagacacaaatgaaagaagaaagcctggattataaaagttctccaggttgggcaatagataggcactgctacataggcattgaagaaagcatttggaactatgctccttctggtaaaaatatgctcaatgaaaagcctttttctgaagacctgtaagtaatcctttgcatt

SEQ ID NO: 195713 - DNA, 929 bp, Homo sapiens
  misc_feature (443)..(443): n is a, c, g, or t
  misc_feature (573)..(574): n is a, c, g, or t
  misc_feature (577)..(577): n is a, c, g, or t
  misc_feature (581)..(581): n is a, c, g, or t
  misc_feature (585)..(586): n is a, c, g, or t
  misc_feature (592)..(592): n is a, c, g, or t
  misc_feature (595)..(595): n is a, c, g, or t
  misc_feature (604)..(604): n is a, c, g, or t
  misc_feature (609)..(609): n is a, c, g, or t
  misc_feature (618)..(618): n is a, c, g, or t
  misc_feature (670)..(670): n is a, c, g, or t
  misc_feature (686)..(686): n is a, c, g, or t
  misc_feature (691)..(691): n is a, c, g, or t
  misc_feature (693)..(693): n is a, c, g, or t
  misc_feature (697)..(698): n is a, c, g, or t
  misc_feature (702)..(703): n is a, c, g, or t
  misc_feature (706)..(706): n is a, c, g, or t
  misc_feature (712)..(712): n is a, c, g, or t
  misc_feature (716)..(717): n is a, c, g, or t
  misc_feature (739)..(739): n is a, c, g, or t
  misc_feature (741)..(742): n is a, c, g, or t
  misc_feature (751)..(751): n is a, c, g, or t
  misc_feature (755)..(755): n is a, c, g, or t
  misc_feature (759)..(759): n is a, c, g, or t
  misc_feature (777)..(777): n is a, c, g, or t
  misc_feature (781)..(781): n is a, c, g, or t
  misc_feature (786)..(786): n is a, c, g, or t
  misc_feature (803)..(803): n is a, c, g, or t
  misc_feature (807)..(807): n is a, c, g, or t
  misc_feature (810)..(810): n is a, c, g, or t
  misc_feature (816)..(816): n is a, c, g, or t
  misc_feature (827)..(827): n is a, c, g, or t
  misc_feature (851)..(851): n is a, c, g, or t
  misc_feature (853)..(853): n is a, c, g, or t
  misc_feature (867)..(867): n is a, c, g, or t
  misc_feature (924)..(924): n is a, c, g, or t
gcggcggttagtcctctcccggccgccgtcgcctccgacatattgcccgcaggagctgcggcggcgaagcggagagcaccggggggaggagatgggaggacgaagaggtcccaacaggacatcttactgtcgaaatccgctctgtgagccgggatcctcggggggctctagtggaagccacacttccagtgcatcggtgaccagtgttcgttcccgcaccaggagcagttctggaacaggcctctccagccctcctctggccacccaaactgttgtgcctctacagcactgcaagatccccgagctgccagtccaggccagcattctgtttgagttgcagctcttcttctgccagctcatagcactcttcgtccactacatcaacatctacaagacagtgtggtggtatccaccttcccacccaccctcccacacctccctgnaacttccatctgatcgacttcaacttgctgatggtgaccaccatcgttctgggccgcgcttcattgggtgccatcgtgaaggaggcctctcagagggggaaggtctccctctttcgctccatcctgctgnnccncacncgcnncaccgnacncacggcaanaggcnggagagagngccgaacccacaaccaccgccacaggacccacgccgacccgaacccccagcnccgccgccaaccgacngggangnacannccgnnccngcagcngaanngcgacctccgcaagacaagccncnncaaccacanggcnccanggggccccgggaggcggncagnggccnggcaaagagccgggacnaccnccngacacngcgggagacgnggaagcagcacacaagacagctgnanggcccggacgccangcccacccaaggcccgcagcccgacacacagccccaaccgcagagagggggagcccncaaga

SEQ ID NO: 195714 - DNA, 686 bp, Homo sapiens
  misc_feature (443)..(443): n is a, c, g, or t
  misc_feature (448)..(448): n is a, c, g, or t
  misc_feature (450)..(450): n is a, c, g, or t
  misc_feature (454)..(455): n is a, c, g, or t
  misc_feature (459)..(460): n is a, c, g, or t
  misc_feature (463)..(463): n is a, c, g, or t
  misc_feature (469)..(469): n is a, c, g, or t
  misc_feature (473)..(474): n is a, c, g, or t
  misc_feature (496)..(496): n is a, c, g, or t
  misc_feature (498)..(499): n is a, c, g, or t
  misc_feature (508)..(508): n is a, c, g, or t
  misc_feature (512)..(512): n is a, c, g, or t
  misc_feature (516)..(516): n is a, c, g, or t
  misc_feature (534)..(534): n is a, c, g, or t
  misc_feature (538)..(538): n is a, c, g, or t
  misc_feature (543)..(543): n is a, c, g, or t
  misc_feature (560)..(560): n is a, c, g, or t
  misc_feature (564)..(564): n is a, c, g, or t
  misc_feature (567)..(567): n is a, c, g, or t
  misc_feature (573)..(573): n is a, c, g, or t
  misc_feature (584)..(584): n is a, c, g, or t
  misc_feature (608)..(608): n is a, c, g, or t
  misc_feature (610)..(610): n is a, c, g, or t
  misc_feature (624)..(624): n is a, c, g, or t
  misc_feature (681)..(681): n is a, c, g, or t
gcggcggttagtcctctcccggccgccgtcgcctccgacatattgcccgcaggagctgcggcggcgaagcggagagcaccggggggaggagatgggaggacgaagaggtcccaacaggacatcttactgtcgaaatccgctctgtgagccgggatcctcggggggctctagtggaagccacacttccagtgcatcggtgaccagtgttcgttcccgcaccaggagcagttctggaacaggcctctccagccctcctctggccacccaaactgttgtgcctctacagcactgcaagatccccgagctgccagtccaggccagcattctgtttgagttgcagctcttcttctgccagctcatagcactcttcgtccactacatcaacatctacaagacagtgtggtggtatccaccttcccacccaccctcccacacctccctgngggangnacannccgnnccngcagcngaanngcgacctccgcaagacaagccncnncaaccacanggcnccanggggccccgggaggcggncagnggccnggcaaagagccgggacnaccnccngacacngcgggagacgnggaagcagcacacaagacagctgnanggcccggacgccangcccacccaaggcccgcagcccgacacacagccccaaccgcagagagggggagcccncaaga

SEQ ID NO: 195715 - DNA, 676 bp, Homo sapiens
  misc_feature (443)..(443): n is a, c, g, or t
  misc_feature (573)..(574): n is a, c, g, or t
  misc_feature (577)..(577): n is a, c, g, or t
  misc_feature (581)..(581): n is a, c, g, or t
  misc_feature (585)..(586): n is a, c, g, or t
  misc_feature (592)..(592): n is a, c, g, or t
  misc_feature (595)..(595): n is a, c, g, or t
  misc_feature (604)..(604): n is a, c, g, or t
  misc_feature (609)..(609): n is a, c, g, or t
gcggcggttagtcctctcccggccgccgtcgcctccgacatattgcccgcaggagctgcggcggcgaagcggagagcaccggggggaggagatgggaggacgaagaggtcccaacaggacatcttactgtcgaaatccgctctgtgagccgggatcctcggggggctctagtggaagccacacttccagtgcatcggtgaccagtgttcgttcccgcaccaggagcagttctggaacaggcctctccagccctcctctggccacccaaactgttgtgcctctacagcactgcaagatccccgagctgccagtccaggccagcattctgtttgagttgcagctcttcttctgccagctcatagcactcttcgtccactacatcaacatctacaagacagtgtggtggtatccaccttcccacccaccctcccacacctccctgnaacttccatctgatcgacttcaacttgctgatggtgaccaccatcgttctgggccgcgcttcattgggtgccatcgtgaaggaggcctctcagagggggaaggtctccctctttcgctccatcctgctgnnccncacncgcnncaccgnacncacggcaanaggcnggagtctgtgccagatccctcatgcacctcttcaggacctacgtccttcctgaacctcctgttcctc

SEQ ID NO: 195716 - DNA, 657 bp, Homo sapiens
tgctgtgctttgaggtataccactgaagacaggagtgatctctgccctcatttataatcagcaaggaaggtcagtcattgaacagatattggaagtatgttgaatgttacgaaaaagatgtcaagtatattctggaagcatttggcaagaggatttaagtcaatgaagtcaaggcacttaactgaagaagttaatgcttaagccaaaagctgtgccgtttgcttatgctggagcaatagtatgtgcagaggcataaagagaaagacattaagggaatttaaaaaattccagtatagcaagggtgttgggaatgaggtaaggtgagaactgaaagatagaagccagattatggaaggtcttggaagctattttcaactttattctaaggacagtgagaatccactgaaaggcttaaaatgatggtgacctaatctgattagcattttatgaagaccaggttgactgtaatgtgtgtggactattatcagagaggagcaagaatgaatgtagggaaaccctaatgaattaatggacttatcaattatatatagtggtcatacttacagcatgttaactgaagggaaacaaaatattatatgactcctgatggaagtatccaatactgcctttgaagttgtcttacccaaaaaaaaaaaa

SEQ ID NO: 195717 - DNA, 184 bp, Homo sapiens
actgcaatttctatccttgtatattttgttgaaaccactaagtattacagaaagtaaaatgctttgaaaactcatctggggccaggtggttttaggaaagcagatactaaaacaaaactaatttgaaatctgtcttggttttttttttttggagggggtgggccgatacgggggaccctctaga

SEQ ID NO: 195718 - DNA, 469 bp, Homo sapiens
gctgaagagtgcagaccccagagggagcagaataacagtgggaggagggtgttgcgaggggacctcaggagggtaacttagcagcagagcaaggagttcagggtgacctccggcctgggcggttaggaggccactggtggccctgctgctggcttggaagggcaggccttggccagcctaggttgaggaatatatgggagggaaaagaccaggggcttgggcagggtgactccaggaaggaggcagttgaaggtgaggttcctggggggagaatgatcccgggtcatccagcaggaagagagaggacctagaaggtgtgaaaaagaactatcgggctgggggtgcagtgggaggagtatgcccggggtgctgtgggggtggggagcgcctgtgagggttggcaagaggaaggggaaccggggcctggcagaggggagccccagactgtctcaaggctgggaactgaagg

SEQ ID NO: 195719 - DNA, 305 bp, Homo sapiens
tatgttaaattgaattctttcagtctgcaatcttcatttgtttcttgctttagagggtatcaaaagaagggaaaaaagaaaaacagaaggaatggtctagtgttctataatctcagtattggtacacaaatattcttgtatcttatctcccaggcaatatggggatcccttttgtagggtccagtgtctgcatgattagagataactcggtactgcccaaagtaacccttttctttgttagacatttcttatttaaaagcacttattagaatatcttttcgtaattctgaaaggatatttgaaaa

SEQ ID NO: 195720 - DNA, 351 bp, Homo sapiens
gtctaacatagagctgctccaatctctaagagaactggatgacttggatacataaaaggagagctcttgcagtcctattcctactcttgactcaagtaaatattttgatggaggtgagctaagaatttccttttacctgaaatattttaagtattttggcactaaaaaataaaaaaagtattttggcactaacaaatctgtaagggagcataaaagaaatattaagaattgtacggctgggcgtgctggctcacgcctgtaatcccagcactttgggaggccaaggcgggtggatcacgaggtcaggcgatcgagaccatcctggctaacaaggtgaaaccccgtctctac

SEQ ID NO: 195721 - DNA, 239 bp, Homo sapiens
aatctacctccatcagaatctatatatgaagacattccagcatcctgctgacagaatcatatagtactcttttacctttttttttttttaagagacagagtctcgctctgtcgcccaggctggagtgcagtggtgcaatctcggctcactgcaacctctgcctcccaggttcaagagattctcctgtctcagcctctcaagtagctgggattacaggcatgtgcaactctatgcccagc

SEQ ID NO: 195722 - DNA, 556 bp, Homo sapiens
tggcataagcaacactccatttgtctcggccgtgctaatacacgtgcagggagataatccatcagttgctaataagcacagattcagacgccaacactctacactttctgaacatctatattctatcaagtagggagtatttccaaaagatgtatctgtacagagtttatctaatagactggaatggctcttatttctgttctgccaaataaagagaaatttcttggactgcaaatgtgattgcttgaactcccaaactgcaatttttctaggcatttcttcttcatgcttcctggcaggccaatctaccatcaaattcttcaggtttaccaaagccttaacaacagccccaatttacaaagtacccatgacttggtcagcattcaaggcaaaaagttaaaacatacacaaaaataacagtagattttgaaaacaggcaaggatttgaaaacgaccattatctctagggcaatactaaaatatagcctcaacttataaatgtgtagaaagtagtgatatttggaaggtacattaaaatgagtaagtaagggaacaa

SEQ ID NO: 195723 - DNA, 381 bp, Homo sapiens
tcctcagactctgatttctttactggttgtaactggaaagtgacctgaaagttagcagtgggaaaccaggatctgtgttgattgattcagtagacttaattttacacaaaatgtttagtaaatagtcttggagggtaggagatgttgactctcctcaccagagaagttcagctgggcttttggacagcaggatatttctgctaccctgagatttgtggctatatcctaaagggttgagattattcttaagaaggatcccctgataagcagagttttttttttatattgtagtattctaagtttattacccaaataaatatttccttgagatttcaaattgaaatagttgtatttttttattagtgacccatgttcttttaa

SEQ ID NO: 195724 - DNA, 513 bp, Homo sapiens
tctctattacccaaatgcaatttgatatagagtacagggacttacacggctgaattcaaatgaaaagagggtcactaaaggaagaaaaagggtggcagctcaaagcatggtaaaggaagtcacattttcattacttagactgacatcatactatacattactttatttttaaaggaacagactttgcttgttcttgtagtagacattcccccaaagtctcataattctgagttgtgtgtataggattcagtttaccattctttttcccaacgttgtcctagtgatttttctctttcagttctatcactccatagactttaatttttgtcaggtctggatctcaaaattgcaataaaagctgatttaaaagattgtcagtaggcaaaggataaattcttgagatgatgggtaccctatttatcctggtgtggttattgtgcattgcatgcctgtatgaaaatatctcatataacccacagatgtatacatctagtatgtacccacaaaaataaa

SEQ ID NO: 195725 - DNA, 596 bp, Homo sapiens
gtgcagaccagtgtgttactcacatgtttatgagtaatgcattgatgaatggtgatgctggtgtacacatcactgtcggctctgccagtcctataaaaaactacagataaaacataaactatgtacagtatgtaatgcttgataataataaattgactgtgttactggtttctgtatttaatatactatactttttattgttaggttagagtgtattccttctagcttacgtgaaaagttaactgtaaaggcagcctcaggcaggtccttcaggaggtacctaggagaaggtcttgttatcataggagatgacagttctatgcatgttattgccccaaagaccttccagtaggaagagatgtggagggagaagacagtgatactgatgatcctggccctgtggaggcctatgctaatgtgtgtgtgtcttagcttttaacaaagaagtttaaagagtaagccgggtggtggctcacaccggtaatcgcagtacctgggtgacagagtgagaccttggctcaacaaaaaagcaaaaacctgccttttcttcaaagcacaaggaagagtgcttgaatcttagaatggcttttaatgat

SEQ ID NO: 195726 - DNA, 339 bp, Homo sapiens
tggtttgcagcttacggcatttctgagttaccggcttcttcagcaccaagtctaggatatatgaggcaaaaggaaaatccagggaacttaccactaattcatttttcaaatcaaggcccctaacctttctaccttcttctctccatcttttgcagtcttaagttttaatatatataacatacagggattttagttgtacttagtaggggaataggaaaaaaatttgtttactgcattttcccagaagtgcaagtacaagttttatgcaccttttaaacatgatcagatttatgttaaaaggaccactctggtttctcttatggagaattgaccatgaag

SEQ ID NO: 195727 - DNA, 343 bp, Homo sapiens
ggagataggcagacgatctacaactctatctgagtatgtacctttctatagacactttccgtaaacggaggattaacatcagagcagggttggaaaattatgtcaactctatctggtgaactccttctgggattacctcactctcttctgccaatttttatttcttattacttatgattataccatgaatctaattatttaatttgtcaatttgacacaatttgttcttaaataaaataaataatacataagcgcagctgactttgaaatacttactttctaaaggcaatgcatgaaacagtatcagaactggttttgaaaatgaagttttagaatagttttc

SEQ ID NO: 195728 - DNA, 247 bp, Homo sapiens
tcaaactactcatgttttaccaaaagaaaggtagaaaaggcattgtaaagttttccctatttctatgtgtggtaacatagagactaaatacttctttcagtctccagcagcaaaaatagcaacctattaagatcagcacccacactggttagctctggtgaggagaacttgtactaatgaggccctggtcagggatttaatgcccatgggatccaattagcttcacacaggatgagactctgagccc

SEQ ID NO: 195729 - DNA, 865 bp, Homo sapiens
tcagctcactgcaagctccgcctcctgggttcacgccattctcctgcctcagcctcccgagtagctgggactacaggtgccgaccaccacgcccggctaattttttgtattgttagtagagacggggtgtcaccttgtcagccaggatggtctcgatctcctgacctcatgatccatccacctcggcctcccaaagtcctgggattacaggcgtgagccaccgcgtctggccttgtgtacttttaacttagatacatttactttttatccactcagctgaaaaaagaggagaaaaataaaagtaggtcaggtcaatctgtttcctttcccatttaatgaattcatgcccaggagtgagtgagaaatgggaggactgaatctgctgttctccaagactagcttaggagtttctgacatcatgggcatcccagcaagccaacggtcacattagtcaccacgtatttttcatatcacgtgatccctctatcagtgtatcagcctttgctgtataatgaacaatcctaaacatcaatggcttaaaacaaaatcacttattagcacataatttggtaggttcatattttgggctggccgcaggtaggttttgcagatttcacctggtcttgtcattttgctgcagtcggctggcattttgaccagggctggaggactatccatgtgtgacaggaagctggttggctggggtgcctagtttcttcttggttctcttccatgtgggcttgggcttggtcaaatggtcttgggtttctctatgcaggaagagaggacagccccaattaacaagtagttttaacgttttggcttttgtcatgtcctgtagaggctaggacgggatcctctagat

SEQ ID NO: 195730 - DNA, 637 bp, Homo sapiens
aattttagggagacataaacattcagtccattgcagtttctaacttcaagcagggttcaatgtgtttaaattgagttgatttaaacttgatcctatctgaggaggtgacatttaagcaaagatacctatgaaacagtcagttatatgaacacattgcagaagacagtgacaagcagaaggaacagcaagtacaaagaacctgaagtcagaaattgctttattgtatgtgaggaacagccaggagatcaaatgactggagctaagtggacaagaagaagactggtaggaggtatatttgaagaggaagccaggggtcagatcgtgtagtgccactgctacgcactttaaataatcctcaagaacacataaccaacagctcataatgcttcacaagacaaaggacgcgtgattaaactgttagaaattaaaattatttattgaatgactatcgcatgccaggcactggatagaaccttaagcatatcatctcatctaatcctcacgctaattctacaagacatatattatcctaattttaccttgagagaaatggaaaaacagaaatattaagtaacatgcttcacacaataggtggcagagacaagatatgacccaggtttctgatttcaaagtctag

SEQ ID NO: 195731 - DNA, 409 bp, Homo sapiens
gagtacttggaatattttaaacactgtgccattagcaatttggaattctgtgttatgcagttcataaggttctagcttgacttttttctctctccattaaccctgtctctcacagatgcaaaccactcttaatggctttactttcacatcaatgtgagtgattcctaaatatgatttatttcccttctcaattccatacccacagatgcttattatttatttatgtgtacctttcttatccccatactctccctgtttgcgatacaactagctcaaaacctcagtcatttttaccttgtctctctctctccagtccaactcacccaactagtttttctcatttgttacttcatttttgtcctggttcttctaccagatttattagcaactgcctggactattaataaag

SEQ ID NO: 195732 - DNA, 496 bp, Homo sapiens
gctgagtgacaagaaaaggatgtgtgtacatgagacagagggcgctgtttatgcccatctgtacagaatgtcattcgttttaaatatgattttcctctttttcctcacagaaagagaaaatggtatatttctccttctatgcaacagagaactgattttttttaaaattcttattactgtttttttttgaagtataatagaaacaaagcagtgtttttctttgttaaggtcagttcatgttttagtaatgtgtcttgagctttctgtattttctgagctaaccatttaaaaaattttgacttctacaccaattattttatgtgtgattgtttaaattctatgggtcttgttgatgaccttcctatatttattgtcattgaaaacattcaatatgtaaatataataaacgattatatctttaagaaaataaaagttttctaaaattaaatgtgaattatcattaaagcataaaatgctgtgactataaggtaacatt

SEQ ID NO: 195733 - DNA, 407 bp, Homo sapiens
taggccccatttgagtcatccccacaaaccttagagggacacttccttgaccagggacagatgagaccagtgagcaaagcgggagggggtgttctgtataaaccaaggccagaggagaggcaatggaaggggaagaaggttctgggaggcagccccatggttccccccaggtaaccccccgtttcagtctaatggagacagaaccccacacagacgatgatcaggctggaagcccaccccagcctggggtcagggaaggcttccctcggaaaatgacaactgagctgtgactgaaggatgaatgggagtccttagaaatggaatggatgcagggatattccagacagcatcaacaaagatcctgggttcagggaaagcttcctagaggtggcgacacatttgggcaa

SEQ ID NO: 195734 - DNA, 526 bp, Homo sapiens
aacatgtttgagaactattaatacagcagagtgcttcctgactataatagataattaaggatgggtaaatttaaacaagttttaaatttactgaggacctttcaatttgttaggttagaacagaagccttttttctaatccgagtgcccatattttttttccatctaagaccgtatttgaggaattagatgatgcatttagttttggacatgttttttacacactgacttcaaggggcactgatgtagacttgtcttatagtttagtgactggatttggagctcagaagctgaacctagagatggagataatttttttttcttctcagctttatgaagagaagggaaactgtctaggattcagctgaaccaccaggaacctggcaacatcacgatttaagctaaggttgggaggctaacgagtctacctccctctttgtaaatcaaagaattgtttaaaatgggattgtcaatcctttaaataaagatgacttggtttcaagccaaatgtgatcgtggggttgtaa

SEQ ID NO: 195735 - DNA, 564 bp, Homo sapiens
ggtccgtgtttttctccggatcgttgggcatgcggaggcagaaggagagcctggcagagtgaatgacaaacgcaagggaggctgcagaggggagggagtgagggcggcccagggcccagcccggcgggagccgaggaagagaaggaccagccagccaagggcgggcggctccagaggaggcccgggactccccagtttcccagcctcttccaccccacgcggatccctgccccgacgctgattcagggggtcaaagcctcgggcggggcggaccgcggcggtgactggaggcgccccagtttctctgggtgtggcctgcggaccccctcgggagcaggtcgtcccgcaccagtgtctgcccccggcccccagggacacctgcacccgccccactcacgacggcgcgtcaggtccccaaccaggcgtggggcggggtgggaaggtctcggttcggccgccccgcctgtgctgtccccaccgccccccggcctcgggcagcgcgctcccgggtcacccacctcccgcgggcacgcgcagggcggcccctccgggcgctgcggccgc

SEQ ID NO: 195736 - DNA, 467 bp, Homo sapiens
aagagggagtgatgaacagtacgaggcacttagcacgcatgggctgtgtctaggcggtggcccccttgaggactcatgacccatggaaaatggctgtgcatctactgtgtgccagcacagtgctgtgcctacatgttcttacctaattgtcattgcaacggagatatgtgttgggctcattttgctgatgaggctcagaggggtgatatgacttgcctaaggccacacagctattgaatagcagagttaggattcaaacccacataggcctacagccaaaatcccaccttcccacctcaccaggccacctgccaatctaatggaggaagcagagtcatttacatacattatttacatatggaaagtgccataacagaggcagtcatttatctgtctagtcaacagatgtttattgagtgcctacgacgtgcaaggcgcagtgctgggagttatgggaacacagagca

SEQ ID NO: 195737 - DNA, 234 bp, Homo sapiens
gtgcatggctgtggctgtgagtataaaatctttttaagatctcagaaaggcctgatgtggcaccccagagagctgttcagacagtaaggcttctaagaagcacagcgtattgtcccttggcagtctgagcagaagctcacagtggagaacttacctcagagatttgtgggtgtggcttttgtgagtgaactgcaataagactcaggtgacgcattcaaaataatgttcccagta

SEQ ID NO: 195738 - DNA, 167 bp, Homo sapiens
ttcataatatgtagattgtgataggaggggtagatcccactcagcagagggctgagaaaaatgagtcttaacagttttagaagttgagggcgtgattatagaaaataaaagaagaataacaagtaatgaaaggacaagtgattttttaaaaaattaccttctgaaat

SEQ ID NO: 195739 - DNA, 573 bp, Homo sapiens
ctgtgggttcatgctgtgggacacctgaaggctgatttgaagcagaatatagaactgcggcacgggagaccagggctgggaatgggaccgacattcccatgctaagtcgaggagcgcccatcacctgcagcgagcttgtaacatgcaagtgtcctgcacaagaccagtccagtcagctgtgggccctcaaaagctcagagtctggcggcgggacatgctgcagagctgctgctagctcaggcaggtgggaaaattcaaagcaagacagacagaagcccgggaaagacgtccagtggcgtccagtgcctaggcaggccctgggtggtggagttggtacagggaaactgggcgtgcaggtctggagttagggcaaggacagagggtacaatagagacagaacaagaggtggtggcttggggagagtgatggaagctttgatttatgtgggagcagataacattcaggacagattgaggaactggaaggcatctggcagtttgggttttattaggcagtgaggaaccattttgaacagaggacaagaatatttagggggtgaccaagcttcctaaa

SEQ ID NO: 195740 - DNA, 217 bp, Homo sapiens
gccatcttggctcctcaagaaaattttaataatcttttcatcctgtcctctctccagcctctcctctactaccaaggtaccttttattaacatcttcttatgcatcttttcacacatttccccatactcatatgtacttatacaaacataaatatttttagtttttagtttttttatttttataattttggaatcaaataatatatatattttccat

SEQ ID NO: 195741 - DNA, 235 bp, Homo sapiens
ctctcttcgacatgagcacctggcttcagtcctcagtcatgtttcttctagtcccacttctactctaagcagcatatgctatggcatatactaagtactgtggtgagggtttgctcattcagccatgctaggatacctccagggactgacacaaggaaggaattcagagcctcagacttgggaaggaatttcacaggaaatggccttgctgtgcccagaattctctgacaactgt

SEQ ID NO: 195742 - DNA, 499 bp, Homo sapiens
gaggacctagtgtggaagtagcaagttcccagaatattgaaagaattcataaagaaacagtcatacacacttacaaagggctttctgcttgtgtggaagattatactgaatgagatgtacgatccccttaaatgctaaaaaaaacttattgaatacatatcaagatgtaccatatgcctggcacttaatgaatattttccttcagtgacaataaacatggttcaaaacaatattcattccagtcggccgcagcactggccctgcctggtgtttgcaaatcaagctgtgtctttggttagctgcatcacccaataaatatttgggaatcaagcttgagctggcaattttcttgataatgcataaggcaaaatagggcacaccctgcatttccacagctgtactggcattgccgcatttaatagttaaaataaaaaaataaaaacaagcaaaaaacaaaacttttgttcctcatgtaggccgttgagatctgggcagcatg

SEQ ID NO: 195743 - DNA, 603 bp, Homo sapiens
gactgtgtctcaaaaaatagaatttttggactagtggaactacacagcctgctttccatatcagaccattcaatccaatgggattcactgccataatctccatgttatgattttaagccaggcctctcttcacctttcctattccttacatttaaagactccaaagcttgtttactgagcacagatcttggaaaacaggatcttcagacttgggaaagcatgacagtagatgatggaaaggtaaagactcagactagcatctagtagtctcgctacacatggatagtaatgctacgtgcatgaatgtgcaatcatgcaaaaactcaaatcagccttctgcacacacacaatggtagactaagaccttctgttaaaggtccaagcactccaaggaagccagcgccttgaggtaccctcagtatgtgcaagtagttcgatgttactcttagttttcccagcaactctgctctagcatgccctaagtttagccagcagcagatcttactgaattataagatgttgccagaggttcagaaccttggtttttttgagatacgcatttgcattgacccaaaatggagaattaaatgactgtatttttca

SEQ ID NO: 195744 - DNA, 307 bp, Homo sapiens
tagaagcacatatgtatagaagtgaaggaagtaaaatcaaattggaaaggcatgttgattcatggttctgaattctaaagataatagggagtcactgaatctttacctgacaagagttgtgctttggtagaacatatgtaagatgagaaaatagaattgattgaagttgggaaacaccatcaacacagtgagtcattcagcaaaggctttgcttacagtaagagaaaaattatttttgtttttgcttgaacatagtcaatgggagagtaacatgtgacacatcactgatcttccagtgtggagagag

SEQ ID NO: 195745 - DNA, 569 bp, Homo sapiens
acctcagcctcccaaagtcctagaattacaggcatgaaccactgcacccggccacatttctacttttgtggagagtatattcaagtctcttgttatttttctatctttttttaaaaatcaatttgtaggaggccagtatatattcaaaatatatgctctttgttagttgtatatgttgtaaataccttttcattttcttaaagctttttaaaagaaattacaattcttaattctagtgaaatccagtatatttttttgtttatgttttaagaaatatattttatatcctgtttaagaaatctttctctgtcccaaggttatgaagatattcttctgcattatcttttagaaccttttctttggtttaaccttgtatattcagatctgcaacctctctgacatttaaaacaacattgtttaatttgacactaattaaaatattagacctaccaaaaaaaaagttgcaagaatagtacaaagatgtccaggtttttttcacccagagtctgcaactgtttatttaatgtattttacaagcttctacatagagcactgatccaaacattaat

SEQ ID NO: 195746 - DNA, 424 bp, Homo sapiens
ctgtatggagggctctacagataccgtctcatttcatgtatttaatttcattaagtgggattcagagcatgccagggcatcgccagacacctgggcttttttcctcaggagttgatcttggtcccagaagaaattacattcatttgattgatagtatttaaacaagcagcagctggccatggtggctcacacctgtaatcccagcactcctgaggtcaggagttcaagaccagccaggccaacatggtgaaaccccatctctacaaaaattagctgggcatggtggtaggtgcctgtaatcccacctactggagagaggctgaggcaggagaatcgtttgaacctgggaggcagaggttgcagtgagccgaggttgcgccactgcacttcagcctgggtgacagagcaagactccatctcccca

SEQ ID NO: 195747 - DNA, 321 bp, Homo sapiens
accctttgaaatcatgatgaaatcatgaaataaccagatgcttatttcatctggtcctaaggcctactccaatctttagtatggccctgactattctgtagtacacaaatggtggttaaatgttatcccctattcctgtgttacaattaaaataaagagaaaaaaatttgaagagaattattttaacaatagagggaagacttccagctttggttccacttgtaagaagcttggaagtggccactccaacctaacaacaagtaaaaagctaagcaaactgcaaaaccaacaatacttcttagattcttaagagaagtgagg

SEQ ID NO: 195748 - DNA, 509 bp, Homo sapiens
gtggttaacgtaatttcttcttctgggacttaaaagaaatgttcaaattaaccactatttaggtttgatcatgcctttggaaggaattggtattatcctttgaaaatgaaaaggcataatttgttgaaggtacatagaattgtacaaaaagaaatcagtaattttcccatttttactattaagttatatcataagcagctattttgaatgacagtatgaaaaagtatgtttgtgttttaaggaggctgtttttgaattaggaaagataaatacgctggtatgaagatcagctcattcaggagcaggcattttcctgcatactaaggagctttaaaggttagacagtaaaaagaaggtgatcattatgtagtctgctccacctcatgcctaccagaaaatttatttcccagcctccctaacttttctacttcaatatacagctaactgttaatgagccctaactctgacctgggtatgtgccaaatatttcacatacatcctgtcattta

SEQ ID NO: 195749 - DNA, 234 bp, Homo sapiens
ccttcacttcttcattagagttattgatagtggagagagaaggttaaaattaaatcatcctgctgcttggtaataatttgatagagtagagacccagacttatcatcaataataagatttgggcatattttctgaagtttaattatctgacccttatgcgcctgggtaaatgaaatttagctgttctgtgaaagggggcccaaagctcattcacatttattttatgcctactag

SEQ ID NO: 195750 - DNA, 479 bp, Homo sapiens
gatacctagccagaagaattactcttaacgctgttaacatttgtagggatatggttctcttgcaaataattgcaattattattatgctattaataacttccattaattgaaagtgtgcttctttcttggccatttgcctgattattttatgtaatgctcatgatactcccattgagggtaggtattaccctatcccattttataggtagggaaacagactctgaaagcttaagtcactttgattacattgcctataagtgagtcaagcatttctctttcacatacaagccagaaggattggaaaaccaagaaaggcttaatgtatcactgcaggaccattgattactctgttttcagctttgttttctttccctctctacagaactcttgggaggaaagtggcacaccactgagtgatggcattagtgccaagttttactgccctttctgatgaagcaaacaatcatcactaaatttct

SEQ ID NO: 195751 - DNA, 443 bp, Homo sapiens
agtgaatcgtgtattaccatcatcgtcaggtattcgtaatctcaatgataataagtaacacccatgccaccactgtgtgccagccactattctaagtgctttacttgtgtccattgggtcatttaagccctcatgatgcccttgtgtagtgggaacacctagaagagcgcagtgattcctgcacatgcgggaggcaggcttggggagcaggggtgccctcgccacccagccttccgcatgtgaggccctccgcactgtacacggttcagaacccacccagtcgcatgatgtcatatatcacatgggtattatgtttacatttgttacacacattcttatattgtataattatatattttacatttattatgcatttcttagtttcttatatacaatgtttctacatgtgtgtaaattacttaggtttataattatctgttact

SEQ ID NO: 195752 - DNA, 276 bp, Homo sapiens
gtgcctgctagaggggtgggcccaggaagaaatggaaaagtcacttcatgtttgctattagtgggattacagccctgctataaagggggtggcttttgaggccatcatgactaatcgtttccaactatgtttgtctatggaggaaggcaatgttaattatggtgttttaatgcttcattctactatgggttattttatatctgatttcttgactcttagtaaaaataataagcaaggaagaaatcaactttttctgatgtaagctctgacaatact

SEQ ID NO: 195753 - DNA, 725 bp, Homo sapiens
ctcttcataaccatgtggcacttgattctgtttccttcttccttgagagtgttgaatacagattctaggaaatctgaaactctgaagcctattttcaaagtctactctttgtttttcctttttcttgatttttttttttttcttttgagacagggtctcactctgtctcccaggctgggagtgcagtgacatgatctcagctcattacagcctcgacctcccaggctcaagtgatcctcccacctcagcctcccacatagctgggaccacaggcacacacaaccacgccgtggctaatttttggtattttttggtagagatagggtttcgacatgttgcccaggttggtctcaaactcccgagctcaggcaatcctcccgcctcccaaagtgctgggattacaggcatgagccactgctcctggcctaaagcctactcttaaaacagttttggacctggtctttttacattctggatgtcagcctcaggcccccacagaaaccatgttttctatcagtgaacggtaaaggtcatcagtgcttttcaccagttttttactaaggcaagtctggtcttgcagcatcctagatcctagattttacaaatccttaggccactggtaatgtgctctggaaatttctgcccccctctgcctctttaacttcatcctggttgatctctcctgcctttctcctgcattgtcatcacttcctacagaaacaaga

SEQ ID NO: 195754 - DNA, 879 bp, Homo sapiens
atccactgaagttactctcatgccctggtgaagtatctctgtgcctattatttgagaatgctagagagacttcttttctccaaacatttgataaaattaataatacaggttattaatgaagaatcagaaactacaaaaaggtggcaacaaatagacggccatgccatggcctcatatccaaaatgcaacggtgctaaacagaaaacacatgtctttccagccttgctttattgtgtagcagtttatgattttgtttttttgtgcctgtaaaaaattgtagccagactgcatatacaattttacattctttttttctctcattacatggcttaaaaaatcacttccctgtctttttacacagttttcagttaatgtcatataatcaagctgttgtaccacaacttatttgagcaatcctctaccattggtcatttacattgttttcaactgagcacgcttcttttttaaaaaaaaatttttaaatttttgtacaaatggggggtctcactatgttgcccaggctggtctcgaactcctggcctcaagcaatcctcccacctcggcctcccaaaatgctgggattataggcatgagacactgtgcctgtggctttcactgctctgaacatctctgagcatagaactattccttcatgtagtattgcttgcattagctaaatttctagagttgggattttttttttgatggggtgctgtattagtccattttcacactactataaagatactacctgagactgggtaattcataaacaaaagaggcttaattgactcacagttccacatggctgggaggcctcaggaaatttacaatcatggcagaaagtgaaggggaagcaggcaccttcttcacaaggtg

SEQ ID NO: 195755 - DNA, 474 bp, Homo sapiens
aactcaacttgtgctcaggtgtctcttccaccctcagatgattcatcgaaagctgactgaattcccagtgacaggagtagactgcccttcatcttagccagatatcacaaggctattcctgagtgactaaggaaagacttatgtcccatgatgtggtaaggccctatggacataaaacataaaatacctctccagagaaaaatatagaatcagaaattatgattttatagaaaattcatatttttaatcagtagattccttggataactaaattcattggactaagtattatttcccaaatcaaatgtcattatgttgtacattctgtttgttaaacatctgacacctaagcatatgacatcctttctttgtgctataaattttatttttgcctattgtgagtatatattactctttatactgaatttttaaaaaaattaataaaacaatttataaatatggcaaaaaaaaaaa

SEQ ID NO: 195756 - DNA, 262 bp, Homo sapiens
acattcgttttgaaggacatgggggcatcagcagcttggggagaggactgtactgcttagaatgaatcccacagcagcacaaggaaccagactgagacaagtgtaagaataagaattaattctcccctaagccacgagggggccagtggtagaaaggccctcagagctggttggttcagaggtgaatcaaattcctaggttacttccagccctctgctcggctgtcgacgcggccgcgaatttagtagtagtaggcggccgc

SEQ ID NO: 195757 - DNA, 500 bp, Homo sapiens
atggtatcattagtcttaagtattgtggtacttcagttctgtaagagttgtaagattaccaattcatcagtgttttttgttgcttagtttggtggcatgtaaatgacagcaacaaaaaagccagtcatgaaggagatttgatttgatttctacaacttttcacggtttctctttagttttatctgaaatacatttgtaagcttagggtgcaatttggattaaaacagttttctttagtgtcaataatggcctttactagagtgaatggatatttttccattctggattatcgtttaatcgaaactttgtttcctgtggaaatttttctggtttaagttatttgatttgggagataaatcatgtaacttaataaactttggcatcctggttaactgaaattgcttcattcaatatttgaagactgaaatctgtattgttgcctgtacctaaattatgggagaaggaaaggaccgtgtacagggtaggtctccaaagatatg

SEQ ID NO: 195758 - DNA, 649 bp, Homo sapiens
agggctccccttgcctcctctccccctacccctctccagcgaagggctcaggagtccagctccacctgcagcctctccctgctccggcacagcatcctctgaccttgggcgaggccctgagcctcagatgtttttgagttcccacatctggagcaggaggataatgattcctgctgcctcccagggttgctgggaggatgaagtgagtctgctgtgtgatgctcagaacagggccactgtcattatgccattctggttactagtactcttattaccattacacttattagagaggcaggatccgtgcttggatttagtagttaggattcacagggtgagtgatccataattctttgccattacgatgaggtcacatttcctttggtaaaatgttgaacacctttgtattatggaaatgttcacacatacccagaagaatagtctcgcgccctcctggggtccctgtcagcagctcagcaggtagcagctgtggccaggccttgtcgcctgtgcctgctcctcacctccctgcttatttcagagcaaatcccaaacgtcgtacagccagaaatattccacacttttccagaacaagcctgcctcagtctcctcatgcttccccagttgtcttataatccttttttttttt

SEQ ID NO: 195759 - DNA, 178 bp, Homo sapiens
ttgtattcgcaggaaccatggcactggcaagtggggctctgccagactggtgtgaacaattaaccagcaaatgtcttagtgctataaggcattcatgcatgcatgcattcattcattcgttcatttttttttttgagacagagtctcactctgttgcccaggctggtgtgcagtggta

SEQ ID NO: 195760 - DNA, 841 bp, Homo sapiens
cgtaaagctggttcacctggttctatctgtatatgatgaagtagcttgtattttatagaataactataaaatctagtaaaaattaagcaacataagcaatcaccacaactgtttaagggcaatgggcagtaaccaagcctgtcaggatttgtggggccataggataaacacaaagaaaaccacatttaagaacatgagagtaaaatggctgaaaaccaactacaaagagaaaatcctaaaagccaccagtgaaaagttatacattattttctaaggagcaaaaaaatactgatggctgggtgtggtggcttatgtctataagcactttgggaggacattgggggaggatcgtttgaggccaggaatttgagaccagcctgggcaacatggcaagaccctgtccctacaaaaaatttaaaaataagccaggtgtgatggcacatgactgtagtcccagctactcaggaagacaggaggatcacttgagcccaggagttcaaggccacagtgagctgtgatcacgctgctgcactccagccagtgtgacagagtgagatcccatctctaaataataatgatgataataataataaatatttgtagctttctttacaaaagatgtttacaaaattatcattggaggagcctagcttagttcatgagtcaatagtttattggttattactgttcaggagttacagtgctggtgaaatgcactgtctttcagaatgctgtggtccatctctgatgaatgccagagataatggaataacattgaatactaaacttttttaaaaggctgtgaacattgtattctatattaaagtatgttttaaaaatg

SEQ ID NO: 195761 - DNA, 397 bp, Homo sapiens
catccaacaagctgactccgtttggcaggcttcttcatctatctgtcagcaagatttgctaagcaagaaaacagaatatgaccacgatttcactcatggaggtatgtatggtacagggtttcactgatttgtgtactgatcaactactaaaggcagggataccatcttaactgggaataccccagaaaaatcagccacatgtctatgatttttacagagactgggagaatattcaggctaggggtggtggtgatcctggcactcagccatattcttggagacccctctctccttccaacaggatgggatctgactaccagccttgggcaagcctctcacatactctagggaagggacagatgagcttcctttctagacccaaggaatgactgaccaa

SEQ ID NO: 195762 - DNA, 683 bp, Homo sapiens
gatctgtcgatctcagcctcccaaagtgctgggatgacaggcatggttgcattactgaaattttatatgaaaaaaagaatgtttcttaattgctcttaggggaatttattttgttggcaaaaatgtgaaatttggggtaggggttgtttttgcctccatgaggttttctttatttgttcttaacctgcttgttttgattcttggagagtataatatagaggctttgaaagaaattgggctctggaattagattagctttaaattgggggctctaccatatttagctgttattcaaactccctgatctttggtttcttcatctctaataaatataatagctcctgtctctcacggttgttttgatgaatgggtattatgcatgtgggatctcaacaactattagctatcattattgttgttagaattactattattaatattattatttgtataaaatcttacaggctttagtatctggcaagacacatattcagaaaacattttagatttgttaggcactttatttctgtgctttatagagatagaaaagcagggtagatcaagagtacaaaaacagaatccaagacttgcccaggttaagttttatctggatagttggcagagccgggtacggtgactcatgcttatagtcttagagctttgggagcttgaagtgggaggat

SEQ ID NO: 195763 - DNA, 468 bp, Homo sapiens
agttcgacggagactctcccaatcctattcagatgttagttaacatctttaggattgggagggtctggaagaaaaagatctagctatgttaatagagattctttacggaattgcagtggaaaaagactaatttacgcagagctggttgtgcttgagaccggagttttattactcaaatcagtctccctgagcatttggggatcagagtttttaaagacaatttggctggtaggggcttgggaagtggatactactgattggtcaggttggagatggaatcacaggggattgaagtgagtttttcttgctgtcttctcttcctgggtgggatggcaaaactggttgagccagataacgagtctgggtggtgtcagctgagtgcagggtctgcaaaatatctcaagtactgatcttaggttttaaatagtgatgttatccacgagagtctccgtcaactggaccgagttc

SEQ ID NO: 195764 - DNA, 565 bp, Homo sapiens
tccccgtacgcccaaaagtgagatcttttattatcttctctgtgtttttgttttgttttgttttttgttgttttttaatgagtaaagaaacaggattacaggcgtgagcaactgcgcccagactcaagtttttcttataagtgtaaccgcccaatgggttaactttgcctgctgcccagacaaagccgattcatcaagatgggggaattgcagtggaaaaagactaatttacgcagagctggttgtgcttgagaccggagttttattactcaaatcagtctccctgagcatttggggatcagagtttttaaagacaatttggctggtaggggcttgggaagtggatactactgattggtcaggttggagatggaatcacaggggattgaagtgagtttttcttgctgtcttctcttcctgggtgggatggcaaaactggttgagccagataacgagtctgggtggtgtcagctgagtgcagggtctgcaaaatatctcaagtactgatcttaggttttaaatagtgatgttatccacgagagtctccgtcaactggaccgagttc

SEQ ID NO: 195765 - DNA, 484 bp, Homo sapiens
  misc_feature (438)..(438): n is a, c, g, or t
  misc_feature (458)..(458): n is a, c, g, or t
cagttcctcagccgtaatagccacatttcaagtgctcaatagcctgatgtagtcagcagctaccatactgcatggtgcaggatgtagaacattcctatccttgtagaagagtctatgatagccctatctaaagaaatggtcacataaaaattggtatctgcatcccatgaagtgacataacaatttaaattctcaatattagtatatgagttccaacatcctctccttgtcaacatcagatcaatattctgatctgatagatgagacataatgttttagttagtatttttttttttttagagacagagtctggctctgtcacccaggcgggagtgcagaggcctgatctcagctcactataacctccatctcccaggttcaagcgattctccggccgcagcctcccaagtagcgggggttacaggcactggccacggngcccagcggatttggggatnttttagtggaaagggtcgccaatcgg

SEQ ID NO: 195766 - DNA, 485 bp, Homo sapiens
  misc_feature (485)..(485): n is a, c, g, or t
attactgaaagcattttctgtttgtttccctcctgaaaacattaggatgggtgagctcttggagggatcctggctctgaaggcacctaggtgagaatggacgtgggatagtgtgagggcatggatttgaggctggtggacgggtgaagggatgacttaaaaggtgatttgctactgataaggatcccaaagaggagaaaattagaatccagatgagtacagccttcttcctagctttgccggcttttccttgggaaagaacataatatttacattgaaaaaaaaaaaaaaaaaaattggggggatcaagtttgggggggggaaaaaggggtaaggaatgggcacagtgggtcattaggcgggtttccgggacccatgttttcttggtacaagggggtaaattcgggcgcgggtctcccatatagggaggtcgtattaaattccagttaacgccaggtaaccggggattaagaatccgggaaatgn

SEQ ID NO: 195767 - DNA, 395 bp, Homo sapiens
ctagagttgcccgtgacatctccgccttacaacaatcacgcttacattgaattcatctaatatgacaggaccagaaagttgtcatgttaaagcgaaagaaaagcagtctgtagaccaggagtacaaaatgatcccatttgtgtagccaaaaaacaaaattataccaaaacaaatgtgtttataaaaggcaataaaatacctgcaagaatattgtcaaactgaaaactgtggttactatgaaaagcggatccaggaaaaacaggaacagaggactgctgtctgtgaaattttaaaacacatgtcaacagggttttaaattaaaggaggccaggcacggtggctctcaactgtaatcccagcactttgggaggattgcttgaccccgtaaggcggag

SEQ ID NO: 195768 - DNA, 483 bp, Homo sapiens
ctgctcccgtttcctcaactaaatgcttgaaaacccatctcagattctcttttctcacaaaccatctcttgatgacttcagtcttctttcaagtcccaccatgatcaatcaatcaatgtttaatgagtacctgctacgtggggtgttataggagttaggaagtttaagaagattttgcctttagttggatggaggtgatgctggagtggatgaagaactctcctgtaatcccagcacgttgggaggccgaggcgggtggatcacgaggtcaggagatcgagaccatcctggctaacacagtgaaaccccgtctctactaaaaaatacaaaaaaatagccaggcgtagtggcgggcgcctgtagtcccagctacacgggaggctgaggcaggagaatggtgtgaacccgagaggtggagcttgcagtgagctgggattgtgccactgcactccagcctcggtgacagagcgagactccgtctcc

SEQ ID NO: 195769 - DNA, 397 bp, Homo sapiens
cattattccagttatatcaacagtaactttaaatatcagtagtctaaagataccaattaaaagagactgttagagtggatttaaaaaaaataaataaatgaaacaagactaggccaggcacggtggctcacgcctgtaatcccaacaatttgggaggccaaggcaggtggatcatgaggtcaggaattcaagaccagcctggccaacatagtgaaaccctgtctctactaaaaatacaaaaattagccaggcatggtggtgcacacctgcagtcccagctactggggaggctaaggcaggagaatcatttgaacttgggaggcagaggttgtggttagccaagatcacgccactgcactccagcctgggcaacagagtgagactccatctcaaaaaa

SEQ ID NO: 195770 - DNA, 689 bp, Homo sapiens
gacattgcacccacacctagttactttcagtcgtaaataaaatacttgcaaatgttaattctgttattaataggtcattgagctttctctgaattctagaatttagggtgtttaactcttctcatatagtgttttttgtttttttacttcatgaaatcagagtcaaagcattttttagagtaactttcatctttcaaactcctgttctttctactagactcagttcacaagtgtaattattttgcataaataccctatcttccctcttatttattcactttctcttctgtgtccgcctgcccagtgggtctgtcaagacttttggttgtgggtgacaagaacttagcttaggcagaaacgataatgtgtgtgtttatatattggaaaaggctggcatagggaagtgctgttcttcgggcacagctggattgaggaccttaaacaatatcaataggaattgttccctttgcttccttcatgtgatggcaggtctcaactctccttttcagcgtcacgtcatccctgttcgggggacatgtccaactctactggtcattatcttacatagatgaaatattcttaactagtcaaactgagtcatgtgtactctgctctgctggaaaagtgactttctgtcttccatcaatcgtggcagaggcgtttccaagaggaggctgggcaggcaaaaa

SEQ ID NO: 195771 - DNA, 129 bp, Homo sapiens
ttttaatttttatttacatatttaaaacatatcatggtataaatatgatgtggatataaattcgagataaaggaagtattgtttaagaaattagttcatcaattcttaaacaatacttcctttatctcg

SEQ ID NO: 195772 - DNA, 248 bp, Homo sapiens
atttgacaggaaaaaaagggggtttttcattcaggatcatctaattcagctcaggacaattcagatttctataaagttaagttacgaaaacagttacaaaatctttaaatgagagggctttccccatggctgtgaaacataacgagaggtttcactgatgtcttctggggtattcacatagtttgaaaaatgaggggcatccttattctcatcttcaaaaacttttctcagattgggaaagcctgaga

SEQ ID NO: 195773 - DNA, 373 bp, Homo sapiens
tatttgatgctttgtggctaacggcagggccatccatcagttttcttctttgttacacagctttattttgtggctttattcttgatcagttgctttactgacaaggaaatcaaatgtgtccttttcctagcgtctcccatggtatacacgaaatacacagctgcagtaattctagcttatcagtgacattttctcctaaagcatatagttagggtgaatgaattcacttattttaaaatgagaaatgtaaaactatatgagtttcaactctaataaaaagtatgcatgtagaacggaagtgaaaggtttctcatctatgcaacacaaaatgcttacctgattctctcctttttctctcttttctgttattcga

SEQ ID NO: 195774 - DNA, 355 bp, Homo sapiens
gaaaacaatgtgattgggggtcatctttattacttaagtatctctatgtcctcacaacaaaaagcatttcatacatataagaataagaacatcattgtacaattacccaaggctctccctttcccttcccttctggagctgttctgactaataacacattgtgttcttagagcaattttgttttacaaagtgctttcacatatcttatctcatttagttctaaatgccctgagagaggacacaggaagaaaatagaaacttaaataaaactcaactgacatctttactacttgttacaaatgcctgtattgttttttaaaagccaacaaaccaaccaacccgctggcctaacgtg

SEQ ID NO: 195775 - DNA, 659 bp, Homo sapiens
  misc_feature (11)..(11): n is a, c, g, or t
ctgaagtatantactgtagtattgttaataattttgtagctgcctcctgttgctattgtggtgagttcaagtcttgcgagtatctgcttaaaataccttaaaataccatatgatgccagtcatctccaagtgaacagtttatctctccagtaagttggatacggtagttaaaaattctcactcttgattatttttcatcatgtttagttgaataacactatgggactcatacacagtgccactagcgatgctggaagtgttcctgagaaacagacaaaagtcatgccattacaagaaaaagtttaattgcttgatatgtagtgtagattgaagtctgcagctttagttgccaaccatttcagacagagattcatttataaacagatgacataaactttcagtattgataaatacagtacaatactataaatgtattttctctcccttatgattttaaaacgttttcttttctgtagcttactttattgtaagaatactatatatatatatatatatatatatatatatatatatatatatatatataatgtgcaaaatatgtgttgtttattggtaaggcttctggtcagcagtaggctctcagtagctaagttgttgaagagttaaaagttatgtgcagatttttgacggctctaggg

SEQ ID NO: 195776 - DNA, 543 bp, Homo sapiens
cactttcccacaggtaatcactatcccacatttgctttaattattcccatcatgttttatgctatgactacaaatgtgtgaatctatattccactgtatgttaataccaacattttttcatttattttaccgctgatgggcaatttaggttatttccagatttttactattacagatgcttctgtgaacatccttactcatttctccttgtgcacatgtgcaaaatttctctggagtacatacctgggagtggaattactagaatgtggtgcatgtacatgttgttgtatttatcagtagttcactcttatttattgctgtgtattccattacatagatataccataatttgtttatctaatcacttatttatagacatttgggttctttctgtttttttgactattagaaataaagcagctataaacatttgtatataagtttttgtataggcatatgctttggtttctcttaggctcaggggctgggaaccccctaggaatggaggaatagctgggtcatatggtaggtttatgtttaact

SEQ ID NO: 195777 - DNA, 434 bp, Homo sapiens
tgcctacctctaggacccttacacttgctagttctacttcttgaaatttgaaaacttagttgtttcattcattctgtcatttattgtgtgcccagaaacttggatgcacctagatgggtcagtgctggaggaaagcagacatggtccttgccttcatgaaatttgcagtccactagggaagacatgaatcaaataatcacatcagtgaatgtcaaaaggcagctgtgacaattgctacagatgtgacgcccatgcattgggttagagaactctcagagatggtgccaggtagaactatgtgaaattgcagatttttcagtcatttttgacctataaaagtaaagacagttcagattacattttatgtttgaccctgaagtcacagaaggttcttgagcagagaagcacatgatgggaatggtatgtaggaacag

SEQ ID NO: 195778 - DNA, 453 bp, Homo sapiens
acaccggcaaaagtcaagttgaccacgatacctagacctatgctgcgaaggagggacccactgtggtatctgcgaaacatttccttctgtctaaggagagtttacaatcttatcagagttctgggttggtctgagcaggaaggggaagcaaattcagaaatgacactttttattttgtttccgtctcatttttctattttctcttaggaaaaaaaaaagataccaaatttagtcaaagtataggaagtagaaactcttgtggaacttcttcagttcccatttctttaatgggacagactatgctgaaaagacagatgctgtgaatctcacaaaattttaaatgagctgaatgtatgtgttggagctatactgtcttcctgtaaaatagtaagctaagcagaattgccagccaacttttggtaacaggaaaactgaaaataaaacctatcatgt

SEQ ID NO: 195779 - DNA, 379 bp, Homo sapiens
aaaatgacagggaacataaaggtcagatgagatgaattctgggactaactcagatacgcttttggaggccttatatagaattcagaaatctcaagtctctggccaaatgtcaaagattcaacaaagggtaataaaaaagataacctgaaagctgtaagtcaccaccaagagcaccttttaggcatgaccttcaccagcaggaaaaggaacaatgcatgtgctgtagatccacatggatagaagtggggaaaaggaggttgtattgcatatatttgtgtctgcagtttgagaatgggacggagttttagtacttcatcttggttgcacaagttgtttgattggatgtaattgttatctaccagtgtggttaatggtttgg

SEQ ID NO: 195780 - DNA, 306 bp, Homo sapiens
ccatggtttcttaatgacagtgctgatctattttacatctaaataactatctccactctcacccagaaaacggtaccattcacttcagagcttgttgccctcgatgccctcatgttccgctcggcactcagcaggaccctgggcaaactgggcagccatcaatctcctgaggcagttacttcattatttgggttaggtcattctctagatggctcactggccttgcctaggcacaggcgcatggagcccatctgttcatcatcgcctgttcatgagaccccaaagattacttgggctcaaaagtac

SEQ ID NO: 195781 - DNA, 146 bp, Homo sapiens
ccggaactatagatgtagtaccatgaggaagttccatatggaggagatcacatcctcacacaacttccatttcatctcctccatatccagcttctgcgcaaagccctggatctgaaacattgtggctctgactcaccagccttcag

SEQ ID NO: 195782 - DNA, 299 bp, Homo sapiens
tcttatcactcaagtgtttcttattttttccaaagctgtaagattgccttaatttatttaaatgtaatcattcagaaaactcctgaaacatgaactcattgctttctcatgacaggcaatactataatgacaagttatttgatctatgacatcaaaaattctttataaatatgtttgaatgcaacaaattattgttaccacttgacattttcctttttgtttgacattgttgtggcaaaatttggtgaatattatataggctacaaattttattaaagattgttattattttaaatgtc

SEQ ID NO: 195783 - DNA, 566 bp, Homo sapiens
  misc_feature (552)..(552): n is a, c, g, or t
ccccgcattggcagcaacactcaaatttttaaagcatgagagaagaaaagaggaaatagatggcataatactttcttcccacatcccaaagattgttggtatgtgcacctcactttggagatttaggtcatttaggtcaaaagaaacttgctattgaggaaagagaatctgtagaagtagggtttaagatttgcggggatggggaagggtttgggacactcactttggacatctaggttaatcagagttactgcataatggctccccttctattttgcttccctttatgtatgggtttgtttagacaaggagcagcatgactcttgtatgttgccatagcacatcaaataggaaaaaaaaatagcttgaagaagttggtgaggaaggagctatttaagtcagaactctcagagtgacaaactcaactaaaattaaatttcacaaaagtcaatttattagctttcataaacgataattgtaatctcctagggtgacagtggcctcccggcatagctggatccagaagctcgagtgtgctgcctatgcgggtcnagctcgattctatt

SEQ ID NO: 195784 - DNA, 859 bp, Homo sapiens
tgacatttttagttcgtgcaacattccaaattacttacgttgtactgttgttgtctaaacgatgtattttaaatagcctctgtcccagatagcgtgaaactgtaacaaaattcttttgacttactcgcctttatgtagaaagaggccagtatttggcaggaagcaatttagaggtaaccagtttggatgttgtttggggccagtgttcattccagctctttcttcaatggcctgctgtctgaaagtcttcctttctgtcatcactggcatcattctggccttcagtgacatgtctgccttactgattagattatgtctctctgttggtctcactgccccaattcattgaacatttaatgaggtgccttccatgtttgaggccgtttctactcccttttaggtgcactttccatgtgtctataaattgaatgccctgcaaaccataaacctttcctgattaggcattttactgactccttattgccatgtgcatgtgagtgtgtgtctacctatgtgcatacatacctacatgtatacatacatatgtactccaaaacacatacacgtgtatacgtggacataacttgtatgtttctttccttgccttcattttttcgctagctttctttttatctcactagcctgctttcctacacaaaaagcctcggctttgctcttatccttctcttctctcaactctatcaatggatcttgagatttaggagataactgtggtatttatgtacctttgaatgacaaacagacgttctgttcctttgagatcatccttttcaattaagtgcgtagatttgggcagcatccatgggcagatatgagggaagaaaaagataacctgttt

SEQ ID NO: 195785 - DNA, 396 bp, Homo sapiens
atttctcagactattttgcatttagggttctagatataaaatagttgtgacaattataatatatatgtgggagatttgaagggagtttatgttttcttcgtttttgtggtctgggtcatgaagaagtgagattttgccaacagtagcagaaatgcagcatagcattatttattctccagcatcttgagttatcaagaggcttttgtggttaaggcagcagctagactgttttattgtgtacatcccctagctgggtatttagaggcagttgtgacagtggcaacttcctgattcaagctttccaatccttggatcacagttatctgccatgtgttcttggatttagtggtcccattggtagcttcttatgatttcagttctgtagtgttctggtag

SEQ ID NO: 195786 - DNA, 333 bp, Homo sapiens
ggagtgcagtggcacaatctcaactcactgcaccctctgcctcccaggttcaagcaattctcctgcctcagcctcccaagtagctgggattacaggcacctgccaccacacccagcttttttgtatttatagtacagacaaggtttcactgtgttggccaggttggtcttgaactcctgacctcgtgatctgcccacctcagcctcccaaagtgctgggaatacaagcgtgagccactgcacccggcctagagggtgtatttctaagaacccctagaaacaaaaatttggaaattgtgatgcaaagagatagccaccaagtctatggatctta

SEQ ID NO: 195787 - DNA, 475 bp, Homo sapiens
accatttttgggtgttcaaatctttgattacaaaaggaggatcttgaggtatacaaaaaaccggaatcctgtgttcttattagcctaaatatgtgaaggacttcttttggccctaataacgccaagttagctaacatttaccacagtcattttttaatcatttggttcaaaataggaatgacagaggccaaaaagcctaccagttataaagacattgttcttgatggatacaggaatattgtggggaaaaggatggaaagggggaattatttcactgaaagagactaccctttcatataattagcacataaaaaagattgttaaaaaataacagtcttaggaaccaagtattaaagatcaatatatttaataattttcaggtttaatgcaattataaaattctaattttctaataataatattcattatccaagtgattaatattaaccataaacacccacagtttcttctgtct

SEQ ID NO: 195788 - DNA, 889 bp, Homo sapiens
ctacttgggagggtaaggaaggagagtcacttgagcccgggaggtggaggttgcagtgggccaagattgtgccactgtactctagcctgggtggcagagcgagacggcatctaaaaaaaaaaaaaaagaacatattcccacagagaagagaagactactctgtacccaaaataattgaaaacagagtctagaagggatatttgcacacccatgttcatagcagcagtatacacaaaatccaagaggtggaagcattccaaatgtccattgatgaatgaatggagaaacaaaatgtggtatatatctgcagtggaatattattcagcctgaaaaggaaggaaatcttgtcacatgctatgacatggattaatcttgaggacataatgctaaatgaaatgaatttatcacaaaaagacaaatactgtatgatttcacttatatgaaatcaagatcacagaaacagaaaataggatggcagttactaggggcagagacttgtttaatggatatagagtttcagttttacaaaatcagaaagttctggagatctgtttcaaaacaatgtgaatatactaatactattaactgcatacttaaaaatggttaagggctgggcatggtggctcacacctgtaatctcagcactttgggaggccgaggagggcggatcacttgagatcaggagtttgagaccagcctgggcaacgtggcggaatcccgtctctactaaaaatacaaaaattagctgggcatgatggcatgagcctgtaatcccagctacttcggaggctgaggaaggaaaattgcttgaacccaggaaagggaggttgcagtgagccagtcatgccactgcactccaacctgggtgacagagtgagactccatctca

SEQ ID NO: 195789 - DNA, 367 bp, Homo sapiens
caaagatgacaagtgacactgacattttattatgaagaagatacattagctttatgtttaagacaagaaatcatttttgtgccatgctgacaagacatttaaagtgttggtgacaaaaataaatgagaagaagcagaaatgcatacggaaaggttaagagaaacgaatggtaaagaacaaaatagtttgctaaataatattaaaagttatttgtacagagctatagtttaatttaaatgcgaatttaggatacagaaggatccttagtaagcttttatatctgttaaatattttaattattatgactgtcaacatcagacacaatctctaaacatgaactgagtcctattgaagtggaactgcttct

SEQ ID NO: 195790 - DNA, 391 bp, Homo sapiens
tctaccacgtgggctcaagtgatcctcccaactcagcctcctaagtagctgggactacagacatgcgccaccatacccagcttatttttctatttttttgtagagacatggtctgtcactgtgttgcctaggctggtcctgggctcaagcgatcctctcaccttggcctctcacagtgctgggattacaggcatgaatcaccatgcctagcccctaatgccagtttttgttgttgttttttcctgagacagagtttcactcagtcgcccaggctggagcaagactccatttcaaaaaacaaacaaaacaacagaaagtactcaataaatattagctattattataagctattactcactgcaaacaacagaatataagctattggtactac

SEQ ID NO: 195791 - DNA, 433 bp, Homo sapiens
ggcaccttcccgccgctccctccgccccaactcgccacgagacagaaaacgccgggagctgggacttctgctgggggccgatggggaaggggagactccggagttgcccggcgacccacacccgcccggcacggcaacccagtccactctcacttgctggagcgggaaagcaagaggagcagagggcttaagacagggaaactgagtttccgaaagctccaaagtcacgcagcaagtcacagaggcagaggagggtggaagcttcggatttaggcagacctaacgtctgcgagcctccgcagtcacctcactccaggcgccctgctaaaccgggatttactcatctgtgaaatgagaaattcggagaacaacgcctaagtcacagcattgctctgaggaattaaagcactaggcacataggaacgggtcgtca

SEQ ID NO: 195792 - DNA, 420 bp, Homo sapiens
ggaaatccagttcagcaaagcagagaagccaacagtcttggcatcagacagtaggtggaggtcaggatcaaaagacataacgcagcaggtcagagggcatggccaaggtaggcatgacaagcatggggtgttagatgtcacaatttctctgattctcactgcaggaagggaggtttctattgtctctattttatcactagggcagaggaagtctattgtttacccctcactgtatctatcataccatcacctaaagaatgctgtggtagtttccagggccccctcagcaggacatcggggcctttacacatgctctttccttaactatgccctctctagtctcttcccccatctttctcccctgtctgggggactcatggctaaagactgaactcaaacatctcttttcttgcaagaccc

SEQ ID NO: 195793 - DNA, 142 bp, Homo sapiens
ggtttcaatttatgaattttggggagacacaacattcaggccatagcatacctcatagatcacatatggatatgccagccaatttgactaatgtcagtggtgaacatagtcttcttgatctatatccaaggcatccttctta

SEQ ID NO: 195794 - DNA, 381 bp, Homo sapiens
gaaggagggaatggggaggacagccaagatttcaatacaaaggagagaaaaaggaaatagggactctgaaactaacttccaggacatatttctcagacttaaaatagacttgaccttaggattgtcatgagaaaagccagaacaaatgaagtcatcatatataaacttcactctcaggaacacgactagggggaaacacagaactaggttaagggacactgattagccaataactgctcccctccttcagctgagttttcctacaggtcatactttaaggctattaaagtcactattatctcaaaaatgttccatgcaacctcacaggggctccaacctcctactaaccctaattaaaagttgaaatgggtgacagaaaaa

SEQ ID NO: 195795 - DNA, 269 bp, Homo sapiens
tgctttagagcatggaccctggagtcaggctgtctgggtctggattttattttgccactaattaattatgtaggtaatttctggacacctcctaagccacatttgtgaggtgggaatgaccggagagttatatttacctcattaggttgtatggggattaaacaaggtgatttggagccagtactcattacttcatacgcagttattattgttactttacagttggtggctgtgaaaaaataaaatcgttctggtattaaatacaagtt

SEQ ID NO: 195796 - DNA, 485 bp, Homo sapiens
aactggtcggagcaaagcccgtgttccctccactgccatccacaggtgcccaaagtctcagtcccgtgaggcttctacactttatttaccacagagaagtagaaccatgacttacaaaaagaaaagctctgaggtatatcacagttgaaacaaaatgtaagtgatcttttgtcctacttagagaaaacaaaaaagtaggcccggcgcagtgactcactcctataatcccagcaacttagggaagctgaggtgggaggatcacttgagcccaggagtttaaggccagcctgggcaacatagtgagacccagtgtctaccaaaaatttttaaaaattagctgggtgtggtggtgtacacttgtagtcccagctactcaggaagctgaggtgggaggatcacttgggcccagcaggttgaggctgcagtgagctatgattgtgtcactgtacttcagtctgggcaacagagtgagagagcctatctca

SEQ ID NO: 195797 - DNA, 412 bp, Homo sapiens
accagattaatgcaaagtagtacaagacattgaagcccaagctgcatgggctaaaatggtaaccggtgcacagtgaatctctttcacaccatttatttaattcagcatagaattaataagtattggccgggcgcggtggctcacgcctgtaatcccagcactttgggaggccgaggcgggcgaatcacgaggtcaggagatcgagaccatcctgactaacacggtgaaatgccatctctattaaaaatataaaaaattagccgggcgtggtgccgggcgcctgtagtcccagctacctgggaggctgaggcaggagaatggcgtgaacccgggaggcagagcttgcagtgagcagagatcacgccactgcactccagcctgggtgacagagcaagactctgtctcaaaaaaa

SEQ ID NO: 195798 - DNA, 472 bp, Homo sapiens
gagaatttattgaaccgggggaggtggaggttgcagtgagctgagatcatgccactgcactccagcctgggcgatggagcgagtcttggcctcaaaataaataaataaaataaaatggtaaattttggctgggcgcagtggctcacacctgtaatcccagcactttggaagaccatggcgggtggatcacctgaggtcaggagttcaagaccagcctgaccaacatggcaaaacccccgtctctactaaaaatacaaaaattagccgggcatggtggtgcgcgcctgtaatcccagctactcgggaggctgagacaggagaatcgcttgaacctgcgaggtggaggttgcattgagccaaaatcatgccactgtactccagcctgggcgacagagtgagactccatctcaaaaataaataaataaataaaaagtttgttttacgaaaattttatctcaacttttttaaattg

SEQ ID NO: 195799 - DNA, 407 bp, Homo sapiens
ttatccacacctttttcctaggctgggcatggtggctcatgcctgtaatcccagcatgctgggaggctgaggtgggcggatcacttgaggtcaggagttcagaaccagcctggccaatgtggtgaaaccctgtctctactaaaaatacaaaaaattagctaggcagggtcgcacacatctgtagtcccagctactcaggaggctgaggcaggaaaattgcttgagaggcggaggttgcagtaagctgagatcccaccactgcactccagcttgggcgacagaggaagactctgtctccaaaacaaaacaaaagaaaaaaactgtttcctaatctgtaacagtggaaagtaatataaactgatttctacatttccttcttttttaatcagtatactttcctattagtt

SEQ ID NO: 195800 - DNA, 383 bp, Homo sapiens
gggtgtgttgcccttggcacattgccacacagtgcttaatgatgatatatgttctttatcaaattccccccaccaaataatggcattatttacgtgtgagaaagttgcacatttcaccacctcatggtttattagagtgcaattccgtgagaacaactgcctgtgatcctctgtatccccagtggccaactcaggagctcagtatgccctacccagtagatgctcagaacatcattgctgagtgaggaagtcagccatcattttctccctggatagtctctcctgtagataacaggggccgttatcagccaggtttttcatcatttgtggctttgaatttcagggacatgacaagtttgctttttgtttcgttttgttttttt

SEQ ID NO: 195801 - DNA, 195 bp, Homo sapiens
ggactgacggaccctctccaacactggatactccagctgcctccattgtcttaattgtttttctctgtttaccaagataataaaagctcattgttttgaacccaatgatacggaatgctatcaagaaagaaaggaaggctgagcgcagtggctcatgcctataatcccagccctttgggaggccagggtgggagg

SEQ ID NO: 195802 - DNA, 310 bp, Homo sapiens
tgtgggcgaatgttttgggagcatctatgcacttgctgctctctcctactcaactacaatctccttgagagctctcatgggtcaggcccacattaagggctcaaaaatatgctagaaacagcaccttcaggttcttccagctgctccatcaggtatcagctcccttcagtagacataccgaaggtggcatgctgggcagtgttcattggtacctgatcttgtcactgacctttaatgtcccatgccttgtgtgtccacagccactttcaacaactcttagcccttatcggtatcttgcttgacagaattc

SEQ ID NO: 195803 - DNA, 644 bp, Homo sapiens
tgcccgcctcagcctcccaaaggcttatgcccacagggttgagccacggcgcccggccctattttacaaaattgtaatgaagctgagaaaagataattcatctaagatcacttgataaatgacagactccaaagcccatggctacttgaccaaatcactttgctctgtatacatccgtatagagaactaggtttggagccaagagggactcctgatttatccctctcatgggcagtaggtttgttatagtgagcccttggccttagcttggttttctttatcagtaaaggagagcatgaccagatcatgccataccaacttgatggcctaggcctagggcttggcttgtgaggtgtgactaaatcacatagcctcagataaggaatgagggaagatttaaagcaggattgataaagcagattatgttttatacttaacaaaatcttaaactggatgtttcagctggggtatcaagatctaatagatatgaaactccaaagggagacagcagatgtaaatgcagtattttaaaggaacttaccaagaaccagttgcacaactcttgaaccccctcacccatttcaagagtatgaaaagtgaagatagaaggccagatgcagtggcttactcttgtaatcctagca

SEQ ID NO: 195804 - DNA, 585 bp, Homo sapiens
tggtactttattgaaatcaatcactacagatgccaagtacacagagcccacgaccttgaagaagtcataggatgggtttccatagcacaggtgttggaaggtgccgtattgtggtgctgggaagcagagacgttctcttctttgaagattttcaaagaaaaaatatagcctgttgtagcagagcagctagcactgcttagatgcagaatcatgagaaagtgaggcgatagcagaggctggtaaactccacctcacaagccaaatcccatgagcaacatgcttttgtaaataaggtttcgttgggacacagccgtgtctattcatttacatattgtccacagctgctttcaagctacaagagcagaattaagtaggaggatgtatggcttgcaaagctgaaaatatttactacctggctcttcacagaacagttgctgacacttgctctacgacaaaggagttactaaaaataagaggccaggaagaggatcccttaaaaaaatgatcgtaatggacaaccatgaataggtctgggaggtggggctgcctagttgtctgcatcactagtaagaataatggtaatta

SEQ ID NO: 195805 - DNA, 158 bp, Homo sapiens
agtggacaagtaaaaccatctatgctacactgcatattttttcctcccccagactggaccagggaatctctcaactttctagagtatcctgtctccattgacaaagctgaacagtattaaagatcctgctgcctttgttaggcagatttggaagggag

SEQ ID NO: 195806 - DNA, 957 bp, Homo sapiens
gcaatcttaatctcatgactatgttcttctcccaaacaaggattgataggtaaatgcattgaacaagtatatataaaaagagattaaaaagcaatattcgtacattatgtgatttatgtttttgatgtcaaaagtttgtgctttgggtgaaatatttgtataactgctgttttcttcactactcctgtacacatttcaccatgtggtcagaaaagttgtagtctgaagacaagtgctttaatatgttctcacccatattggaacttgatttaaaagtcagtgagccaaaaggaagctatccagcgttgattgctagctaagagtaaggagcccctttggttttctgtgatatatatatatatcacacgctctccctcctttaccacaggtgtcattctacctttaatcatcactgtatcatagccccaaagagatcctgaaatggctgtgcatggatttcctcctttgcccttgtgatgttgttgtcttgtggatttggttgggctagtagtttgccaggagtgtaatccagtggatagtgatccaaactgtagccgcagaatcctgtgactgacatttttctttgtggtggtggttggccctgagatttgttgcctacagattttgctaatttacccccctaacgcttcacatagtggggaaaatacacaagaagaacttgagtatgaacgataagcacctttgaaaactccatacagttttggattagggctcatcctaatataaatcactgccagtatcacatgacatcagtatgtgatttctgggtatgtggtagtgagattaaggagcagcttttttttttttttttttttgagacggagtttcactcttgttgcccaggctggagtgcaatggcgcaatctcggctcactgcgacctctgtctcccaggttcaagcagttctcctgcctcagcctcccaagtagctgggat

SEQ ID NO: 195807 - DNA, 426 bp, Homo sapiens
caatgtgtttgtttactcatgtgacttcaactctgcataggcctctcaaatctgcaatcctggattttttactggctttcatatatcataagttggatattttattgggacttgaaatgcacgtctaaagtgaaaaccatttattaatacctaacctttccatatcaacctcttctctttaacttttctgttagtaggaccagcgtactcttcgattacctagattcaaaactgagtaacctctgtgtgcattcaatcagttgccacatcttacaaactcttaccacctgggttattagttttcctctactatcagtctcacatactgtcatggcactgatgtttctagactgtaactcattataatagacaaccattgaagtttttgagcaaggcaaagattataatgagtgggtaccgagctcg

SEQ ID NO: 195808 - DNA, 971 bp, Homo sapiens
gatttttaaatcatttattaaaactaaaaatgagtgtgcgtacgcgtggagagggggaacaaggcttctctaatcagcaaaggggctgtcggcaggcgatgtacaaatgaaagcgcgctttctaaatttccaaagcactaaagggagagaaatgcgcaattactgtgggattcgcccagaggagcagcctcaggagttgaaggggatcctgtccctcccagaggaaagctcacgattggattggaacttctagcgactgcctgaggtgagcttcaggtggggaccggccccgccaagtccgaggcagttatccacaagaaaacacgcgcgtgcccccgctgctcctgcgtggtggtcgtccggagacaggcgccctgcagggcatctagagggccccaaatggctcagccgggcccgcggcgcaacaggctgcacaataaattaaaacaatagtgagaataagcaaatggtctggagggcgggcggaaccgaagctcgctcttcggagctggagtgccgcggggaggggggtgtcagcgtcccagggatgagaccttcccctcccccttccgctccccggcacccccccgaccagacgtctcttccgtaggcgcgtcctccgggtcatggggaaacagaggcagagacttgggaaggagaaatggagaaaccagggcaacgtggtcagtgctgcagcgccatccctttttcactaagaccaccctgggcccctgggcgggaagcccttcgcacactccagccggggagagtccaggctgggttccgcagcgcctgtggctgtgtggccgggaggctccttgctctcgcccgcgtggtcctgagatcggtcgctcgttcccacaggccccgggattggctgcaccacgcagctgttgtccagttccggagctgccgcgttcaatccgagtccctccgatgctttcactgatattaaaatttcacttttcgaa

SEQ ID NO: 195809 - DNA, 626 bp, Homo sapiens
gatttttaaatcatttattaaaactaaaaatgagtgtgcgtacgcgtggagagggggaacaaggcttctctaatcagcaaaggggctgtcggcaggcgatgtacaaatgaaagcgcgctttctaaatttccaaagcactaaagggagagaaatgcgcaattactgtgggattcgcccagaggagcagcctcaggagttgaaggggatcctgtccctcccagaggaaagctcacgattggattggaacttctagcgactgcctgaggcgcgtcctccgggtcatggggaaacagaggcagagacttgggaaggagaaatggagaaaccagggcaacgtggtcagtgctgcagcgccatccctttttcactaagaccaccctgggcccctgggcgggaagcccttcgcacactccagccggggagagtccaggctgggttccgcagcgcctgtggctgtgtggccgggaggctccttgctctcgcccgcgtggtcctgagatcggtcgctcgttcccacaggccccgggattggctgcaccacgcagctgttgtccagttccggagctgccgcgttcaatccgagtccctccgatgctttcactgatattaaaatttcacttttcgaa

SEQ ID NO: 195810 - DNA, 875 bp, Homo sapiens
gatttttaaatcatttattaaaactaaaaatgagtgtgcgtacgcgtggagagggggaacaaggcttctctaatcagcaaaggggctgtcggcaggcgatgtacaaatgaaagcgcgctttctaaatttccaaagcagattggattggaacttctagcgactgcctgaggtgagcttcaggtggggaccggccccgccaagtccgaggcagttatccacaagaaaacacgcgcgtgcccccgctgctcctgcgtggtggtcgtccggagacaggcgccctgcagggcatctagagggccccaaatggctcagccgggcccgcggcgcaacaggctgcacaataaattaaaacaatagtgagaataagcaaatggtctggagggcgggcggaaccgaagctcgctcttcggagctggagtgccgcggggaggggggtgtcagcgtcccagggatgagaccttcccctcccccttccgctccccggcacccccccgaccagacgtctcttccgtaggcgcgtcctccgggtcatggggaaacagaggcagagacttgggaaggagaaatggagaaaccagggcaacgtggtcagtgctgcagcgccatccctttttcactaagaccaccctgggcccctgggcgggaagcccttcgcacactccagccggggagagtccaggctgggttccgcagcgcctgtggctgtgtggccgggaggctccttgctctcgcccgcgtggtcctgagatcggtcgctcgttcccacaggccccgggattggctgcaccacgcagctgttgtccagttccggagctgccgcgttcaatccgagtccctccgatgctttcactgatattaaaatttcacttttcgaa

SEQ ID NO: 195811 - DNA, 430 bp, Homo sapiens
cacagagtcgggcaaatggattgctggcccatgagccagatgggagcattgagcctatcctttcaccataaactacttccctgatattcttcccaatgcacacaactctttgtttataagttgagagaagaaaaggagcatttatttgcagtttccattgcctggcaaaactgcagcagtgatgaaagctaccacattgtcagtgctttccaggcaatggagataactcttcctctcctagatgtgatcgggagcctcaaaaggtaatttccacattttagagtaagtagaaaggaatgactgagtttttcagagtcttgcaattaaattacaactttgaaagaataatctcaaagttcttggaaaacatcagtggggattaattacatctttggaaaagagatcgatatcatttaaggaataatgcacc

SEQ ID NO: 195812 - DNA, 541 bp, Homo sapiens
cagatccaaaaatcttggtaaatattgggttcagtactatccgcagtttcaggcgttccaagactgggggtcttggaatgtatccgagtggatatgaggggactgctgtagatgtgtgtgtttaagccataagtttcaatggttgttttaattatataaatcagactataagaaacgtgtgtagttttaccgttattgaggagtgcccattacaagtgtatagctcgatgaattttcacaagcagaacactcccaagaaaatgtgattaaattcccatacatttggctgggcgcggtggctcacgcctgtaatcccagcactttggaaggccgaggcgggaggatcacttgaggtcaggagtttgagaccagcctggacaacatggcaaaacccgatctctactaaaaacagaaaaattagctgggcgtggtgacgggcacctgtaatccctgctactcgagaagctgagacaggagaattgcttgaacccaggaggcggaggctgcagtgagccgagatcgcaccattgcattgcagcct

SEQ ID NO: 195813 - DNA, 386 bp, Homo sapiens
ggtttgagctttgagctgccagcaatccccagtagctgggagaaatgagtgcctccatccagaaggaagggtgtaagcggcattccacagcatcctctgcactcgcagctccatatgtctataaaacaactgattttagaaggcacattcagtttctggtactaagtagttcctaataattgaaatatttgctatttagatttctctgttatcagaatctgcccattttctttgaaaaaaaatatatacatctttagaaaatgagagaaaatgaaatcgtctaggctgagcatggtggcctgtaatcccagcactttgggaggctggagctggcagacctcttgagcccaggagtttgagatccaccaggggaacatggcaaaacc

SEQ ID NO: 195814 - DNA, 344 bp, Homo sapiens
aattgttaaactaagcaaactattgctttggtgcacttaaactttcaactctctttactaagaaagaatttctttctctctcttagtggtagataaaataatttttttaaaaagaaaaaaaagagccaggcatcgtggctcacgcctgtaatcccagcactttgggaggctgagactggtagatcacctgaggtcagaagttttgaccagcctggccaacatgatgaaaccccgtctctactaaaaatacaaaaattagccggacttggtagcaggtgcctgtaatcccagctaatcaggtggctaaggcaggagaattgctagaacccagaaggcggaggttg

SEQ ID NO: 195815 - DNA, 584 bp, Homo sapiens
gtgggctgtctagaggatccctatgttatcccaacacgaagagctggaccagcttaagtacatgtcacagcaacatgcaggaaggcctcttccctgatggccgcgtcttcatggaagtaggagagaagactagaggtaaagacatagtgacaaatggctacagactgctggaaaggtagcaggtgatgccaagggatactgctcatctgtggagcagaggtacagacaacccttcccatctggcgggacccagaggtgctgagatgggggtctgggaaacactgcccagccctgaccagccctgtgggtggaggtacctgtaaaaagcgaaaggcagcagcctggtgtgctgatccggggccacacggaggaggagccgccccagcctgaggtctgcaacaccaagaagtggctcaggcaactctggacatctctgcctattatcagtgctggggacacccctgggggtcgggacgtgtaccctgggaggcctggctgtggggatagtgttgggcgataacatcacttatcgcccaacacacagaagagaaataattcaagaaaagacaccaaatagctaaaaa

SEQ ID NO: 195816 - DNA, 616 bp, Homo sapiens
gtacagcctctgtggctgctttccctggctggtgttgagtgcctgcagcttttccagatggcatggtgcaagctgtcggatctaccattctgaggtctggaggacggtggcccttttctcacagctccactaggcagtgccccagtgggtactctgtgtggggtgagggctccaacctcacatttcccctctgcactgccctagcagaggttctccatgaagggcctgcccctgcagcagacttctgcctggacaccctggcttttccatacatcctctgaaatctaggtggaggctgccaaacctcagctcttgccttctgcctacccacatacccaacaccatgtggaagcttccagggcttggggcttgcaccctctgaagcatcgacccttttagccctgtaccttggccccttttagccatggctgggacacagagcaccatggcacatgtcccagtgcttcacagagtagtggggcccttttccctcctagacccccaggcctgtgatggcagtgtctgggcaaaggtctttgaaatgtccctgaggtattaacatttggctcctctttacttacgcaaatgtctgcagccttcttgaattcctccccag

SEQ ID NO: 195817 - DNA, 365 bp, Homo sapiens
ttctcacttccagtagcagacagtctttgaagtgttcttttctccaaattatcaccctcctcccacattcactccttccttactcatcccagacacaatgctgtgccatctgccagcgccacgcgttctatggcagcgaggcacagtggctgaggaacagacacaggcctggggtcagtgccagctctgccactcccagctgcatgaccccatgcctgtcacctcacctgtacacattcctccttcctagaagatgagaccagtagtgcctcccctggcagggttatttgaggaacggaatgagatcatggacataaagtatttagttaagtgctggccacagtaaatgctcagtaagcagcagg

SEQ ID NO: 195818 - DNA, 447 bp, Homo sapiens
accaaaggcagttttccagaagtaccattgataatgtatttgattatgagatctttactgaattaacatgatagttttttggtaatcagtaaataatctcatttagcatttgatctttcactggatggccttaaactaggttagctcccttatactttagccaatgatataaataatttacttaattggtcttaggttgaggttgaggcttgaatttcccaggtttggcctgaggcttaaatttcttagagtataccctgatgtactttcctgtgtgtacatagaacaaatgcatattcctatacattatgatatttagataaaataatgtttttcatgattgatttaaaccatggataactacagtcaaatcataatggaatataatcatataattgtgaagtgaaaaaaagtgatcctaatctattatttactaaatgtagatga

SEQ ID NO: 195819 - DNA, 399 bp, Homo sapiens
ctttaaatttgaggcctgggtggaactgacaggtggagtttgaaggcacatctgctagctcacataggaaacagaatctcccagggaaaagacataggacctctgactctaactgaggttctggattattatgagagattttcagaaatggtctaatggtgttggcttgctccataccatagattttaagagacagtagagcttctgcgatgagattcccccataaaataattatggatctgcactggcaagctggtcttggctccaaagaccaagagttggtttgtggtgctgattctgaacccttgcgatgcaactgtctggtagtaaaatggctttgtatggtaagaaagctttaatcctcgaggcctagacaactttactgcagggcattctcta

SEQ ID NO: 195820 - DNA, 548 bp, Homo sapiens
aggcgtgagccaccatgcccggccaataaagatactttttaaactccatattttgagtcaggagaaatttaggagttaacttgctgaagtattttgagtgcttactgattggcagaaagaaatcactcatacacctaaactataagttgcatgtatgtttatgcaatagaaatgaagtggctttacaacccttttccttgatccctgggctatgtaaggggctctcagccatcaaataaggcctgccatggctgagaaaatagccaaattcttatgacctctttattctttttatcaacaggatttacatcattattgcagaaaacttacactaacatttccatgtaagggaatgtttaaaaacatagagctctcccagttgttgaacaaaatgcagtattggcaaggccgtgtcctcaaggagggaaaagcaaagttgggttttcagtgtgctggaatgcctaactcactaggactgaatttgattaatcctgccctctaactggatgtttaaattttcattttcttgtcaaagtagtacatataca

SEQ ID NO: 195821 - DNA, 203 bp, Homo sapiens
agtcccagcgacttgggaccatgcggtgtgtggatagctagagccaggaggtcaaggctgcagtgaaccgtgatcgtgccatcgcactccaggctagcgatctgcctcaaaaaataataaagaatagtattctgcccatttcagtattgagttggtgtttccccatcaccatcagtttttgaaacttgctttgatcaactcag

SEQ ID NO: 195822 - DNA, 484 bp, Homo sapiens
tgctttttccttttgatgtacaaaggatgtacattgtctatgtagggcaattatgggaacgtcccaactttggcatgctttccagagtaagcaactttacaggaagatggatgaagacaacaactcatcttcacgtcaactgtaaatttctctctatttgtgttgcaaatgttgaaactaaatttaaacattgcttggtgtgagggccttccagaggccacattctcatggaatactttgtatcccacttactttcttctgtcagaccctatgaatgattcccagttctgtatctatctttacagacactcctagttagtaaaatccaggctttgaccagaaagagtcaggacttccacccactactgaaaattatagcttaatcaataacacaattagacctccccaacaaactggatcctacgtgcctatatactacttaaggttcatttctggtttaataaagctctgttctcaacatcag

SEQ ID NO: 195823 - DNA, 428 bp, Homo sapiens
gtcatcccattagcatatgaaagacacacattactcctgtgattcttcaagttttaggtttgtgtgtcaggaactagggacaaagaccaaatatatttgttcttaccacatactaggtggcttaaatttatttctcatagtctggaggctgggaagtctaagatcaaggtcccagtgatttggttcctggtgagggctctcttcctgccttgcatatggctgccttctctccgtgtcctcacatggcctcatctgtgtgcatgcttgaagacagagagagatctgtctcttccatttcttataaggacacttataggaagaaatcaaatttgggccccaatccttatgacttcatttagcctttatccactcctcacaggcctgataacacttgcagactcacaggagtaatgtgtgtctttcatatg

SEQ ID NO: 195824 - DNA, 473 bp, Homo sapiens
gtcatcccattagcatatgaaagacacacattactcctgtgattcttcaagttttaggtttgtgtgtcaggaactagggacaaagaccaaatatatttgttcttaccacatactaggtggcttaaatttatttctcatagtctggaggctgggaagtctaagatcaaggtcccagtgatttggttcctggtgagggctctcttcctgccttgcatatggctgccttctctccgtgtcctcacatggcctcatctgtgtgcatgcttgaagacagagagagatctgtctcttccatttcttataaggacacttataggaagaaatcaaatttgggccccaatccttatgacttcatttagcctttatccactcctcacaggcctgataacacttgaacatatgaactttgaggagacatagactttcagtccgtaacaggtggcatgcagccaaattcaggccaatattgctgg

SEQ ID NO: 195825 - DNA, 424 bp, Homo sapiens
cgcttcaatgatctttgaatgccttcctctgcatgaaaccaagagaggttcaacatctccaattcactcatggtggaccattttgatgtatgtttcagcaaactaaccatactgctagagacctttctaactccatgagcagcaacaataaaaaataattcctgtttagtgggccaatatatcaataatttggcctgttcaatctttatgttccttccaccattatcctatacccttaataggcattcccacacatattcgcccgatttctgcttgtatatattccaaagattttttttggtgggggagtggaatacacttcctcacaggtaacactttgtatctcacctataaggtccttctgggattcttgtctacttataggtctggaaacaaaggggctggtggggggagaatcaacatt

SEQ ID NO: 195826 - DNA, 1236 bp, Homo sapiens
tctattaagtcgtgtcacagccaaactctcacccctaatgaggcacagctgggcccttggccctgaagaaatacgcgttggaaatgaactggaaaacacttggcctccctcaaacttcccaggagacagcttagcccctcgtgccccctgggagttggcttcttttccagcggccatcttcacaatcaagcaggaaaatgccattgttccaaagtacacaataggttctggtggttttcaaacatcctccatataccagtgcaaatggaggggcatctgaggcgaattccacaggatgttttaggagcccacaggccttgactttcttttctcggcagaagttttaagttccagtccccaggcttcattctttatattcttggtttggaagacagaggcagcagtaagaaaatagattatgtataaggaagacaaatagggcccaatgaattacccaaaccaaacaaacaaagtctgctttggaaataaggttttggagggaggtgagacctgtatgcatgagtgtataaaatcagagagaaatgtgtcaaaaacaaattacaaaccttccaaatacgggattacacatgaatggatggtaataatcacacatcactccaaggcaatctgtgtattacatcttgcatttcatcaaacaaggcttagctcttgggtcattaattagcaacctcggttccagataccaaaatatgaggaaggctatagtactcgggtcctgcttcaatattgtgatttgtttttcttatctacttctctttttcttcccttattttgctcacaatgccttctgaggaaagacaagacctttcttataaaaggaaaaatatccatgtctctacccacagagtccaccattaatggaaataggagattgctttcttcaaagtacacaattaaagtaacgtactaactcctttacacataacacaagaaagctagaggaagttttatgtatttatattacactttttccttcttcctcttttctcaatataggaatctttctgttttatgaaagctaagccactccatacaacgaacagtttactccaatacaaatagaaattatagaaaatataaaaatcctactaaaccttttaatctctaactttccaagcaggtgaattaatacagaggacattagagatttattttctttaagctccaacagtaaagagtgtttcaaagtcattctcaaagctgtagagattttta

SEQ ID NO: 195827 - DNA, 214 bp, Homo sapiens
cttccccctggtgagatggcagagggctgagtaaccaaggtcccagctgctctgatgggacccaaatacgacagaggcttaagcaggacaggagtttattcctccttcctgtgatagtgtgagcataggtaatcgtaaaaccactgatgacctggagccaggttccacttacctggattctgccctcttcaacttcaagctttcactcctaggt

SEQ ID NO: 195828 - DNA, 688 bp, Homo sapiens
gctccatgctcgacaaaagcagtgagatgaccaatggaacagttgggaatggataacaaaaaatacggagctctatccacagatgacctgttactttgatcctatttccctacatagtccaaggatctaaaatgagacctatcttgtctgccaaatcttccttacgtgtcatgagttgttccaaggtgactgttgtggaagataatgacaacccacacccctgagtacagtggaggtttaggaggtttggatctccacgtttaagtactgccaagtgtgtcctcctgtgtttcattgctacgtatctcactgtgttagaaatgggatcgaagatactttttcacacttgcttgtgaaagagaggcctttctccttgagctggtaagaagggtatgtatctaatttcaggttattaatgtaactttttggtgatgggtatccattctcccttctgacattttcctgagttcctctgacttgagggagcctagccaatgtcatgctacttcctctcatagaagctttgccagcttctgtggggtctgagccgcatcacatggggtagtgctggatacaaccttgatcagtttgactcttacctgtcagacattcctgtttgtgtccctattgtgttcattttcatgccagagtttgggatgatccaggtgaggtttcttgctctacctat

SEQ ID NO: 195829 - DNA, 326 bp, Homo sapiens
attacaaagtgaaaccagaaattaaccacatcccagcatccatgagggatttttgcaaatgcagtgtggacaggactacacagaacacatcactgattgctaggaaatgcttcacatccagagacaaataatgcctggaaaggaagcttggctgtgccacacaatagcccactagcaccctctcattcaaaagcatgggctcacaggcacggtggtgcacacctataatcctcagctactcgggaagctgagatgggaggactgtttaagcccaggagatcaagaccagcctgggcaacatagcaagacccctgtctctcttaaaa

SEQ ID NO: 195830 - DNA, 839 bp, Homo sapiens
gctcaggccacagcacctgcacccgttttctgctgctgcacacaagggctctgtgcattccgcatccaggtgtgcccctcctcttctggaggattctttttcaggctgtcccagagactttgcagcacagcatccttgctctatttcttcctgcaacatctctgctgaagctctattgcttttggcaactcttccgtctatttgtggtttaggtgtctcctacttttactaaaaatggaatttgtgtttttatcgctcaagtcctttttgcttttggattacttccagaaaatgaagggagggttactaactttatgccatcttcaaaccagaagatcttagattagtaagatcatgttggccatggcatggagaatgggctggaggtggagagactggaggttggaagtccagttaggagattgctcctgcgctggggagttggtgttaggacagaagatccaagacgcgtttcagagagcccctcttcttgggcctgcgattcctcacctggaagggagaagagtggacttcctgcctagagaacaccttggtaaactctttgtggttcctgtcatgagaaggtgtgcagcttagggaaaaagcctgtgagctctggaatcagatggaactggatatgaatttccatttagtgcttgttggattaaatgtgatgctacttctcccagccgaaagaataaacactggtacgaggacggcgaatgcgcctcagtaaggaggctccattctggagggttccaggccagagaagggagaagtattggacaccaagtatggggatgcaggctcacttaccgggatttgatctcaaagagctg

SEQ ID NO: 195831 - DNA, 497 bp, Homo sapiens
ggaaacacatcataagggcctccttataggacagtagtaagactaggtaataaaaccagtctcaatcacggcccttggaaaaggcataaactgcaagtcaagctagctgagttctggctttaggattacttagttgggtactgttgagcaagtcacttcacttctctgggcctcagttttcccacccgtgaaatggacaggagaacatatataaaaaaggctaatgcaatggtgctaatgcacacaatgtattcctccatcctttttcttggagatagtctaaattttcctgtatatttttgtgtcctgtagagatcagcaaatgtcagtcatttttgaaatgacatatttttaggccattttattggctattgtttcttgggaagagataaggaaaagcaaacaaaggcttatagatagagagagagcactgcttttgataagcacatggcccatagttgtttgtttttaacacagttaatacatagccaagaaaa

SEQ ID NO: 195832 - DNA, 119 bp, Homo sapiens
cttggcaccaaggtcacttaggttggcagaaagatatagcacagtaaacaactggcatgtagaggaggcatcctctttaggtaagcctcatgtgtgatagggagcgctatcttgtaaaa

SEQ ID NO: 195833 - DNA, 937 bp, Homo sapiens
agaggtggggctgcggtgggaagctgcatgaaggaaattttaggagatgccaaagactttgtgtttggaaacaagcagtctcagagaggtggctctgcatgtagatggcactgaaacacacgccatgtgcatgaagcgaggagaggcagtgtgggatgtgggctccagggagagaggaaaggaaatagaggtgcaaacccaggaaccccaggggagcatgcaccccgacctcaagaattgtctggtagctggggatactgggagcccaagcgcagccccttctgtgccctaaggggtaaagggctcttttgttttctcaactacctttaaggcacatggggactaactccggcatgtggctatgtattcagaacatacttaagaggtttaacttcagtaaactcagcctaagttagcccaaattagggatttcacagcactgactctataataatgaagaaaaatccatcttctgtgtagctgccagtaaaggccaaccccttctcatctcctatggagacagcatggactcactccattcaaagacagaaggggagacacacaaaaaaaatcctaccagaatcttacgaaaagttggaatgtctgtaatcacgcccacccagaaggtacccgggtcccctgggtttttagctcagcaagcactcagactgtcaaacagcagataatcagcagactccacagcaaaggtgtgacttacaaggccaacagctgatgtgagcgcacagagctcctaacccatttcaggacttaagaaacttgaaagaaaagttagccaaatatcaaggaaactttcctaatgcctgaagggcaattactgaaaaaaaccagctaagctacttatacagtttgtaacagggcctcggaagacggaaagttctggggcacgcacactccactccccaccaggcctggcagc

SEQ ID NO: 195834 - DNA, 121 bp, Homo sapiens
aggatccccccggtaacagctagatgaaaaagtgtaaggttgatcttcgcctttcctgggcattactcactgctgtcatgacctttatgcaatttgcagtaaacatcataaaggtctctct

SEQ ID NO: 195835 - DNA, 358 bp, Homo sapiens
tgtaaagggcgctttgctcctcgccattgctgggatatgtgcaggtggcttacaccagtgcgcttctgcacacacctttttctaacactgttctctctcttaaatgaagatgctttattcaaccttttggaaaatacctgtttgaccttgacccatgttaccatttttgtaaaatttttctgagtgtgacttggcagagtggattggcctttctgtgggtcccttaacattacatgtacttctgataatgcacttaccagagtgtattggaaatagtttcatttgttccttaagccgacacttccaaagtttcaggtgctatataaagagatcactggtttaagagacaaatggagca

SEQ ID NO: 195836 - DNA, 452 bp, Homo sapiens
taggaagacactccctccctccttccctggtgatttaattggtcatctactatgtgcccagcaaacagaacagcagagctcaccgtccagggtagtttagagatgaaatgaggtaaagcgtgcctagtatgcaggagtacccctggtacataataagcatttgacaggctgggcacagtggctcacgcctgtaatcccagcactttgggaggccgaggtgggcggatcacaaggtcaggagatcgagaccatcctggctaacacggtgaaaccccgtctctactgaaaatacaaaaacaaaattagccgggcgtggtggcgggtgcctgtagtctcagctacttgggaggctgaggcgggagaatgaagtgaacccgggaggcggagcttgcagtgagccaagatcgcgccactgcactccagcctgggccacagggcaagactccgtttca

SEQ ID NO: 195837 - DNA, 1110 bp, Homo sapiens
cttgatgccagtggagtcacacggtcaccaggtctacctccctttcctcctgtggaagagctcggtttgctcaggaacatgatggacattgctggcctgggcagagggcgtggccttgatggagaccacctctcctctccgtcatcctgagggggtgcaggagggagtccgcatcgccctccacacccgagaccacctctcatatccatctagtcatcctgagggggtgcaggggggagtctgcatcgccctccacacccctccttgggtgtcgtcatgtgggcagggagtgcacagcacccttgaatgtggggagcggcgcctgcctggaccttcctgcagcatggcggaatctgagctggtccttgagagaactcatctgtgggtggtgcacagactacagaccacatagcctgggcaccagagagaagctgctggcgtcagcggccccttctgtggctctggcctccatgcaccgagcagctggacacctgtctgtgcagggaatgacttgatttaaatgacataaaacgacaccaaatggtagaatggacactggcggtgcttgtctgtcatctctttcttattctttatttgtttctgttctgtgagaattgcctagtggtgtcatgctgaacctgcctctctgtgtaggtggcctttcttcagtgagtatttgcgaaagtgttgggaggtagtgagagtcgttgcatctttttctggcacttccttggtgggaccagccacttacatgcaccctgaaagtcaagacgctcgtcccgtcttccccctcggcggttttcagtaagcgagcgcgcagttgaacgtttctcacctgaacaagtccccttcgtcatgagacggggcagctataacattgccaaacacatttttctcaactaggagagctcaagcaagggacggagccctagggttgtctcgtggtgtccgcagggcttggttcttgggcgtctcgtggcgcctgcagggttctgttcttgggtgtgttgagtgccgtggggtgaatggaggcttggccttttgagaggctgctgtactgagcactcaggagccggcctgggggtcgtctggggctgacatcagcaggga

SEQ ID NO: 195838 - DNA, 613 bp, Homo sapiens
caagttgtcaatggaatactgcatgagaccaatcagttaactggaaacatttgtaaagcctatctgtttgaatgtagaaatcgatgtgaatactacctatttctatgttttattttttgtgtttttttcaaattaagagtttccaacaatgaagtctttctaataggctgacaacctactttaccttgcttagttgaaacagatgttgaaaaataccttttagggaggaatgcatttgggaaacagtggtgtgctagagctggctgtactggctcctgagagccacttattaaattattggaaatcttggtagaggatcgtcgctcatgcctgtaatctcagcatttggggaggctgaggcaataagtttgcttgaccccagtagttgagaacagtttgagcaacaagggagacttcctctctagttttaaaaaataaaaaaataaaaaatagcagtgagtcagtgcttttctcaagatcacagatgagcaactatgcagttataagaaaaatatatatttttgtaacactgtagtaaacaatggctttcttgtaaacaaactatagcacatcttcacagttttgtacaattaaatatgctacttctgtttaa

SEQ ID NO: 195839 - DNA, 430 bp, Homo sapiens
tgcaatttgtcacatacttaattccttgaggtttcttaaagctaacataaaaatacctcaggaggaaaagaggaccttaaagtaaaatcaaaattaagtactactgtcccagttgtacttctggggtgttgcttctccagatgcttctccagatgcagggcgcgacagtgtgagaaggtgcgaggagactcacttgcctcccctcccctcatccctgtctccaggtgaggaatgcgatgccagtgccagggtggagcacgcagctgctgtgtgcagtgtgtggacgctcgtttttccaacttcagcacaccaggctcctcagcctacttctgtttggaaaaacagcgggtctaaaattctcctcttactcccattgcctgtgcaggagagcacagcccccttgcacccctgcagcctggcagctggggct

SEQ ID NO: 195840 - DNA, 139 bp, Homo sapiens
acagtgcaccggcaggcatcactcgtgacaggtggaacaacagtggaaatgcagagtggctcaaggagcctggtcacgcgccaatggctcagcccccctcttccactgcggaggacctgcctatctcatctcttctcag

SEQ ID NO: 195841 - DNA, 357 bp, Homo sapiens
cggcgaggggatgtgattatatttctatgtgaatcgtgagaatcttgaaccatggttgtcctgctggcctgttttactacataccaatgagtaaaatgtgatcatacagaaatcacaaagttgaaatctataaaatgaaaagatctctgtattataaggtgagagtgccaaggattgaacattcatctttgtcagactttgatgtagaatctcccaaaataatgatgagctaaagcgtctgggagacagcatcagcctgtccaggtgctctcaggtgcaggcatttccaccccattcattcgttattgacacgttcatgcattttcagtctttttcctacccatgtatattttacat

SEQ ID NO: 195842 - DNA, 369 bp, Homo sapiens
tcaaaataatgtatacacaacaacaatacacatatcaataacaacatgcatacgacaataataacaaatgcatgcaacaatagtaacaactatatgcatacaacaacaaaaatatgcatacaatatgcataaaacaacaacaaaactatgcataccacaatagcaaccatatacatacaataatactgacagtagctatattactgagcgcttactgtgtattttacatagaggttgctttgcactcatgagtaactattatccctaatttagaaaccaagacagcaagcaaattgctggagatcacacagctacaaagcagaagagccaggtttcagattgtgctcttaattataaccctactatgcc

SEQ ID NO: 195843 - DNA, 713 bp, Homo sapiens
atccccttcccaaacacctaaaaagtcatctagtccaactccctgtttaacagataagaaaactgaggtcacacccttgtctactcagaagacaagagtcaccaaaaacaatgatctctaccagagtgtaggaagtaaatattagaactatgtttatttttaaaactaaaaggaaacaaaattagctttacaaatatttaatgtgtatattttcagtagaatcctaacttggtccttatgacaagatcccatgacacaaacagttcaagggatatcacaagagaggagtagacgttctacaaagaagagcctggacagtgactgtcattccttttttcacttccagcatttgtgatgttctacagtttgtacatgcctggttgagtggattaacagattatataacccagttgataccaaagctacactcactaaataagcaagtagctttaaaaatatgtcttcaaagcaattggagactgtaaaaaatacaaatcatataagcataagaaaacagtagaacacacacctctaatcttagtaggagtctttaccagctacatcagaaaacaaaagaggagcagtgtgatcacatgttgggcgagtattatccccaacaccaaagaaaataattttctcattgcaacagaaatatctaagacaactcgtgtggggtacatcatacgccacaccatttcatggaattatgtggg

SEQ ID NO: 195844 - DNA, 443 bp, Homo sapiens
ttcaataacattatacattgcaaagcaccttgcattgttttaccttttataaaagcccattgatataaatggatattaatataaaatcccatataaaatgatgatataagaaaacctatgacccttgcaacgtcatatcacatattactaataaatgggagtttagaaatcagaactctagattctatcatcttatttcattatgtaatctcttaaagtgtcaaaataaactggaagagtagggatatacatattgttaaaagaaattttgttcaaccagagtgttacagagagaaaaaaggagagcttaataataaaactgtgtcttcatggaatttttcatgtggatgcattgatggaaaggcattctaggaaaaggcaacaacatgagtgaaggcccagaaacctgaaagctctgggaaatgttgcttagtccatgtcta

SEQ ID NO: 195845 - DNA, 471 bp, Homo sapiens
atttcatcatcttcacagattctgtgagtctgtgagggattccgggggaatttggacagaacacagagagggtggcttgtctctgccctgcaatgtctgggcctcagctgggaagactcaaatggttgggggctgaaccgtctggaggcatttttgcttacctggcacgtggctggaagactgggctaggctgagccagtaccagagcaccaacatgtggcctctccaacatggtggcctcaaaggagttgggtttcttttatagtggctcagggctcaagagtgtgtgttcccagagaacaaggtgaagctacataaccttctatatcctaagcctcagaagtcacatttcttcccatggtactctatgatagaagactgcccaggttcaagtggaggtgttgtagaccccccacctcttgatgggaagagagtggaagaatttgtggccatatttataaaccactacag

SEQ ID NO: 195846 - DNA, 1119 bp, Homo sapiens
cctcccactccccacacaggcttcttctggtcatgctgccgtcctagccatcactagcaggagatactcggctttgaacttactgcttccttctactctttctttcttagctgcctgaccacctttgctcattcttcaaagcacaggccaaggttcaccctcagccctcctccccatcccagagatggacaaagtatctcctcaccatgcattgcccacacacacctcaaccaggattcttcttgtaatgatgctcacgttcaggtttttagccacttgtggtagactggaggtggtatcatttattctattttataaacaatgtttatagtttgtatgacagttatggtataaactatgtttataaattaagagtttagtgttgggcatggtggttcacacctgtaattccagcactttgggaggctgaggtgggaggatcgcttgaggccaggggttcgagaccagcctgggcaacatagcaagatcctggcactacaaaaaatttttagaagttagtcgaatgtggtggtgcgtgcctatagtcccagctacaggggaggccaacgcaggaagatcacttgagcccaggagtttgaggctgcagtgagttatgattgtgccactgcactccagcctgggtaacagagtgagaccctgtctctaaaaataataataataataataataatttttgaaaagcatttagactatgggccagacaactgaggtagggcaagttattttaacttatgtgccttagtttgtataaaataggagtgacaatggccacgccacagagctgctctagggattaaatacattagtaggaaacagtcccttgcacagagcaaatgctaaataatctgctatgatcacttttatcatctccattctttcctggaacacaggctgtcttttctgtgcagcgtttgccttctcgtagaccacatggatgcctactaggagatgtttgggagttccatgaggaagttagaagggcaaatggcattaatgggagcttcaacaaggacagggtgtccaaaattgtatagatgttgtataaaataaggacaaaaatgcttgctggatttggtaactggcaggtcaccgacatct

SEQ ID NO: 195847 - DNA, 352 bp, Homo sapiens
  misc_feature (39)..(39): n is a, c, g, or t
  misc_feature (55)..(55): n is a, c, g, or t
  misc_feature (71)..(72): n is a, c, g, or t
tgacttagaggatcgcgtatccgtacattgtaaagtggnctctgttgtgtctgtnggctggctccggtccnngaaggctgttgactggcgtctcttctggtagagcagtcagcggaaacctaagtgaagaaaggaaagaagtctgtacccttgagccctgtcacacgttagaaaatggagacgggtttgagctgagcactccttgtcagaccccttcaggtgttactcacacaatgcaggggttcagttgcttggtgggtatcaacccaatgaccacaaccaaggaggatttaacaatgagatttaagtaaggagaacaccagggatggttcccaaagtagtgcctctgagc

SEQ ID NO: 195848 - DNA, 321 bp, Homo sapiens
taagcagaaactgctttacgctgttactagaactgtcgaagcagtgtgagagctcctaattctgagcctcctctcattttgctgttgtctcaattaagttacttttctatgatttgtggctcattagcgtcagtgactcctaactgcctattctcatccttgagtctttccagccatatgtgaatgatacatgctcagagtcccttctaattatgataatttcctcttgtcctcctgaatgctggtgacagcgctaatagcaagatggaagtgaagctttggatagaaattctatgtcttgaaactccttgggacctcttc

SEQ ID NO: 195849 - DNA, 503 bp, Homo sapiens
aaacaaacaaccctaaaaattcaaatggaaccaaaaaacagcctgaatagccaaaacaatcctaaacaaaaggaacaaagctggaggcatcacattatctgacttcaaattatattgcaaggctatagtaaacaaaagagcatgatactggtatacaaatagatatatagatcaacagaacagaatagagaagtcagaaataaagccacatgcctgcaagcaactgatctttggcaaagttgacaaaaacatacactggagaaaggacatcctattcaataaacagtgctgggaaaactggcaagctgtatgtagaagaataaaactggaacccctatctctcaccatatacaaaaattaactcaagatgaattaaagacttaaatgtaagacataaagctataaaaatcctaaaaggaagcctagcaaaattagacttgaaatactaagagctgattttgaaatactgagagatacgttttatgttataaaatacaaagaag

SEQ ID NO: 195850 - DNA, 623 bp, Homo sapiens
agaaaataaaacagtaaactaggcaggaatatgactgggattgacagacgattttaggtaggctggaaggagcatctttttgagatagtgattaagttttagccatgaagtacgagaaagaagccagccttatgaagatgtagtatagaggaaacggcaaatacagtgtctccaaggcaaaattaagcctggacctgttctaggaacagaaggaagccagtgtggctagaacaaggactatagtaacagaaaatgaagttggagaagtaggcaggggccacatgtagggccttttgggccacagtaaggactttggatttattttgaggctaacgggaaaccatcggaagttttaagctgagtctgtcaggatatgatttacattttaaaagatcattctggatgctgtatggaggatgtaaggaactcaaagtacggccaggcacggtggctcatgcccgtaatcccagcaactttgggaggccgaggcaggtggatcgcttgagctcgggagttcaagaccagcctggccaacatgacgaaaccccgtctccactaaaaatacaaaaattagctgggtatgggggtaggcacctgtaatcccagctacttggaggctgagg

SEQ ID NO: 195851 - DNA, 677 bp, Homo sapiens
cccttagtaaaaacaccagaaatttatcaaagagatgaaagcatcttgctaaaaaggaggaatgaagcagaactcatttttcatgaagctgtaagccaaattttcatttttcatatgtttattatttttaaaactgttactaccatgactttaattactgaataagtactacatgtattgtgcactgagcatctattacataactaaacaccttcaatgacatatcaagctataaagtactttctcatgaggaaaaatgggctcagaaatttctagctgataaagcttagaacttcagccctggtccatgtattcccaaatcccaagttcattattcaattcctttaattattctcatgctgaaatataggccattgtcactaaatacaattttatatttttgtattaaattactgctgatcatctatgggctatgtagtaactttacctgcaatattaatatgatttgaattataatctcaaaatttcataaaattgaaaagttgtaatttaccccttgtattagtctgttctgtatttcgataaaggaattcctgagacaaggtaatttataaagaaaagaggtttatttggcttatagttctgcaggctgtacaagaagtatgactctagcatctgcttctggtgagggcttcaaaaagcttttactcacagca

SEQ ID NO: 195852 - DNA, 670 bp, Homo sapiens
aacactcttcagaaaatcttaaaagaattgtctgctacagaaacataaaggaaacaaagaagcaataaaacatggttttggtcccacagtgaggaccagggaagaaaggagtcttggtcaaattgcagaagaaaggaatttaaccaaactgattcctggactacttagaagaaaaagaaagatggtgattggaaagctggctgcaactgtcaaatattcctaagagttacctcagcagcatgccccagtactcagtaaattctcacccatagtcctttgtttcccatcgtctacaccacaggccacagaatcttcagtactgcttggagccggggaactccctttatccagtacatagcagataggaagcaactctggatatgttccacacagctatatgcggcagttcagttcaagagtaccaccagggctttaataatactttgcataaatgctggattaaatatgcttttaaaacctaacttctaccaacctagacatacactaggtaaaaaggccaaagaagtatccccaatacccatgtctgctgcgtgataactgtccaatcaatagtgtcgcgcgacactcttggttgtaggagtgaaggcgttgcgctgctgagggttgatagctggtcacagaaggagcttgtcatgctgtcattttgtca

SEQ ID NO: 195853 - DNA, 481 bp, Homo sapiens
ccgcctcagcctcccaaagtgctgggattagcggccttagccaccgtgcccagcctgtcttcatggaagctttttcttaagattgtgaaatgggctcctgaaggaaaacgccgatgttaaaatttgtgttttgaaaagggagttggtgtacatttacagttagggtgtacagtactggacttatgggtaaatagtgtagaaatggtaacctatggttttcttttggggagcattggttcattgtattttcatgttgctatctatctgataacattagtctcaaatagtattaggtgattaagcagttgctggtgagattattaattaagaaaatatgaagattatttttcatgattagcaaatggacgtattagttttgtggaaagtttcagtgaactgcatactgaataaggtctttggagcaagcattgttattgataaggtttttgcataagttattttctaatctgaagtgatagtc

SEQ ID NO: 195854 - DNA, 179 bp, Homo sapiens
ccccgccgcgtcctgctgcccatcctgcccgggttgtcgcgggccgggggcacgacaagaggccggggtctgcccggacgcagcggcctgcagggcgcagctgtccctccaccagccggggtcccctcgctcagcccatgagacaaataaatgaatacataaataaataaataaataaa

SEQ ID NO: 195855 - DNA, 237 bp, Homo sapiens
agccaggtgtggtggtgcatgcctgtggtcccagctactctggaggctgaggtgggaggattgcttgagcccaggaggttgaggctacagtgagccatgatcgctcaaatacactccagcctggtgacagtgagatcttatctcaaaagaacaacaaaaaaagaggaatcctttagccccctgagactcagctctgctagcagtcttggtactttgtaaatgacacatctctttgct

SEQ ID NO: 195856 - DNA, 409 bp, Homo sapiens
  misc_feature (18)..(18): n is a, c, g, or t
tctatatgatcccccccnatatgaatccatggagatattatctaaggttgaagtttcaaaaatgatttaagattatatataaatgtcacaagaggggaattaagaataaaagggggtaaagggagtaggtggtgataggaatttagatggtagctaatgatatcctgtaatgatggtttggcatattagaaaccctaaggaggtaactgtgagaataaatatgttgtcacagggatgaaggggatccttgcgttttacccttctgttatttaacattgtacatggaatacctcagaaaaatttactgacgtagtttactaagtgtcagaactaatcgtatcaaatatatttttttcatttttttattcattggttatctaaagtgggatatacatttaaaaagttatgg

SEQ ID NO: 195857 - DNA, 360 bp, Homo sapiens
  misc_feature (18)..(18): n is a, c, g, or t
tctatatgatcccccccnatatgaatccatggagatattatctaaggttgaagtttcaaaaatgatttaagattatatataaatgtcacaagaggggaattaagaataaaagggggtaaagggagtaggtggtgataggaatttagatggtagctaatgatatcctgtaatgatggtttggcatattagaaaccctaaggaggtaactgtgagaataaatatgttgtcacagggatgaaggcgaccgggtgcgtcccagtcttgacgtagttaaacgatcgacctggacacgtcagcaagactgcaggacgatctttagaggaatctgctccacgatctagatcgctagctacatatacg

SEQ ID NO: 195858 - DNA, 307 bp, Homo sapiens
aaataaataaataaatccaaagatttcagattataaaatatctgaatccacaaataatttataaaatgctcccatgtacataggaaaaaaaatagttactacgtagaagagaaaggaaacggctcaacagtaaataatcaattcctctttgaccagtttgatagcttcaaagttattttaagtggtctacacttatgtttaagtcatatacaactcccagataataattccagggtagtgttccccaagcttgccttgactgacatgcttaaaaatgaagatccccactccgactcagacctccaaa

SEQ ID NO: 195859 - DNA, 430 bp, Homo sapiens
tgggactgttttcatccctcagaggacctgcctgtgggccatgaggatgatggtggtttccccaaggccacacagcatggccctgtctgattcctattcccccagggacatggtgtaggaacatttgggattggggaagactgggcctggtgatccccaacctgtgcttcctccaggtttcctttgaacatggccatctctggctttgtcacctgtgcaggttacttccccttccctgggcctcagattctgtgtccctaaaacaaggtccttgccagctccaagtcactcaatggaaaacccaagctagaggccgggcacaatggctcacgcctgtaatcccagcattttgggaagccgaggcgggtggatcacttgaggtcagaagtttgagaccagcctgggcaacataatgagaccccatctctac

SEQ ID NO: 195860 - DNA, 731 bp, Homo sapiens
ttcaagatgatgttagagagatgacagagtctaggttagggagggcctgagtccttgtagactctgagtacggtgctgagcagggaagagacaggctctggcttagggtttagaaggaacacaggctactgcgatgaggattgtctgaaggggaacaaaggccaagatgttgtttgaagccgtgagactgagtgagatcatggaggaagtgaatgtaaatagaaaagggaagaagtctgaagacggagccctgagacactccattgtaaactggaagatgaggaagagccagcaaaggagactgagaaggggcagccagtgaagatggagccagggctagagtaagagccccttctgggatgctgtgacccccaagtttgaagactgctgataaccccaatctacgaagactagctatggaacttcctacactgagacaactccagtggaactctgataattatcctaaaataaggaggcttcttcagtagccctcgaaatatgttcaaatacatgattacatttatgtccttaatattgctattagtttctgatgttaatgtaaaagttggggaaaaagtggaaaagttaaagcagtgcaggttaattcaatgccagagtaacttctcagagggtgtatattcagtgtgaacaattttcaacagagaaatgtcaacttctggccacaacggcaaccagtaaaatgactatttttactgtcttatctatta

SEQ ID NO: 195861 - DNA, 767 bp, Homo sapiens
tgagctgaaatatgagttgtccaactcttgtaagtgcatgctccatcacatcatcctgagtcagtaatgaggatgccattgtacccttcaagcagccctggagagtttatctctgcatgctggagctaataataatagaatctcaagagccttcaaacatccatattatgctgatgtcttttaaggtgattcaactcagcatatgttgtttgaagccgtgagactgagtgagatcatggaggaagtgaatgtaaatagaaaagggaagaagtctgaagacggagccctgagacactccattgtaaactggaagatgaggaagagccagcaaaggagactgagaaggggcagccagtgaagatggagccagggctagagtaagagccccttctgggatgctgtgacccccaagtttgaagactgctgataaccccaatctacgaagactagctatggaacttcctacactgagacaactccagtggaactctgataattatcctaaaataaggaggcttcttcagtagccctcgaaatatgttcaaatacatgattacatttatgtccttaatattgctattagtttctgatgttaatgtaaaagttggggaaaaagtggaaaagttaaagcagtgcaggttaattcaatgccagagtaacttctcagagggtgtatattcagtgtgaacaattttcaacagagaaatgtcaacttctggccacaacggcaaccagtaaaatgactatttttactgtcttatctatta

SEQ ID NO: 195862 - DNA, 427 bp, Homo sapiens
tgagctgaaatatgagttgtccaactcttgtaagtgcatgctccatcacatcatcctgagtcagtaatgaggatgccattgtacccttcaagcagccctggagagtttatctctgcatgctggagctaataataatagaatctcaagagccttcaaacatccatattatgctgatgtcttttaaggtgattcaactcagcatatgttgtttgaagccgtgagactgagtgagatcatggaggaagtgaatgtaaatagaaaagggaagaagtctgaagacggagccctgagacactccattgtaaactggaagatgaggaagagccagcaaaggagactgagaaggggcagccagtgaagatggaggtaaccaggagagtgtggtgtctgaaagccaagcagcaaagggtttccatgaggaaggaga

SEQ ID NO: 195863 - DNA, 423 bp, Homo sapiens
cttaaaatccctagtgtttagcttagaatacattgctctgtaaagagttctccattggttcttccttctttatttaatagagctaatctgtcatcacttccaaacagttcttacctaagacatgcctcatccttggtaatcacactttcacgatcctatttcttttttctgtttgtttgtttgttttgttttttaaacggagtctcactctgttgcccaggctggggtacagtggcacaatctcggctcactgcaacctctgcctcctaggttcaagtgattctcctgcttcagcctaccaagtacctgggattacaggcatgtcctgccacacccggctgacttttgtatttttagtagagacggggtttcaccatgttgcccaggctggcgttgaactcctgacctcaggtgatccacctc

SEQ ID NO: 195864 - DNA, 158 bp, Homo sapiens
gtgaggtgtggactgtgagttgtgactgtgaggtgtgactgtgaggcgtggactgtgaggcgtgactgaggcgtgactgtgaggcgtgactgtgaggcgtggactgtgaggcgtggactgtgaggtgtgactgtgaggtgtgcctgtgaggcgtggac

SEQ ID NO: 195865 - DNA, 1146 bp, Homo sapiens
  misc_feature (24)..(24): n is a, c, g, or t
ctgcagaggcttcaggagcagctnactaaggatacagagtcaatgactgggtctcccctgcagcacctccttcaggcgaagcagagccaagtactggtagtggtcaagcctgaaggaggtgctgcagaggcttcaggagcagctgactaaggatacagagtcaatgactgggtctcccctgcagaatcagacagcttgcattggagttctctttcccagtgctgaagtggctctgcttatgcatcctgcacccggtgctgtcgatgctgactctgcaggctcagatagcactagcctcgtagattcagagctatctccttcagaggatcgggaactgaagtctgatgcctcatcagaccagggcccagcaagccctgagaaggtcttggaggaaagtagcattgaaaatcaggatgtatcccaggagaggccacatagcaatggagaactgcaggactcaggtccacttgcccagcagctggcagggaagggccatgaggcagtagagtccctacaggccaagaaactgagcagaacccaagcctccagctcaccagctgcattgaagcccccagctggcagggagactgctgtgaatggacagggtgagctcatccccttgaagaacattgagggagaattgtcaagtgctattcacatgaccaaggatgccaccaaggaggctctacatgccaccatggacctcaccaaggaagctgtgtccctgactaaggatgccttcagtttgggcagagatcgaatgacctccaccatgcacaagatgttgtccctgcccccagccaaggagcccatggccaagacagatgagggggtggcagccccagtgagtggaggtgctgcacgactccgatttttctccatgaagaggacggtatctcaacagtcatttgatggtgtctcattggatagcagtggccctgaagaccggatttcagtggacagtgatggcagtgatagctttgtgatgctcttggagtctgagtctggtccagaatctgttccaccaggatctctttcaaatgtctcagataatgctggtgttcaagggagccctcttgtgaataattatggccaggggtcaccagcagccaacagttcagtttcacccagtggagaagacctcat

SEQ ID NO: 195866 - DNA, 369 bp, Homo sapiens
tataagactggaggagatgcaaaacacacatacgcaactttaacagcacacctaaatatacgtgtagaaggtactgggagaacacagcacacaggatctaaataggggtgaggaagaaactagaaaggtttcaccaagcagattgaatgagattcaccaagatggtatggatggaatggaggaaagacatttaaggagaggaaagagcatggcaggtggggtcgtaaaagaagacagtgaagggagaggggcaaggatagggaaaggggcaaggatatggagagaggcaaggatagggagaagggtgtggctggagcaaaaggtgtttaggtacatgctgggaagcggagaagatgaggccagttatat

SEQ ID NO: 195867 - DNA, 434 bp, Homo sapiens
aagaactcctccttccaccatttttatcatagtctgtatcaagtatcctatttactctgttaatttcttgtgcacatatgagtctatcataccatgctattcaacatatatgattatcttccccaataggctgtgaatgtcttgaagctacccacagggtcctattaatctttgtgttaccaatttccatccaaaaatgggcaaatagtagttagtattcaaacattgaatggtatgcaggttttagatgttcataatgatgttattccaacatggtgctgcatcacattattaatgattattttaaaaagaaattgattattcaatacctaaatgagttccataagtagaaaattgtatagtagttgaaaacttggtttaaaaatttcaaggaaagggtgatatttgaactttatggtacaagatttgactaa

SEQ ID NO: 195868 - DNA, 290 bp, Homo sapiens
aatgaaaagattcactgaagaaggattcaatcatgctgtactacttcctggagttggcagagaaatcatccatttcttggtagttgaaagaaggctgatccaagaacacagtgaagagatgttcccatttctcaaggtgtttcatcttcctggccatgatgatttagcacctgcaaaattcccaaacctacgcaatgtggttaatgcggggaagcagacattggactaccaacttccaaagagtcactatctcgactagcagatcatgaggtagatgaggcagtttcaag

SEQ ID NO: 195869 - DNA, 601 bp, Homo sapiens
gcgcccggccgacaggtaaattcttatatcaaaaaactgagttagacttggccctggagctgttttccatccctaaaaagatgatgtcaagctatcatgtataataaataacaactcaattgaccacatattttcctttaagcctaatgatgaaataatattataatgaaatacttagaagttttaagggaaaaaatcctttaagtcattaaattaaaattgaaaccaaaacaataacttcactgttttaggataaaattggcatatgaaaggtttgatagtgaacgacagtaagattaacctactacagcatttgcctttagcttttactgagtaatacttggagctatatatttatagcatttgctataaatgtgcaaacgaagacattatttattgtattactgctgagattaatattgtctttttcagatttctaaaacattacagcaaatgcgcacatgagggcgctctaatcagctagatgtggagagggtaggcatttgttgactgttaagtcaaaactagttctatacttttacagatggaaaaatcaaggtccaccaaagaggttatgattctacacgagttattctctaga

SEQ ID NO: 195870 - DNA, 255 bp, Homo sapiens
agcagagagacatgtgtgttcaaattcctcactcaaaacaattagagcagtccaacgttgggactgtgggtttgccacccgtatctgggattgcaggttcctccgagacagtttacttaccaatatggtaagatgcaatgctaagagatgaatagttatgaggcagttaccaagtagctttgtttcatacttagagaatgtcagaaaaagtattatgaggaataggattgtatttttgttgttattgtttattgg

SEQ ID NO: 195871 - DNA, 486 bp, Homo sapiens
taattgggcatggattgggtatacatttattagaaaaagactggaaggttggaataaccggagtacagagtgtgtagtggtgtggaggctggaggtatggaagcatagtgaaggagttgggaccctgctggaagtgttaggggcattgtgaaatggttggaactttgttggagatggaggggggtgaaagtggaggaggagttgcatggtaggtagaataatggctcataaagctgtccacatcctaatctcaggactatgttatgttacatggcaggggagttaaggcagcagatggaatgaggttgctaatcagctgattttaaaatagggagattatcctggattatctgggtgggctctgagtaatcacaagggttcttaaaagtagaagagagaggcagaatagtcagtgtcagagtgatgtgaggtgagaaagactctagctgccattgctggctttgaagatggaagggtgcactagtc

SEQ ID NO: 195872 - DNA, 434 bp, Homo sapiens
atttattgtagtacctttttaaattactatagctttttagtacctattttttggtaggctgtcttatttttttcactcctttttatagtttttctgagttatctcacatgcctctttttcccatatgagctttagaaacagcttgtcttgttactaaaaaaagaagaagatccagctataatttttgttgttgtatttactgctagcaagagatttttgaaggaaaaaaatactgtctccagagatgccaaaggctttagataacattagacattattattatcttagtagattttctagtattgttctagtcttatgatgaagaaccgtctccagttggtcatggtggattattcttttaatgtgatggattttatttgctaacatttaagatggtttcatctattcataaaattacttgcattcgtgtgtat

SEQ ID NO: 195873 - DNA, 183 bp, Homo sapiens
ttctgtctcttcacaatgtgataaataattatctgtaagatacggtaacaatgactgaaatctgccaaaaaatacaggatctaaattctttctgattttatactgaacaaaatattttagactagaaatacttgtacccatcttgcaatccaaaaatataaagcttatccacttgcatcacag

SEQ ID NO: 195874 - DNA, 155 bp, Homo sapiens
atgtactacccataagtatccacaactttcctcaggaaaaactgagtatttctccagaaagtatttgtcctgcataattgttttttaagtacaaagcaaaacaagccttttgcttccttgaataaggaattattgcctacatactgctagccaag

SEQ ID NO: 195875 - DNA, 607 bp, Homo sapiens
tatacacacccatgatggagaaaaactatagcacaatgaaaaattagaaatcaagaagtttttatattttctacggagaaaatctgtgaaaccaatgaatcaatttgtagggagttataacagtaaaagggttacaaactatgcacatttaagaaccacattttaaaggagcaaaagattaagtctggatattttttaaaatcatggttttaaacctttgtcaagttttaatttttatattcctactttctagttcttgacactaactcaacattgctaatatagttatcaagtggttaacttattcttccttttattcaattcagagaaaagtataaaaagtaaggctttaaaaattttaaaggaaacagataagctttataatatttttgtgtgttttataatctcagattaacaaaattcaagcaacagcatactaattcctttagcacaaaaacattttttattttttagagacaaggtcttgctctgtagcccaggctggagtgcagtctgaaactctacaatgaatgatgaaaaaattatactattttcccttccttcaccttgaagtgcatagctcactgcaaaccgaatccctggtttc

SEQ ID NO: 195876 - DNA, 415 bp, Homo sapiens
cttcagaaagatccagggtcagggactaagaagacaggcgctcgtccactgctagagaagcctcaaagtgcattctggggttcccactgtccttcaggtttggatcctcctggaagttttatttgacccaagtcacgtgtaggttagaggcacaggggcaggctgctaccaaaggagacagtgtagcaggttctcagaggcaagggcagccccccccgtttgcttctcctcctttttccttcctccatccttcctcttcctttctgtccctccacccctctcccttcctttgtcctccaacttgagatgtatgaaggcttttggtctccctgggagtgggtggaggcagccagggcttacctgtacactgacttgagaccagttgaataaaagtgcacaccatcaccaccaggaa

SEQ ID NO: 195877 - DNA, 289 bp, Homo sapiens
gtgtttaagggcatttcacagatgggaaataaggtgcagagggctagagagatgggctcaaggctgtggtgccagtgacactggcttcccctgtgttgtcctttgctcttgaacatcacgccacgcagcagcagaacaaagataaagaaccaattccaaaaccaggcgtggtggcttatgcctataatcccagcactttgggtggccaaggtgggaggatcacttgagtccagaagtttgagaccagcctgggcaacacagtgagaccccatctcaaaaaaaaaaaaaa

SEQ ID NO: 195878 - DNA, 542 bp, Homo sapiens
ctccaagggcaggagaagatggatgacccagctcaaggagagagagtaaattcactctcctctgcctctgtgttctatctgggccctcagtggattgtgtgatgcccacccacatgggcaagggcagatgttctttactcagtttacttacttaaatgccgctctctctggaagcatccttgcagacacacccccataatgtctaccagctatctaggtgtcttttatccctctcaagttgacacatacaattaaccagcacactcagtgagttgctaactctaaaaacctctatttctaattctaacctttctcctaccttatccttctcctataatcaggcttccatccttccattttacaaatatttgtcaagagccttttgtgtgccaatattttttctagattgcattcaaagacaaatcaagcagaatcctccatgaaaactcatacatccatttgcggttggatatctccaattgaatgacatacactcgacttacattgaactcattctataactcttctcccacacagatcag

SEQ ID NO: 195879 - DNA, 313 bp, Homo sapiens
gaaatgcccatacaatcatataaacagtttcttgtaacacagaacaacctaataagaacatgcatctaatgaaacaaaagcccaaagatgaaaagacaaaacaggtaaattgaaaagaaaggcttcagcgttaaggaaaccaattaagaagaacaatgaatttgaaagaaaaaaaaaaaaaagcaaggaaaagaagcaaagacttaaacaaatggcaaggagaaaaatcttaaggtaacaagagtatatcgaggaggctaaggtgggttgatcacttgagaccaggggggggaggtttgaacattcggggggt

SEQ ID NO: 195880 - DNA, 188 bp, Homo sapiens
gaaaaattaagtcagccgagcaaggtgatagaacaaattagtctaaaaggagattttttgactattctagattattgataatttcatgaataacatttgtttacattttgttagaatcattttgtaactacttcttaaagtaggtagatccggagtttgacaaaatagggatcaagtaagtagttagt

SEQ ID NO: 195881 - DNA, 567 bp, Homo sapiens
tagagacggggtttcatcatgttgcccaggctggtctggaactcctgaactcaagctatttgcaggcctcagcctcccaaaatgctgggattacaggttgagccactgcgcccagctgttcatattctgaaacaacttcttaagcctgtttttctcaattaaatttttgatttcttattgagtacaaaatgcagttcttcaagcagccttcttgggcccaaaacatagcctcaaaaaaatttgggaatgttaagaaaatcaataaatgtcctggggcaaaagtttgcttctgccagattttagaaggaaatgcagatgactttgactttatctgtgataatataacctttttttcaattctccagtggttcagttaagagagctgcttatttaaagcttaaacattcataagagaggaaagtgcaggaacaacccttgtagaaaaataaatctatctaaacactgttgtctcagagtaatagattaactttttaacaccttctaactacctcaaaataattctcagattaagcttttaacaccttctaactacctcagaaataattc

SEQ ID NO: 195882 - DNA, 484 bp, Homo sapiens
ttacgccattctcctgcctcagcctccccagcagctgggactacaggcgcacgctgccacgcccggttgatttttttgtatttttagtagagacggggtttcaccgtgttagccaggatggtctcgatctcctgacctcatgatccacccgcctcggcctcccaaagtgctgggattacaggcgtgagccaccgtgcctggcttgtttttgtttttaaatagagacagggttttgccatgttgcccaggctggtcttgaattcctcgactcaagcagtccttctgcctgcacctcccaaagttctgggaatacaagtatgagccacccctctgagccctggttctaattattctctccacatttatatgtgtttagaattcctcatcacacaaagcaagtcatgaaggaaagatctaggtgcatataatagggaggttatacctgacaaggctttgggaaagacttcctgatgggatagacact

SEQ ID NO: 195883 - DNA, 335 bp, Homo sapiens
cagcctccaccttacttgctaaaagacttcccccttgaagccatcagctgctatataagaagtctaattcccctaaggctatcattaatccttgcaaagagctatatggagagatccttatgacacgacaaagagtaacatcagtccccttgctgttccattgcctctctgcccaccggcctctttcatctgatcacaaacacatgaaagactccaagccaaaactgcccagtggattctttctcaaattcttgatcctgacagaaataattgaaagaaataataaaataactgttgctgtttttagcttctaagtttgagatgatttgttatgc

SEQ ID NO: 195884 - DNA, 303 bp, Homo sapiens
gtgcgaccggaaggtagctgttactgtggacaaatcactttccccctcacctgcactggatgagaccgggaatctccactctgggttctttaagagtcctggggctccacagagtacacccagtagcagcagtgggatggggggacagggtcaggggagctccatgcctccctcaactttaatcagagcatctccactttaaccccttcctgggcccagtgttcagagagaacgggaaggaagctcagcctggccatgggctactctagcctgtcagtaacagctacctttccggtcgagccc

SEQ ID NO: 195885 - DNA, 526 bp, Homo sapiens
tgctttgcctttatttcatcatcagtgaggttgaacatctgtttatagatttgcagcccattatttttctttgtaaattgtctattcatatcctttgccaactttcttctacaagtattttccttattttcttgttgattttacatgagcccttcatgtatgaaggatattaactctttgcagtactttgttgtgtattgtattacaggttgaatatcccttatccaaaatgcttggggccaggcacggtggctcacgcctgtaatcctagcacattgggaggccgaggcaggtggattgcctgagctcaggagtttgagaccagcctgggccatatggtgaaaccccatctctactaaaatacaaaaagtagccaggtgtggtggtgggtgcctgtagtcccagctactctggaggccaaggcaggagaatcacttgaatcgggaaggtggaggttgcagtgagctgagatagtaccattgcactccagcctgggcaacagagtgagactctgtctccaaaaaaa

SEQ ID NO: 195886 - DNA, 441 bp, Homo sapiens
gtgaagccacagagatacacaagcagaaggccacgtgaagctggaggcagagactggagtgatgcatctacaagccaaggaacaccaagcattgcctatgttcaccagaagccaggacacagacatgaaacagattctcccccagagcccccgaaaggcacccgccctgctgacatcttcctttcagacttgtagcctccaaaacacaacatgtatctcaaccgtaagccatctgaacttgatcctggttaaatttaatttaattcagtaagtatttattatttgcctaatatgtacaacacatcacagatgttctaaaaaattcagcaaaaagttctttccttgtctcacttctcacagcttataacatatcaaactgcaccaggtagatagttgatagaaatggtgagatgaatggacagatgtaggcaagatacacat

SEQ ID NO: 195887 - DNA, 595 bp, Homo sapiens
tcgcataatttttttttagataccatatttgctttcttgtgagaaaatgcatttattttgtagatagctgggcttccatcaagttatgctgcaagaagatttgaggttttagtttaagttattataatccattccaaacctgtctactaatcaagtttggcattttatgtatattgatctaaaatttttgttgtcctaatctcaataatctattcaatctgcaagaaacaaccacacgttttagtcaagctctatgaaggaggatattataacatattttaagttgctttattaaagttcttggagaaaaagccaaggtcctatttaaaatgttttcataagtataccattgtaagttgaactatgttgccactttaatatttaataagtagggctagataaaagaaaatcagcatcctttagcacaagtatcatatatggcaagtgtttttttgttaacacatgttcaataaaatgtggttgcaggagggtgcccttcaaagtcagtaagagagggtgaaatgaaaggatgctttaggccaggcatggtggctcacgcctgtaatcccagcactttgggaggctgaagcaggag

SEQ ID NO: 195888 - DNA, 481 bp, Homo sapiens
ctcactctgtataccctcatccataccttcaagatctggtgaaaacactatctcttgcaagaacattctttgatgctgttcagaattaatccagacccttttctgtattctcttaataccttatctgatcctctcttaagttacttctcactatctaccttagtaacacaattttatttacatacaagttctctctccctcactagacaaaaacttcttgagggcaagcactgtgtctcctttcaaccattattatcttctctcatgttttttgaacagatttatctatagcccaaacataccttttcaaaaaactaaaaattactttacatatttgatctaaggctttgtttttctccattaagagcatgctgtggatatctttgcaagtgagtgcataaggatttttcttaaccttggagatggctgtctaggatttcagaatatcaactcatatttgtagctccatggcaactcacct

SEQ ID NO: 195889 - DNA, 1075 bp, Homo sapiens
gcacttctctctcactggaaagagaactgttctcctttctctttcttctgcctattaagcctctgctcctaaactcctcatgtgtgtctgtgtcctaaattttcctggcatggcaggacaaaccccgggtatttaccacagacaacaaaaccgcttcactatgatgtatgcatgctgcaaaggaagagacagaatcttgctctatcacccagctggagtgcagtggcaccattgcagcttactgcagcctcaaactcctggctcaagggatccttcagcttcagcctcctggttaactaggactataggtttacaagaactggtcagtaaagctggtttttcaattggtgctggatgccaatcacgatctcccatggcctgtggcttgcagtgctcctcaatctagctgaagacacaggctgacagctcctagaagttggtcacagagatgaagacattgaaggactggaacagggagttcatgatacctcgaaacacactgaccttgacttggtcagaggcctggtcctcccctcatgggggttgtcctggtgtgccttcacaatctgcttatagttccctttcatgatctttagggctgtgaggtccttgcatagtgtggacacctcctcctcctgcattttcttctccttgtgcaaaaactgagtgtagtcaatggtcttttgtagaacgatggctttgctgagctttcaggagccaatgcaggagtcctgctgctggcatgtggggatgatggtctgaaggtcatcacagcctctcttgatgacatccttcctcttctgctcagactcagtgtgtgctcaccactactggtccttgtaggaactcttggtggtaatcactgtcctcctcaatctgtgttggggattggaagaaggccctggtgggaaccgatgctattagctctagacactactgtcccattgtgggtgctttctataaaatacgtgaggtctgagcttttgtagctgtagatgtactccacctttacccaggggtctttgggagaggcacctggctccatcgtcttggacctactggaccagaaacaagc

SEQ ID NO: 195890 - DNA, 459 bp, Homo sapiens
aaaagccaggaaattcaagataaaagaaacattaagcagaagtattttaatgaccacttgatgaaaaaagtcattcagcacttcgttattcttattaaaatgagaatgactttttcattttattttattttttagagacagaatcttgctctatcacccagctggagtgcagtggcaccattgcagcttactgcagcctcaaactcctggctcaagggatccttcagcttcagcctcctggttaactaggactataggtgagcaccatcatgccctgctaatttcttaattttttgtagagatggagttttggtatgttgcccaggctaagaataactttaatccatcatgagctatactactggtttacaatttttgattatttatgccaatgttttccagtagggcttcgtagaaaattaactggaagtctgatgaaattcagagagtaaaaaaaag

SEQ ID NO: 195891 - DNA, 1229 bp, Homo sapiens
  misc_feature (152)..(152): n is a, c, g, or t
  misc_feature (179)..(179): n is a, c, g, or t
  misc_feature (235)..(235): n is a, c, g, or t
  misc_feature (247)..(247): n is a, c, g, or t
  misc_feature (318)..(318): n is a, c, g, or t
  misc_feature (323)..(323): n is a, c, g, or t
  misc_feature (345)..(345): n is a, c, g, or t
  misc_feature (388)..(388): n is a, c, g, or t
cacagcgggtcccgggactgaggcagcagcgggggcggcggcgggcggaagctgaggtgacgaaggcagcggcggcggcggccgtttccctcacggtggcggagaccaaggcggcggcggcggacggggagcggcccggccccggccccctnctcgttggctgtggcagggccgccgtngggccggcccggctcccgccccccgcggctccccctccggctcctcctccgggganacgccgggggcntggcccggcccgcactcagactgctgctgcagccgccgccgggggagtcggaggcggttggcggcgccatnggcgncctggcctctgggggggatgtngagccgggactgcccgttcgaggttcgcggctccaacggggcnttctacaagggctttgtgaaggatgtccatgaaaactctgtcaccatcttctttgaaaacaactggcagagtgagagacaaattccttttggggatgtccggctaccacctccagctgactataataaggagatcacagaaggggatgaagtggaggtttattctcgagccaatgaacaggaaccttgtggctggtggctggcccgggtgcggatgatgaagggagatttctatgtcattgaatatgctgcctgtgatgccacctacaattcttcatctattagctcagtgctgaaggatccagacagtaatccctacagcctattggacacgtctgaaccagagcccccggttgattcagaacctggggaaccccccccagcaagtgccaggcgccgccgtcccgccgacgcgcactgatgaagacaggaccgtcatggatggaggcctggaatcagatgggcccaacatgacagagaatggcctggaagatgaatcaagacctcaacgtcgtaatcgcagccgccgccgcgtaaccgtggtaatcggactgatggctctatcagtggagaccgcagccagtgactgtggctgactatatctcacgagcagagtctcagagccgccagaggccacccctggaacgcactaaaccctcagaagactctctttcaggacagaaagggtgactctgtcagcaagcttcctaagggcccctcggaggaatggcggagctctccgccccctggagtggggtaagtatggggacctggggtttcataaaaacctccagctgaaccctccttcttcatcatggcttgctgaccaaaccatggcctca

SEQ ID NO: 195892 - DNA, 758 bp, Homo sapiens
  misc_feature (152)..(152): n is a, c, g, or t
  misc_feature (179)..(179): n is a, c, g, or t
  misc_feature (235)..(235): n is a, c, g, or t
  misc_feature (247)..(247): n is a, c, g, or t
  misc_feature (318)..(318): n is a, c, g, or t
  misc_feature (323)..(323): n is a, c, g, or t
  misc_feature (345)..(345): n is a, c, g, or t
  misc_feature (388)..(388): n is a, c, g, or t
cacagcgggtcccgggactgaggcagcagcgggggcggcggcgggcggaagctgaggtgacgaaggcagcggcggcggcggccgtttccctcacggtggcggagaccaaggcggcggcggcggacggggagcggcccggccccggccccctnctcgttggctgtggcagggccgccgtngggccggcccggctcccgccccccgcggctccccctccggctcctcctccgggganacgccgggggcntggcccggcccgcactcagactgctgctgcagccgccgccgggggagtcggaggcggttggcggcgccatnggcgncctggcctctgggggggatgtngagccgggactgcccgttcgaggttcgcggctccaacggggcnttctacaagggctttgtgaaggatgtccatgaaaactctgtcaccatcttctttgaaaacaactggcagagtgagagacaaattccttttggggatgtccggctaccacctccagctgactataataaggagatcacagaaggggatgaagtggaggtttattctcgagccaatgaacaggaaccttgtggctggtggctggcccgggtgcggatgatgaagggagatttctatgtcattgaatatgctgcctgtgatgccacctacaatgaaattgttaccctggagcgacttcggccagttaatcccaatccccttgcaaccaaaggcagcttcttcaaggttaccatggctgtgcccgaggatctga

SEQ ID NO: 195893 - DNA, 581 bp, Homo sapiens
cgttgctgataatacacgtacatgtgtcagacttgatggatgcaccatccgtcctctcgtggattgattctgagtattgtaggaaaaccatgcaccatggaactgcagaggcattcctaacatccatatgtgccatgaggaacaataatgctacacgtggtacttgccaactagacacctcctcaggaccaggtggctctggcactggactggttgcctggtggcagctcagctctgtgcatgattcaacctcagcaagcctcagtttcttcctctgtaaaatgggaataacaacagcacctacctcttaggctgctacaaggatttaatcaaatcattcacattaagcattctgcacagcagctgacccacagtaagcacttacgttgcatcgcaagaaggggcaaatgaagaggatggggagtctgctcagggaaacagatcttgtggcaaacatctatttggcacaaacaaagtgttggacatttagcaaagagaaggggcaatacagttgtaattatgtaaactggcaggataagcacagaaatgaactttttctgaacaatgccgagcttcctcct

SEQ ID NO: 195894 - DNA, 818 bp, Homo sapiens
tcagccccctgagtagctgggattacaggcatgcgccaccacgccggctaattttgtatttttagtagagatggggtttctccatgttggtcaggctgctctcgaactccagacctcaggtgatctgcctgcctcggcctcccaaagtcctgggattacaggcatgagccaccgtgcccagccaggcccagaatcttaaaagaaggctctgccagagaagagtagttattagatgagaactcttcttcttctgtagcctgatgctttgttcagctttgtttaactcagtgtggctcattatacgtacttttctcttcttggccaagttctcctcttatgggtatggagatgacatgctctaaatgctttgggagcaagcactcattagagaagacttttgatgtatccttatcttgttagtagtttaagcttgtcagatccttaaagaatgacaggcttaggaccatatcccctagacttaagaggattctcattgaccatttgttcagtgtccatcactgaatcacttaccaaatacagttgacactctgtatccacaggttccacacccatagattcaaccaaatgctgattggacatattcaggaaaaaaatgcattaacactgcaacaataaaaaataatacaggccaggagtggtggcttactctgtaatcccaacattttgggaggcccaggtgggaggattgcttgaggccaggagtttgagaccagcctgggcaacacagggagaccccatctctacaaaaaataaaagtgaaaaaattagccaagtgtggtggctatcaacttgggagg

SEQ ID NO: 195895 - DNA, 555 bp, Homo sapiens
gtggggaagggctaaaagtcccaatcctctaatcatgtcttggtcattctggtgaccagtcacattctgaagttattttggggttgccatccaccaatcaactcattagcatacaaacagacatccctttggagattctaggtctttcagaagttctatgttaggaagtggggactaacgccaaatttgtatttcatattatcacaatctgcaagttggtttcttaagaaatcactgctgatctttacagagaaatgctataacaaaagcacaaaacccaaatgcttgaggaccatgagtaaggaaataagatttttcatgtgacaagcaatgttccaaccactttaacactccattgtccctgtgcagaaacatgtttcccctcccattattaaagcatctgatgtatttttcaatgattttctatagacatcttatttagtaagtgtattaagcctcaggctttccctccagtcttacctagaacctgaaactgcactagagatgtgtcatagttgccaaatccctagctgaagtgtcaagtgctttttcatt

SEQ ID NO: 195896 - DNA, 451 bp, Homo sapiens
cacacacacacacacacacacacacacacaatggaatgctactcagtattaataaagaaaaaaattttgtcagttgggacaacactgatggaattggagaacattatactaagtgaattacgccagtcacagaaagaaataccacatattctcacttgtttgtgggatctacagttgaactcatataagcagagaacagaacagtggttacagagaatggaggatggggggaatggggcaatgattatcaaatggtaatctgtaagcatatcttcgaacgtagattcattatgtgaacaaactatatctagtttatttttggttgaatacaataattcttttaagaaaacatgaaacaaatctactcgatataaaacgcattttaaaactctcataagtcagtcaaaactcattccttttattgtataaagctaactacttgagtcactag

SEQ ID NO: 195897 - DNA, 800 bp, Homo sapiens
cagggctggggaggtggggaggtccgtggcgtttgtctgctgcttctcgggatgctgggagaaaacctgctggtggaattcagggctggcctgagggctggtgacaccatccctggggactccccgagtttctctctccatcctgctgatgggactctgggagccgccctgcatgtcttgctttcttgggtttttggattttaatataccttagcacccttggtttatacctttgatttatactttgggtccctcttcacttacactctcatacctctccttgacttaacacctgtgatccccgagcttaaacttctgatgcccctaacccctctcattttcctgccttccactccctctcggcttgtggttttatttttgtttatttatttttgtcctctgtggcctcttacctgtctgagaccttgattcctgcatgcgtcttctagactgtcagcccagaaagctaagtggacagagagacatgggcctccctgcctcctggacccatgcttgctcccggacataacattccagagacctaggagataccgggggagtgagagttctggctttcgggcttacagttcaacatcctccccgccaccttccagatttttttgtgtcgctcctgcatgcgttttctctgtgtggttgtgcatcttgagttgtggttttcttaccgttttttttctttctccattttgtttttcctttttcctttttttgcgtccatccgtccatccgtgcgtccatccctccgtccattcgtcctcactctctacatcctcctatgcccc

SEQ ID NO: 195898 - DNA, 390 bp, Homo sapiens
cagggctggggaggtggggaggtccgtggcgtttgtctgctgcttctcgggatgctgggagaaaacctgctggtggaattcagggctggcctgagggctggtgacaccatccctggggactccccgagtttctctctccatcctgctgatgggactctgggagccgccctgcatgtcttgctttcttgggtttttggattttaatataccttagcacccttggtttatacctttgatttatactttgggtccctcttcacttacactctcatacctctccttgacttaacacctgtgatccccgagcgtcccccaccgagcgagcgtcgacgctctctctgtggggggttccaccacatccgtactggcccgccccaacagagagagcgt

SEQ ID NO: 195899 - DNA, 795 bp, Homo sapiens
gtaccacgctgcagaccaccaggatgtggctgtccctggcagtgcccatgctgcctcctgctgccttccgggccagcaccaccacacggcccatatggatgattgctactttggtagtcgagctttctctctccatcctgctgatgggactctgggagccgccctgcatgtcttgctttcttgggtttttggattttaatataccttagcacccttggtttatacctttgatttatactttgggtccctcttcacttacactctcatacctctccttgacttaacacctgtgatccccgagcttaaacttctgatgcccctaacccctctcattttcctgccttccactccctctcggcttgtggttttatttttgtttatttatttttgtcctctgtggcctcttacctgtctgagaccttgattcctgcatgcgtcttctagactgtcagcccagaaagctaagtggacagagagacatgggcctccctgcctcctggacccatgcttgctcccggacataacattccagagacctaggagataccgggggagtgagagttctggctttcgggcttacagttcaacatcctccccgccaccttccagatttttttgtgtcgctcctgcatgcgttttctctgtgtggttgtgcatcttgagttgtggttttcttaccgttttttttctttctccattttgtttttcctttttcctttttttgcgtccatccgtccatccgtgcgtccatccctccgtccattcgtcctcactctctacatcctcctatgcccc

SEQ ID NO: 195900 - DNA, 147 bp, Homo sapiens
cctcaccgtggaggcgggggtgttcacacagaacgcttggctgctcatctccactgggaagttggtggctgcctgacgccctccttccctatcaatctccccattcctgtcgggctcagcaaatgaagtattgctcatggcccctgc

SEQ ID NO: 195901 - DNA, 342 bp, Homo sapiens
gaaatattggttgacgaatgaatgcatgaatgaatgaattcacagtgaggaccctgttgtgaggaatacatttgagcacaaaggggaaattatggctagcccttttccaggggatactgtttctagcatatgctgtccacatgagctattggttgtaaatgggatagttgaactggtaagggccaaagagagaaatggaatgttttgaacttcactttttttccctagtaagtgccacactcacctagcacgttgtccctgacgctagttctgggataactgtcctcaggaaatcaaatcttggtggactttgtgcctcatatatccctgccgtccttcaat

SEQ ID NO: 195902 - DNA, 388 bp, Homo sapiens
caatttgacagctgctcaaaaagttaaagaaaaaattaatatacaatccctcaattctactcccaggtatatactccaaagaaaacaggaactcagaaaagtatacagatatatacacaatggaatacatttagcagtgcaaaagaacagggtaataatacaagctagtatatgaacaaactccaaaatattatgctaaatgaaagaagtcagtcgcaaaaggtgtatgaggctacagggaagggaaatcagaaggaaaatgcttaatgactagagtgttttctctttactttgaagtgatggaagcattttagaactagatagaggtatggttgctcaacactgtgaatgtactaagtgccactacactgttcatattaaaatggtt

SEQ ID NO: 195903 - DNA, 129 bp, Homo sapiens
agatgattttaagctaataagaacccccaaattagaaactaattaaggagatggaaaatacaaatgtatttgtttttagtcgggtactatttttatcagaagaatcatgaaaaattaaaattgttaaat

SEQ ID NO: 195904 - DNA, 362 bp, Homo sapiens
ccagcctgggtgacagagtgagacactgtctcaaaaaaaataaaaataaaaataaaaacataaggcatcatcaaaaaaggccagaggaataaacagaaacttgcaattcttttttcttggatatttaaagacataatgacagaagaagaaacaattcaggtgataaccacatatactattcattacaataggctttaatatggtgatgatctgaaaagttactgaggcattaccctaaaataaacaccatcccaaactgccattcatcttgaaatactgcatccatttattatgggtttcatttccctcctgatggacaggtttttcaaatattacttccctgtattgtcagcactactacc

SEQ ID NO: 195905 - DNA, 609 bp, Homo sapiens
tatctttgatctcttgcctctttatcttccaaacctaaaatgtttaccacctggccctttacagaaaaatatttgccagtccctgctgtagaaggttatatagccagcagctttcaaagtaaccttttacctggaaatgtgaattctctcttagttctggtcatctgttatttgtgggagccaatcctctctctgttggctgatgatgagaattctgttatataccacaacacaaacttggggataaaactttccattaggcatttctgtaaaatttccatctattttagaagcagaactaaggtgaagcccagtgtgaatgaatcctgcttgttggtacaagccaagtgggacatttggcagcaaagcccaggagtccttggtgctcttcttttaactgcctcctcatctcattgggctgcccggtgttaactggttgattatcacctctgtgttttgcctgcaaggaaagaagctactgacacccagagtggctcatcgatactcacacgtgctttcagttactttacgcgggatttggttaaagtgagtttagctgcacatcctcacttggtaacattctgtggctgtgaaaattgtttctctctt

SEQ ID NO: 195906 - DNA, 419 bp, Homo sapiens
tgaaagctgccattggacccgaaatgtcactggcacttctcgttatttacctttttgtcactttcctgatcaaaaccagactcattcccagaaaacccaaagaatccgtatctggcagaggagcaggagtgggaaaaactgcatgggtccctggggaccaagtcaggccctccccggagcctccggcgttcttactttgtccactttgcccctgagcatggtgctgcctaccagtgacttcagtatcgactaggattttatctctttgagtctgccggtgaggacaaatgtgccctaatggcagtaaagctgggtaaggatccaaaacaaagccagcttccctctgtgtaactgtatcatggctgattctgaagtgtggtagacatgcaggatgttggagacagatcagagatttatct

SEQ ID NO: 195907 - DNA, 410 bp, Homo sapiens
ctcggcctcccaaagtgttgggattacaggcgtgagccaccgtgcccagcctgaccagtagtttaaatgtggtctagatcaagagacaaattaagaaacctggtgatgtgagtcctctttcacatggtctagtaggaaagacttcattcagtagtaatagcataaatgaaggattagagtcctctttcacatggtctagtaggaaagacttcagtagtaatagcataaatgaaggattaatttattggttgattagatgttcattacaaaggattttgtggattagtgttaattgtataggatagaagtaaattggcaagagagtaaattgcctgtatttgaggaaagacgtttcacatcttaacactctaataaataaaatattttcttctaagctcctatttctctag

SEQ ID NO: 195908 - DNA, 406 bp, Homo sapiens
cttagtgccacccacctaattatgacaggacttgaaacagaatgattattttgtatgtgatatactgagtatatgtccactctggacatgtggacccaataagacagcttaataagtggtctgcctgtccctctctccccaggaagaacctaaagacagaataaaagaagcctagcttcttgctcatacactggctattaggaaggctgttgtaatttttaaagccggtattaagagtattttgaaagcccaagttttgagtctaaagaccttggtagactttagtgaaactgcccgactgttgaggatcaggtgtaatcctggccacatgtttatattgctgtgcccatcaccatcatcccgattcctaaggctagtctctggtaccgaatgggtagatgatcaa

SEQ ID NO: 195909 - DNA, 276 bp, Homo sapiens
tcatgttttagaatatttactatggatgttgtgggagaatggatgacttccttcctcttgaggctggtattaaaggtaacctttatgcagctgatgatatttaaattgggtcttaagttggaaaaatctgtaggcattcaccagaaatgcttagggaaaactgaattcaggttgagaaaaaaagcatttgaataacatgaaactgtgaaaaatcaagggatttttttaaaaatagcaaatagtaaacaattcaatgtgtctgaaacatagaaaata

SEQ ID NO: 195910 - DNA, 199 bp, Homo sapiens
ggtaaggaacttgccccaaaaagattaagtgacttagccaaggttatggggaagagctgtcattttttccctgttatctgggtttaaaatattggaatcaccttggactcatctctctctttttctattgctgtatccagtaaagcaccaattcctataggttgtttctacaaagtatctgtttccatttcttcctctc

SEQ ID NO: 195911 - DNA, 352 bp, Homo sapiens
ctggagccggatcaccctccttaggcaactggaggtcccccggaccgggaggtcaccatatagatgccgaacatagtgcggacacccgatcggcatagcgcactacagcccagaactcctgggctcacgcaagcctcccaccttggcctcccaagtagctgggattacaggcatgtgccaccatggccagctactttttgtatttttagtagagacagggttttgccatgttggtcaggctgatcttaaactcctgacctcaggtgatccccccacctcggcctccaaagtgctgggattgcaggtgtgagccaccaagcctggccgtaagtttaactgcacatcattctga

SEQ ID NO: 195912 - DNA, 600 bp, Homo sapiens
  misc_feature (35)..(35): n is a, c, g, or t
tccacactggtgtaagtgattctcatgcctcatcntcctgagtagctgggattacaggcacctgccaccatgcccggctagttttttattttttattctttttattttttatttttttagtagagacagggtttcaccgtgttagccaggacggtctcgatctcctgacctcatgatcctcccgcctcagcctcccacagtgctgggattacaggcgtgagccaccacgcctggccatgactggtgttcttataagaagaagggccacacagagacacaggagaatgccatgtgaaaatagaggaggcagggattggagtgagaaaccaaggcctactggtaacccccagaagcaagagaggagcacagaacagattctctctccagcctccaggaggaacctaccatgacacaccctgattccagggtgagagagtaaattcttattgctttaagccactcagtttgtgacaacgtgttacagtagccagggataacccctagacccggacatacagcttgatcatattctaccggtcacacaggcattcaatggagactgtagacatctaggtccaccagtgtggagggtaatagcta

SEQ ID NO: 195913 - DNA, 397 bp, Homo sapiens
caaaaaataaaaaaaaatcagcaaagaacagtcagaagaaaatatccctgttatacacagaatgacaaaagaatggaaaattaaaaacaggaaagaatatcaaagacataatatgggccgggcatggtggctcaagcttgtaatcctatcattttgggaggccaaggcaggtggatcacctgaggtcaggagtttgagaccagcctggccaacacggtgaaacccctctttactaaaaatacaaaaattagctaggcatggtggtgggcacctgaaattccagctactcaggaagatgaggcaggagaattgcttgaacccaggaggtggaggttatagtgagccaagatcgcgccactgcactccagcctgggctacaagagcaaaactctgactc

SEQ ID NO: 195914 - DNA, 407 bp, Homo sapiens
cagtcatgggttgcttggtgacaggaatatgtcctgagaaatgtgtcattcggcaatttcaaggttgtgcaagtatcaaagagtgtacttacacaaacctagatggtatagcctactacatacctaggctatatgatatagcctgttggtcctaggctacgagcctgtacagcatgttactgtactgaatattgcaggcaattaaaacacaatggtaagtatttgtctatctacccagagctaaacatagaaaaggtaaggttaaaaaaaatacgagtatcggcctggtgcagtggctcacacctgtaatcccagcactttgggaggccaaggcaggtggatcacgaggtcaggagattgagaccattctggctaacacggtgaaaccctgtctctactaaaaatac

SEQ ID NO: 195915 - DNA, 250 bp, Homo sapiens
aattttataccttgtgccacacttagttcctgccctgtctctccttacacattgctaacaacctggaaacagattctatgaattcttcttacttatcctcaaagcaattaacaaaaacccttacaaacttttcatatttggtgtttaatacctacttgataaataaataagaaacagaatattcatattctgtataccaaaaaaggctgtgtgagagtgtatgtatgtgagtgtgtgggggggggcgggg

SEQ ID NO: 195916 - DNA, 538 bp, Homo sapiens
gacacagccagagagaggaccaagagaggtccaggaaaacaaaaccatcccctcagacaaaagagaacgatgacagccagaactggcaagagtgaggggaaacaagcccttcggtgcagatgtgagagtgcacatactttctcgagggcactctggcaacacatatcaaaagcctgtatatctcggtccttaaattccatgtccaggctttacccttcagacatagtcagtgatgcgggcaggatatagttgccagaacattcacaggagcatatttttattagtgaaaaattggaaatgaactatagatccagtaaaaacagataacagaatttatggtagatgtattctttggaatactatgtggtcattggaaatcattttgtgaaaaaatatgtaaacgctatgtcctcccattgaaggtaaaaagttggtacagtgacaggtgctggtaacgatctgcttcttttggtgccgatcatgtgggtgggttcagtttgtaaaaatttattgagctgcactcttatgacatatccac

SEQ ID NO: 195917 - DNA, 592 bp, Homo sapiens
cctaatgctaaatgacgagttaatgggtgcagcacaccaacatggcacatgtatacatatgtaacaaacctgcacgttgtgcacatgtaccctagaacttaaagtataataataataaaataaaaaaaaagaaaatcttatcagatacacaaaaaacatagtggaaaacaaatggaaattttagaactaaaacacacaacatctgaaattttaaaatttactggatgaacttaataagagactggggatgagagaggaaagaatcagtgaccactgaaattagattaatagagatgacccaatgatccaatctcaaaaagagaaaaaagataaagaatgaggtgcaggcatctttggggcaattcctaaaggcctaatacacaagtagttggaatctcacagaagagaacaaagagagtggggcagagaatgtttttagaagcagaaaactttccaaatttggtgaaagacataaatttacagatttcaagaagctccacaaattccaaatatgataagtatgaagaaactcatagcaaggatgctataccacacacttctgaataatccacaggtcaaagaagtcagactc

SEQ ID NO: 195918 - DNA, 411 bp, Homo sapiens
ccccattttctcaagcaggaagggagaaaagaaagggggaacagagaaaagaaaggcgagaaagaggaaagaaggtaagctgtaaggaatagagggagagaacaagggagggaaggaagaagtgagtaagaaagaaagcaaagatttcaaaaactgtaaccctggacatattctaggctctctcaagccttacagtaaagaagtttttttctaataataccaaatatgaataattcctatcatacatgaataagtttggtttattagtagtaaacagattatcattcctaggatataagaagtaaagttgctttctgataataaaatttgaaagatgtaatttaaaacttatttattgtatatactatatgatataaacttccacaaataatttgaaaaaataatttccat

SEQ ID NO: 195919 - DNA, 911 bp, Homo sapiens
caaatcttcaggaaccaattcattaccattaaaaatgatctaacaagctttattttttatcattgttaaaaatcctcgttttgagtaacacaaccacaaagtaaagaatgttatcattgatttaaccagtaaaagacaatacttaacaataaaattttaaaaacatacgccagccggcttacctggtgaaaaaaatgattgcggctgcaagctgcatttgccagacaatggttttagatttgctgtgcacgctgaacgccatgaaaaatggactgcctggcctcttcataaggaaatcaattacttgcctctttctgagtgaaaagaatgaaaggatttaaaaaatcataataaccaaaatggggagaataaaacaaactgggcagagggatgggctactttgcgtcttcagcttctgaagtcttcaaagccctcttccagttcttagaattaggtcacatgaaaaaatctggtaggatgaaatgagtgtcagagcagggaatggaaaggagagtagaaactttatcaatgtgctgtcgagaggtctgaatccacactgattcttgattctttgtggctggaagcttacggaatcttcgctgtctatggtgttctgcagttttacagtgatacgcccttgtgtgggccactttcatccacgaggtatttttggtgggcgttttcaatctggcaattgtgtttgattctgagaacttctcctgacaacttcctcttttccctcttgtatttatcttgagctatgattttattgaacgttggacttcctattttggtcttctgacattcttatcatttctctccagttttcctctttgtctctttttctttttggggtatttgtatgtgttcaggtttttaagatttccttatcttggtcgtccaaccctact

SEQ ID NO: 195920 - DNA, 147 bp, Homo sapiens
atacccttgctccgtaagcgtcggttccagttaggccgttccatgaacctgagggccaggaagaaccgctctcagatagtcctgttccagaaacgtcggttccagttcttctgttccatgagcggcagggcttgggtttccccggag

SEQ ID NO: 195921 - DNA, 434 bp, Homo sapiens
atgataaaactggacttctaattccctctttcacgtaaatcagagccagtcatatcatttctgcccacaacccaacagccgtagcgagccacagggccctacctgactgcagatggctggacgcatggggagcagaaggaaggtaatgaacaacaccacctccaccagcctttaacaggagtgacgtggctctacgtgcgcttacagaaaaggccttcaagacctgccgttagctggaaaaataagaagagcaagctacaaaactcacatagaatatgatcccacttggcacacagaggccgtgtgagcacagccagatggcggctgcttacaagcaagaggaggcctcagaacgaaccctaccttgccagaccttgatcttgaactacccagcctccagactgtgagaaaataaacatctgttgtgtaagcca

SEQ ID NO: 195922 - DNA, 391 bp, Homo sapiens
cagactttagtttcaccttctcagctgctgatataggtaggctgaaaaccagagaaaaatcaagagcagactgggtgccgtggctcatgcctgtaatcccagcactttgggagaccaagacaggcagatcacctgcagtcaggagttctagaccagcctggccaacatatagtgaaaccccatctccactaaaaaatacaaaaattagctgggtgtggtgatgcatgcctgtagtctcagctacttgggaaactaaggcaggagaatcactagaacccaggaggtagaggttgcagtgagctgagatcgcgccactgcactccagccttggtgacagagtgatactccgtctcacacaaataaaataaaataaaataaaataaaataaaat

SEQ ID NO: 195923 - DNA, 475 bp, Homo sapiens
gccattgctctccagcctgggcacaatctcagctcactgcaacctctgcctcccaggtcgcagtgagctgagattgtgccattgctctccagcctgggcaacaagaacaaaactccttctcaaaaaaaaaaaaagaaagaaaatgaacaaacaagaaatcttctattccctgtgacatagttataaaggcccattaagcctgaacaagtccctgggcactcctaccctgacacattgaaagcacgggccagtttccaatccttactaacttccagaatgagggccactgatacactgcccaacagcccactggtccctagaaaaggtgtcctaccatggaaatagttatacattcttaagagctgggctgacattaggatgaacaggcaatagcggtcaataatgtcacatggtacaagaaggcaggaaggatgaggaatggggaaaaggcactagacctcactaagggcaaatc

SEQ ID NO: 195924 - DNA, 482 bp, Homo sapiens
gagaggtgttacctgcatcagtcctctcaaaccaagctcccatgacacaggatctggcctgggaggaatatggttcccctatggtcacgggatctgtttgggggtaatgcagctctcagagattgagccaagtaacccccaagggacctctgtagtgcaaaggcaggttttctgtgggtgaggacaatggacaacatgatgtgggcagcagggactgaattccaaatggccctggatgatggtcctgctccccttgtaccagctgtgtggtcttggacaagtcacttctcctctctgggcctgtctcctcatttctcaaagagggatactgcccaagtgtgatgatggtcacagcagacaaggtctgctgaggggtctgcaaggggtggggcatggcatcagtgggaaagactggtatcaccctcttggcatgaattcgtattgtctctagtaaatttcctacttcatgaaggcacatggcc

SEQ ID NO: 195925 - DNA, 316 bp, Homo sapiens
tctggagttgtcatttaatggaaggattatgagtactttgatgatttttctctttgtgtttctttttttttaatagtaaagaatgtaaaaatttaaaaatcaatgtaaaagaaaaaaggaattaaatttatgacaaatattgtgacaaatgtttatgacatttttataaagatttaatcttttctcagtagtacactacagttcaggttattttctacagcctatattaccatctacagaatttttctagacagaattatcttggccattgcaacagtgcactctagcctgggtgacagagcgagactctgtctca

SEQ ID NO: 195926 - DNA, 460 bp, Homo sapiens
  misc_feature (424)..(424): n is a, c, g, or t
tgagacagagtcgctctgtcacccaggctgaagtgcagtgagtgatgtgatctctgctcgctgcaacctccacctcgcgggttcaagcgccgggcctcagtgaactattaatgcaactcagaaccacctggagaaaagcacagcttggtctttgtaaagtctgtctccacagcttcattctttctgcggtaggaataaagatgatgtcagaggctgggcatggtggctcacacctgtgaaaattaatattaatattttaaaaattaatgtgaaacactaaattatgttagttgccattattatgacacatcatttttaaaaagtgacagcaactattttatttatttatttattttgaggcagaggcagagaatcgcttggacccgggaggcggaggttgcagtgagcggagatcatgaagcgnacatccagcctgggcgacagagcaagtctacttatc

SEQ ID NO: 195927 - DNA, 156 bp, Homo sapiens
aacgggtttacaatcagaagcagacagggcagaagaaggtaatacaggagaactagcttttgacggtagcccagtatttcccaggtatattcagtatttaccattccttgcaagaccaggtgaaggataatgaaggtatggtttcatgtatggaag

SEQ ID NO: 195928 - DNA, 198 bp, Homo sapiens
caggaaacggtacacatgttcacacacacttgcacacatgctaccatgtgcacacacatgttcacacatgcttacatacattcttataaatacacaagttctcacacatgcccacacacatgttcacacacacgctcacacatgctcacacagatgctcacacacatgctcacacacatgctcacacatattcgcacg

SEQ ID NO: 195929 - DNA, 439 bp, Homo sapiens
tctctcaataattaatagttatgataagcagagacagtcagaacaatgctttcaatcactttgacctaactggcatttataaaaacactctgttcaaccacagaagaatatgcattcttttcaagtgcacaaggcacttttagcaagatagaacatattctaaggcattaaatatgtctcaatacattttaaaagatctaagtcataaaagtatgtttctgactataatagaattattacagcaaaatcaataaaagaaagctatctagaaaatccccaaatatttggaaactaaatgacacatttataaataacctatgagttaaacacagaaatcaaagggatattagaaatattttaatttaattaaatggaaaagcaaattatcaaaatttgtgagatgtagctgatgtagtatttagaggggaaaatgcctgtg

SEQ ID NO: 195930 - DNA, 250 bp, Homo sapiens
aataatttagaacaatttcaagagtatgagattatccagccagtagtccttcttctataaccttccattttagggcctgcatacttgactctcacttctttttcttaaaaatgggctcaaaagcaaataatcagtcttgggtcacatggccaggagaagtaagaagagtgaaggttattgaaggttacagaacatgcaggaagagtcgagggtgtggcagagtacagagactaactcctcaagtccctta

SEQ ID NO: 195931 - DNA, 453 bp, Homo sapiens
cgatctcggctcactgcaagctccgcctcccgggttcacgccattctcctgcttcagcctcccgagtagctgggactacaggcgcccaccaccacacccggctaggtttttttttattttttagtagagatggggtttcaccgtgttagccaggatggtctcaatctcctgacctcgtgatccacccgcctcggcctcccaaagtgctgagattacaggcttgagccaccgcgcccagcaagggcatggttttctcaaaagttaggagagtgattacctggggtgggggagaacagagtgggggagagccctgctgagaggtggctgtgttctctttgttgacctaggtgatagtcacatgaatgtttgctttgtattttttaaactgaatatatgttttatgtacatatgttgtatctcgcaatttaaaaaaataaagaggacagatcacct

SEQ ID NO: 195932 - DNA, 270 bp, Homo sapiens
tctgtaattttgagggcaagttcagcgaataactgtagacgctattaagagctgtcatggaaaatgtatctgtccttaaatggaagggagaaacattactgcagaggcagtgctgtttcaatgtagataattctccccttcaagctttttaaaataatgtttattgtttcctacgatgtctccccagaccgttctaacacttgcaattgcagtcctgcctttttcctcttgtcaggaataaaatttatggaagaagcatggcccacggga

SEQ ID NO: 195933 - DNA, 274 bp, Homo sapiens
tcccaaattaactttccccacacccaagaaagcagatttcggtacattccagagcgtggatatcaagcaatttcaccagcatggcaccactactagcacttctgagccactcagtgaaccacagctgcgggaaggaggaaggggctcttctctgggtccccgtcttagtcctaagggtagcagctcctccttatagataatacttctggactctttcattacctcttactggccaatccctgattacccaagttctgtgttggagtttgtaatt

SEQ ID NO: 195934 - DNA, 180 bp, Homo sapiens
gatgaaatgccccacgccaagggttgaggttgagagtggataactagtggggtgtgaataaaagatgaagagtgtatgaacaaatgagctccgaagtagaagtttcctaattttacaattctgcctgaggaaagcccagggccatcatatagggttgaatggactttgctcagactaagg

SEQ ID NO: 195935 - DNA, 288 bp, Homo sapiens
agcctggtccagcccagaatgggaagctcacctcaggccttttccctccctcctggccctgcatccagctcctccctgcatggcttcagtttccttgtctgtacaactgactcaaaaagaacccacctcctaggattttgtgcagattagacgggctgaagtgtgtcagtgctggcacatagtgggcactcaatacacgttagcaatgatgatgccatggcagagggcactgttcagtcctctccttcgggaagtgggggagtccttggctgtctttgtggagaccgg

SEQ ID NO: 195936 - DNA, 401 bp, Homo sapiens
ttagggatgacctctgccctgctgggtgcccttgatgactaacacagcaagtgtgtggaccgccacctgtcctggcctcacccaccttcaccctccatttcttcatgactgcccccgtggcttctagggggaaggccccagacaggtttgctaaactactgactcccagggctccctgacagggcctgatgcagggtggccagcggttgtgacccctagaccaggtgggtcccagcacagggacctgagccccaccctcagggagctggcggctacacggggagcggtcacctgtacagataaatctagtggaaagcccccatggccagaaccagggcggagggcctggggcaggctctggagtatagaagagggaaggcgcctttggaacagacagcaga

SEQ ID NO: 195937 - DNA, 541 bp, Homo sapiens
aaaagtgaggcaggaatagcagtcatgaaaatgaagcctccctggtggtcactgacaacatcttcagagtggcaggcagcagtctgctagctgctccggtagaactgtgtgcagcggtggaaatgttttctgtctgccctgtccaaatgggtagcccttagcacatgtggctgttgagcaactggattattcatttcaaataattgcggttaaaatccaaatagccacaagtagctaccatattagaaagtgctggttcagattgagccaagagaagaaggaagccagcagggagattaatgaactataaggaaatcctgccatttgcagcaaaacaacatggctggaagtggaggtcattatgttaactgaataagccaggcacagaaatacaaatacaacatcttctcacttatatgtgggagctaaaagttttgatctcatgggcatcgagaatagaatgatagaatccagaaactgggaaaggtagtggggaggtgggggaagaaaagaattgattaatgggtacaaatatatggtt

SEQ ID NO: 195938 - DNA, 552 bp, Homo sapiens
ttcaaagctttcaatggctttctgctgccttttcaatacagaacaaatcccttgaactaacagtcaagctcccttaccctagattcttatctagtctcattcagcacatatatataacatacacacactcacaaactctaccttctgtgcagcctacatactagaaactcagaaattcatttttctatagcatctgtttgtgctgctacagatacgatcctggaatatctttccttcttaactccaaaacttatccaaccttttgatcttgctcaaacaatagtttgcttcaagtctatccaaatttactctccagctaaaaagtaattctccctcttgtaatttatttgaactttttttcacaagacacttaagactttctgctttctgttgttatttatgaacgtgccttctagcccttactagaagctcctttaagacaagatttatgattgattcaccattcctacaacagtggtgttcatatgtaaaactgtcaataaaaatatgttaaattaactgacactttctatctggattagctgattttac

SEQ ID NO: 195939 - DNA, 339 bp, Homo sapiens
tatggtagactaatgccatgttgctaaccttgtgtaagaatattatagtaagaatagcaatgtgattttagaatttaaaaagataaataatcaacattagaagacatttgtaagtatagttcatatatagtcttgagaaaatatcttgtaaaattttatttattttaagaaactcttgggagcatagtataaaagtatcatataaattacttgatgtaattgtaattggatctttgggttgaattccattatatggcttactaaaatgctttttttatccatcagtaatagactcacagcatctattacgtacttgttgtagaaagtgtgccccaggat

SEQ ID NO: 195940 - DNA, 308 bp, Homo sapiens
cctagagcaaccagaggtccggttgggtcagcttttcacaccccatgccatgttgaaacctcagtggacgagaaggttcttttgaagttcatatgcaactgctgggtttacttctgtctttgtcccagaacagtttcagcatcaatgacctagggcaagtttttttgtttgtttgtttgtttgttttgactcctatgtctttgagtgtgtgggtacatatgagaaaactccctaactagagcatgctgcttctgttgactagtaaacattatgtggcagagagcgccttcaaagcaccagccttccct

SEQ ID NO: 195941 - DNA, 295 bp, Homo sapiens
tgtcccatacaaaataaaacagcaaatgtctagaaaaagaggactcaagatagtgactgtcatcgggatgagttccaagagaaggttggacttgagaaggattttgcataaaaggtgcatccttattcccaaagcacttccatggtccctgctccccaaactatcaagcccaaacaccatgatccctggctttcagagtttttttgatttggtcctgagtactcaaccatttacatgatctccttaatttccattacgctttcttatatagcctgtggtcctcgttttgtcactt

SEQ ID NO: 195942 - DNA, 365 bp, Homo sapiens
gggaagcagctgtgtacgatatataaatgatgcaatacagaaattattgtggcatggtatacagggagaaatgaaagcattgaagaaggcaaagaagtcttcctcgggaagtcatggcttcaaagagaaaagtaggctgtgtcttaaaggataagtatgactttgccaagctaatttagggaactttgtattctaggaagagggaacagaatgtgcaaagcctcgaaggtgcactgttttgtgtgtgtgtgtgcgtgtggggattctttagtatattttgactgcatgttgaggagtgatgaggaatagagtttgacaggtagtcaggatactgtaaggttaaaacctgagctctgtggttgact

SEQ ID NO: 195943 - DNA, 320 bp, Homo sapiens
tatttattgtttgacaaactggggaaagaaaatagaacttgttggatggaaactaggaaggcatgggactacccattgttgaatttggagaaagatattttactcctgttactccatctgaggggtggaagttctagtgcttatcttgcctagacttctctttactatttttattactgcagaattggtcctggcaactatattgagaggtgtagccaagcacgacttagggtaactggggagaagacagtaggaaaagtgagcattatctgatggtagatgaagcaatatagccatgagcactggtcaaacaatgactg

SEQ ID NO: 195944 - DNA, 417 bp, Homo sapiens
cagagtctccaggatttttccttggccttgtcccagctgcaccacctctgtcgcagccccatctccgggcctggaaagaacccaggtgcctcggggcccagcaggaaggggccagggacaaagagttgtttaactgggcaggctggtgaaggagagtgaagagggtgtctcaggcggaaaggtcattcatcgcccaaggcttgtgcagggaaaggcagggctgagccccgaggaagagatcctgaaagtcagaggtcagtggcggcaaatcctccaccgccatctctgggaccttggagcctggaagctccagggcttataaatactgtcacctagtgttcacttaggcaactgcagacactctccctgtccagcctggtttcttgccaacatagagcaaaacacctactgagtgcc

SEQ ID NO: 195945 - DNA, 215 bp, Homo sapiens
aaaaacagagatctatattccctggaaagagtgaacagaataattctgttattattaataaaaatccactccaacctctttttgtttgtctctcccacaacactaggatcatgactcagaacaaacatataaaagccaggtacagtaactcatgcgtgtaatcccagcaacttgggaggctggggtgggagaatggcttgagcccaggagttgga

SEQ ID NO: 195946 - DNA, 225 bp, Homo sapiens
cactcttttgcccaggttggagtacaatagcttgatcatagttcaccgcaacatcgaactcctgggttcaagtgatcctcccacttcaggctcccaagtacctggaactacagaactacaggaacatgccaccatacttacctaatttttttttgtgcgacagggtttcactcttttgcccagggtggagtacaatagcttgatcatagttgcccgccaatcgaa

SEQ ID NO: 195947 - DNA, 588 bp, Homo sapiens
cttttctgttacattttgttaactttagaaatagtagatcatgttagactaagtagagatcacaaaaagatgagatttaggagaaatccatagatgttttgaactgtggatgaatagttcaccaactatttcctgtacacaaaagccatgcaatatatgtgattaaatttgtgccttggtgaaataatatgttatatgtcactgtatgtattgtggggtcatttataaatggttacaatattttaaagtaggaatacctagggtctgcttgtcgttagttttctgtgatagatattcgacagtgcttcctggcatttaggaaggggcagtgagatcttttaatacatctagagaagacacttccttatatgatcttttcatttattcaaatatatatttattacttcctctgtgccaggtactgtgtggctgagcagcctagacttgattctgtaaaggaaattaaaaatcccaggacccccagactccttatgcaaaaggaaagttaatcctggagtctgagtcatgcaacacactctttcaagtgagtagctgttactaacattatgccttaaccagatcctcatg

SEQ ID NO: 195948 - DNA, 358 bp, Homo sapiens
gttgactttatctttttaaatatttcctgaatgtttactcttttctacacacccatgtttactctagtccaagcttctatcacacttacccaaacttgtggggaaaagcaagagagatcagattgttactgtgtctgtgtagaaagaagtagacataagagactccattttgttatgtactaagaaaaattcttctgccttgagattctgttaatctataaccttacccccaaccccgtgctctctgaaacgtgtgctgtgtcaactcagagttaaatggattaagggcggtgcaagatgtgctttgttaaacagatgcttgaaggcagcatgctccttaagagtcatcaccactccc

SEQ ID NO: 195949 - DNA, 590 bp, Homo sapiens
caaccctgtctctaaagaaaaaaagtgatttgaaatagaaaacattttttaaaaagtggaggtgcttaatcattgttcattgttcattttctttttgcttcctctaatatctctgccagtactcaacaaaagttcctttttcaaagcaaatgtgtttaagcagaggacagctaaggaggatgagggggagcttttgcaatatattgttatacttttgaagtggtaatgcttagctcaagtaggattttctttttaaagcagcattgtcttagatctctgctcagtggctggtattcccacagctaacctcaaaaagccttttggttggtggaatagctgtgacctgggtagggagggcctaaccccagggctaaggctttcaaaaggcagtgtacaggttttggtttttgcatttgtgtttgtttttgtttgttggttggttttagaatacttaatgctttaattggaccatttttcagtgcttgcagcccctgtatgcattaaggatagaactgaggtgttacaggaatgttccaaaatattttctgttacacttggaaaaatatattcagttcctagatttcaggtta

SEQ ID NO: 195950 - DNA, 461 bp, Homo sapiens
agatgaggatttgcagagccaagccccacctgggaggcatgttaagtcctttccagttcttctcaattatggctctgcagtgagtatcttttgttcataaattcttgactgcacatcttgattatctcctcaggatattttcctagaagtgggattactggattgaaggggatgcacatatttaagattcttgattccgaacccctccagcagtataaaaatgagtccgcttcccagcaagctggcccaaacaggctattatcaggcttaatttttattttttatttttgtgccctcctaatagaacaaaaatcgcatctcgtttggtttgcatctctttggggactaattagatcgagattgaactagttttgaagaaacactctaaggagtccagagaaatcctgtgtggggcaggagatccatgaaaggaggcacatcccgcccactgaggtgaaacc

SEQ ID NO: 195951 - DNA, 479 bp, Homo sapiens
actcagtaccaagagagtcttccctgcagtcccctgggggtggagtaagaacagtaagtttactgctgattcaccctaacacttacagtgtagcctttgagattagtctaatatggtagggcaggtttccttgtactagactcccaaacttggataggcccttggccttggcttctggagccatcagtccaggaggctagccaaacccaaacttagtttgcctggatttgcaaatatcaatcccccttacctgaggcaaaattactttaatgttctgatatttcacttacctctctgggtctctagaaagaaagggtaggtcacagagtaacttcacctgctaatttatatttgggaaatgtttgaatgttttataacaagcatacatttctttaacttttaattacagtttctttaaaaatatcaaatagaactaaaaagctggccaggcgcggtggctcaccgctgtaatcccagta

SEQ ID NO: 195952 - DNA, 162 bp, Homo sapiens
atatttaaaagaaaaggaacctgcatttagaagttattaaataggggccagacgcagtggctcatgcctgtaatcacagcactatgagaggctgaagtgggagcaacacttcagtccaggagttcaagaccagcctgggcaatatagtgaggcctcatctct

SEQ ID NO: 195953 - DNA, 972 bp, Homo sapiens
aagagagagaattatacctggaagcaactagaaacaaaaatgaagcaaaagcagctgttgtcttatctcaaatgacctttcagcaccattatttaagtctattttgtcctaaatattaatgttttcactactgggtctctaagactgggtctccaagaaaaatagtttataatttatatttaaaaaaggtagccctttaaacattttcatttgattctgcttctagctgcagcagcaccacaacaaagcagggaataaaataagagtccagattatttgaaaactcagcttaaaaaaaaaagactgtacaatttctttcttcccttgtggttctacagtgtctttagggcagaaatcaatttttgctcaccaaggttatgatttcaactgttcaaccagaagactaactaagcaaacaaaccaacactggtcaaaacccttttgcagctcttccagaggtgtcaactatgattactttacaaattcttcccacctttttgttggaaattcttatttctcttcttaacatttttgatctactctgaataatattcatgcaattaaaatagagattttttaaatctggtaagaacgggtggggcatggtggctcatgcctgtaatcctagctctttgggaggccaaagctggaggattgcttgaggccaggagatctagaccagtggaggcaacatagtgagaccttgtctctaaagacaaataaaaacaaaagttaaaaaaaatctagcaagaatgctttctttaaaaattgtcgacacatgatgatatttatttgggcacttattctaacccttaactaatgaccatacttgtaaatatcactaaagcaaccacctcctccataaatttgaggaaagaaaaattaaaaattttaagcaatcctttaaaatgtaagcaattctgaaaatacagtgatggtcctgcacaaagctactaaataaattctgccacc

SEQ ID NO: 195954 - DNA, 534 bp, Homo sapiens
acgagatccccgtgcttcatcaacctacctggaaaaaataaaattgaataagtgaaaaaatatcaaaaacatcccatgacattggataagacaaggtgataaactgtcaattttcagaaactaatacataaatataaatgcaattctgatgagaattctaacaaggacatttgtgtgtgtgtgtgtgtgtaaggctatatgactgagagtagctaagaaaagtattaaaaagaactgtttgggatatcaaatcaaaatagtattagcctaagaagaaacagatcagtggagcagagtaaataatccagaaactgattccattatatacatgggaatacagcatgtgacaaaggtggtcattcaattcagtaggagggattatttaatagacaataaactgactctgcactggaaagaaaaataaaataattagtgctcccaaccttacacaaaaaattccagattaaagatgtaataacacacaaaatacgtgttcaagaaaatctgagagactactgggaactcagaagtatt

SEQ ID NO: 195955 - DNA, 615 bp, Homo sapiens
tctagcagcaagtataaagaaacagaaacgggattgaaatatttaattcacatcactaacaaaaaccataaaacactaacaaatttaattaaaaagggctagaacctacctggaaaaaataaaattgaataagtgaaaaaatatcaaaaacatcccatgacattggataagacaaggtgataaactgtcaattttcagaaactaatacataaatataaatgcaattctgatgagaattctaacaaggacatttgtgtgtgtgtgtgtgtgtaaggctatatgactgagagtagctaagaaaagtattaaaaagaactgtttgggatatcaaatcaaaatagtattagcctaagaagaaacagatcagtggagcagagtaaataatccagaaactgattccattatatacatgggaatacagcatgtgacaaaggtggtcattcaattcagtaggagggattatttaatagacaataaactgactctgcactggaaagaaaaataaaataattagtgctcccaaccttacacaaaaaattccagattaaagatgtaataacacacaaaatacgtgttcaagaaaatctgagagactactgggaactcagaagtatt

SEQ ID NO: 195956 - DNA, 1037 bp, Homo sapiens
  misc_feature (883)..(883): n is a, c, g, or t
tgcagagaacaccaagtctgtggtcgtgtccatcagctcagaacttcggggtttctgttaccccatggttagggttccttggagtatgaaatgtgctaaggaagcctcaatggagacggggacggagactgggagttccctgaccacttccttgcagggtactttctgcagcccctagagatagtaccagattatttgtttggcacatcaggaaactgaggcacagatggtcaagttggcctcccaagaccgctctagaaaactggcagaagcagcctgtatgcccacagccctccacatgagtgagagcgtggaagacagaacatgccgagggagacgttagacgtctagctctgcgttctagacgtggctttgtgtggctgtgggaaggtcatgcagctcctctgtgcctcagtgtccccatctgtagtttgtgataatgctgcctgactgaccaagaactgttccaaggcagagatgaaatgacagatgggaaagtattttgtaaactctaaagtgccagccagatgtgcagttcattgctgagtgcttagtagatgagcctcccctatggacaccctggagctcagagggagggagagtgtgtggtgcagctggtttaaaggtttttctctgcgaccccaagctactcccggggaggcaggcatttggtaatatctgctagtgcccagcgcagtgggtgttcactgaaggctagtcaagcaaaccaatgagaaaatggggattgtgacatgcacagacatgcacagtagcctcacagcagaatagaaaaaggccggatggcaggtgcggtggctcacaactgtaacgccagcacttgggaagcagacagacagattgcggagtccaggagttcgaacanctggcaactggggaccatttagaaaacacaaggcgcgtggccccgaattcaccacaggcggggaaccgcccggggggcgccgcaccccgtgggaccaacgggtgcccccgcgcgcaggacgccgcgccaagggccgggaccgttgatcacctgt

SEQ ID NO: 195957 - DNA, 471 bp, Homo sapiens
gtgtaatcctctgtgcctcagtttcctcacctaaaaaatgagtgtcaaacccagtactaccccacagagtcattgtgagggatcagtgtttagaacagtgccccatgcagagcacacataagtgtctgccgtgactattactatttagctgacgtacctgaggtgggtgcgcaggtgtagaggaaagacgttcacgcctggccaggagtgtgaaacgtagacagccatttcagagggctcttgatgtttcaaaactttcaaactacatacaagactccccccaaggtgccccctctaaccctgaaattccacctctaggaccctgaatcccttggggtcaaacatgtttcagattttcggaaggtaacttggcgcatatgccccatcctgtgttactcttccccggggtctggggctgccccatgctgtagaccctctggggtgttcagcccacctcaagtgcaactgggg

SEQ ID NO: 195958 - DNA, 325 bp, Homo sapiens
acatgtattgaaaatagaatattctcaggatgcaaacccgaagatatggaaggctgactttgggacttgagtatttgaggatttttgtatactcgagggtcctagaaccaatcccctggatatatagagggacaaccatagttcaagagtcaaggagggccgggcaccgggctcacgcctgtaatcctaacattttgggaggccgaagagggtggatcacctgaggtcaagagttcaagaccagcctggccaacatggtgaaacctggtctctactaaaaatacagaaattagccaggtgtggtggttgggcacctataatccta

SEQ ID NO: 195959 - DNA, 272 bp, Homo sapiens
aatgtatctcttgcaactgcatagcttggattcacgaagaactttgcaaggatggaaggcgtatggggcaccatgaaagctattttatatacatactgagggaagggaagttacttgctctttggaaatcactgccatttatttgttatgtggagaatccctaaaataaaagcgcaaaaatgttgatgaaagatgatttacataaatatttcattgcatgctcttgtaattctgtgggaaaacatccatccaaacctcacctcccagacagg

SEQ ID NO: 195960 - DNA, 500 bp, Homo sapiens
ggataataggagttgttgaagatcttggagcaggccgttggtgtactggtatgttggtatggctggattttaggaagctggatcttgtggcatcgatgaatggttgattggagggtgttagggcaacagtaaacaacaatgaagatgttaacagaggtggggtataattagggcctgaacataggatggtgtcagtgggaatggaaaagaaggaatgggctgggcatggtggctcacgcctgtaatcccagcactttgggaggccgaggtgggtggatcacttgaggtcaggagttcaagaccagcctggccaacgtggggaaaccttgtctctactaaaaatacaaaaattagccaggtgtggtggcacagtcctgtaatcccagctactcaggaggctgaggcaggagaatcatttgaacctggaaggcggaggttgcaatgggccgagatcacgtcactgcacttgagcctgggccacagagcaagactctatctca

SEQ ID NO: 195961 - DNA, 320 bp, Homo sapiens
gctttatccaaactaatttctccttactctgaaatacctcccttagttggccctctaccattcaattctaattttaacatctacatcaagttcaaatgtctccctgttgatttctctaaaagggtttatagttaacaccacaatttgttctcaccttttcagatcatttcaagcatatcaattttatctctacaactgtaagattctaaagataaaaaatggtcttatattgcttcttaaaacccaaagcacataggagagggatggaaatttacatcccaattttttttttttttagaaaggacagaaaggtatcagag

SEQ ID NO: 195962 - DNA, 172 bp, Homo sapiens
ctgggaagctcccttacaccccctgccgccctcactctgctttaatatctctccgtttcttgctttcttaaagaagttctcatcttgagtctagtatgtacgtgtgcatgtggaaatgtatgtatgcaggtggaggtgtgtgtgtggagatggaagtgtgtatgtccagatg

SEQ ID NO: 195963 - DNA, 353 bp, Homo sapiens
taacaaaggccctataacaaaattgagacaaaagacagactggaagaaaacatttgcaacatagtcaatctacaaagtctttttagaggtaatcactcgaaaaaagacaatgaaaaaaagatgggcaaaggatttgacaagaaggttgataggtgatgaatacatattgccagtaaatgcatgaaaagatggtcaagttgacttttcatctaggaaatccaaattaaggcaaactataaattttcactcaagttgtcaaacatttaagaagtttgataatatcaagtgttgagcagggtaaaaggataatggaattttcaaaatgcaattgatgtgtaaattaatacagccat

SEQ ID NO: 195964 - DNA, 606 bp, Homo sapiens
ttgtccagaaagatttgaacccaagtttatttgcaaatgtctgctcataactgttacgattatactgtcttccagtagttggagcagggaattcagagaacacatctttgattctcttgctaaaatagatagtctaaataggttgcctggtagttttcttatagaaagagatctgtgaaagagtgcaacaggtactgggtcctatttgccttagagctcaccatagttacactgcttttgcatatgtgaggcttgtaggctatgctgtctaatgcatttcattcattacgtatgtcttgagagttctagagcagcatatttctagcagaaacttcgctggcgatggaaatgttctatatttgcactaatatggtagctgctagccacatttgactattgagcccttaaaagtagctagtgtaactgatgacctgaatttttttgtttaacttattgatttaaacttaagtagcctcatgtggccagtggctatttattggacagcgcagttccagaggtatattgcccacacttccttagttcctgcatattgtccacgagggatcggtatcagctcactgcaggcttgacctcctgggctcaagc

SEQ ID NO: 195965 - DNA, 815 bp, Homo sapiens
gggggacaggatacttgtcacatatttgaagaaattccatacagtgaaggaaatttgagtctgtattgctgctacaagggtaaaaccaggaccaatgggtaaaagtaacaggcgggcagattttggcttgaggaagagcttctagcacgactggttcatgcgggaatagctgctctggccacctgcaggcagaaagtgggggaagtggctcctggcaggagatttctcccagcactaatatcctggtgttctataaaatctttattgagtgcctaccggtgcaggcgctgggagagacaatagctttgaggagctcacaatctagctgaggagacaagacacatccaatgctgcaaaaatggtgaataacctgattcagggttagcagcaatgagtatcacagcgtccaactcagtagctccagtgtatgaaaatgtctccagggctaaaggctggagatctcaccagtggggaaagtacatctgagtcaggattttgggggaaagctagttactgatagccacaggaagttgagacttctgccccattctctccaatggctgggtgaaaaccaagaattcatcggaagatggctttggcctggaggtagctagggtggtctaggaagctcactcctctcttagtctcagtctttcattctttctgctgagactggcctgaaaggctggcaagtgggagggagtcagtggggaggccaggatagaactagagctggtgtcccaggttccagtctgggctcttcactgacaaagtgggcaacactagaaacttccctttgtctctctgggccttag

SEQ ID NO: 195966 - DNA, 540 bp, Homo sapiens
aatgaatgaagcattttttgctataaacttggagggtctaattattggttgttatctctttaaaatcatctcatttccatattttcaattcatttatattatgtatgtggccttatttatgatttatttttttcctgcatggtattaaaaacccaaataggtctgggcgtggtggctcacgcttgtaatcccagcactttgggaggccaaggcaggtggattgcttgagctcaggagtttgagaccagcctggctgacatggcaaaaaccatctctactaaaaatacaaaaatgagctgggcatggtggtgtgcacctatatagtcccagctacttgagtggctgaggtgggaagattgcttgagcctgggtggtcaaagctgcagtgagccaagatcaccccactgcactccagcctgggtgacagagcaagaccttgtctcaaaaacaaaacaaaacaaaaatcaccacatggactcttatattctgtactaaaaaaatagaaggaactagaaggcagatgtcaaagttgtgtttggg

SEQ ID NO: 195967 - DNA, 549 bp, Homo sapiens
gcatcttcctcttctgctgccacgagccgccgtgctgtgccgccctgcgagtttctaggaatcagctacccaggaaaaatgatttttactcatatgagccaccttctgagaatccttccccagaaacaggagaatcggtgtatctccaacttaagtctggtgctcatctctgcagtgtttgtggctgtttaggccccaaaacttgctccagatgccacaaagcgtattactgcagcaaggagcatcagaccctagactggagattgggacataagcaggcttgtgcacaaccagatcatttggaccttacaactccagaccacaacttcctttttccagaatttgaaattgtaatagaaacaagatgagattatgcctgaggttgcggaaaaggaagattattcagatattatagggagcatggttaagcagtttcaggacttcattcattaagtggttaaacttaatgcttggaagaaaggtctcaatgtgtctagaagagaggtactgagaggaagactcactttggaggctggagcctacaatttt

SEQ ID NO: 195968 - DNA, 169 bp, Homo sapiens
gttgctatttttttgttgttgttgtttggcttggggccagtcttttcacggctgtagtgagcaatgactttataagaccaaagagacatagaaaggtttctgctgccccaaattatcactctacaggacacgtcacagtgcctaaaattcctcacatttcctccttgga

SEQ ID NO: 195969 - DNA, 888 bp, Homo sapiens
cctcctacactgtgtgaactcaaatcactgtaacaaatgccttaatacatacacacacatatcccatatacgttttcctttatccatcctaggggtttcatttttctaaaccttatgtgatcctgaaaaaaatattacaattaaaagtcaacaaggccgggcacggtggctcacgcctgtaatcccagggaggccaaggcaggcggatgacctgaggtggggagttcaagaccagcctgaccaacatggagaaacccgtttctactgaaaatacaaaattagctgggtgtggtggtgcatgcctgtaatcccagctactcaggaggctgaggcaggagaattgcttgatcccacgaggcggaggttgcgatgagccaacatcgcgccattgcactccagcctgggcaacaagagcgaaactctgtctcaaaataaataaataaaagtcaacaaattgttacttaataatcactgtatgacaaacacctgtgcagacaagacatttaaccaaccagacaccctcaattttcttattatttaattctcgctactgcacagggtagcttgagccctcacaattcagacactgagctagataccagaaaagtaattacaggcaaaaacaggaatggttctgctttcatgaaactcagcctttgtgggaaaactaaaattaattaaatcacataaactaatataacattgtaattctgataagcaccaagaggacttgactgcagaaaagtcaaaaaaattcaagaacttcagacagccaggcacggtgactcatgcctgtagtgcagtggcacaggtgggaggctgaggcagcactttgggaggctgaggcaggtacactgcttgagttcaggagctcgagaccagcctggg

SEQ ID NO: 195970 - DNA, 435 bp, Homo sapiens
cctcctacactgtgtgaactcaaatcactgtaacaaatgccttaatacatacacacacatatcccatatacgttttcctttatccatcctaggggtttcatttttctaaaccttatgtgatcctgaaaaaaatattacaattaaaagtcaacaaggccgggcacggtggctcacgcctgtaatcccagggaggccaaggcaggcggatgacctgaggtggggagttcaagaccagcctgaccaacatggagaaacccgtttctactgaaaatacaaaattagctgggtgtggtggtgcatgcctgtaatcccagctactcaggaggctgaggcaggagaattgcttgatcccacgaggcggaggttgcgatgagccgagatctccacactggctctctccacttcagcctgggtgactgagcgagactctgtctc

SEQ ID NO: 195971 - DNA, 674 bp, Homo sapiens
tattttcattctttttactttaaaatatgccttagtttttgaatagataagacattcaagtgtcagaaagtaaaagtcagttcaggactgagaaaggaaagatcagtgctgattttaatcagactgtaatgtaccaactagatacagacagggccagtggcaaggccatcagaaaacttcttcccaaggccacaccacacctgcaaaatgcctaacaaccttcttcttttcagtgattaccactttcttaccaatgacttcgctttgttcctcgtgcctctgaacagactgctgagatacccaatcaagagccaatccttgcttccctagactctcctcaatcattcaacagaagcccaaatcttgtaaaagttcctttctgggccgggcacagtggctcacgcctgtaatcccagcactttggaaggccgagatgggtgaatcacaaggtcaggagtttgagactagcctggccaacatggtgaaaccctgtctctactaaaaatacaaaaaaaaattagctgggcatagtggtgggtgcctgtaatcccagctacttgggaggctgagacaggagaatcacttgaacccgggaggctgaggttgcagtgagccaagatcgcaccactgcactccagccctggcgacagagtgagactccatctcaaaaaata

SEQ ID NO: 195972 - DNA, 249 bp, Homo sapiens
ccatgaggtccaactggccattaactggacctttcagagaatagaaaaaaagcactgggggaaaaaaaatcaagaattcaagaaattttcctagacctgaatgacatgagtttcctgattaaaagggccaagactgccaggtacagtggcatgtctataatcccagctactctgggaagctgaggcaggaggatcacttgaagccaagagttccagaccagactgagtaacagagcaagatctaccacg

SEQ ID NO: 195973 - DNA, 532 bp, Homo sapiens
ggcacctttatatacatcatttcacttcatcattattaaagccctataaagtaactcttttattcctgttttacagatttgggaatgcagttaaatatattattcacttgctcaaggtcataatgctaagaagtggtagaatcaagatttatatccaggcccaaatttgaagtttataacttgcattttttccattacatggtacgtgtcttttggttagagttagagacagcagctggacttcaagagtttggtaacattacttactttctcttactaaagaaatggggttggggggaggaaagagtctacaactgagctttaaattggggattagtggaagcatattttataacattttaagttcaatgtcttttattgggttggccttgaaatgaaagtctaggaaataagatgtctgctctgagatgggggtggaagatcctgtactttcacatgcctgttaaaattagagatgaaatataatcagttgatggagggcttggataaaagaaactgagacacataactg

SEQ ID NO: 195974 - DNA, 262 bp, Homo sapiens
gcatgaacatgtccaagctatcccactggaggatgaggaacatatggcccagtgattctgccccactcaacagcctatcaactgccagactcatttgaagccagaagaacctcccagctgagtccgtcctaattcagtcaaccctggcaactatcaggcatactaatgggtccaaccaagaccagaagaacttcctagacaggccaacctacactgccatcctgagaccatggccttagtaaatactcattgctttcagcca

SEQ ID NO: 195975 - DNA, 175 bp, Homo sapiens
agttcatgttagtgacagtaacaaaaagtaaggctgttttatgactagggagagattattgctgagtcagttctgcattgatatcccatctccagggagactacttccgttaggcaaaccaacttagtaaagtaaataacattttactcagcattataaccacatgtgactagta

SEQ ID NO: 195976 - DNA, 157 bp, Homo sapiens
gttcttcttcccaaggacaaatgcatagtatatctcatgtttttatagcctcctaataaaaggcagttgtatataaattctataaaaacaaagctctcatgggatttgagaggagatgaaattaagttatttctatagtcttgggctctgccattta

SEQ ID NO: 195977 - DNA, 395 bp, Homo sapiens
caaaatcccatctctacaaaaaagaaaaaagtaaaaactagccggaggtggtagtgtacacctgtagtcccagctactcaggaggctgagctgggaggatcacttgagcccagggagtttgaggctacagtgagtcgtgcaccccagcctgggcaacaaatcaagcaagaactgtctcaaacatgcaaacaacaaaatccccacaaactcttcctttccttctttcctcgtgggtcaggatgagggtagggatcttattcttcctgcacggagaagcctggggtatcttttttgggccaggctcctctgtgcaggaagagtaagacgctcttcctctccttccctgtggcatcctgacttcagctatctttcagtgagcctgacactagacatgg

SEQ ID NO: 195978 - DNA, 908 bp, Homo sapiens
  misc_feature (11)..(11): n is a, c, g, or t
  misc_feature (20)..(21): n is a, c, g, or t
  misc_feature (23)..(23): n is a, c, g, or t
tagtctagtangaggctggnntnccacccggactggctgcctttgagaccctgtccctgcctacctaatccacactgaccccattcgcccctgaacacccttcgtcctcctccaaaaccctcctactctgtctggtccccagttgtacgacatcttcccgagcctcctgaactgggtgcctgggccgcaccaacgcatcttccagaacttcaagtgcctgagagacctcatcgcccacagcgtccacgaccaccaggcctcgctagaccccagatctccccgggacttcatccactgcttcctcaccaagatggcagagaagaaggaggacccgctgagccacttccacatggataccctgctgatgaccacacataacctgctctttggcggcaccgagacggtgggcaccacgctgcgccacgccttcctggcattcatgaagtacccgaaagttcaagggcaccgtctgtgcctgggagagtcgctggcgcgcatggagctctttctgtacctcaccgccatcctgcagagcttttcgctgcagccgctgggtgcgcccgaggacatcgacctgaccccgctcagctcaggtcttggcaatttgccgcggcctttccagctgtgcctgcacccgcgctaacgccccggcccttccagattcgcctgtgagcgatgaggcccacccatgtgggttgctacgtccccttcttggtccacggtctgcctccatccctctggcagtcacgctgtcttccctgcatgctgtgcctgccggtgccttcccccatccctccaatctgtaccccgtctgcaggcaaggcagatgtggcatgtctttttgtacccacagactgtctatggcacgcctttctgggctttttgtatcatttcttagtacattgtaa

SEQ ID NO: 195979 - DNA, 504 bp, Homo sapiens
tcagcccccggagtagccaggactacaggagcatgccaccacacacagctaatttttgtatttttgtagagatggggtttctccatgttggcaaggctggtctcaaactcctggggtcaagtgacctgcctgcctcagcctcccaaagtgctgggattacaggtgtgagccactgcacctggccaatttaaatcatatttgaaacaccatccacagacacacttgataaataccttattctgaatcccatagttatgtaaaataatccttaccactcaaaatagaatagacttcttttgccctggaatcacccacttatgtggttcccattttaaaacatctagaggccagaaagggggttggggggctgaaaagaaaaaaacaaaagaatataaatgtatttttactactgaattgtacacttaaaaatggtaaagatggtaaattttatatgtacattttacctctataataaagaaataaaaattttttaaaaatttaaca

SEQ ID NO: 195980 - DNA, 273 bp, Homo sapiens
attcacccaaaggtcagaagcggtgagttctggagttctttatggtgtcctgggaatgcctttcaagtctctggctgctcacaatatttttgtgtgtgctgaactgttatctaaaacgaagtatttcctaatttcagcctactctgagaaccttcagcttttaaagagcttgctgtataaaaaacacaacaggcctctgtaattctacttcaggtgcgatctggacaccatgaagcactgcaaattctctaaggggatgcccgttaatgtcaa

SEQ ID NO: 195981 - DNA, 641 bp, Homo sapiens
tgtggaaggaagcggaagaccagaagagcatcacactgcctcaagtcccaaatttgattctgctcctgatcctgtgactcaaattgtcattctcttttactgctgtggggtgtgctctgggcccagctgacaggacattctttgtactccacgtatttatgctggtgggagttgtatggctagtgctttgtgctttgtctcagaaattgtgtggactaaatgtaatatgggcagtgaatgggtttcttctggaagatgttaggcctggagggtggtttgggtttttacgagtctttttctcagattacagattacgaatggatgttataaaacaggcgtgagccaccgcgccccgccaggaaatcctttcctactcttaacaacagatcaatagtcatctatattttcttcctaaaaaacctgatgatgtattatattcatacatacgtatttaatacatacaaaagggccaccgtgcctggcctcaggatggtgtatataatacatattctgcatttttccatctcatatattcatctctgcctcatttctttttaaatagcagttgtagttccagggctgacttaaccgtcatgcatttcgaagtcctctctatgttataacagatgctacagggattg

SEQ ID NO: 195982 - DNA, 656 bp, Homo sapiens
cttctctggattaggaatccaggaacagctttgctaggtgcctctgcctcaaggaatccacaaggctgtaatcaaggtgtcaacagggcttaggtctcatctgaagactcaactgaaggaggctatgctccaaactcactcacattgttgttggcaagattctcaagtagctgggaccacaggctagttctttgaaaagaaaaaaatggcagaccattagtaagattaaccaagaaaaggagagaagatccaaataaactcaattagcaatgaaatgggagatattacagccaataccacagaaatacaaaaagatcattcagggctactgtgaacacgtttacatgcacaagctagaaaatctagaggagatcgataaattctgggaaaaaatacaaccctcctagattaaatcaggaagaaatagaaaatctgaaaaaaaaaaaacaataacaagtagcaagattgaaacaataattttttaaattgccaacaaaaaagtccagaacgagatggattcacagctgaattttatcagacattcaaagaaaattggtatgatcttactgaaactattccaaaagatagagaaagaaggaatcctccattctatgaggccagtatcaccctaataacaaaaccagtaaaggacatta

SEQ ID NO: 195983 - DNA, 543 bp, Homo sapiens
gacctatcatagttacctcaccaattgctgccatcctttctaaaggtacctcctccaagaagccttcacagctccaactggtagagaacagaggtcaccaaggctctacctcaatcatatccataacaaatcttagcatagtgcatcttgattcatctgattggcactcaatctttcctcaacaaactaggagcttcttaacagcaagactggtgtttcacatacctgtatcccaagagtagatatagcccgatactacagtggatactcaggaaatgtaggctgactccagtgctacagggctttgccttgggccctgtcccattcatactatatcaatgactttaaaacaaccaaatctgttggtgataataaattggaagggaaagcgaccaccatcaaagacagcactgatagccagaatgatttctataagctgtctctcaaggttgaaacccataaacaaaataaaatctcatggagagttgagataggcattgcatgaagtttcaaaatgcacatacaaaacagaaaagattccaa

SEQ ID NO: 195984 - DNA, 130 bp, Homo sapiens
tgtagttcttggccctcttttcccctctcactccccacattctcttatgcattctcagcatttaaacaattatcagaaataaggcttcagttcaaaggctgataaatagggatgtgaatcccacaacttg

SEQ ID NO: 195985 - DNA, 393 bp, Homo sapiens
acaacaagtagatcagaactatatgttatcagtgtaaataatttcaaaagcatgatatcaagtgaaaagagtaaagaaattttgcgtatacagacttgcataacatgtagaagagaatcatttacataaaatttaaaatcatgtaaaacaaaactatatgtttttttatggacagatgtacatgcactacaagtacatagacatatttgttatttgagaggctgaggtggggtttcattgtgttagccaggatggtcttgatctcctgaccccatgatccgcccgtctcagcctcccaaaggactgggattacaggagtgagccactgcacccggcctacttgtcattcttaatagctcctcttcccgggcttcaaaatacaaaagctactaa

SEQ ID NO: 195986 - DNA, 258 bp, Homo sapiens
atctgtctttctctacatcagtgactaggaagtgaaaggaaatattactggtaatatctctcagcttacagaataacaccttcccttcccaacattaatcattcactgacattcagagagtttttagaaatttgcttatgggtaatctttcaataagtagaggctgaccctttcatgatttgatgtccctttgtcaccatgcacgtgattacgtgtcaacaaatgttcattacaagttgggctttctcaattagaata

SEQ ID NO: 195987 - DNA, 821 bp, Homo sapiens
aagaagggggatcttttaaagaaggcagtcacaccgccatgattgcctcttaaacaatggacagtcgctacttaccagcaaacatctggtcaatgtttagatgtttccactaatctcacaggctttttgcagctggatcaggatccaaacaagatccacatgttgcatttggttgacgtggccctaagtctcttttaatctcatacagttctccttttcccccctgaaatatatttgtgaggtaaactggttgtcttcctgggcttcctggagctaattttcctagttgcacccctaggtttaagttggcctgtgcttcctggaaatggttcgcatccaaggcttcataagattccggctcagtgtggccggaatggttactgggggtgccgtatgctgctgttggggctggaagatcctgtcgtctctcctattatgactggcttgcagcagtgtgcatcgccagcttgcagaatggtgatctgctggctctctcattccatctacattaattaactgcgatacttccagaacgagagacttcccctcaggtgtgttggggacagacaggcaggttccatgtttgctgtttcctttgatttccctgtctccagtggatgggttggtttgggagatgcttgtctaaaaatgagggaaagatgttggcttcagcaaggcctaatgttcctccagatttggatgtggctggagtctgtgaggagagtctgggtgactggagtgagagccagcagggagtgggatggggtagaggctcatgcggagggacagggagtcactagagacccagtgccggccacaca

SEQ ID NO: 195988 - DNA, 340 bp, Homo sapiens
gtcagattatccaaaccctagacttggaagagatcgatgaaattgaggaggcatacacagccctacggcacatgcagagagactccaaccccacggtcagctgcctcaccacgcagactttccatatcctggaagccaagaagaagctgctactggccaagcccccaacctcctgcttctgcaggaggaggccccaaaggcactacttctgagcctgcatccttgagtctcagatgtaggcctggccattagaccctgtgacaatggggccagattcctgggtcctgcactagaaatggaggtgtatccctgcagaatctttgtaataaaaggaaaaagt

SEQ ID NO: 195989 - DNA, 406 bp, Homo sapiens
actattacagagtattttgcatgctgtacattttaagtgaaataacattccagttttatttttaagatagaaaattgttatatatatatataatttgatactctattcttacagtttcaaattccttatcccttctttacaaaaaaaactttttttttacctgttatgatttattctatacttttttcttcttccttcccctttcccacttgccatttattacttcatgtcattgccatatgagaaagtaccaaattatatccagtttcctcctagtgatattactctgaaaaatttcacaaagccagacaagaataattactcattttttttcccaagacgaccctcaaagttaatgtgcagcaggtattccaaatggtaatttttttttttaggattccctaat

SEQ ID NO: 195990 - DNA, 553 bp, Homo sapiens
atcgatctcggcacccgtcagacgctgaactctgtgtagagtgatgtcctggtttgccggggactttcaccagttttagcactgaaagacctgtgtcctgagaaacccctcagccttggcaaagcagaatgagtagtcactcaatgttcgtccagaaatgtcacttctaagaatttatccaaaaagagtactttttttttttagacaaggtcttgctctgtcaccaggttggattgcggtgacgtgaacacagctcactgcagcctcagcaacagagtgaaaccctgtctcaaaaacaaaacgaaacaggccaggtgctatggctcacacctataatcccaggactttgggaggccaaggtggaaggatggcttgagcccaggaggctgaggctgcagtgagccaagatcacatcactgcactccagtctgggtaacagccagatcctgtctcaaaaaataaaacaaaaaaataaccctattctcataggtaaaaactgatattttaccgttatttaatggaaatcacttccgaaaagtcttcacatagttca

SEQ ID NO: 195991 - DNA, 287 bp, Homo sapiens
agcctgtactcagagaaggaatgtgagggagagcaggacatggaatgagaagccaccagggtcacagatgccttctcaggcctaggcccagctcttcatgagatcaagcttcacttcctgccctgggattccagggaatacctctgtatcctcttaatcctttttacttgagctagcggtaatagacctactcatgttaccatgaagctgtcttagacgctgaacccaaagttgctggcttaaggatgagatataatcaagcgttttctgggtattgaatggagaga

SEQ ID NO: 195992 - DNA, 356 bp, Homo sapiens
atcttccttaaactaaaaacaaaacattaagtttactatatactttattaaacttttataaaatactaaaactagaggagaatttgtagaatatgaatgccgtgataaaaatcattacacttcggcattcttcggtcaagaagccaatgttaactacgtaaacattactccttaactaatgttaactagaataaccaatcatacgagactgcaggttttaaacctctagtgtttctcccgcttattacctcaaacttatcttccttctctcttttgtgttgtcacggtatatggcaatttctgctttaaaatgtatgtatgccttaaccagccctatgcgactgcacataacaaaa

SEQ ID NO: 195993 - DNA, 527 bp, Homo sapiens
aaagagttaaaatagagtaactatgtgactcagcaactccactcctaggagtccacgccccacaagaattgacagcagtgactcaagaagatacctgtgcacacatgtttatagcagcattagtcaccttcaccaaaaggaaccaacaacacaaatacccatcaatggatgaacggatgaacacaatgtgttccagacacgctatggaatattacgcagccataaaaaggaatgaggcactgatccatgctacaacctcgatgaaccttgagtacatcatgcagagtgagagaggccagaatgccacctcttgtatgactccattgatatgaagtgtccagaacaggcaaatcgacagagacaagaagtagattaatggttgtgagccacttgaggagggggaatggggagtggctggtaatggggatggggtctccttttggggggatgaaaatcttctggagctagacagaggtaatgattgtacaacactaaatgccactgaataaaatgattaattttatgtt

SEQ ID NO: 195994 - DNA, 424 bp, Homo sapiens
gttcctcatcatggtgggaagcttcccagacaatgaatgtggacaaagcctttggagctccaagactagaacgagtccatcatcacttctatcacattctattggccaaagcaaatcacaaggccaagcgcagagtcagtgcggaaggatcttaccaaatagcatagacactcagagatgtgaaaaatcagggacaagcaaccatagtgatggagcccgaatacaaactccagagacctcactcctagaggtcttactccacagtcatctcccaagcaaatctttaattagtatctatgtcaagttccacctagcctggcactgtgaaagagcaaggtcctgctgttaaggagtttacggcctagataaggagaggagacacccaccatgaaagtttggtaacaagaaaggtaaggcaaatgta

SEQ ID NO: 195995 - DNA, 232 bp, Homo sapiens
cataaattccttgagggaaggtagatattatgtcttgattgtgtttctattttcagtgacaaaagcaagttaaataattggcataaagtcaaagtaaagatctaggctaagattccagtacaaacctgccaggaataactgcactcattctccctacaccatactgctgtcaggtgcaacgcttacattactctaacttcagtgatggttatgtgtttacttcatatgatgg

SEQ ID NO: 195996 - DNA, 545 bp, Homo sapiens
aaatgcaagaaacacatatttgacttatccatttactttagccaaacagtctccttatttttaaatgtctgtgtatactactttgacctgcatcttaagaaacatatcaaaagtagctgacaaattctaccaccatatggttcatttctcttttctttgttcctttttacttctcactgtagcagtgtctgcagaggggagatgtttagagaactctccagataatttggaaaaggaagtagctaggggctcaaattttgtagagtgactctctcctctgtttgaatctgctagataatttcctgtttcattttgtctgagcaaaaaacaagcctcctttatgcaaaacagtttactgcagggaaagaataaatttgctggattaaataatttattctctttagtttacaacctgagttggatgagataaaatctagaaaatctacaagcaaaataaccacattttgaaatgttgccttcttttgttcacaggagctaaatgtgcctcttctttattagccaaaggcacaagaactaaatacaaa

SEQ ID NO: 195997 - DNA, 276 bp, Homo sapiens
ctctatcttttcctggtcctgattttcagaactgcctgggcctgacccaggatacccacagctgccacttctcttggaggatctagtgattatcaacccctgggtcactcctcccagaggacagcttaaggtgtaggggtggggcctctcacgggagcagctgtatgccctgaggtgggaggagtctcccggtatccccttcctctgaaaagtttaccctttgggacgctcagcttttcttcctcaaccccagtttccgttccttagggacacatt

SEQ ID NO: 195998 - DNA, 446 bp, Homo sapiens
gaatgtgtggtgtgtggtgggaagccccagccttaagagtcaggcaggctcagggtccaggccctgctccccattcccaggctctatgacctcaggcaaattattcttctctccagggcttagtcttctcatctgcaagatggggataatcatgcctacttcataaaattgttgggaggattaaatgagggaacctatgtaaggcatacctggaatttagtaagtagtcattggcgctgctatcgtaataggagggagtctgctttgagtaatccagtgccttctgaaagtttctccctaattgttgcccctcagccaaggtgctcagagcgtttaggtagctgatgttgttttaggcatgtagtgcatgtaagtgctggtgccaccctgtcgcttttgaagcctgctcctgagtgtcctggagctcctgtgtcatgtttgctctt

SEQ ID NO: 195999 - DNA, 418 bp, Homo sapiens
ccttagaagtagatcaaatttgtattttaaaagcaaaaggatttcatattaaacctatctgtaagtctgtctgttttggaaagtaaaagaaaaactattttaaaattctaatagcatagaacatggaactaattctactttgtattcctctagaagtggtacccaaccttggcatcaggaactagttttgtgaatgacaatttttccacagatgtgggttggggagtggggccggatgaaactgttctacctcacatcatcatcaggaattagatgctcataaagagcacacaacctagatacctcagaagcgcagttcacaatagggtccgcactcctatgggaatctaatgccgctgctgatctgacaagaggtggatttcaggcagtaatgctagcttgccagtgtgtcgctcac

SEQ ID NO: 196000 - DNA, 308 bp, Homo sapiens
accaggtgcccacttaactttgaaaaagatatttgttggtggcattaaagaagacactgaagaacatcaactaagagattattttgaatagtatggaaaaattgaagtaattgaaatcatgaccgactgaggcagtggtaagaaaagggattttgcctttgtaacctttgacaaccatgactccatggataagactgtcattcagaaataccatagtgtgaatgaccacaactgtgaagttaggaaagccctgtcaaagcaagagttggccattgcctcatccagccagaggtggaagtggttctgga

SEQ ID NO: 196001 - DNA, 494 bp, Homo sapiens
taggtatttcttattccaaagatactgtcttggcctagaaaacacataaaccacagatgatacattgggatatagggtacattttatctaatgataggctgacgttggtttcagtttgtaatctatgagtgcacataaaatactgctagaaggcaatggccacagagttgtgctcaggacatgtgcaattctgaagttaaaattactgtgaataatttgcctatggtcaataaaagctaataaatgctagttttctttttacaaattaaattcatagaactattgctctcaaactttgatatattgtattatttttccactgtattatttcagagatgtgttcccatagaaaaggagtaactatatcaccaattttaaacatctctacttaaattttaattttaatatgtacttcagggtgcattcattcattaagcagatattgatggaatgtctattctgtgccagtcactgtttttcatgctggggatata

SEQ ID NO: 196002 - DNA, 572 bp, Homo sapiens
aagctcacagcaaagagaagggtcctgaaagcaagttgccagttgcccccttcacagttgaatacaagggtgtaaggcacgaatttctggtggctccaccccatccttccagtgtgcctgtgggcccttggtctgagccactccatattaatttatatcccttgctgtgcatatgttacggaatggaattttccacgtggacatgtttaggcaatccccctttgcaagttcccttatctgcacaaagcatctcatgctgtggagccagtggcagattctccggggacccttcccttactgtctgcctaaagcaaactggctaaattctttcacaagtttttctttttcttttttttctttttctttctttttttttttccaatttgcattagaaagcttttattgagacaaggtaaacagtgggctgaaaatattacaggctgaaggaaggctgaggaaaccagtatgaaggctgctcaaatgatgaactaaatacattccaaaggtactatttatacttaaggcagttttaaaagtgaggtcttaaccaaaaatcctttacatggcattca

SEQ ID NO: 196003 - DNA, 1028 bp, Homo sapiens
ggatcctggaaccaaaaaagaaccttaggtaaaaactaacaaaatccaaataaatgaattttagttagtagtaatgtaccaacattggttccttaacggtgacaaatttaacattgaaatgtcagacactggcaacatgacgagacccccatttcttacaaaaaaaaaaaaataggggaaactgggtgcaaggtataccttaactccctgtaacttttctgtaaatctaaacatattttataagaaaacatttattcaaattaaataaaaatatggggaagttgttgccttaaccaatctgattttagtcctttaaggcatgtatagtgggttggacaaaaacagaaatacaggtagtattgtgcaaaataatctcaacattgatgaaccatttataatactgtatgtgtaagtgcctataagtcatttttttatgtgcacattttgattccttaattggtaagaactacaggagcagaaagccctcctccaagcaggaggaggccactcaaatttgggactaaagcaaaactgtggtactaattatattaataaaaattccacctgggccgggcaatggtgtctcatgcctgtaatcccagcactttgggagcctgaggcgggcagatcactttaggtcaggagtttaagaccagcctgaccaagatggtgaaaccccacctctaacaaaaaatacaaaaattagcaaggcatggtggtgtatgcctgtagtcccagctacttgggaattgcttgaacctgggaggcggaggttgcagtgagccaccactgcactccagcctgggtgacagaacgagactctgtctcaaaaaaaaaaaaatccacatggcttttgtagtggtaaatattttttttgtttctaaatgaaagccgaaatacaaagatcagaaatttataaaggctgggcatggtggctcacgattataattccagcactttggggggccaaggcaggcacatagtttgagaccagcctgggcaacatggcaaaacctagtctctacaag

SEQ ID NO: 196004 - DNA, 243 bp, Homo sapiens
ggtttacctggggaaggtggcatgaagtaagggcatgagattggagggccacatcacctacggcctgatccagatttgtttcttagcctgaagtacgggattccttagaagggagcaggtgcacaaggcaggcagattggtgtttttgaaaggtaccctggctgctttttggagactgaattggaaaggtgtattaataaatcaggtttctgggtgtctcttgctgtgttgggtgagactggg

SEQ ID NO: 196005 - DNA, 447 bp, Homo sapiens
gccgtattacatagtagtaatggcttgctaactgtgaatatactaaacaacacgaattgtatatacttgaaaagggtaaatgtgccgggcacggtggctcatgctgtaatcccagctctatggaggctgaggtgggagaatcacctgaggtcaggagtttcagaccagcctgggcaacaagagcaaaactccgtctcaaattaaaaaaaaaaaggatgcttttatatattttgtgtatcatgaattctcttatagcagaatatataatttaagaccatcacctcaaaacaaaacaaaaacaccagattacttttgtgtaggcagagtttgttatacacaattgcaaaattctgttttcttagaaggcactattatatgtacacttaggtgtttagaaacctggagaaaacctcaaattttcatgaaaacagaaacttagcactatat

SEQ ID NO: 196006 - DNA, 443 bp, Homo sapiens
agggggttctaatgcatagggagagggtagtttcatctccagtaacagtgtagtaatagcagagaataaaagtagccctgtccaattaagtgtaatgtgagccacaaagacaatgtaaattttctagtagccacattaaaaagtaaaacacgccaggcatggtggctcacacctgtaatctcagcactttgggaggccaaggtggatggatcacttgaggtcaggagttggagactagtctggccaaaatgatgaaaccccgcctctactaaaaatacaaaattagccaggcatggtggcaggtgcctgtagtcccagctacccgggaggctgaggtaggagaatcgcttgaacctaggagatggaggctgcagtgagcggagatcatgccactgcactctgttgcctgggcaacagagccagactgtctcaaaaaaaaaaaa

SEQ ID NO: 196007 - DNA, 369 bp, Homo sapiens
tagctagggggtcatttggacttgaaaaggaggcatggtttctgagtcttggctcaaggcaaggatggtgtagacccctatatgttataatgacattcacattgataataattgcagttaagataatggtgaaatacgtactggatccattcaaggcattgtacacaatgaggcaccatagagtttagatactcctgttaatttcaggtactgatagtggatagagctaatctgagagccaggaacatatagaatcttctaagaaaataattaatagtctaaaaatgtgagccaggctactgaaagttaggaagtcaaaagtagtcatgcataaggcaagaccaaaatcagattacttgcttagtaatg

SEQ ID NO: 196008 - DNA, 454 bp, Homo sapiens
tagctgagattacaggcatgtgccaccaggcctggttagtttttgtatttttagtagagacggggtttcaccatgttggccaggctctgcctcgtgggttcaagcaattcctgtgtctcagcctcccgagtagctgggattacaggtgtgcaccaccaagcctggctaatttttgtatttttagtagagacaggttttcaccatgtcggccgggctgatctcaaactgctggcatcaagtaatccgcctgcctcggcctccaaaagtgctgggatgactgctgtgagccaccacactggccaacatctacagacatttctaattgtctttaagttcagaggatgctgccgaacattgacacatcgttaccactcaaagtccatcgtttacattagcattcactggtggtgttgtacatagatgcatccaccattacaatatcagatagactcat

SEQ ID NO: 196009 - DNA, 129 bp, Homo sapiens
cactccccatccctgcttttaaaaacagattcaggctttccaaacaaagtcatctgtaaaccttgccatggaccaacagaagaaattaacagtgactccaggctagacaaggtggttcacgcctgtaat

SEQ ID NO: 196010 - DNA, 282 bp, Homo sapiens
ataaaattattgtggagaacgaaaggtgttgcttctttaaaaccaaatctacctttatctattcttttatgtgttaataaagttgaaatacttgatactgcataaccttctgcagtatcttttgtccttttcctccatgagaaatcagtttccttgcatcagaataagtcaaaattccctctctgtacgtgccgcaaacaagaaatagtagtagtattatcaaagagttcttgcacatgaatacaggtatatttcttaaactgacatcaaaaattgccctcc

SEQ ID NO: 196011 - DNA, 202 bp, Homo sapiens
agcagcacacttgcaattatactcaggtatatccactatctccaagaagcctgggtttatgaacagaggagaagagaagacaacagagaaagtgcctactgcctctgaaattctgaccagggatgtgttctttcactagtttacttatactaagaactctatcaggtgccaactgaggtattcccaactcatcacctaaaaa

SEQ ID NO: 196012 - DNA, 498 bp, Homo sapiens
tgggattacagatgtgagccaccgcgcccggcaataacagttcttttcaaagggtaaggtttgaatccaggtcttagaacagtgcctggcatataactaaataagggttatctctgattattattcctcaagctcagtttggtgaaccagatagatccacaaatgaataattatacaaacagtgaaatgcagttgagacaaatgcttctaagaactatagagtcctgagagggcataggaaggaggctgggggatgacctggcctggagagggcgttgggtcttttgggaagggatgtttgccatgagaatgggtaggaactggcctggcaaaatggagcaggaggaagagtattcccagccaagggagcaacacagggcaaggctatggccagggaaggggtcccagaggtttgagaggggtacggaaggtttagcaagggccaaggagtgtgggctttgttatagggacactggggaggcacagagaggggttaag

SEQ ID NO: 196013 - DNA, 321 bp, Homo sapiens
tgatcttcttttagatgtctttctttacacccccaaggtgcaggaaaatagctgtaagctgagggtaatatgcttttccttttaatatgttattcttatatcaagaccattctcttggccgggcacggtggttcatgcctgtaaccccagcactttgtggggctgaggcaggtggatcacatgaggccaagagttagagaccagcctggccagcatggtgaaacccagtctctacttcaaaaacaaacaaaaacctgggcatggtggtgcatgcctgtaatcccagctacttgggaggctgaggtacgagaatcacttgaa

SEQ ID NO: 196014 - DNA, 342 bp, Homo sapiens
ggaggatgtagaagggaacttctgtctagctgttgctagatgacctgtctcacacggtagcccattccatcattaggaagtgccgacaatcagaatattccccacaccctcttccctctggccatagatctgttcttgagtgacacgcagagcaaatctaaatttctttttctcatgatgacctttcaaataattaaagcagatcctatgttcccgttcaatatttcctgctctaggctacatctcccctgattccttcaactgttctcagatgatgtaatttaagatttatatttaccactgttcacagaaatagaaagtttcaatgatcctttatcagtg

SEQ ID NO: 196015 - DNA, 415 bp, Homo sapiens
agaagaaatgtaaaagcagagatgtgaacaagagatagagtgcatctttgttgcttgggtgctccccctgttgtccaatggcagaagctccacgtcttcctctgagggctgaatctggttctacttgtgcccattggatcctcttattgatgagggttacaaaggccgagattggcctgccagagagacccacagcacctcttcagacttactaccttctttcctttccttcttttgacaaatatgtattgagcactcctagtccaggaattgtaccaaatgcccagaatataaatgaacaagacatggtcctcaaccaccaccctagagacaggcataaaaagaactgacagtaacaagcccctaatttcatgtagtaaattatatctaataaagtgccttcgcttttcatgga

SEQ ID NO: 196016 - DNA, 145 bp, Homo sapiens
tatgcatgccactcactctttttctcctttattttcttcatgtaatcctacctgaagttatattatttgttaattgcttattttttaccataggactttgtccagtctaccactgcaaccccatcacccacatagaaagtgtgta

SEQ ID NO: 196017 - DNA, 816 bp, Homo sapiens
gagccgttcctgccacgagcttctagtgcatgttctattctgaaaaagatgagaattaaccagctacagtgcaagatgtcatgaaatgagctgtgttcagaatctaggcacgtgtgactttgacatatctatgaggtttaaaaaagaaatatcaggaatacaagtagaatatgtgccatatgaagaaatcatagcttatttatgtaacatttagtatcctcattagctgtttgactggttttagaattcagcatataatccttggctctttggaaataaaattgtataaatactaatatttattagatctgaatggtaggtacatgggtgttaaactagtctctgtgcttttgtgtgttttttttaattaaactagtgactttaattaaactagtgatttatgactgcctaggaatgtggccattcatatcataccttttcatccatttcttaggttcccagtctaagtgggtgactttccaagatagaggcagatcatttctccgtcaagtatagagagacacatctgctcctcctagagtgtccataagtatgaagaaaatagaaataacttagaagaggctgcaaaaacattaaagtttgaaatttttttgggtggggaataacattttgatggcaatttaatagtgattttcatgtgtgtcttgataatgtcaaaggtaataaccaggtgttttggcagggcaagttttggggatcagggaaacactcatatttgctaagtacctattatgccataaactgtactgaaagctttttatctgttacctcattttaatctgtagtcaatttatg

SEQ ID NO: 196018 - DNA, 400 bp, Homo sapiens
ttaaaaataattgtcagggcatagggccctgagtgcctgtggggggcacctacatgtaccccataacccttccatggggaaattccatagccagccagagattggtattttaatagcaattcctcaagatgctgtataaaaaagaccacagaaacagtttttttccgtatgtcccagcatgcctttgtgtacggtctgtagtattgtaaactccccaaaatcaaaatgtgcatgaacaggggattcgagagagaagcaggtgtagctctgggaggggatatggaatagtcgccccagcgcagggacttctttttgtttttgttttttgtttttttttttttactgtatcaatgtagactggaaacaatgtcagaaggagaaagcaagtagcagaaggatg

SEQ ID NO: 196019 - DNA, 623 bp, Homo sapiens
actggagtgcagtggcacaatctgggctcactgcaacctctgactccctagttcaagagattctcctgcctcagccgcctgagtagctgggattacaggcacgtgccaccacgcccagctaattattgtatttacagtaaagacggggtttcaccatgttggccaggatggtctcgatctcctgacctcgtgatctgcctgcctcggcctcccaaagtgctgggattacaagtgtgagccaccgcacccggccttggctctgtttttaaaaagaaatacctggtaagtcagattccaacccactaattgcccgcttgtgattgctgctttgctgccactgccccagaaaccatttggaaaaatcctcatgctttttgaaaataccggttttctgaagagatggagcaagctctggaaggcaggaaaggcagatttctcaccaggagcaattttgttttggttccccttttctactcctgaagttccttcacttagaacaccttgatgtagacgtgggggcatagtaggaagtggacagaggatcaaggtctccaggtcttgaaaattttatgtttatcaaaagagaatattggttaaaataaaagattaaattggtgaaaata

SEQ ID NO: 196020 - DNA, 269 bp, Homo sapiens
agtgatgggttaatctgtgcagcaaaccaccacagcacacatctagagtttctgattgaattcattattggagtggtctgaaagtcagaatttttaaggcttcttaaataattctaatatatatcctgagttgagaaccataaataaaatcaggtgcagttcttatcaaaaaaaaaaaactgcagtaattatgagagatcccatatccaaggtaaatgggtggatttgtatttgaattgaattagagaagggtcagctgtgaacccacc

SEQ ID NO: 196021 - DNA, 247 bp, Homo sapiens
gtgctgggattacagacatgagccaccgcgccctgctgacctcttaactctttagaacagagttctaaacttcctgactctgaagttatctttccatttcatcctcaaagatacccaaaggaccttttagcatactggtgattgagacaaaagaatttccaaacctggagacaaatcccaactcttgcttcctgattctcttttctatactgtcttctcaggtcatcctttccccatggctgcataa

SEQ ID NO: 196022 - DNA, 360 bp, Homo sapiens
agcatttctcatttggaattttactaacaaattaataataatgactttgactatggggatgcttaagaaaatctcccagtccttggaggtatcctgggagaagatagaaacaactctgagaatcagaacatctgggaggattctgcagatggatcccagggacagcccaacaatcagagggccctccttcaaagcaagtgctgcctccagcctggggcagacccatccctctctgtgtcatttgttttcccaaacattcccttcttaaactggggttcatgaagtctatagatggaattccagagggtttatgaacttggagaataactggatctttattatcacaggcttctagccgaa

SEQ ID NO: 196023 - DNA, 517 bp, Homo sapiens
taagaagtagatgatgtgactatcaattgtgtacaggatagaatgttaggaaacttttgattctattcctgccttttattttgcagcaggaatttggcaatgtgtgtgctccctctgttgttgagtttcttgagtgtcttcatgaaatagatgcaaaatatcagctaatggccacaatagattttcactaaaaggctacacgaaattattaattctgtttgtgctgtaaaatgtgaattacagtcatgcatcacttaacaatgggaatacatttagagaaatgcatccttaggtgatttcatccttgtagaaatatcagagtgtatttacacaaacctaggtggtagagcctgctatatacctaggctatatggtatatagcccattgcccctaggctataaacccatacagcatgttactctactgaatactgtaggcagttgtaacacaatggtatttgtgtatctaaacgtgcctaacaaagaaaaactacagtaaaaatacagcataaaagat

SEQ ID NO: 196024 - DNA, 489 bp, Homo sapiens
atacgaataattgatttgatctgtttaatactgagaaagaattggagagtgttgtcctcagtagaagcttagaaagcttctaaagaaggagaggctggatgaattccccaagatgacatactaaaaaatagaaccaggctgggatggaagggctcctgactcctccttcagtgctctatgctaaacaaaaccttccttttcgcctttccacatgaagcccacatctgagaccacaaaagcgtccctctcaaaaaggtgtggaattgttgtgaaagctgtgcctggaggacaagggctgcgcctgactgttcactgcaggattctttctcttgtgcctccacagtaggcaagcaggactgatgttccgttgtcccgaggctgacacggcttccctctcccagcctgaaagcatccaaatgggtcacactggcttcactaatagtgaccatgttattaaaattccaggcagaatccaaagtgcaagattaa

SEQ ID NO: 196025 - DNA, 1215 bp, Homo sapiens
gcgccatgtcctgcttggccggctggagggcggcctccagctcggacagcttggcgttggcacccttaactgccagctcctcaggctgctcggcatctgtgatggcggcctccagggaagccctctggcctttgaggcactcagtctcagcctggagcccactgatgttccagtttatctcggaggtctcagtctttgtatgctgcacgtcatcccagtgcctcccagccagcgcctgcagcttctcatacttgatctggtacatgctctcagcctcagcccgcctgcggttggcgatctcgtactgcgccttgacctcagcgatgatgctgtccgtgtccatggagcggctgttgtccatggacagcaccacagacgtggcggagatctgggactgcagctcccggatcttctcttcatacagccgcctgaggaagttgatctcgtcagtcagcccttccaggccagactccagctctaacttgttcatgtaagcttcatccacatccttcttgatgaggacaaattgattctccatctctgtacgcttattgatctcatcctcgtacttgttcttgaagtcctccaccagcccctgcgtgttgccaagctccgtctccagcttcagcttctcctggcccagagtctccagctgcgcctaaggttgttgatgtagctctggaacatgttgtccgtgttgctcccagccgtctgctgctgctgcaggaggctccacttcgtctcctgaatcttgttctgctgccccaggaaccgcaccttgtcgatgaaggaggcaaacttgttggtggggttcttgatctgctccttctcctgggtgcgcatggcctggatgttgagatccacctcctaagggggctcagcagactctggttgactgtgacagcagtgatgcctcccatgccgctggtcccaccatagcctctgcccaggccagcccagaagctgctgctgcccagtagggagaagctctaagagctgatgcaggcactgggcccactcgtataggagcggcatagcagcatttttacaataatccagtaaccctgttgttcatcaatagcataattgagaaatatattgtgatatatttatacgatggaaactattcagcaatgggaatgactgaactacagcactatgaatcttatagattgagtatacgaagcaagatacaaattactccatttatataaa

SEQ ID NO: 196026 - DNA, 888 bp, Homo sapiens
gcgccatgtcctgcttggccggctggagggcggcctccagctcggacagcttggcgttggcacccttaactgccagctcctcaggctgctcggcatctgtgatggcggcctccagggaagccctctggcctttgaggcactcagtctcagcctggagcccactgatgttccagtttatctcggaggtctcagtctttgtatgctgcacgtcatcccagtgcctcccagccagcgcctgcagcttctcatacttgatctggtacatgctctcagcctcagcccgcctgcggttggcgatctcgtactgcgccttgacctcagcgatgatgctgtccgtgtccatggagcggctgttgtccatggacagcaccacagacgtggcggagatctgggactgcagctcccggatcttctcttcatacagccgcctgaggaagttgatctcgtcagtcagcccttccaggccagactccagctctaacttgttcatgtaagcttcatccacatccttcttgatgaggacaaattgattctccatctctgtacgcttattgatctcatcctcgtacttgttcttgaagtcctccaccagcccctgcgtgttgccaagctccgtctccagcttcagcttctcctggcccagagtctccagctgcgcctaaggttgttgatgtagctctggaacatgttgtccgtgttgctcccagccgtctgctgctgctgcaggaggctccacttcgtctcctgaatcttgttctgctgccccaggaaccgcaccttgtcgatgaaggaggcaaacttgttggtggggttcttgatctgctccttctcctgggtgcgcatggcctggatgttgagaacccgcgttcatcacaataccattaacat

SEQ ID NO: 196027 - DNA, 319 bp, Homo sapiens
agatgacttagcctttcaggacaataagaaatttacagtttaaaaagtgacagaaatagggttagacataagtttttaaatgccaggacatcacaatgagaactggcaaaaaccatgatatggaggaatgggtggcatctgctctgaagatctgacaactactatctgttttatcctacaaggaaatggaggacaatttgattcttaaagttccttcccacttggtgcttcaaataacactgccatgactcataaccatttggatatttaaattggaattgtcttttgagccaataaaagttatggaagaaatctgcct

SEQ ID NO: 196028 - DNA, 467 bp, Homo sapiens
cgatgaaagaactgaggctgaaattattattgacatgagctaatctcactctcttgtttcagaatatatacagccctgctctgggacacacctccattggatttaaaagacagtcctcgtcagcactgactttcagctatggaatcggtaaatactcactgcattctctatcaatttatgtttttgtcattgatttgtaaaaataagtatcaaaataatgcgtgagtgtccaggttggttttcttggacttgatagagttttgtcgaaatgttgtgaattttgttctggatttcacttagagtgtattcagagtggtaacaggtaagcatttttggattaatgaatgggatccttggtgtcacagtgagaagaaatctgctgaaaaattaaataggttgttaatagcctataaaagaagtttatttcctcttgtcctcctttaattttcttcatcctcagatggtct

SEQ ID NO: 196029 - DNA, 894 bp, Homo sapiens
ggggaggcgccgccgccgagcccgcggccagacgccccatcagtagcgtccgcaccgggagccgcggctctcgcccgagccgtgggcgcgcccgaggggcgggctcgcctcccgccgtccctcgcagctctgccgggcccgagcccgcgccgccgccgccgccgccttgccgctcgggccgcgcggcccgggaaacgcggccgcgggctgcatgggcagcgcccgcgccccgccgctgagccgtcgcggagccgcgcagccctcggagcacgaatatatacagccctgctctgggacacacctccattggatttaaaagacagtcctcgtcagcactgactttcagctatggaatcgcagaacggtgatgatgaaggcgccggcgggtaaatgaagatcgggtgaggagcagggacggatgcccaaggggtgggtggcctaaaagcagccaccagcagggaagagcttccccttcagcagcgaccatggtgggaagaagcagactggggaaaaacaggctaccgataaaaagtttctctaaccaaaagaccccaaaaactggagcgtggccgattggccgggaaggagcgtgagggaagcgagggcagcaagcggaaacgctgccccatacaaccggggggggcgccaaatggggcgacgcaagaaagggacttccggaacaccagagaaagcaggggccctgcagccggaaacaggatacaacgaaacacggctggtatcccgggaaaggccggggacgcgctgtaggaacatgggggcatgcatggactacagcagcaggtacccacctatccgaccgcccagagggggggcctctcatgcaaatacaggcgacgaactgcaacagcacgtgacagaaaacaaacaacctcc

SEQ ID NO: 196030 - DNA, 520 bp, Homo sapiens
ggggaggcgccgccgccgagcccgcggccagacgccccatcagtagcgtccgcaccgggagccgcggctctcgcccgagccgtgggcgcgcccgaggggcgggctcgcctcccgccgtccctcgcagctctgccgggcccgagcccgcgccgccgccgccgccgccttgccgctcgggccgcgcggcccgggaaacgcggccgcgggctgcatgggcagcgcccgcgccccgccgctgagccgtcgcggagccgcgcagccctcggagcacgaatatatacagccctgctctgggacacacctccattggatttaaaagacagtcctcgtcagcactgactttcagctatggaatcggagtggaaggtctccctgagcctgtgtcctttgctggcagtcccactgccctcagagcggcattctcccagcaggatgggcctcagtgctgcctgcagagccttctggtgatgcggatgttcctctgctgattctgtagcatcataaccaaagaagaaaacac

SEQ ID NO: 196031 - DNA, 677 bp, Homo sapiens
ggggaggcgccgccgccgagcccgcggccagacgccccatcagtagcgtccgcaccgggagccgcggctctcgcccgagccgtgggcgcgcccgaggggcgggctcgcctcccgccgtccctcgcagctctgccgggcccgagcccgcgccgccgccgccgccgccttgccgctcgggccgcgcggcccgggaaacgcggccgcgggctgcatgggcagcgcccgcgccccgccgctgagccgtcgcggagccgcgcagccctcggagcacgaatatatacagccctgctctgggacacacctccattggatttaaaagacagtcctcgtcagcactgactttcagctatggaatcggtaaatactcactgcattctctatcaatttatgtttttgtcattgatttgtaaaaataagtatcaaaataatgcgtgagtgtccaggttggttttcttggacttgatagagttttgtcgaaatgttgtgaattttgttctggatttcacttagagtgtattcagagtggtaacaggtaagcatttttggattaatgaatgggatccttggtgtcacagtgagaagaaatctgctgaaaaattaaataggttgttaatagcctataaaagaagtttatttcctcttgtcctcctttaattttcttcatcctcagatggtct

SEQ ID NO: 196032 - DNA, 638 bp, Homo sapiens
ggggaggcgccgccgccgagcccgcggccagacgccccatcagtagcgtccgcaccgggagccgcggctctcgcccgagccgtgggcgcgcccgaggggcgggctcgcctcccgccgtccctcgcagctctgccgggcccgagcccgcgccgccgccgccgccgccttgccgctcgggccgcgcggcccgggaaacgcggccgcgggctgcatgggcagcgcccgcgccccgccgctgagccgtcgcggagccgcgcagccctcggagcacgaatatatacagccctgctctgggacacacctccattggatttaaaagacagtcctcgtcagcactgactttcagctatggaatcgggcatccctcagaagggctttatttgaaccccggtgatatgcagcgggagaagagttctttatgacagcgacaatggggacagaggaacggtgactggaagattctttccttgcagtgaacgcacgtactgtgggtgctgtgccttcctcggggtgtatgtaggtaggcaggcacacaccagtcagcttgcattctgtgggtgatactctctgaggtggactgggtcacccgggagcttccggggtccgtaaacggggaccactgatgaacgagtggtgca

SEQ ID NO: 196033 - DNA, 476 bp, Homo sapiens
gcatgggtagtagaaaatatgacaactgagtccagtttgggagtgaagaaatcacatggattagtgatgacgacacttactctgccactggaaatgagcacaaataagtcttagtatgaggcagttaagagagaaacaaagataggtgggaaaactgaccttgatcacccagccccagccagatacccctctgtgaaccttatcatatttatcaaatagtggaggctctgaaggaggaagcttggatggcttgaatccattcaatttgaggtagtttttttttttttaatagaaaaggttgttgcagcaggcagctgttgtcattcatgctgagaacttgaaagaatgatttattagagtggtggaatggaatgagcaatggaatgggaattgtgagatgtgagatcttgtcttgattctgccagagcttcatagatgggtcactgatgatctctctctgtctcagttttctcatg

SEQ ID NO: 196034 - DNA, 397 bp, Homo sapiens
atttgcttcttttgatccaggcgtgtaagagacagtaagagaaatttagtcttgggaatcactattttaaacaaaggccaaaaacagtggtgtctatttttaaagcctcctcatttctccccagaaccaagtgcaaggtaatttgaattcggtttccagtcaatatggttaacctgatttcactctacaatttagcagtctgttctttatacttgatttctatgatattaagtgcatgcaacatttccttcccttttaacccggtttccacttacagttttctgtgtatttgagatctgtttggtggcctgcctgaactcatggaaaattgacgacactgaaagagaattgttgtagttaagcttccctgatggcattttttaaaaaacaacagtgg

SEQ ID NO: 196035 - DNA, 433 bp, Homo sapiens
ctttttaatgtaaccactcaccaacagacatgaaatcagtaagtcaatcattaacggtctccaaatacttatagattgaatcaaaaacgataaataccacataacaatacctgtctagaactttgactaaatgctttatattttcacccatgtcttttcatcagaagtgtatttatatgacactatctactaattgggatatttttattcttcttaagatcagttcttctttctgcatatagggctgcctttgatagtaaagggcctctccccagcagaagtgtataatagtttgagcctcttcatcctgggaattgcaagtgtttgttcattttaacatttgcttttcataaagtttgctggttcaaactgttttcaactgtgttagccctgcaacacagttcacctaggtcactgctattgctgtaaactt

SEQ ID NO: 196036 - DNA, 347 bp, Homo sapiens
atgttctgggaatagcagaagtatgtgttctgaatacaagtgatgggatatgaatgggagaagaggtagaagattaggttgcaaaaatacattggtgctagattgctggggcctacaagcaccatgctaaggagtgggtccactatcctgtagctctgaggctctcaactctggatacacattaaaatctcctgagaagctttaaaacaaaatgctgacggcctgttatttgttagcaataataattgggtccaggcatcagcagtttttaaaaacttcccatgtagcaattctaacctgtgggcaagaaccactcctgtgggcaacagggagtcaacaccactgca

SEQ ID NO: 196037 - DNA, 354 bp, Homo sapiens
ttggaagtgtgaagttttgagaatcctgtgagacatcaagtgcagatgtcagaagccaacttcagatgtggaaatctggaactcccaggagagatttggcctagaaacagaaacgtgggagttttcagttttaaaagccatggagagatgtatggaatccttaggagagagtatagagaaaaaagaaaaggaaaaaggattctttgtgcattataattgggcaaaagattgtatataaatacatttgggttagaagttttgaagatgacagacttgtgtgatagcttcctttttttagtgaaataagaggaaaagcccagaatgagtgggtgcagcatatttggagaatgtgga

SEQ ID NO: 196038 - DNA, 360 bp, Homo sapiens
gaaaagttgagtgatgtggtgaatgaagtgttggctttttgccagagatgcaggtttcaatctgacctatagttctagacaatatgaatagtcttagcccggtccctagggtcagtggtctatggcagataaacctttgaatgtaattcaacacagtaggcagtcctgtgaggttgaaagctgggactgtgtttgcaaagaggattaaatacttccccacttagacagggagagagaaagagcgagaaactttcttgctaagacttcaattcattggaaacattcacacctgagttctttgtacctgttacagagaagcaatggtgcccattttcaaagccaagctaaaaatgtctataa

SEQ ID NO: 196039 - DNA, 359 bp, Homo sapiens
ttttattctttgtagagacaataaagcatatacactctggcatcagactgccaggttccaagcctgacaaaaaattattaatttatgcctatgaacttgggcatgttatttagtctttctgtgtctcagtttttctgcctataaaatggtaaaacaaagttagagttatcatgaggattacatgaggtaatatacgtataaagtacttagtgtgtggagttcaatattagtaatattattctacatgtattttttctgtataaaacatacagaaatgtaagtaaattttaaatgtgagtaaattttaatatttcttgtaacttaaggcttgcagaattttctggcatctctaagagaat

SEQ ID NO: 196040 - DNA, 245 bp, Homo sapiens
actaccagctttccaccactcctacctcatccatcagaaaacagagccaccagccttccagggtagggttcatcaagccttttcctccccatggaactaagctgtacacagtagtcagagataaataatgtctaagccaaaccggcttgagggcacatatggaggtggggggcagagggacactggcctgggacctaaaccaccattcagacctcatctttacaaaatagtatactccacattcc

SEQ ID NO: 196041 - DNA, 834 bp, Homo sapiens
tacatattcccagggtacatgtgatgttttggtacatgtatacaatgtaatgatcaagttagggtaactggaatatctatcacttcaaacatttatcttttcttatgttagaaatattacaattctcatctagctattttgaaacataaaataaatagtcatataatttctctactgtactacagactactagaatcgattccctctgatatttcctgaaaggaaaataaaactcaaagaatgatttcatcttcccttcccctagcttatttttctcctttatctgtgcttcttttcttgagtggatcattttactatcagactatctgtgaaagtaattatacttctctggatatttgacaaaggaaaggtattaagggtaggaataacctataaaatagaaaccatttctgacaacatgaaaaagggctgaggaaggaatggagagaatgtggagcccagtgattcagcgagagatatacattttccaagagacaggaagtaaaaaagttaaaacaaagagtctacaaaagaggagatctgtagaaaaggcaaaaatggtggaaagggggctcaaggggtggaggaaagagattttgaaatattttcaagtaaaaatatgagaatattagacaacaaacaatataaaataaaaaagagaataagaatcagatttcagacacagtagactgaagagctggtggaattactaacagcaaaagagaacagagaagagagtctgaaagatgagtagctttctttttgtaatgctgggtttaaggtggcagtgaggttctcactagtggaaagggtgtaagagctttaagaggtaaa

SEQ ID NO: 196042 - DNA, 354 bp, Homo sapiens
tcctgtctgagatggccctggtgaactccatgtaccagtactccctgattgccttcttagaggtcttcaggctgtcactgaagaagtcgctgcctgattccatcctcatgaaacgcctgaggaacatcatggacacgctgaccttcagcatctataaccacggctgcacagggctgtttgagaggcacaagctactcttttcttttaatatgaccatcaagatagaacaagcagaagggagagtccctcaagaagaactagatttctttttaaaaggaaacatttccctggagaaaagcaaaagaaaaaagccctgcgcttggttgtctgaccaaggatgggaagatatcattc

SEQ ID NO: 196043 - DNA, 361 bp, Homo sapiens
ggaggttgagattctggtggaaggaactcatatttgaacctgggggctgttccctcccagctgtgcagtgctgggggagaccagctgtgctgagctcaagttcttcctctacatgggagaacctcaggcttcagggctgtggcagggctcggaaataacaacctaaagacctcacgcctggcccagcaggtgagctgtcctgcaaaacagttgctttgaaattagaggctgggcctgctagcttgcacctgaactcccagcactttgggaggccaaagcagaaggaacgcttgaggccgggagttcaagaccagcctgggcaacatagggagaccccatctctacaaaaattaacaaatac

SEQ ID NO: 196044 - DNA, 383 bp, Homo sapiens
agtcacattaatatatgatatataatgttcatttattaatacttatacgtatgtaaagtcttgtactagataattaagagagtgttaatttctaaacgattgtttctcccagttcacatttcataatgttttgttaaaacttgtcacgagtgtctttgaggtcccaagatcacttttggaatcccccagcatggatttccagggctcagcaatatcacttaggtctatgttatgtgacatgtaccattttctgagtccgaggtgggtgctgagcctggaattgttaccccaaacccaagttctcatttacataatataggcaagttcccccatgcacttgctattttatgttcattagctcagtaaaataacgtccaactaaa

SEQ ID NO: 196045 - DNA, 350 bp, Homo sapiens
gtacaggcatgagtcaccatgctcagccgtctcctctcatcttctaagaactggatattgtcatttgaaagtcttatttttaaccatcatggtctctacgcttgagtgtgtctgagaatatgaagacatactgtaattactggctcattaagattaagcatcataaccttcctagttgcaaagggttagccaagtactgtataaggtgtaactataagtatttaaccttacaaattcctcaagaagataggcagaaaatcggaaagaaaagggcaaaaataggccgggtgcagtggcccacctgaggtacagagttcaagaccagcctggccaacatgatgaaaccctgt

SEQ ID NO: 196046 - DNA, 390 bp, Homo sapiens
agctttgagtggcagatgctgaaggggatctggaaatccagggaagaagagagacttgggattggagagataaaaggttgtgggtaaaaagttcccccctggctgggcgcagtggctcacacctggaatcccagcactttgggaggctgaggcaagtggatcacgaggtcaggagatcgagaccatcctggctaacacggtgaaaccccatctctactaaaaatacaaaaaaaaataaattagccgggtgtggtggcgggcgtgtgtagtcccagctactcaggaggctgaggcaggagaatggtgtgaacccaggaggcagagcttgcagtgagccgagatcgtgccaccgcactccagcctgggtgacagagcgagactccgtaaaaa

SEQ ID NO: 196047 - DNA, 385 bp, Homo sapiens
aactgttattattcttgataattttaccaaagatgtagtagtcttagttataaaatacaaggtaaaattatacacaaagtgctaagtgcaatggagtttatgtactatgaagtatagatagcataaatagttgaagttgaaaatataacttgtattatttaaatactgactggtcacattttattgtaaaactattcaagacaactctaatagatataatagacaataatcttaaaatatgcaatttaaattaaatatcaaggtcacatgtgccctcttacattgttccctcaggacagggacttgggccttatttaacattgtagcactcataagcctaacacgagtatctgtatttaatatatagctaataggggcctcctga

SEQ ID NO: 196048 - DNA, 439 bp, Homo sapiens
tggctgagcatccatccctacactccttgcagctgcttcccagaccagacttcatatttctcttcaagaccagaacacacagagtgacttcaggaaatcttgagagaatcagacttgagaagcctaggaaagacaagtatctatttacagttaatcagcaccctacccggccctgcagacagttctgacaactggagccaggaagaatcaaccacaggctctgactggggcccacctgaggctaggagccagttggacccccagatgagtactgactctgatccccacccagactggctgcactgccatagggagccccttcctcggagacacactcaggcactgggatccaaagttcatggaaagtttcactttctcttatagctcaacccccaaaactgcctgataatcttatcatcttatctaaatatcttcccca

SEQ ID NO: 196049 - DNA, 526 bp, Homo sapiens
acttagaagtgagaacatgtagtgtttggttttctgttcctgtgttagtttgctgagaatgatgatttccagcttcatccatgtccctgcaaaggacctgagctcagtggatttttttttttatcttctctcttattgttggttttgccagctgtcacctcctggcagttattttgtctccctttgatagtctttctggttcccttttacctggctgctttaaactttgtgtgctagaaaaatcggtatttctagaagttaaaatttcattaattaagttataaaaattaaattataaatacaggtacctggctttagtgctggggttttatgacagctgttttggttactcaacagtttttttttagatgtaggaactgttagaagatgccaaatatctctagaacaatgcaatattactgtattatgagattctatagcagcaaactagatttttgtggattatgaaaatattaaacaaatgtccctggtactaaattgtcataaaattggagatttttcttta

SEQ ID NO: 196050 - DNA, 778 bp, Homo sapiens
ttaaaatttatttggtgcaataaatagtatgccaggcttataatctagagattgagtcttgaaaaaagacaggataaaccaagttgaaagacaaaaggaagcagggcatggatattaatctttgttacattgtctccataacatctttgttaaattgtctctaatttctcaaatgctctttggaccacttttaacattttcctaacccccaccctgtttttttttgttgttggttttttttggtttttggtttttttgagacagagtctcactctgtcacccaggctgcagtgcaatggcgtggtcttggctcattgccacctccacctcccaggttcaagcgattctcccgcttcagcctcccgagtagcgagtagctgggactacaggtgtgtgccaccacacctggctaattcttgtatttttagtagtagagacggggtttcactatgttggccgggctggtctcaaactactgacctcgtgatccgcccacctcggcctcccaaagtgctgggatcacaggtgtgagccaccacacccagcgcccccttattaataagttaaataaaacctttaatttgtcggaatcagtattttacttttttcaaagttatacttcaacattctgtgcctattttggtttagctgttttcccactgatttgaaagagttctttattatgtatttatatactctacttattagaatttgcattctggtggttttaaaaatatgtccaagtaatgatttgctacttctcccttcaagagatata

SEQ ID NO: 196051 - DNA, 770 bp, Homo sapiens
ttaaaatttatttggtgcaataaatagtatgccaggcttataatctagagattgagtcttgaaaaaagacaggataaaccaagttgaaagacaaaaggaagcagggcatggatattaatctttgttacattgtctccataacatctttgttaaattgtctctaatttctcaaatgctctttggaccacttttaacattttcctaacccccaccctgtttttttttgttgttggttttttttggtttttggtttttttgagacagagtctcactctgtcacccaggctgcagtgcaatggcgtggtcttggctcattgccacctctgcctcccaggttcaagtgattctcctgccttaacctcccgagtagctgggattataggcgtgtgccaccatgcccagataacttttgtatttttagtagagacggggttttgccatgttggccaggccggtctcgaactcctgacctcaagtgatccgcccacgtcagcctcccaaagtgctgggattacaggcctgaggcactgtgcccagccaaaaaaatgttcttacattcccttttatatgactggtgggagaagagagatgttagagaaaacagggaagtcggcagagccagaggaatgcccaaatgttatcctattaaggcagacaaatcttcagacatgctatgatttctctcccagcccagttttaccatctgaacccacccagacttattcactaaaacataaccacttggttgcgcgcggtggctcactcctgta

SEQ ID NO: 196052 - DNA, 868 bp, Homo sapiens
aaacttaagtggtatccctccattacccctctaaaattcactcatccaattttgccttcatggaatttatccattatctgaaattatctttatttacttgtttattatctgtttcccttctggaatgaaaactcaacaaaagcagaaaacttgctggtcttcaacagtgcctataactgcctggctcagggtaggcactgaaataaatatttggtatatgaaaaagggtgtattgctaaactacaaattgtatttaccttaacttcttaaattctaggatccaatgtcaaattccacagagtctaacattataggttatattccatttttaaaaatcaacttttattctactcaaaattttttttttttgagacagagtcttgatggagtgcagtagcatgatgtcggctcactacaacctctgcctcccaggttcaagtgattctcctgccttaacctcccgagtagctgggattataggcgtgtgccaccatgcccagataacttttgtatttttagtagagacggggttttgccatgttggccaggccggtctcgaactcctgacctcaagtgatccgcccacgtcagcctcccaaagtgctgggattacaggcctgaggcactgtgcccagccaaaaaaatgttcttacattcccttttatatgactggtgggagaagagagatgttagagaaaacagggaagtcggcagagccagaggaatgcccaaatgttatcctattaaggcagacaaatcttcagacatgctatgatttctctcccagcccagttttaccatctgaacccacccagacttattcactaaaacataaccacttggttgcgcgcggtggctcactcctgta

SEQ ID NO: 196053 - DNA, 151 bp, Homo sapiens
ttactttgctatgccagcctatccactatctaacatgttatctgggccattatttaaataaaataaagttatgcagaaaatatgcatcagtcagaatttaacactgttcctgagttatatcagataggcagtgtgacagagaggaaagaat

SEQ ID NO: 196054 - DNA, 794 bp, Homo sapiens
taattctgcctcttgcagtctaggagacctattatgctaggaagaaagcaaaagtggttgggggtggggatagtaatgactattgatcaaacagccagcaaagtctgccagattcagggcttaataaatgtttattgaattactttgcttggatttatagttgctactgacaattcctaatatgaagaatgtttttttattttggaaatctttcattagctgtttttttctccctgttgataaatgctcctgcattaatctacttagactgctatacaatattccacagactgggtggcttagacaacagaaatttgttttttcatcattaaggttgctagagtcaaagatcaaggtatcagcagggctggtttctggctgtgtccttactggcttgcagatggctgtcttcttgctatgtcctctcatggcattttcttagtgtgcacaagtatacacacacacataaacacataaacacacacacacacacacacagatgtggtgtgttttttccttcctcttctaacaacacccagcctatttgattagggtcccacccttatgactttatgtaacactacctacctccttaaaagtcctatctccaaatacagtcacattcacaggttaagacttcaacatataaatttgagagacacagtttagcccataacattctgtcttctggccccctgaaatttatgtttttctcagatacaaactacattcactgtgtcccaagagcccccaaagtcttcacccactccagtgtcaatttcaagtccaaagtc

SEQ ID NO: 196055 - DNA, 415 bp, Homo sapiens
agtaattgcttgctgtaatgggtacaagaggttatacctgttacaatgattaagaaatacagtccctaaagaaatggaatgcaatgttctacttaaaggaggacactagaataaatatgatttcacagtccatacttttagggttgtatttttctaattataacaccaaactgtagttcctttaaataaatacctgaagatgtaaagacacaacttatattaactgctaatgtattcctcagtgcccaattgtgattcttatattcagctctgcattctgctttttaattccacttgttgtagatttttgtattaaggtatatattttagtgtctctttgttctgctaacatgaaatgtgttatgatttattcaatcatccctataataaagattaaagttttttctgagtttcc

SEQ ID NO: 196056 - DNA, 296 bp, Homo sapiens
tccaccttactcagtccctcaatggtgacagtctccttgaacttggctgccagcggcatctgacacagacaccgaccccgcctcctcctccttcctctggttctgtgccagtctcctccttccttccacctctgactgctccttctcatcctccacctagtttctcatctctctgaattccaaatactggactcaaacccaacactcagtctttggacttattttcttctacttgtctgcttggtaatctcaactagtctcatcactttaaaccacagcttcatagtaaggcggag

SEQ ID NO: 196057 - DNA, 253 bp, Homo sapiens
cggagactaccttacgagatttaagtcacaattctaaattttggaataatagcaagaaacgtttggaacactttgcagatagtttcaggtgtgtatatgtgagtgtaccctttattttctctgcagcccttacctaacacacagcagagagaaaaataccaaggaatgaaattgtgttttatgagtaaacatgatgacttccttctcaaacagacataactctgtaactgcttaagttgttgaaccttttatt

SEQ ID NO: 196058 - DNA, 343 bp, Homo sapiens
atgtctaactgtcctcttcttgaggatccccaaggacagtctgacttaatgcaaagactgcatattttcactggtccctaatgaaatctcattcccttctattttatctaatatcctctctctgtcccttggagtagatttgatcagtgttcaccattagactcttcaaaagtcagtcatctccccttgaaactttattaccccagtcactttaaccttgcctctggaacaaaccatgtaaacaaagctaccactgggaagtgcagccatgtggacctcatcccatggctctcttactcatcccaaaatataatttttgctcccaccatcccaggtgcctcct

SEQ ID NO: 196059 - DNA, 117 bp, Homo sapiens
atccttactgcaatttcttgagagctcctcaagagtaaagaatattgtgtccgtctttgtgttccctgtacccagcatacaacttggcttccaaagagagggagtgatgtgttacat

SEQ ID NO: 196060 - DNA, 868 bp, Homo sapiens
gttttcagactcattcaggctacagatatttattgagcataactgggtgctgagaacgttgtccaccccctctcccttttccctgactccagcccttggcagtgtggaccacacgcaatgcctattatgtctcgaggcttgtccacacatctgtctcatgatgcatgtgggtctttatgtttgattccccacaaacggatggccattccatccattcttgttccttgggaacaagaacagaggcctcttttccccctagtcctcctgtgctgccacaacaaagcatccagacctggtggctttgaagcagctacgttgtcggggtatataccctggggttcgttgtcgcgcaccaggaaagtttaggacacggacgcattcaaagcagtgtgtagagggaaatttatagcactaaatgcccacaagagaaagcaggaaagattcaaaattgacaccctaacatcacaattaaaagaactagaaaagcaagagcaaacacattcaaaagctagcagaaggcaagaaataactaaaatcagagcagaactgaaggaaatagagacaccaaaaacccttcaaaaaattaatgaatccaggagctggttttttgaaaggatcaacaaaattgatagactgctagcaagactaataaagaaaaaaagaggggagaatcaaatagacgcaataaaaatgataaaggggatatcaccaccgatcccacagaaatacaactaccatcagggaataatacaacacctctatgcaaataaactagaaaatctagatgaaatggataaattcctggacacatacactctcccagactaaaccaggaagaagttgatctctgatgcgtcttcgcgactgg

SEQ ID NO: 196061 - DNA, 493 bp, Homo sapiens
gttttcagactcattcaggctacagatatttattgagcataactgggtgctgagaacgttgtccaccccctctcccttttccctgactccagcccttggcagtgtggaccacacgcaatgcctattatgtctcgaggcttgtccacacatctgtctcatgatgcatgtgggtctttatgtttgattccccacaaacggatggccattccatccattcttgttccttgggaacaagaacagaggcctcttttccccctagtcctcctgtgctgccacaacaaagcatccagacctggtggctttgaagcagctacgttgtcggggtatataccctggggttcgttgtcgcgcaccaggaaagtttaggacacggacgcacacgaggagtttaggaggggaggtttaataggcagaagagaagagaaagagaaacagctctctccatagagaaaggggtctccaatcggaaaagactggctggtggtgaatgcgc

SEQ ID NO: 196062 - DNA, 443 bp, Homo sapiens
agattgtgccagtgcactccagcctggccaacagagtaaggccctgtcttcaaacaaacaaatcaaattaaacaaaaaacccaaaacccttgtaaagtaagctatgacctccatttacgggtgaagaaatgaactcagaattaaagggacttgatgaagcccctttgaattgtgaatcaatgtagatttaagctctagggaggtgtcataatgcagtcctttagaggatggactggactgactgaaagtttatggacccagaaatttaattccagcattgaggctgatcttttgtttggattgttattttgcttattgcccatccttccatgtaggttccatgaggacaagggtgggtttcttcccccaccactgtgtctcagcacctaaagcagtgcttcacatacagatgttcaataaatgcttcttaagtgaattgttat

SEQ ID NO: 196063 - DNA, 302 bp, Homo sapiens
gatactttacataaccaaaaacctaggagagcattctacattgtaattttttttttactttgtttacataaaatttacagggttttgtttttttaagcttagtctgttctttgacattgttgattcatgttctaaattttcatcagatttaacatgtttggaggttcttgtgcactcaatgtgaacctactacaagcttctgaactgcaaaaccttttttttaggtcactgtcaacagaaagatgccttatagaatttctcatgattgaaacagaactctgcattctaaccaagcaacccct

SEQ ID NO: 196064 - DNA, 459 bp, Homo sapiens
tgagaggtgtttgtgtcctgacatgctggagggcccgtcataaccagtgccattccctttaaagttgttcatgtgacttccagtaccctggtgtctgggattagttgaatactggcttatagaggagctcagatttacagagacaagaacactgcatgtttgctagattatgcctttagaattctccataacacacaaggatgattacttcttttggttaagaaatacatgattttactgatcatttttacagtctttgtggtattagaattctaaaaagtataaaacaaattatttatgattacttgttagagatactacacactggctgggcacagtggctcgtgcctgtaatcctagcactttgggaggctgaggtgggcagataaggccaggagttcaaagccagcctgagcaacaaagaaagaccctgtcgctacaaaaagataaaagaaaaaa

SEQ ID NO: 196065 - DNA, 290 bp, Homo sapiens
acttccccaaagccatacctgtggtgtataagaatattatatataaagggttttttgtgtgtgtaggtttctcagatgcgtatgtgaaagagaaagaggaagggtgtgtgtgtgtaagagtgagaatgcatgtgtgagcatgtgtgtctgtgtgaacatgtgtgtctgtgaatgtgtatgagaatgaaagtgaatgtgtatccaagaaaaagaaagagaggacagagaggtgaacctatgtgtgtgtctgtgtgtgtgcatgtgtgtgagggggacgatcgtgtgtgtgt

SEQ ID NO: 196066 - DNA, 313 bp, Homo sapiens
gtcctaccttctaccttactaaggagactagaataccaaaagagagtttctcagcttctctcctcttcataaagttatttttacacaccacttcatctctttacccatccttgatgactttccaaatagctcaaagaagcagtgaccctcctttcttgggttactctctccccattcctttgaatttattccctctaatctcctttcagaataatttgcagaacacctttgctgcaaatacctttgctgcaaaggtatttgcagaatacctttcagaatacctttgctgtttgtgaaaatgactggaaataca

SEQ ID NO: 196067 - DNA, 422 bp, Homo sapiens
tgaaaagcagctcattttcccccaagttttctgcatcagtggttctccaactggagtgcagcttgaacaatgtgatttttaagttttccaggcatttctaaaatgtagccaagtttgggaatcaccacacctagttggttatctcaaactactactatcagaatacaggttctgtgctgcgaatctgaatatgggatacattttctttaggtagcaagaaaggtttatttacctttaggacattatactgatctgcatgagaatcttagaaactaagaacccttaaaatcagttaaggttggtacactgtggcctcattttgatagttctctgcatggagtcatgtttggcatgatttgcatactgtgctagaattaagctgggttggttgagaaggggttaggaagaggcagatgtaagct

SEQ ID NO: 196068 - DNA, 502 bp, Homo sapiens
agttagagacatattatgaactcaggagttccaataatccaggggaagattgatgtcattgtagattatttaggccagcaattctcaaaccttggtagctagctaacagaatcatctaggtagctaccaaaaacagacaactgaacactgtccctaaagctgaggattccatagcctggagtagagcctaggagtctgtactctccacgagcccttgggagattcttatacatgaccaagattgaaataaacatggacttttgccattattccaggtcagctttatttccacaccccagaagatctaggctaagtcctcacattgcccagtcagcatgtgttaagagtgtagactaatctcaaagcagtaacaccacattaagcagcagcagtggagctgggcatgcctgtaatcccagctacctaggaggtcgaggctttagtgagccataatcacaccactgtacttggcccaggcagcagagcaagaccctgtctaaaa

SEQ ID NO: 196069 - DNA, 564 bp, Homo sapiens
actcggtgcagacccctcgcagctcccaaaggaggagatccagccatttgccacgacatggatgaacctagatgacactatggtaagtgaaataaaccagacaggaaagaaaaacattgcatgatctcactgataagatggaatagaaatagagagtaagataaaatgtggttactggagcagggtgggggatagaaatggggagatgtaggtcaaaggatgcaaagtagcaggtgtgtaggtccccacactgtaccttagctctctgcacttcagatctaaggtatggtgtggggactgtggctaataacagtgtactgtgtcaggaggttcactaaatgagattacacctgctcttgccatgaagggaaaatgggtaactatgtcactacatatatgtaactcataacatgtacagctttaaatatactcgataaaaaaaaatttttccgggcaggccccctaagccgggatgaaactggcaagagctaaacacaggtctgagctatttatataggacactccatgttcttgcggaataagtacccttttacacaagttcag

SEQ ID NO: 196070 - DNA, 316 bp, Homo sapiens
cccacaaggctcagctcctcatggtgctgtcacggtccagctgccacttgagttgcttcttcatctgtgaccagagtggctgtgagacaccaataaggtgagggacatgcaggcactctgccagcaggtttcttaggaagtgatgggactcagcatgaagcctccagttccccttacattgcctcatggaggaggcaggatgcaagtggcctgtgcacaaagacagtgcctgtggagcccagtgtgcccttccccatgtgttagaaaatgtcattgttgaagctgggcgcagtggctcacgcctgtaatcccagca

SEQ ID NO: 196071 - DNA, 600 bp, Homo sapiens
aaaattcctctcccatcatgcctgtaaacttgggcatgccactcctttgtgtctaggattttttcttatttcacattcctctccaatcttttctggtcaaaaatgaacaaagtcgcagagaatccagaaaagcacaaaagcagaccaaggcttaagggctcctttcactccctctgcggcatagcttccttcaatttcctcacgtggcaacagcttcaccaacacaattcaaactcctagtatacatttgttgctatgggtaaatcaagtaccaacgtagcctacctatgtacagacctaacctaaaaggacattctctggtgggaaacttctggaaaatgtgctcttcaggggtgcttaggagactgtgagctggctggcagggctacactctctctcctcaccatctgccctctcctcatcttcccaccttcccacctgattttctgcgtcaccttcccaatagccagaattatgccttaacttttgttccctaagaggattagaaaaaggtacaatgaatgaaagtcctatcccagactggctatttgtggtaaaataagcaaatcattggaatggtaatcacatgggcacgattaa

SEQ ID NO: 196072 - DNA, 300 bp, Homo sapiens
taaatgagtaaattttttttctagtaagacaggaagatgtctggctcatattaacatcatcatatgtttaatagtttaatttagcatctggtgcctttgctgccagccctacagggagagagattaaagatggaccacatctgcagttagtaatagccaatcaaagcagtcagactctaagaaaacgaagatcttcaggccacattatatgctgctgggttgctagccataatttgtgacatgtccagaacactccagatattctggatttacctaagaaataatactaaacttgaagtg

SEQ ID NO: 196073 - DNA, 171 bp, Homo sapiens
tttgagggtctaaaccacatcagacaagagggacaggctgttctgttttttaaaaaggcccagattagacctgaaaccctcagatgctggaggaaggcttcacctccccacagtcttttttttttttttaagacagtgtcagccaggcacagtggctcatgcctgtaatcc

SEQ ID NO: 196074 - DNA, 498 bp, Homo sapiens
agacctatgtagtggagagatgcatattgcaaggaaaaaccttcacaaaagttcactcgtttttgaaataatgtttactgaatgccaggcactgtactaggccttggagttaccctacctactttccagaacttctcattctaagaaaagaaaaaaactgatgattacaatgtgataagtgctataataaataggtaccaagtgtaataagaacgatccaactgtctggggcagtaatgtttacattctaaaggattaataggactcatgaggttcaaattagagagaaatagacatttgaagacataggtatgaaaaggaacattgtgttggaataacacaccaaattccagaaattgctgtctgaatgtttgctatgggtaaaagaggggaaactgataagggatgttgctaggtaggtaagtttggaccagttgtgaaggcctggtggcatgcaaaggaaattttaactttggccatgggaaagcactggagatt

SEQ ID NO: 196075 - DNA, 404 bp, Homo sapiens
cattcaaaaaatggttcatttcaatagaacaactgacctggtttctttttcaatgtgttaatagtgttaaaaagtctgttttagatcaaaagagactgatgagaccacatgcaaatacattgcacagctcttgtttgattcaaagaagtcaagtgtaaaagacattttttagacacgtgaaatggtgttgcggctgactaaaaggatgtgtatgtgtgtttttgaagtatttagggctaaaatatgtccaggattggcttttaaatactacaaaaaatggagtatgccaaaacgttgaccattgttaaagctcagtgaagggcaggtagatgccaattgcactcttcacttttatgtgcaaagtttggaaaatttcacaataaaatttttgtgtttacataaat

SEQ ID NO: 196076 - DNA, 400 bp, Homo sapiens
ctctagcacgatccccccctgaaacccagtttagatgaggtacccaggtaaggcttctcagaggaggtgacttttgagctgaggtctgaatggcaagaaggaggcagccaggagcagcttggaagagaagcattccagacttagggaacaaccagtgttcagaccctggggtatcatgaactgggtgggtctgaggaacagaaaaaaggcatacaagatggagagcagaaacactcaaggcagcagaactagttggggcctgatcttacagactttggaaaccagggtcgcaagacgccgagctttattcttctacctattactttaatgctaaaagggaactaggaatctgttcagtcatgagccaaataatagaatcagtgaaacagtctccagatat

SEQ ID NO: 196077 - DNA, 649 bp, Homo sapiens
taagaactcagctgtcaccaggagcgctcccaaaatcatgtgagacgtaagaactcgctaacatcaggagtgctcccaaaatcacctgagacatgaaaactcgctctcaccatgagtgctcccaaaatcacaggagatgtgagaactcgctaacgtggatttttcttctggaagcgactctaaagcatgcacccccacacagtccctgagtctcctcgtggtgggcgtggccaaagcactgtgcctggtgactgtgtgtgaatagcactcagtcctcgtgctgtggcctcagcacaggacgaatgtgtgttgtgtgtgtggatcctcacgccacggcctcggcacaggacgggtgtgcgtttgtcgtgtgtggatcctcacgctgcggcctcagcagaggacaggtgtgcgtttggcgtgtgtggatcctcgcgccgcagcctcggcacaggacgggtgtgcgtttggtgtgtttgtgcacaaacacccgcctgtctcagccagctcacaaagagactcacacccatgtgtcggtccccctgcaggttcctgtgtgatcatggaactgcggggaagggaaggtgccggaaccagggctgggagatcactgagggttgaggtggggcccgtctcctgtacacccctgcgg

SEQ ID NO: 196078 - DNA, 1225 bp, Homo sapiens
  misc_feature (926)..(926): n is a, c, g, or t
gggaatctcttgaacctgggaggtggaagctgcagtgagccaagatcacaccactgcactccagcctgggcgacagagactccatctcaaaaaaaaaaaaaaagtgtttaatgaacttacagttccacttggctggggtggcttcagaatcatggcggaaggcaaggaggagcaagtcacatcttacatggatggcagcaggcagagagagcttgtgcagcaaaactcccatttttaaacctatcagatctcatgagacttattcactatcatgagaacagcatgggaaagacctgcccctatggaactgggttccttccatgacacgtgagaattgtgggagttacaattcaagatgagatctgggtggggacacagcccaaccatatcagaggccttggaaggaaccaaccctgccaacaccttgatgttggatgtgaactgtgaggacgtaaataaatctctgttgttttaggccacctagcttgtgatatttgttacaggagccctagcaaactagcacactaggctagacaatgctgccggggactgacatctgctcatgtgcacttatgcctttgactgtgggctgaaatgagccagtgccccaggtctgctggccaacattggttcacaagccacctcctccaggaagccttcctttatccatccaggaagaatatggggtctctttctctgactcttgaacccttgtgcagatttccatgagggcatcttgcatctgccactgcttttataaatggctctgactcaggtactattcagcagctcctcaaaggggaccagaagcatgtctctcccatgggtgtactctctgagtgctgcacagagccacctgcacttcttggcccttttgcctgctgtactacagcttccccatggggcttattgtcttcctgagttgnttaggatttacttcctggttttacctgtcttctcccactggcatgtgagccatgtgtggctgagacatttggtccattttgtccctgctgcagctcagtgcctaggacagggcctgggacctggtagtcactctatgcatttttgttaatgaataaataaatgggaaataaaggtgcaaatatctctgctgctgatggggattctgctctcccagagggaaggtcttgctgtttggatgtgccagttattctctctataagatccacactcagcatttttccttgcctctatgttcccc

SEQ ID NO: 196079 - DNA, 1240 bp, Homo sapiens
gggaatctcttgaacctgggaggtggaagctgcagtgagccaagatcacaccactgcactccagcctgggcgacagagactccatctcaaaaaaaaaaaaaaagtgtttaatgaacttacagttccacttggctggggtggcttcagaatcatggcggaaggcaaggaggagcaagtcacatcttacatggatggcagcaggcagagagagcttgtgcagcaaaactcccatttttaaacctatcagatctcatgagacttattcactatcatgagaacagcatgggaaagacctgcccctatggaactgggttccttccatgacacgtgagaattgtgggagttacaattcaagatgagatctgggtggggacacagcccaaccatatcagaggccttggaaggaaccaaccctgccaacaccttgatgttggatgtgaactgtgaggacgtaaataaatctctgttgttttaggccacctagcttgtgatatttgttacaggagccctagcaaactagcacactaggctagacaatgctgccggggactgacatctgctcatgtgcacttatgcctttgactgtgggctgaaatgagccagtgccccaggtctgctggccaacattggttcacaagccacctcctccaggaagccttcctttatccatccaggaagaatatggggtctctttctctgactcttgaacccttgtgcagatttccatgagggcatcttgcatctgccactgcttttataaatggctctgactcaggtactattcagcagctcctcaaaggggaccagaagcatgtctctcccatgggtgtactctctgagtgctgcacagagccacctgcacttcttggcccttttgcctgctgtatcaaaaagctttcctcactggggtttatctccgtcgtatctctgatgtgtagtaatcacggatttaccgtcactgatgttacttgtattctgggccaatgagatgtgagatatgacttcactaaaacatgtgatgcctatgctcggtaccctgaacgcaacgcgtacgacgtgaccgctgaggtaccagtggacctgagggacagtcggtcagtcacatactattcgcaattatgtctatatcaattaaaatcagaatgattaatgcaagattcagtacagaggatgcgaatatatgtgcgggtatatcgggcaatcacgtctcgccatatgaagtcttggttactgctggcca

SEQ ID NO: 196080 - DNA, 493 bp, Homo sapiens
  misc_feature (477)..(477): n is a, c, g, or t
aagaagagaagagaagagaagagaagctgtggcctgtaatgaaaagaagtggagaagtgactgtcagaggaagcagattaaggagctgccggagagtatcctgaatacctgaagaagacgattgaggacaatggcaatttgcctgagcaggttgtcagtgctgctgaaactctggaagcaaatgcctacttgcacatctattgcaaagcatgagaaaaggaccagaggcttcaagcctggaaaagacaaactcaaagttctgctttgttccagtgtgttctgattaaacccatgttgctttacagattccaaaattgttaccttctttaaagagaaagccagaaacacttttctgtgtacatgaagggaaaccatgaaatatggatcactgagaaactctttttgaactggtctttgaagtgttttgttctgaggttaaataacatttaaatgaatgcagtcattgctgctccttgngttcgtcatctccatt

SEQ ID NO: 196081 - DNA, 195 bp, Homo sapiens
gaggaaaattgtatgagcacagggaggtgtgattaaaatgatacaggatgcctttttcatccttatccccactcctacatgcccacaattcattgcctacctctggtgatcagtcttggcagactcataaaatgaaatacatgatactccctcaaattccataggaattcaaagaatatatgagagatggggata

SEQ ID NO: 196082 - DNA, 394 bp, Homo sapiens
atcttactatatgttatggcacgctatgatgatgagcagcgatgagcagccgaagcctcaaggaagggatgcttttgtaaaacaagacttgtagaatataacgtgtgaaagtaaagcccatggcagagctccctcctcagcacacggggagcagacaggaagcttttgcctcaccttcctcaatggcctgcagccacgtctcccaggtcagtcttaaggacaatgaaactctggtcttcactgtggacacgccacactaccaggtgctccaaagccatggtgacccaccctcgggtgggtcctgagaacaaagctctggttctaatcctaaccctaaccctgtcccaagactttgagcctgaacctaaatcctgatccctaccctggtccttaa

SEQ ID NO: 196083 - DNA, 616 bp, Homo sapiens
cgaagcttgtgcccagcacagccagaattagacacagtccgtgggtgagcacaagtggtagccttggagagaagtcagggtcggcatcagaggagcagcacgaccatcaggctcggcgcccgcgggcagctgcaagcaggcgagacccaagtccaggcaccaggaacacaaagcaagatgcacagtagagacacattgtggcaggtgacacaaacgttggcttcactgacagtcactggaaggtcggtgctagtgtcctgggcagtggcgtcatgaagacagggccatctctcctccctgcttatctgctccctctcccggatccctgctccgtgaacaccgctgtcatcagagccaggttcacacgctggtctctcagcaactccggcagaaaggagggatttccacttccctataatcctgtccaaacacagaaattatgttttcttggctccactaaggccacaagcccaaccctgcactaactgtggtagccagaggcgatgcagagcccagagggccagggccgagttgtggccactcctgggaatatggagaatgggtgattcccccaggaaaatcccattgctgtcatcttaggaagaatgactggatg

SEQ ID NO: 196084 - DNA, 442 bp, Homo sapiens
catgataagttgcacagataacattatctctactacaacacaattttcaagggattgttcacaatatctctccagtatttggagactcctagaatttctttgacttcatgatttggttctcaaagaaatatacatttatatctgttttatggactctaggacttcttacagttcctcaaatagtcagcaaccctttcattgtgtatataagcatgatgtagtagtaaagtattgccttggagtcagcgccatttcagttagattattctacaacctcccttggcaaatgttaacaacacccttatacattggttcttcaatttaggcatctgagaaatgaagataacatgaattgtggactgcatcatatgtgataaagaggatggctgcctaaggaaggcaaacaggaccctctgtcaggtagttctcaataaacttcaga

SEQ ID NO: 196085 - DNA, 533 bp, Homo sapiens
tcagacgctgaactatgtgataactttatgtttaacattctaggaaactgccaaactgtttcccaagcagctgtactgttttacagtcccaccagcaatgtagaagggctctgatttctccacatcttcaccagcacttgctactgtctgtctttttttattatagccatcatagaggatgtgaagtggtatcttactgtggttttaatttgtatttccctgatggttaattatttgaacatcttttcatgcgcttattaaccacttgtctatctttctctttctttctttctttcttctttctctttctttctttctttctttctttctttctttctttctttccttctttcttttcttttcttttttcctttccttttcttttcttttcttttttggagacagagtcttgctctgtcgcccaggctggagtgcagttgcgcaatcttagctcactgcaacctccacctcctgggttcatgtcattctcctgcctcagcctcccaagtagctgggaccacaggtgcccgcca

SEQ ID NO: 196086 - DNA, 426 bp, Homo sapiens
ttaacaccacatgctgctgacagcagaatatgtccatttccccaaatcctgtgtcagaagatggcacacatgaaaatagccattgattggattttaatgagtcaaccaaacattcctgtaagactggtaccaaaaagtaaacccaaattccctgctataatcatccctgggaaaacccactgttttgatatttcatattgccgtctgtttgacttacccctctatgtttctgtggggaaaatctgcacagtgagcaaatcctgtaatttcagctgcccatcgttgtattatcattggcacctcagcagcagtgtttggctgcgtttcaattatgacagggatactttcgcattttccctattactcaggagtcccagggcctggctggcactggctcctcctgaaggcacagatgttctgtcttct

SEQ ID NO: 196087 - DNA, 414 bp, Homo sapiens
cagactggtgcagttcagggctgaaaagtgctgcctgggatggcaaagcattctctgaaggtttatgcaaatttctgcagcaaaaaagtgttcgcttgttgcctcaatgcttggatgttgacacatttgagcccattagaagggcatcttgtgcgcaagtcactgccagtctgtctgcatgaaacaccatgatggggggtggggatgtctagtcagtgtaagaaagaaggtggcgagtgtgtgtgatgtgtaattcccccaggtctttatttgaacacaaatctatgctctttcccagctacaaaaggaaacatttacctacatgaataatcaacactctgggcgtgtgtgtaagctatgtatacatacaaattcataatctaatatataccagctattgcaacagtctgtctg

SEQ ID NO: 196088 - DNA, 322 bp, Homo sapiens
caaaacttactatataaaacaagtaatcaagacagtgtggtactgacacaagaacagacatacagatcaatgggatagaattgagaatccagaaataaaaccatgtgctaattttcaacaaaagggccaagaccatctaacggggaaagaagtattttcaacaagtggtgtggagataaatgtgataactacacacaaaataatgaatttgaatccttaagtcataccctatataaaaattaactaaaaatggccaaagacctaaatgtaaaggttaaaattacaaaattcttagaagaaaacacagagtaaatcttcatag

SEQ ID NO: 196089 - DNA, 203 bp, Homo sapiens
  misc_feature (11)..(11): n is a, c, g, or t
aatagccggtncctctctccacactggtgctcaatgagggaggagctctggctgaaggctttcccacacttctggcatttgtagggcttctcgccagtgtgggtcttgcggtgctcaatgaggttggagctctggctgaaggccttcccgcactcatcgcatttgtatggtttcttcccagtgtggatccgctggtgtcggat

SEQ ID NO: 196090 - DNA, 128 bp, Homo sapiens
tattcagccattaaaaaggatgacgttctgacacatgctacaatacggatgaagcttgaagacattatgctaaacacaaaaggataaatcttacatggttccatctagatgagatgtctggagtggtc

SEQ ID NO: 196091 - DNA, 476 bp, Homo sapiens
tgagatctcactacattgcccaggctggtctcaaactcctgggcttaagtgatcctccagtattggcctcccaaagtgctgggattgcagtcatgagttaccacgcctggcctcagcatagtttctttcataatcttcacatatactaatctgcaaaaactatattgtgttctgtaaggtcatcttagtttttataaaagataaggaaatgttttcttcacattaaattacattaaaataagctgaaagcacttatttattttctaaaattagtatttagtaatagcattccctaacctgaactgcagaagaccatttaaaagtagctctgttccctctactatgatgaccaggtttctgctcttcaaagagaaagaaataagaacaaccaacattggcttactctgtgctaggcactattctgaactctttatcaatatgatctgattcagtcctgacaaccaccctctgaagat

SEQ ID NO: 196092 - DNA, 188 bp, Homo sapiens
ggacatttcaattctttcctctctcttgtcttactcccccataatctcccactctttagctagagtgaattattcaacttttctttggaaacccctttattaagatacaatttaccgcaaagcctcttgccaccaccagccaacacactccctcgtccagtccttccagagctggtcattcgatcatg

SEQ ID NO: 196093 - DNA, 551 bp, Homo sapiens
ataaaggctgtagaccctggtgactagtgaagaacctatggcctggcttctgcttaaagagagctcaatgttgcaaaattcctatttgccctttcacttttgctagaagtgtattgcatcacttgtaagattaaagggaaaatatacttattttgtttcccaaaagtttataggtttctgactttcacaaatgcttaagagtactcttctctttgttgttatggctgtccacgtgtagcagtttcatctttagaagtttaaattcttttctctttcttgctggatacaatggctcatgcctgtcatcccagcaatttgggaggctgaggcaagaggatcacttgaggccaggagttcaagaccacctgggcaacatagagagatactgcctgtacgaaagtttaaaaatcagctgggcatgctggtatgcatcccagctactcaggagcctgaggtgtgagtatcactcggggccagaagtttgaggctacagtgagccatgatctcatcactgcactccagcctgtgtgacagggcaataccctatatca

SEQ ID NO: 196094 - DNA, 491 bp, Homo sapiens
ggcacgatctcggctcactgcaacctccacctcctgtgtccaagcgattctcctgcctcagctctctgagtagctgggattacaggcacgtgccaccacacccggctaattttttatatttttggtagagatgggttttcaccatgttggccaggctggtcttgaactcctggcctcaggtgatcctcctgcctaggcctcccaaagtgctgggattacagatatgagccactgctcccagcagtaattttttttttataacttgtaacagaaatttggcattttcttcaattatgaagacaggcaacaaaccacagcaatattagcaatacttgtgactatgtcaccagtagaaaccacagatactttaatatcagattatatcgttgcagatattgcaaaatatctgtgctttttataactagaaaattaagatctataaaaagatctataaaagagttataaaaatacttcaaaattaagattataac

SEQ ID NO: 196095 - DNA, 515 bp, Homo sapiens
agctgctgctgaatgtggagggcccagggtaagctctctgtgccccagcctccatgtctgcagagccagcgaagattcccagccatgtgcccgcctgacggtcagtgttggccactcgtccagtccctgagacatccttgctgcctttactcctgaatccccttccacgggtggggctgccacttggcctcagctctgctcagccctccttcagcctgccccagagcaagaccgggggtcctgccctctccccgcactctgtctccttgcagatggatgaatgtgcccacaaatgccaggaccgctccagctctgcagaggagctgggggcaccccgggcccatcctctgggcccagacagtgcacgctgcctccttggtagagacgaggttagaggaacctcgtaaggatggacaataggctctaaaaataccccaaaggcaggcaggatttgccagtaacatctgtaagttctgtccggcggaagttataaatactaaataatgttaattcag

SEQ ID NO: 196096 - DNA, 330 bp, Homo sapiens
tcagactagtatgaacccacttattatactaccatactgttatgagattcaagtaaaaaaaaatgtagacattccacaaaagggataacaactgtttttttaatcaatgtattctcaaagattaagtatgtttcctggaattaaatgtgtgtcacctaaaattaaaacaaacaacgcccccccattctgctaaatgcaatgtggtatgctggatcagatcctggaaaagaaaaaggacacttgcagagaactagtgatttggtgaaaacaaattttgttgaaattcaaatagtctgtagtttagttaaaaataaggtaccaatgttaggc

SEQ ID NO: 196097 - DNA, 690 bp, Homo sapiens
cagtgcatgtgtgggaaaaaactacacagagccaaagaaagaacaacctgaaaggattacaagtaaccatccttggaattcacataggactagaaatagtttatattcccatcagccaaagtggaatttggctccaaattttatggaatatcaagtacagtactcagaaagatgttatatcagtagaggagaaaattagccttaaagattgctctgatctcaaataacaaagcagaaaagtaagcctaaaaagagtgaaaaccagactcaaactgtttccaagtaacagaactgtgtcccaaaacaaagcccaaaaatgtttataagaatatagaaatatgcagcattaaacagggtaaaatttacaatgaccagcatccaatcaaatattaccaagcatacaaaagaagcaggacaacataatccataagaagaaaaatcaatcagtagaaacagacccagaaatgaaacagataatacaatgagtagacaagaattaatggttatcataattatattacatgttgcaactgtattccatgttaaacaacgtaaaggaaggatagactatgttaagtagagatatgcttaaagatttttagattttttaaaacgacccaatcaacttctagagatgaaaataaacaatctgatatgaaaaatacactggatggaattaatgcagattag

SEQ ID NO: 196098 - DNA, 347 bp, Homo sapiens
gccccatggaagtgctatttcatgctttagtatgtctaaaagagaccttgtgttttatcttgaattttgttgaatgaaaatttggactgttatgttaccagacttaggatagatgatagcaagaaggaaagggaacacattgattccatccagagttcaatgacctgaacagtattctgttatcactaggctgggagataatttccactagttattcccagaagtgctagaattgctgctgtttttcacttaatcagtaattactggtttctctctcttggctaattctgttcctaggtagttattttaaagattacaaggcagtacattaaaaattaagtaaaaca

SEQ ID NO: 196099 - DNA, 333 bp, Homo sapiens
  misc_feature (256)..(256): n is a, c, g, or t
acagtggattcgctactcctcacatctggaattctcccacagtctcctttgtcaaaactgtacctatattccaaggactagattcaaatgctatctctcttttttctttttttttgaaacggagtctcgctctgttgcccagactagagtgcagtggtgctatcttggctcactgcaacctcaacctcctgggctcaagtgatcctcccacctcagtctcctcagtagcgtgttccaccacacccggctgcttttngtattttttggtagaggtggagtttcaccatgttgctcaggctggtctggaacccctgagctcaagggcactgatca

SEQ ID NO: 196100 - DNA, 998 bp, Homo sapiens
ttatcagtgacattgtcattggtggtcagagaattaactgtgtgtaactgtatatttgaggcaaggcaaggggacagatattttccttacgttattagttgtgcaacagaagccaattaagagattggagagatgaataacactagtgatgggttgcaacttgggtgtggagctgggcacacccacgtacgtcattgtgactcagaagtccctgtcaccgccctgagccaagtactaaagtaaggcccaaataccacacttacttcataaagaaaccaaagtctgactgcctccatttctcatgagtgaaaaactgtttctattataggaaacttaggtcttcagtgtgtttgatggtagcatgctattagattgtgtattctcaagtctgattttccccattactgtgctttctccttttcacttctgctttgtcacttggaatgtttctagaagtagaagtcactgcccctgcctacatcagactgcaattccgggacatccagacaacagcaagggataattaggaataaatttggctggaagaaagggagaatgcagcttaggcagcctaaaccaacaggcttatttttctcactcagtaagagagctgaggtcgcctgactcagctcaggttctcagtgagccatcagccaccaggtgccacctttcagtgagtgggcttctatcccttccaggtgtctcttcatgctccatgggaattagatgggacatgctttgactctctcttccagaagctttctcttctttttgaaggggcttctgtttgcgctgggtggtcaatgactcagcctagtcttgatttatcccccaggatggggacagacagcaggggagagatctcaggttgagatgagtgtacagtaagggctgggagtatcagaaggggaaacgctctcccagatagtgacaaagctaagcgtccatgtgaagggagaggacaaacatcccatggaaagaagggtagctgccaggcc

SEQ ID NO: 196101 - DNA, 286 bp, Homo sapiens
gagaaatgctggcttggggtgtgagagtcagatcaggaagagactggggatatgggctctggattggtgtttataaagttgtttctactcgggaggctgagataggagaatcgcttgaacccaggaggtggaggttgcagtgagccaagattgggccattgcactccagcctgggcgacaagagtgaaactacatttcaaaaaaaaaaaaaataaataaataagccgggccaagagagtttattcagatcatctttcttttgttactttcactttctcataaataa

SEQ ID NO: 196102 - DNA, 457 bp, Homo sapiens
aagtgtttaggaaagtgcttccctgtgtaaaacttagctggttcacagatgaagagaaattttgtgagaatgaactgtaccgtgaagctcacctgcatctgatttaggtaatatttaaataagaccttggactttagactggacttgaggctggaatgagttaagatttgtggatttgttggaatggaatgactgcattttgcatgtgaagacatgaattttggggaacctggggcagaatgttacggactgaatttttaaagtgtaccctcaaaatctgtatattgaaatcgtaactgtcaatgtaatggtattagtagtgggaccttcaggaggtaattaggttgtcatagtagaggcctcatgaataggcttagtgttcttataaaagggacctaagagagctctcacttctttccccatgtgcttatacaaaaacccaacagtctgcaaccgc

SEQ ID NO: 196103 - DNA, 254 bp, Homo sapiens
tacgaattctctttacctcttagtagttaatcccctattactacttaataactccttatattaaaatttctggtcaggcgtggtggctcaccactgtaatcgcagcactttgtgaggccaaagtgggcagacagcttgagtctaggaatttgagaccagcctgggcaacatgatgaaactctgtctctacaaaaaaaaaaaaggggggacccttcaagagcggccctgcgggcttgcagggttgggaccgggcc

SEQ ID NO: 196104 - DNA, 168 bp, Homo sapiens
aatcaaattaatttttaatgagatttacggaatatttactatgagtctctgccagaccctttcacatgttgcaagtgattctaatagcagccccctcacatgagcctttcctggagaccagccagtattagtgtgtttgtatgttatttcatttagtgctcatgacaa

SEQ ID NO: 196105 - DNA, 240 bp, Homo sapiens
aggaaggtttcattcacgtcctcattgttctgcaggcactgagggcctggggaagggacagccacactttcacatgctgagatggaggaaattgtgagtaggacaaatgaactaatgggtggaaatcagtttgcatactgtctggcacaaagcaaacgcctagtaaacgttagctattacacagcatgcagaatagagcagtccctgcctggggtaactgtgtcgagtatctgtcgtgtg

SEQ ID NO: 196106 - DNA, 382 bp, Homo sapiens
ttaaagcttccgcgcagatacaaaaactcagggagaaatgaccacatgctgtacttggccgtgctgatgaagtttttgcagcaaatggttcttaagggggtcattgatgtaaatggtgcagccttttagcccttgtaagccttgcatagttcatagccagggcatcctctcctccaccttctgactgcccaaggagaaatgagtagatctcagactgctcagctggtgtatgatagtggcaagagtactattggttacacattcaagttcactggtaatcccctcaggcagagctccctggcacaagtgctggggcttggtgttcctcttcactaaaggcatggctcacaatcgtatgatagttgactgcgggttgcagaaa

SEQ ID NO: 196107 - DNA, 513 bp, Homo sapiens
ctgcctcgtagacctcatgcctgatttcacagcttcctaggcaggcagtgttgtccctgcttaactgatgaagaaactgatgtcccaagaggtgaagctgcccaaagcttcgtggccaggaagggttgaagctgggactcagcctgggctgatcccgtcgaaagcccacactctttctgatggaccctgctagaaccttttcatgggacttggtttactttcatgggagggcacaaggagggttagcgataagggtgtctgggtgcttcgcccgccttgggtccctggagctgcagggctgagggccgcgtgtgctgggtggggtggtgctggtggggggctcacgtgctctgacaaggccatctatgcagctggcacggctgcccccttaatcacatcatgacaccgaggacatccaaatgtgacccgagagagccatctagagtcctcctctgaggagtggctgggaatgagattagtgggatgaggtgacgcttgtgaagccgtgcttca

SEQ ID NO: 196108 - DNA, 517 bp, Homo sapiens
cgtggccggcgcctactttcttactctcctgctgctccctcgtctccctaagtctccttgttggccatgtcttgcgcccaggttctaaggtctctgtaggatgcttccccatagccatgatatggctagccgtttagaaattccatctagctagatgccctaaacgagggagatagatatgacgcttatttgtcctccaagggggatccagctggatagcaaccgccgactccagtatgccaccaggaacccctcccagggaggtttgtgcaggcctaggattccaggtttgacctcacctccccgactcctcctgtggtctcccaaaggcatgggctgggggctgggggctctgaatgctcctcatgacaccatggctcctttcagcagccgcatctcaatgccagatccccttagagtaaagggcagcggaataacgctagggggttttcacatgcacccctgggccaagccgacttgcccttgccgtggatccctgcattcatggatcggttat

SEQ ID NO: 196109 - DNA, 425 bp, Homo sapiens
tgtccagtcgcctcgcagcagcgagcccgagcgcccttctccagtcccggcttggaactgaactgtgtgagcacgggtcctggaacccgggcccagaaccggcgagcccaggtctgagcccagagctcagcggtcagcctcgtaggccctgactcggaatcgagccgaggcgctgaggttggagccggagagcgtgagagccgaagagcagggagggcgggccggctgcgcgtccgacgagtcgcagagcaggaccgcggaaggcagggagacggccgcaagcccagggcagagggcagagggcagagagcggcctggctcggcggagagggcgccgcccggccggaaccaagctcgccgcccgggacggcgggccccgtggggcgcggacccagggtggccgtgggtccgcagcgactccccgg

SEQ ID NO: 196110 - DNA, 513 bp, Homo sapiens
agcacaaacggatttaaggcccctttgcaaaccacattacttctatataggccaaatggcaaccacagggaaactttataatcagaagatctggataattcattatcttggatctgctgctgatggagtttagggaaatcacatgacctctcaaccccatttttaaaatttattaaatgagaggcattgaataagttaatgatttccaaagtgtttcaaagccttgggagtcgatagggaagtattgaggaattagaggagagaaagggcatttctttcaactcttacatattgggttccctcagattcgatttgaaaaaggtttcatagcacttttaaaaagaatctaaaaacctgatattttcccaggtttttggattctgtgagccagtgggattttaagattggccagtatatggaagaggtacacgtaccagtcctgtctgccagatgtaaagacatgaaatgaggcgaataccatctatcactgtaattacaacactaaaaaaaaaa

SEQ ID NO: 196111 - DNA, 739 bp, Homo sapiens
ccatgattgtgccactgcactgcagcctgggtgatagagccagaccctgtttcaaatttaaaagaaaaaaattataaatactcttttttttcctaaccatcaacttgccactaaaccaataacatttgggtttttttagagtcctgcagaaaccttctaagtcagttctacagtttacaccctttatcatcacctcctctctctctaccccacctctccatgttgcagtcagaatgaacatttaagacacagagctgagcacaccattctactgcttaaatctttcaatactttcccattaactgcaggataaaatgaaaacttttagcaagcactacaagaaggtccctgaataatctttttcctattttattaatctcattcccaggcttgctttcccttactccttgcatccagccacactcactttcagtttatggaactagccatctgattttcaccccaaggttcacttatactggcccccttacctaggattctgtttcccaccttacaccacacaccctacctgggtgggagatagataactgctatccatccttcagctttcagctcaaaaaccacagaaaagtattccttgacccccatatgaagtaagtttcccatataatatgcctttggagcacttaatataataaaattaaattttatttgttggctggttgcatattggctgtctcaccctctgaaatgtaagccctatgagatcgccaactac

SEQ ID NO: 196112 - DNA, 472 bp, Homo sapiens
gtaccaatgaaatgcaacatgtaatactgaaccagacgatggactagaattttgattttcctttttgccataaaggacattatttggacaattgccagatgtgaataaagtaatacatactcatggtattttggagtcaaagggacattatgtctacaacttgctttcaaatgattcagaaaaaatactgtgtagagagaaaatgataacagcaaatgcggaaaatgttaataacgggggcatctggttttagggtatatgggagttctttgttttatccttgcaacttttctataaaccagaactattttaaaattttcaaaaagtataaaacataagtggcagcatttggtagctactgaaaagaaacagcagtttcttcagtctattaaatgaaaatacaagtaatagctaaataactggagtgtcatatagtgcttcttcaggccccattcatgggggcacttccccc

SEQ ID NO: 196113 - DNA, 517 bp, Homo sapiens
tctctcaggctcatgtgattcttgtgcctcagccacccgagtagctgagattacaggctcacgccaccacgcccagataatttttgtatttttagtagagatttcaccatgttggccaggctggtcacgaactcctggcctcaagtgatccaccagcctaggcctcccgaagtgctgggattacaggcaggagccactgcgcccagccttaattttttcttttcacgatttttttccattttaaattaaatgcctttggattttaaaaaatgcaacattcctctgctatcttattaaacgtatccttgaacttcagggagtggagaataggtgtctggaaaatgagacactgcttttctttgtttttgaacttaacaagttccacattcagagatctcaattacatgcccttcattgaatgtaagtgtgatgcatttaacatacagcttgtgtgaaagcaggatattataaccacaaacatatctgactttaaaattaagtaaaatactcaacatag

SEQ ID NO: 196114 - DNA, 530 bp, Homo sapiens
atgtcacgagccagcacagatatatgaggatagaaggataagcaaaagactccaccttttgatgggaggacaggcatacgtcatattgcacaaaagagtgcgtatataaaaatacagccagaaattgtgtctatactttgacatcttctatcttctacaaaatagagaaatttttatagtacctatattttcaactacaaatcatcacagaagttctgaaggacaaaagtaggtactagcttgcattttccccaacatgaagtaatattactctgctgcttcagtcacagatttcaacagaagaccaagatccagactcaacgtctgataccatcatttaagttgcttggttgggtgatttttctgtgttttaagagccttcaacacttttctatttgatctaatcgataaatttccatctaatttgatatttttacctacaagagcagctttattttatttgtctattgtttgttgagatggagtttagctcttgttgcccaggctggagtgcaatggtgcaatctcgg

SEQ ID NO: 196115 - DNA, 421 bp, Homo sapiens
tagagaataacataggagagaacacgttgaaacccagtggtaggtaaacttttatgttacacaaatatcttatgagaactctaaaatttaaaacaaatgttgattgaaactcatcacaattaaaaacttctgggccaggtgcagtggctcacgcctgtaatcccagcactttgggagtctgaggcaggcggttcaaactgaggtcaggagtttgagaccagcctggccaacatggtgaaaccctgtttctactaaaaatacaaaaagtagccaggcatggtggcacgtgcctgtaatcccagctacttgggaggctgaggcagggtaattgcttaaacctggaaggtggggtttgcagtgagcccagatcacaccactgcactccagcctggatgacagagcaagacttcgtctcaaaaaa

SEQ ID NO: 196116 - DNA, 249 bp, Homo sapiens
gtaatagaagaatttagttaagcaagaataaagacctagggaggcactggctgtaggggtggaagaggcactggctgtagaggtggagaggaatggattcatctgggacataattaggccatagaatcaacagaacttgaccaactgactgtgagaggaaaggaaacaatccttctggagcactgaccagggtgtgtggcaacaaaagaggtgaaactgccgcagcagttagcgtgacccgtggcagtg

SEQ ID NO: 196117 - DNA, 788 bp, Homo sapiens
aaatggtctgaggtctattcctacttatcctactagattgcctcttggtgcttattcaaattcttgatcctgaattcctttaatcaagtaattatttcaaagaacataattaggtttccatagggtcgttacttcttttatattcttggttctttttaccttatccacccgtatctttattttcagggatttccatatccatcagttgggactgaaaactaatctgcattaaagtagcagttgttacttgatatgacttacttttttttttctcatggatatttgaatgttacaggatttgggaaggtaatttttttaaattactgataaaaatcttgtggaggattctgattctcaggtctggaataacctgcattttttgaataagtggagcattcacatgtggtttaaaattcaaaatatgtaattgatgacaccatatccgagccattcagtttccttctcaggaggcagtgttgttagtgggtgtgtctgttgtgtgtgttcttctagagatagtttatgtttatataagcaaatgcagatataccttcctctcattttacatacttttcagttttctaagcctttagcaaaagtatataaattaatgttatgggattttacaaaaggcagaagccttcaagactataagcagtgcagacagagtgatttgaatgataggaagtaggtatgctaagtaacctctgaaatgacacccgcacaccacaattttcactttctgtgcacagagatggtactatctgtagatttccagagttttgcca

SEQ ID NO: 196118 - DNA, 193 bp, Homo sapiens
aaaaaaaaaaaaaaaaaaaaaaaaaaaaaaaaaaaaaaaattaaggttttcagtggaaaggaggaaaaaaaatcaaagaaattttgaaaaacaacttaaattggaaatctatgaactttatttttgaatatatttgcttactctgttttttaaaggactagaatcaaaggcaatctgacagcggcacccagat

SEQ ID NO: 196119 - DNA, 227 bp, Homo sapiens
agcagaaactaacctcaaaagaataggtaatagtgcaataataagaaatgtttattacatttgtttttaatattttatttttttagtttatttttattttttattttagtttttttagtttatgtaatttaatttttaataataattactttaaagactggcttgcaaaattcatgaaaatctaataagtaatcatttttgctggctgactccatcacactattgaa

SEQ ID NO: 196120 - DNA, 532 bp, Homo sapiens
aatgtcaatagtgcctagattgagaaactctgatttgtgggaattgaactcagcaaaccaggcttgggactgggtctcttgaagctttctaagttaattcatgttcatccatctgtgcaatgaaaaggaggagatgggaaagggaaataataataaaatcacctgccctatcaacttcagtgagttataatgaggatttcagcacaattagataatttgagggaaagtgctatctaaactactatgcagattttattataggactcatggacttgcctccagagtttgtacatggaatgagtttttaatacattttggatccataggagacatgaatgatcctgtaccttaaaagttcattttgtttttattcagaaaattggaaaggtcattctgctacataaagcatctgcatcagactccatattacaaatgaaccaaaaagcctagaagctcctcaatgcaaatatttgagttttggccaattctcatgataaggtcacattgttagcccttgagattattaaaaaaa

SEQ ID NO: 196121 - DNA, 424 bp, Homo sapiens
taggtgtctctacaggatcccccctcgaaacccaatattgtcacatcgctactgctggctgccaggttgctcggttatgatcagtgggcagagtggactggagctgttttttcttttggaaaaacatttctgcagtacttattacattctcagtgatttgcaaaaatgctctctctcttaacccaatgacagagctacagtttttgttcccatttaacaggttaaacaattgagatacagggaactaatccaaagtctcacagtgacagggacttgaacccaggtcatctgtcaacagagtctgtgctcttagctgctacattggatttctcatccacaaaatgtctaatcctatgtgctctttttatttgttgtagctctcctgttgattcagagggaaaactgatatggcatattattacac

SEQ ID NO: 196122 - DNA, 420 bp, Homo sapiens
atagttgagattttgggaaatgaggtctaatctgaagtaggccaaatatctaaaataatattagacattcagatccatcctaaaaatgatataaataatttaaaaccagagtaattttttactatcaattatatgaaaataatgaagtagggacattctaataggaaagtctattcaccgaagctttgaataaatgtttactgctcgtgatggatattcattcaacaatcatttctgaatggcaactgtgaactaacactgtgttaggcttctgacaacagaatacctttatagagcaacatgagatttaacaggaaaaagatagaacaaccaaaaaaaaggagtcaacaaagtaacggatgttaatcatagcactcctagtggtgaatacaaagttggaattctcagagttattggtta

SEQ ID NO: 196123 - DNA, 759 bp, Homo sapiens
gcagtcacgtgggggatgagggacgataccagtgcgtggccttcagcccagctggtcagcaggccagggacttccagctccgagttcatgcgccccccactatctggggctccaacgagacaggcgaggtggccgtcatggaggaccacctagtgcagctcctgtgtgaggctcgaggagtgcccaccccaaacatcacctggttcaaggacggggccctgctccccaccagcaccaaggtggtctacactaggggcggtcggcagttgcagctggggagggcccagagctccgatgccggcgtctacacctgcaaggccagcaatgctgtgggggccgcagagaaggccaccaggctggatgtttatgtcccacctaccatcgagggcgccggtggaagaccatacgtggtgaaggctgtggctgggaggcctgtggcgctggagtgcgtggccagaggccacccgtcccccacctctcctggcaccacgaggggctgcccgtggcagagagcaacgagtcgcggctggagacagacgggagtgtgctgaggctggagagcccgggggaggcatccagtggcctgtacagctgtgtggccagcagtcctgccggggaagccgtcctgcagtactccgtgcgaggttcaggtgcccccacagctcctggtggctgaaggcttgggacaggtgaccaccatcgtgggacagccctggaacttcctgccaggcctcaggctccccagtacccactatccag

SEQ ID NO: 196124 - DNA, 714 bp, Homo sapiens
atacccactctccgcgcagtacacgttaaccacaaaccacaccaccttacacagtgaagcacaagtgatagaggttgtcaagtctgcatgtggccctttcccaaatcctctggaagaaggaatctcatttgatatttattcaacattcatagagccccccacaatattggatacggaaatgaagaggttggatcaagaacaaggccctgaggagtctcagccagaaactgacacctcagacatggatcctttagttggtttcaccattgaagatgtaaaatcagtgctggatcaagtcacagatgacattttaatcggcattcagaccgagataaacgaaaaactgcaaatacaggaagaggcctttaatgcacgaatagaaaaattgaaaaaggcctaaggacttggtacaaggagagtgatgctaaacttcacagaaacaaacaaaaccagccagaataacagactctctggagcgtcgtgtctccatcacttagttgtgaaaggaaaaccaagccccactttttattttcctaagtaattagaaaagtattggtcccaattttgctatctcccatcccataacagcctctgaatttattgcaccaagtgtaatgagaacattttgtatacaagagtttgaaaaattatatataaaaatacaattacttttatgatagtcctttgacgttttgactaataaatcctattcat

SEQ ID NO: 196125 - DNA, 1254 bp, Homo sapiens
acgaggggcagcgtctctcggccgagattgcggcgatgtcgcaggggacgactccctgggggccgaccccggcaggccgaccccggcgggaaccacgcccgaatcggagagagacactgaattccaggagcatgaaaagattctgtctccggattttctttcagttgcccaaatcactgatttgttaatggaggacatcgatggagttcaagaaaaactgagaatatttttgaatttcaaaaaccttgaaacttgtttaaaggatgccattctactagattattatgtatctggatttttgtgggctagaggaatggatttctctattattcagtattcaaaatttatgactttactagctatgtcacttcaaaatcttaaaacactacatatgtccttagaggaaagcataaaatggcttggagaagttatggctgaaataggaccaacacattcgcaaaagagtgaggactggaatatctttgatgtaaaacaagccaatgctatcattgattacttaaaaatcagcttatttcaacactacaagctatacgagtttatgttctactctgccagggaagaaattgtgataggaactgagcaagtgatagaggttgtcaagtctgcatgtggccctttcccaaatcctctggaagaaggaatctcatttgatatttattcaacattcatagagccccccacaatattggatacggaaatgaagaggttggatcaagaacaaggccctgaggagtctcagccagaaactgacacctcagacatggatcctttagttggtttcaccattgaagatgtaaaatcagtgctggatcaagtcacagatgacattttaatcggcattcagaccgagataaacgaaaaactgcaaatacaggaagaggcctttaatgcacgaatagaaaaattgaaaaaggcctaaggacttggtacaaggagagtgatgctaaacttcacagaaacaaacaaaaccagccagaataacagactctctggagcgtcgtgtctccatcacttagttgtgaaaggaaaaccaagccccactttttattttcctaagtaattagaaaagtattggtcccaattttgctatctcccatcccataacagcctctgaatttattgcaccaagtgtaatgagaacattttgtatacaagagtttgaaaaattatatataaaaatacaattacttttatgatagtcctttgacgttttgactaataaatcctattcat

SEQ ID NO: 196126 - DNA, 1027 bp, Homo sapiens
acgaggggcagcgtctctcggccgagattgcggcgatgtcgcaggggacgactccctgggggccgaccccggcaggccgaccccggcgggaaccacgcccgaatcggagaaaactgagaatatttttgaatttcaaaaaccttgaaacttgtttaaaggatgccattctactagattattatgtatctggatttttgtgggctagaggaatggatttctctattattcagtattcaaaatttatgactttactagctatgtcacttcaaaatcttaaaacactacatatgtccttagaggaaagcataaaatggcttggagaagttatggctgaaataggaccaacacattcgcaaaagagtgaggactggaatatctttgatgtaaaacaagccaatgctatcattgattacttaaaaatcagcttatttcaacactacaagctatacgagtttatgttctactctgccagggaagaaattgtgataggaactgagaggttggatcaagaacaaggccctgaggagtctcagccagaaactgacacctcagacatggatcctttagttggtttcaccattgaagatgtaaaatcagtgctggatcaagtcacagatgacattttaatcggcattcagaccgagataaacgaaaaactgcaaatacaggaagaggcctttaatgcacgaatagaaaaattgaaaaaggcctaaggacttggtacaaggagagtgatgctaaacttcacagaaacaaacaaaaccagccagaataacagactctctggagcgtcgtgtctccatcacttagttgtgaaaggaaaaccaagccccactttttattttcctaagtaattagaaaagtattggtcccaattttgctatctcccatcccataacagcctctgaatttattgcaccaagtgtaatgagaacattttgtatacaagagtttgaaaaattatatataaaaatacaattacttttatgatagtcctttgacgttttgactaataaatcctattcat

SEQ ID NO: 196127 - DNA, 748 bp, Homo sapiens
acgaggggcagcgtctctcggccgagattgcggcgatgtcgcaggggacgactccctgggggccgaccccggcaggccgaccccggcgggaaccacgcccgaatcggagccgcccctttcccttcccggtaccggtgccggtaccagagacctccgagcgctcattcccagtccgcggagtctgcggccaagccaaatccggtctccgaagaggcgccgcacgtctggccccggctgaaaactgagaatatttttgaatttcaaaaaccttgaaacttgtttaaaggatgccattctactagattattatgtatctggatttttgtgggctagaggaatggatttctctattattcagtattcaaaatttatgactttactagctatgtcacttcaaaatcttaaaacactacatatgtccttagaggaaagcataaaatggcttggagaagttatggctgaaataggaccaacacattcgcaaaagagtgaggactggaatatctttgatgtaaaacaagccaatgctatcattgattacttaaaaatcagcttattgcaaacacatacaagactatacgaaggtgatgttcgtactctgaccagggaaagcaaattgtgcataggacactgagcacagctgaatacaagagatgacaaggtcttgcacatgtgggcctagccccaaattcctatggaagaaggaatctcaatagggtaattaactgaaacgtccatagagccccca

SEQ ID NO: 196128 - DNA, 980 bp, Homo sapiens
acgaggggcagcgtctctcggccgagattgcggcgatgtcgcaggggacgactccctgggggccgaccccggcaggccgaccccggcgggaaccacgcccgaatcggagcactacatatgtccttagaggaaagcataaaatggcttggagaagttatggctgaaataggaccaacacattcgcaaaagagtgaggactggaatatctttgatgtaaaacaagccaatgctatcattgattacttaaaaatcagcttatttcaacactacaagctatacgagtttatgttctactctgccagggaagaaattgtgataggaactgagcaagtgatagaggttgtcaagtctgcatgtggccctttcccaaatcctctggaagaaggaatctcatttgatatttattcaacattcatagagccccccacaatattggatacggaaatgaagaggttggatcaagaacaaggccctgaggagtctcagccagaaactgacacctcagacatggatcctttagttggtttcaccattgaagatgtaaaatcagtgctggatcaagtcacagatgacattttaatcggcattcagaccgagataaacgaaaaactgcaaatacaggaagaggcctttaatgcacgaatagaaaaattgaaaaaggcctaaggacttggtacaaggagagtgatgctaaacttcacagaaacaaacaaaaccagccagaataacagactctctggagcgtcgtgtctccatcacttagttgtgaaaggaaaaccaagccccactttttattttcctaagtaattagaaaagtattggtcccaattttgctatctcccatcccataacagcctctgaatttattgcaccaagtgtaatgagaacattttgtatacaagagtttgaaaaattatatataaaaatacaattacttttatgatagtcctttgacgttttgactaataaatcctattcat

SEQ ID NO: 196129 - DNA, 614 bp, Homo sapiens
cttctgggctcaagctgtcctcctgccttaaccttccaaaatactgggattacagacatgagccaccacacccggtctcttctaaatttttacttgacacttaagagtagtaaaaaacatactttcctttttatcttacattaatggatgtgtttaaactggtgtttaataaaataatggaatgtggccaaatcatatatattgtttgacatttactttaccaaagtaaaacggaaaggcactggtcttcaatcttaacattgtatgcttaataatacttttttttaaattatgaaataatcactttcatggtatgcttactttgttccagggactattctaagcactttacatgtattaactcattaaattcatataacattttatgaggattactgttgctatcttatgggtgaagaaattggcataaagaaattaagtaagtggcccacaaattacttaataatacaaaatctgtcatcactctatatctaaatccctaaaccttaagcatgcaatgaggacagcaattgtgcctcttaattttcagaaagaatccttatggatattacatactctgtgtccacacaagttcttataaagtgaggtgctaa

SEQ ID NO: 196130 - DNA, 809 bp, Homo sapiens
gttgtatttaagaacatagtaaccacaagccttagaaatgctgcagttcactagcacacgcacctaaggcacagcagcaaacaggagctcaaggaacaacttgggcattagcctggtgcccatctctcctgctggaattcctgcacagctgggatggagagggtcagcgcccccacctgctgcttccaggatgggctctcccagtgtcagagccagtgagagcctgagcagtagcagactccctggacgcgtgtgttgaagagggagaccggaaggacagatagcacatgtgacatgtcatgtttaaatggtaggataattgtattttcaaatctttaattttgcttaaaacagatgtttgacggataaatgttgtagaatattttggctgaattgcatattttttaaaagaagggctgattttatgatgtaagaaatcttctaggaggggtgatccacacagcagcgcaggtgggtcctgggagtaaatgccctcagaagggatcaggaaggcagcagaggccgggagcggtggctcacatctgtaatctgagtacttttggaggccatggtggatgtattgcttgagcccaggagttcgagaccagcctgggcaacctggcaaaaccccatttctacaaaaaaatacaaaaaatcagctgggcttgatgggggcatctgtagttttagcgacttggaggctgaggcgaaggatccacccgggcttgggaggtcgaggctgcagtgagttgtgattgaaccacagcactccagcctgggtgacagtgcaaaaccatctcaaacaaaaa

SEQ ID NO: 196131 - DNA, 1022 bp, Homo sapiens
taaaaacagaagcatttccacagaatcaagccattttgggttcacttctgggataatcatacaacagatatctgagcagaatctgctgtaagcaaagttgtgagacttagcacaacctcccttgcattgagaaaggtagaacctttctaagcattcagaattctttcttccctgccccatgcagattaaagtaaaacctttcatacatactccttaagaaataagcaatagagcaatagtatgaagggcaagaaaaagtgaatggatgggtgtctcaggtgtttcagggaaacattaatacagaaaagcccctcaccagaatgaagaaggaaagagagacagcatacactacctcatcccagtgtaagaagaaagaacaggttctttctgctccaattagactgaataaaatgacaaaacccaaatccttctggtaaaatttgttttaaagagattacctaaagattaactcaaatgactgagcagagtgttaaagcccaggctagatattatggagagaaaacagatttgctgtaaaaatgctatctaagatatattcaagcacagctccctaacaactctgacacttagaaacacgctgattgcatttcagaagaggtaaagagatagggaccagaagtcagaatttaaaaaaagagtgggcaatgattggaggtagaagaggtgaagaagccacaaacacaggaaaagggggaagaggcaaaggaatgactatgttatgtacatgtatatatggaaagcacacactcacacacccctctaaagggcacttctcatcactcaaaactttttaaaaagactttacttactatgtggcttggtttgcatgtgtgatgatagacccaatattacatatataaatatataaccacatatataccacatacacacataaacacacatacacaaatctgtacaacacgtttatcaactacacaacataagcactgaccaatcaggatggagcagagtccttatggtcactgctggtttagttgcca

SEQ ID NO: 196132 - DNA, 146 bp, Homo sapiens
ggtggtgggtgggaagcggagcaagtaaatataacagatttactgagtaaggtttaaacttgatggccatgacaaaaactttcattcctatggagggaaaagtgtttcaaataacactctctagcccctaacactctcccctgctt

SEQ ID NO: 196133 - DNA, 793 bp, Homo sapiens
ggggaacctgctgctggtgtgtgtgtggtctggagaggcgtgtgcctgtgtaggggaaaaatctgggtgtatgtggaaaggttgtattgcagctgaaggaggctgggagggtcttctgtccctgggagacactgaataatccgtgttgtgtatctgcgtttcgactgtgaactctttcatgaggttaggggtggaattcctacttggagcgtcatgtcagtgttcaaaagctctgaatcttgcagcatttccgagtttggattttattgggtttgggatgctcaacctgtatctcactaatagtcaacacaagggattttatgtgtgtggaagacccactgtcagggtccaagagtatcattctcagggaggagaaacccagaaaccgggggcacagacaagtcatttggcaatttgacaaaattaccccagttcattccttcaacataacaaatacataacagtaagaaatcatcaagtggctatttcctgttagttactatgcttcatgttggtgatacaagaattaaaaagatactgtcacaaatcaaaacaaaaagcacaacacatatattaggatggctcaaattcaaaaaacggacaataccaagtgctgagaaggatgtgaggtaagagaaactatcgttgctggtgggagtacagcatggaatagccactttgcaagacagtttggcagtttcttacaaagttaacaagattaatcctatcatacaacccagcaatcatgttcctgcagatgtactcagttgatgtgaaacttatgtgcacacaa

SEQ ID NO: 196134 - DNA, 453 bp, Homo sapiens
gagcaatggtttttttaatgccaagtgtataattatatgtctgtaaagcccgtgaaagttgatgggaaaactatgacagacaatttagcaaagttacagatataagattgatatgcaaaaatcaatgttctttatatatataaacaaattccaactgaatgatgtaattaaagagaagacacctcttcagtagcaacaacaaagataacgtagaggttaaatgagtaaaatttacacaaggaatttaaaccctttaaaaaacacagaagtcgactcgaacagagccttttttgtcaactatgacatttttgaagaatcagctggccgggcgcggtggctctcgcctgtaatcccagcactttgggaggccagggtgggcagatcacgaggtcaggagatcgagaccaacctggctaacacagtgaaaccctgtctctacttaaaaaaaaaaaa

SEQ ID NO: 196135 - DNA, 230 bp, Homo sapiens
catccttccacctcagtctcccaaagtattaggattacaggagggagccaccattcctggcccagcctctgcttttaaagggctcttaggccacatgctggttttttgtgttttttttttaagcttactctattcaaagtggagatgaaggatcacaggacaactttagtgccttatgcctaggccaaaggaaacacgtagcttttcacaggtggtagataaggctctgg

SEQ ID NO: 196136 - DNA, 404 bp, Homo sapiens
tttggggacttagtcaaaaattctttgccaaggctgatgttgagaaaactatttcttaggttctcttctaggatttttctagtttgaggtcttatatttaaatctttaatccatcttgagataatttttgtatatggtgaaaggtaggggtccagtttaattcttctgcatatggctagccagttatcccagcaccatttattgaactggggagccctctccccattacttgtttttgttggccttattgaagatcagatcgtaagtgtgccactttatttctgaattttctattctgttccattgatctatgtgtctgtttttgtatgagtaccacactgttttgtttggtatagccttatagtttgaagtcagatagtgatgcctccagctttgttcttttt

SEQ ID NO: 196137 - DNA, 313 bp, Homo sapiens
cttttccatccactgattatcttaccaactttaacaatgaaaaaagcatcaacgtatatattgggaccgttatagaagtttacgccaaaaatgttaaagagatgttttatatatacttgacacagtcatattatagtgagcaggaaagaacctttctatttaatatttgttctcccaggtcatgtgtttgctgaaaagccatcagttaaagcgaggcggccaggtgcactctctaggtggagaaattaagagcctgttgctctctttacagtgattttagttttgtgaggtttcttgtttcttttaaaagaaa

SEQ ID NO: 196138 - DNA, 450 bp, Homo sapiens
ttctgttaaaccttttccatgacaggcaactagaatagtagaaagcataacatggatatgcctgatttttaataaaaaataagatcacactattgatttagtgtgaatctcttcctgacaagcattttgttgacttgttaatctttttggttgtccagtgtctactggtaacaatggactataatccaaggtttcttccctggatcaaaactatagttttcagatatagtttgaattactacccttcacaccatttcctcagaatgagctgacagctagatacccttatatatcaagataacttcctattaccatgccatagaatcagaaggtatttcattttcactaccttttttcatgtcctcccatggaaatgcatctgagaaactgcttcttgtaaaacatgagcaaatgagaatgagttgaatatctgttcaattcagttcaatt

SEQ ID NO: 196139 - DNA, 392 bp, Homo sapiens
aaaggaatgatttggccaacatactattcaggcagcagtacagaagatggatttaaagggataggactggcagaaggaagtccaattcggagacagttgtaattattctgacagaagatgataagggcctaaaataatgggatgaaagcggtagcaaatctggagaaaacagactacatttagattatgttgctggtccagagatcaaactttgacaaccactaacctacactggctagggtttggcaaattttttctatgaagagccaaagagtaaatatttcagactttgtgtgtcaaatacagtctctacagcatttcatgtttttgtttgttttttaaacaacccattaaatattaacaaccattcttagctactggaccttaccaaa

SEQ ID NO: 196140 - DNA, 357 bp, Homo sapiens
aaagaactagacaatctcaagtgttccttccagctctgctgtttatctgaaaattcacgacagacactcagtgatacagaaatgtgtgctccagaccatgtgaactggagaacagaatttggttctcttcagcttcaattcacatttgggttcatgtgttttgctgccttccttcttttctctacgtattgacacctaggaaaactcaagatgccagagatccctgacacctggctcatatggtaggctgcgtgatgatggagccgagagctgaaccgcccaaggacagagggcctcagcaggaactttgggaatcagcatattgatacctaagtggagacctctttccagacccag

SEQ ID NO: 196141 - DNA, 515 bp, Homo sapiens
gcctcagcctcccaaagtgctgggatcaaaggtgtgagccaccacgcccggccacctctttcatttctaatattagtaatttgtgtcctgtgtctttcttccttagttaacctgctagaagcttatcagttttattgatcacattgttcatagtatttctttctttctttttcttttttcttttttttttttttttttttcgagacagagtctcagtctgtcgcccaggccggagtgcagtggtgcgatcttggctcactgcaacctccgcctcctaggtacaagcgattctcctgcttcagcctcccaagtagctgaggttacaggtgctcgccaccatgcctgactaatttttgtatttttagtagaaacggggtttcaccatgttggccaggctggtcttgaactcttgacctcaggtgatccgcctgcctggacctcccaaagtgctgggattacagatgtgagccactgtacccggcctgtttatagtatttctttattatccttttaat

SEQ ID NO: 196142 - DNA, 505 bp, Homo sapiens
ttgagctaaaatttctctgtatgtaacttctccttattggttttctttatttccttggcagattcaaggaggtaatggccatttttttctgaagtcccagtcccagttaacctactaagtcctacatattggtcaggatgaaggtcagagcatctatattttgggtttcttcctaccttcagggagacctggtgtcagttcttagctgagtgagatggccagcacgcatcccccagggtttgtctggggatccatcttgttacttgtgccagctcctccacctggctaggataattccctctcctgtcctcactcaggtggggaagcccttctgtgccaccagctatcctgtttcttgtaagaggatttttaatgtgggaaatcatggcaagaaagaggtgccaggcagctttaaagcaccaagagaagaactccaaacccatgtcataaacactcaagaaaaatcagcactgttctacatgcatacatgtagaacatgactttc

SEQ ID NO: 196143 - DNA, 187 bp, Homo sapiens
gtgtcagggcaccagattcagaaaattgcaccacaatcagagtccagattctggtcagagccctgtctcttaccagctgcgcaatcttaggcaaggccgtctcttaacctctctgacttccagtttcctcactggataaaggaaacctctgctgccagcacgggctacctgccctacctactcagag

SEQ ID NO: 196144 - DNA, 123 bp, Homo sapiens
gtgttctgaaatcagtatcactgggctgtaaccaaggtaatacactccctctggaagctctaggagggaatctgttcctttcttcttccagcttctagtgagtaagcattctttggcttctgg

SEQ ID NO: 196145 - DNA, 755 bp, Homo sapiens
aggggggacgatggcgggacgggtggccgccggggttccagccctgcgcctgctccggagcaccgggcccctctcgctgaccccctcgtcccaggaccccgcaggcccgagtgcctgggctcgtcctctttcgcgcccgctgccaggtgccaggccgcgcagtgctgggcggaggacagaagtcggtcctaggccccccaggctctgaccttctttcccaggatgaggtggggccaccatttgcccagggcctcttggggctctggttttagaagagcactccagcgaccagatgatcgtatccccttcctgatccactggagttggccccttcaaggggagcgtccctttgggccccctagggcctttatacgccaccacggaagctcggtagatagcgctcccccacccgggaggcatggacggctgttccccagcgcctctgcaactgaagctatacatgctgtgcacctgtctggaacctggctgagtggttcagcctggctgccagggaggagcgccagtttggccaactttgccctagacacggtccacgttgacccttgtgatccgctgcagaggtaccccctgatgagctaacttcgcccatccgctgtgagctgggcactggatgcatcatggcaccccgaggcctgtggtccccctcattggttctttgttctacacgtctttaacccggattgccttgttggccggcccgggttgcagacacgcggtgctgtttggcccgtcgg

SEQ ID NO: 196146 - DNA, 582 bp, Homo sapiens
tgatccgcctgcctcggcctcccaaagtgctgagattacaggtgtgagcacctggcctactctttattttttcttatggtttgtgcttttaaagttttatttaagaagtccttatctttccttaggtcttagatatagtctcctgttttttctatacttttaggtcctttatttacctagagactactcttatatctgatattagaagggtatccaattttaattttctctgtataatgggtcactttccccaacaccttctttttttttcccctttgattcgtagtgactgcaaactcttcacctatattgtcacttccttcattatgccttgtctctaacattatagccccataactggccttcttgctgctatcctactgctctgtagtatcttctcactacagctagtatgattgtgtataagaagtcagatcagtccaggcacgatggctcatgactgtaatcccagcacagaggcaggcagatcacttgaggccaggagttccagactatcctggctaacacggcaaaacccgatctctactaaaaatacaaaaattagctacttgggaggctgag

SEQ ID NO: 196147 - DNA, 318 bp, Homo sapiens
gttttagcagagacagggtttcaccatcttggccaggctggttttgaactcctgaccttgtgatccacccacctcagcctcctgaagtgctgggattacaggcataagccaccgcacccagccaataaaacatttttatattttattttgctttatttgtctttgtatcttctatagtacccattttcaagaaatatatattgaggatctgttctgctcagaaatggaatagaatttgtatgttttaaccaggtcaaagtccattcataaacttaacatttattgtcttattgctgtatgagaatactgtgacagata

SEQ ID NO: 196148 - DNA, 216 bp, Homo sapiens
attattacatgagtagagatgctttgtaggcagagaaaggtggctgactgagtctaatactcacggggaagagcattctagtttgaccacttagaaaaggaactgctaatttggaagatcttgttagcataatttattttgtcacttttaagacagcccaccaagaggcagtatattgtggtacttaaagagtggctctgaggctgggcgcagtgg

SEQ ID NO: 196149 - DNA, 249 bp, Homo sapiens
ggggcccagcctgtccgtgggctgacactgactgtgtgtctgactcttctgagtgtccctcgctgtcactggcctggctaccactggaccctcggtttccactgtctccgactacagatgaatcttgtctgcgcccagtgcctgagtctgtggagctgtctgctgactgctggtggcgggatccatgtctttctcctggacttgaccttgcctgttcctgggatgatgcagcctgtccaccagaggaag

SEQ ID NO: 196150 - DNA, 128 bp, Homo sapiens
aggatctggccaggcgcagatgccggaattacaactgcgcactaccgcgcccagccaattttattgtagagacgaggtctccctatgttgtccaggctggtcttgaactcctgggctcaagtgatcct

SEQ ID NO: 196151 - DNA, 311 bp, Homo sapiens
cccttttgagaaaaagttagctgacccctgccctatattgcaagaggaattagtattagtattgggaccattgcaaggtagattgtaaggtttgttgtgtgggaaaaagatcgccctccaggaggcccagtaatcttcaggttcatgccagttggcagagagcctgactaagccatttcttggctgggtgtctggacatgctgtgaggtgacattttagaggcacacaaacaagggaatttcatgtcttttctttctcctgcccatcatcacaagaacagggaaatattcctaaagcagatacatatcaga

SEQ ID NO: 196152 - DNA, 310 bp, Homo sapiens
gtttttgtaacttcttgtgagtctaattttattttaaaataaaatgtttaaaagtatacatggtaacagactttctttggggaggggaggtagttctgcttagcagacatacctcctttatgacaccccttgattccttctggagaggaagagaataaaaattatcccactgtgaacaggcagacttgaggggattctaaatcaaggcgctttcgtatttccaagccaaatgcatccacagggtctatcacagacgacttcagcaagaatattcctctcatagccaaagtatagggatcggactcaagct

SEQ ID NO: 196153 - DNA, 290 bp, Homo sapiens
tataaaaacaagagtaatgggctttgaaatgagtttaaatattacttctgctacctcttatatttaaataagtcattttgagtttcagattctccatgtgaacaacaatttttccaggatattaaatagagtttaaaatatgaaagtattttgattagtctccaagagtccttaaaatcctaaaattccatgtgctttaattttagctatagaaaaatggggctggcagaaagaaataaaataatagaagaaaagaacaccaaggaaagcagagaagaaagtaatcagga

SEQ ID NO: 196154 - DNA, 294 bp, Homo sapiens
aggtgacatttgaacagtgatctagaggaagcagggccttgaggatatgtgagaaaacaattgctgaggcagtgggcctgcaaaggccctaaggcagagcatgcctggtttgttagaggaaggaggccagtatgactgggtagcagcaaggtagggagatcttggaaagagctcacatcagagaggttgtcggggactcaatcaggtccactataaagactttgatgtttactctgagtgagctgggaagctgttaaagggttttggtttttttgttttttgtttttttttttt

SEQ ID NO: 196155 - DNA, 294 bp, Homo sapiens
gaaagtatctgtcgttgggaacacacatgacctttcaggaggtaattgacctgcactgttggtaggagcatcttatgtagccatctgaagacagattggaacctccttactcagaagggttcgattgtttggccaaggaatgtcaactgttgctgcagaataagctgggtggttacctgctgaccccttttcattcttttctgctttattagaaccttgatatgagaataagttcagcaagagttggagaggagagtgaaatcattcccaggcttcgtgtggaggtctgtgctt

SEQ ID NO: 196156 - DNA, 263 bp, Homo sapiens
ccactgctggtagattcctgtttgtcacagtcagcctcctcctccgttcccatttaaaatggaaatgtcactggctgggaaagcacactctgtttctgacgtgggagcatggatgaactgatgggagtcctttcctcttgagcagaagaagatggacagtaaaagtgtcagtgactgaaggaagcatggatgtgagcacatgtggagcgtgagttggcggaggtggaactttctgacctctgtactttggccagcccagccct

SEQ ID NO: 196157 - DNA, 529 bp, Homo sapiens
tactcgggaggctgaggcaggaaaattgcttgaacctgggaggtggaagttgcagtgagccgagactgcgccactgcactccagactgggcaaaagagcaagactccatctcaacaacaacaaaaagagtattgaagtggctaaatattattggtgtattgtttatcttccctccaattactgcagtttttacttcatgtactttgaggctctgtttttcggtgcatataggcttacaaatgttatatcttcttgaaggattgacccttttatcattctataatgtccttctttgtctctagtaacattttttttgtcttaaagccaatttttttctgacattaatatagccactctagctctcttttggttactttctgcatggaatatttttgcatccttttactttcaacctatttgtgttttttaatccattctgccaatctgtgccttttagttagagactttaacccatttaatttaatgtaattaatcataaggatttacttctcccagtctatatgccatt

SEQ ID NO: 196158 - DNA, 646 bp, Homo sapiens
cgcctgcctcagcctcccaaagtgctgggattacagacatgagccatcacgcctgacagacagctaggttttctaatgcggatgataagggcatgaaagaggaatcaggcatgagcccaaggtttttgatcttagcagctgtaaccatggacgctgcatcagctgacatgaagttggtattgacataatattgactgtggatatcaagagtgttgttttggccatatgaagagtcagtgaccaataaatggtggcattaaatggataactagacatacaggatggggtatctgggagggtgttgatactggagacatccaatatttgaaagctaatgggtgaacttcagtaagttagttatgggtccatttaggaggacatgcttcagattttggtggtaaatcttttcaggggccaggaaggtgtgactacaggctgaggagtggatctcttacttacgtccctgagtgatgttattgggcttcctaaacacctgagagggtgtgagtgaacatcatggcaggatgtatcagacagtagagtttggaaggggacatagacatccgaggagagaatagatgagatagatgcatgcagaagcataggagtaaggaagatgacacttctgcctgagttggtgccaagt

SEQ ID NO: 196159 - DNA, 436 bp, Homo sapiens
catttagttaatctgagccagcattgatcagtttaaaactaatcaatatgattaatcagcaagctggagacagttctctttgaggtgctattgggaatacacaagtataaaaaatggtccctgccctcaagctagagataaaagatataaaccctatcaaccaaatggcaataaaagattgcaattgttcaaaacggaaagacaaggttggttcagggaatgcctgacacgcccttaaactcacagaaaactcaagaggaatccatgaagatctattttttcaaagacaattaggacaaccaaaacagaatggtgtctagggtgaaaggcagtattcaaaattaaccgcagaggtgtgcaggagcgccattagagactgggtggaggaatacattcgaacacggtggcaaatgttatgaaacaaatataaactgga

SEQ ID NO: 196160 - DNA, 594 bp, Homo sapiens
ctttcttagaagcccttagcagttgttcatgagctttgattttttaaaaactcctttggccttgcttttgatgccttgatgtgtttttttcatcacctttggttatatcagtaagcattgaagcaccctctctgctggtacttggtgtcttagcctgaagctccctttgacgttccctggaggtggaaagcactctttttattttgatgtcaccattttgtttttgctttgatggcatttgggcctggaatatagaccctctattggcaccggtagcctttatatgcctacgaggctcaaagccctgcctgtgcccaccgggcctgtctcataccaggaggctatttctctgtctgtcctggggaagccacagaaccagtgcaaaggagttgaggggtagtttttttattgttgctgttgttgggtgcccttctcaatcattgcctttctagatagccatctggatcaccttttcttcctaaaatgtgaaaaggcccacacccctatgcattttattgttcccaagtattatatgtttgtgtacatatatacatatgtatatatacacatatatatatgttttttttttaacca

SEQ ID NO: 196161 - DNA, 650 bp, Homo sapiens
taaggcagagacgaggaagttatgtactagggcagcagcactgaggatgaacggcagtgacaagttcagagaaacataccagaggagttctatctccagcaagggtggattgggtgactgaaactcactcttcttgcggaggacagctaggaaatatggacaaactactttttagaacacctgttgaaggcatcataaagctagcaggagagtgaagaatcattaggccgggatccaggggaaaatagaggccctggaggtgagcctgacatttggaacagctcctcccctaggggacatttgctgaatctggaggaagtggccaagaagctgaacagcactagaaagacatgagctagaggtcagggcctgccaggatgtgggggtctgtctggtgaatccccctcacttagaggtgagaccatgaaggacagcactctaagggtaaaagtggaccaaaagcagacagttcaccttcaaatcatcccaatactggaaattgaatttaagttaccccagattgctcatgcccagattgcaggtgcctatcagaagcaaacatgaatcctctctttaggaagataacatcagcagatgccacaaattatttctacaaactattttgcaaatgccgtgtctggcatacaata

SEQ ID NO: 196162 - DNA, 504 bp, Homo sapiens
cacttgggttgattccacctctttgctattgtgaatagtagcatgcatctctttggaataaggccagtctcctacataaccacataccattgtcacatctaaagaaatttgtaataattccatgatattatccagtattgactctatattcaaatgtccccagttatcatgaaatgtttgttatatttgtttcctcactaggccttaacctaggttcacacattactgttgcttgtatgtctttttaggctgttttatcatagaactgtatttccattcttcccatatgcctgtccccaaagatactgactgttttataagagtccagtgaccgggcgcagtggctcatgcctgtagtcccagtactttgggaggccaaggtgggcggatcacaaggtcttgaactcctgagctcaggcaatccacctgcctcggcctcccagagtgctaggttcacatgcgtgagccaccgtgcctggcctgagacaacacatattataacct

SEQ ID NO: 196163 - DNA, 578 bp, Homo sapiens
ccacctcagcctccagagtatttgggattacaggcacctgccatcatgcctggataatttttgtacttttgtagagacagggtctcgctctgttacttaggccggagtgcagtggtacaatcttggctcactgcaaccccaacctcctgggctcaagtgatcctcccatttcagcttcctgagtagctaggactacagatgcacaccaccacgcctggctaatttttgtagagacagcctcttgctatgtttcttagacttgtctcgaattcctgggctcaaatgatccaccagcctcagcctcccaaagtgctgggattgcaggcatgagccactgcgcctggtctaaaaacacccttttcattcagcactataggttttaaaaggcagtgttcccataagaaataatggcaaagaaaggaactcccagtcacattcagcaaacctgttttcccagctacattcatgcactggttgatgcaggtaagtgtacaggggaggttgatggagagataggagggtcctggaaacaaaggaagactgtgacattagatgactgcaatcgtggagactcagat

SEQ ID NO: 196164 - DNA, 252 bp, Homo sapiens
tcggcagggaacaaaagagggtgagatgcctagacagcccccacacacaaaagactgcaaacaatggggagggtgtactgctttcatgcctggccactgacactgttctctacagctaacaagcaaggcagggccggacccagcttagcaccggctcccgaagttccaaaaagtagctgtgtatctaactgcatgggcattttttgaaaaaaagcccatgcaagttcgggactaaccagccatgcaagtcgg

SEQ ID NO: 196165 - DNA, 704 bp, Homo sapiens
agggcttaaaacagtgtctggcacataacagctatgtaaccctttgttgctactattactggtagaagattcccagtaagaatttggagatatgccttatgttgttccgaagattaacctgaagacaaactaattaaattaagtgtattgtatataattaccaagaaaacaaagaaactgggtgaaagctttgggacagactcaccatgggcttggtaaggagcctgccatcccacagccagcgaaggaggttcagttacttcagtcaggtgctgccctcagactctctaactccctggctatgtaggtgctatgtcatgtctttttctcacaaagagatatggaaacttacgtgtgaataatttggttgtgaagagtttactgaagtaaatttatcattttttttttaacttgagacagggtcttgctatgttgcccaggctggtctcaaactcctggactcaagtgaccctcccgccttggcatcccaaagtgctgggattataggtatgagccaccacgctcagcctggaagtaaatttcatacggtttttccctcatggagacgttaagaaaaatctgaaagtaacagtttaggaagaacacggatagttgggatactaatgcaaatcttgttttcttcatttgcttctggtgtgattcattgctaaacatctttatttagtattaaattatactgattt

SEQ ID NO: 196166 - DNA, 246 bp, Homo sapiens
tggcttttacatatatttttatttctctaaggaaagtattttgtatgcttgacttctgaaatgccatatttatgcaaagcaagattggagttaatgggtccttgagctatatagtgcttcttgtactaaaattttgttagtacacgctcattgtagaaaaattaggaaatgcagagaaaaggggaaaaagaaagtcaccttgtatcttctcatttaagagttaatcactagttttcatagaaaaca

SEQ ID NO: 196167 - DNA, 1627 bp, Homo sapiens
taaagacacagtgcccctttttaatgagtctgattcaagatgaatgccagaccatgtttccttgtacagaggaatttgacctgcagagggaagaataaggcccagggtgtcaggactagcattaaggagcacctctgattttctggtggagtcgtgctaaagctggcccaaacccactcgggccgttgttcaccttttgcctcatctctgtgttcagtgacatcatgttggtggatgttgggggatgaacaccagtacaccactgtgtatgttgtgctctgggagccatagcttgggcacccattctagagcaaggatcagccaaccccagcctgagcctgtgcagcccattgcctgttcttgtaaataacgttttatccaaaggcagccatgccatgcccacgtatttacatgttgtctaaggctgctttgaccaaaaggccaaaagtgctcaatatctggctcttgaaggaaaaaatttgccagcctctcttctggagtttaccaggaatctggttctggacacatgaagatatcttgggttaaaaagagattaggggccaggcttatgtttgtaatcccagcactttgggaggctgaggcgggatcacttgagcccaggagtttttgtattttttatagagacagggtcccactcttatccaggcatagtggcatgcacctgtagtcccagctactggggaggctgaggtgggaggatcacttgatcccaggatttggaagctgcagtgtgccatgatcatgccattgcactccagactgagcgacagagtgagactctgtcttaaaaaatattattttaaaaaagagattagagtggttcaagttgtgaggaagcttcagcagctttcctatttccaagaaaaaaagcaatcaaataagggtgaggcccctttaccatatcctagttaaaattattgttatatcatagacatgcccgttgtcacgggacctgtgtcccaaatccaagatgtggtttctaaatggcccttctaggcatgtgccatttttctagcattgcaggaagtcagaagagcaggcttccccctccactgtgtttctgagccttccagagttcagctccatggaacctcttgggtagtgtgtgataagtttcctgtaaaggcagaagtggagtctggctggggctgaggctggggcaaggctaagggagccatctttacaaatggtttgcaggattcccaggtgcctgtccctgggtctccctcccaggagatggcctgaaaagctgtagctcttcccaggcccttactactcctgggactcccctgctccctctgctgtcctgctgcgagtctctgacctggcccaggctcttgctcagccatgtggttcctacctcctacctcatgccagcccagcctgtctgtggccctccctgcatgttgacgctcttctaacccccatcttggggagctggagctggagtggggcctggttagagcagcttgcctgagccgacgagggtccagcctggagcatcaggctctggaagccgagcttgtatgtaggttttcacactgtccgggagtcaagacacagtgggttatgaaatccatctagtaggtcaccagtcagcatttta

SEQ ID NO: 196168 - DNA, 416 bp, Homo sapiens
ctttctgttctttgtagcatttaatccttacaccagccttgtgaagtagatgttcttattaccttttacaggtgaatcaacccaggcttagagaagtgaagtattgtgcccaaggcgctaatatcagagatacaacctatacccaagtctgtgggacaccgaagtacgtgcctctaagacgtcaccaccttgccttttatgtggccttctctcaagaagaggacttagaggcttggggcgtccagtttctggaggcaggcagggcctcctgtggcctgatccattggctggagaggagtcagcaggggctggggtcatggcattgtcccagtgggaatggaaagtttgcctcctggaggcgccccctctgccccacgtctgattgcgggcagagtcttggacggggcagtggcaca

SEQ ID NO: 196169 - DNA, 473 bp, Homo sapiens
tatgaattcatcaagctaggagtaaacaagaaagaattccttcattgtgtggtggggtgaggagtcagcacactggaacaacttgtacatttaatgactccagattaatatttgcagattatatttcagtttggtatcattgaacaactgcttctattatatttcagtttagtatcattgaacaactgcttctatttgctgtttctgagttatttggctttcactgaatttcaagatctatctgggtgccatccaagtcacctagactttttgaaccttggttcccttatgaataatacccatctcccagggttggctgagaattaaacaaggtaatgtttgtgaaagtgaccagcacaggaactgccatgcatgaaatacttctgatgccttctcttcattccaattctataaatggcccttggctgttgatttcggtgctttcacatttcagctatggcaaaaggatattt

SEQ ID NO: 196170 - DNA, 608 bp, Homo sapiens
aggacttggatctcagacacttactgtttctataagagaggagctggatttgaacatgtaggccaaataaggagctgctgcccacccacacactggtcaggataaaaatctccacccagggccatgcacagtggctcacacctgtaatcctagcgctgggattacaggtgcttgccaccatgccaggctaattattttgtttgtttgtttgttgttgttgttagcagagacggggtttcactatgttggccaggctggtttcgaactcctgacctcaagtgatccgcctgcctcggcttcccaaagtgctaggattacaggtgtgagccaccatgcccagccctggctcttaatcctattttccaaaccactttctttctgtaattcttaagtgggctagttctccttcctcagaaaaattaatataaggctgttagcctgccactgacatctgaacatggatttatttagctaggttagattctgcagtggggggattaagtagcacactcctgatggtgactgtcttcatgaaaaaagaggcacagctatcagccagcagtaagaaggggagagaggctgtcggagatttgaggagagaggactgc

SEQ ID NO: 196171 - DNA, 650 bp, Homo sapiens
agtagtaggcctgtgtaaagaccagctatgactgaattcctcggctctgccaagttgtttattcctaatcttgtgatttcttgtttaacctcctaagttgtttttgtatactctttttatcactgcttctctctttttcacctcctctctctccttttcttcctgtgttaaaggagggtttatttcattccatttctagagccaagttatctttctgtctctccccgacacacaccataatgtcacttcttgcactggtctctaaggtgtccttagtgtttgttcttctgtgtctacacagaatgccctggtctcggagtgaatacagcccttcccatggctctactgccccactaactgtagttccatttccattgttctcatgcaaggtgaacttgaattcgtgggtgatttacgcccagtctttaattctactttctctgttctctttctagagtcccatagcctggttttcagtcctacccagaattcactgatgatttcccaattttcaaatcctgtggccgtttcctagtcatcaccttttttattgtttctgtggtatctgatactgttaacccttcagtggagcactctcttaatctttttccacctttctttctgtcatatagaaccctgctgatttcttt

SEQ ID NO: 196172 - DNA, 409 bp, Homo sapiens
aagaaaccaacatctgacccggcgcggtggctcgtacctgtaatcccagcactttggaaggccgaggtgggcagatcacttgaggctaggagtcaagagtagacagctgcaaggtctggcaatccataggtctggccaagaattaccacgaggcaagacaacatttggcaattacaagggcattccagtgaagtggagtgtcagattttgcaatagttctgcaaataaaatagatttttctggagcggctgggttcttggaaaaacacgcgttgatggcaaaaattaatctgggtcccacttttatagagatcacgcaagatataatctctgccagagtcaaataagaagtggtgatattaataaattttctgggccgggcgcagtggttcacacctgtaatcccagca

SEQ ID NO: 196173 - DNA, 235 bp, Homo sapiens
taatagttgactctgtgactagagagaggcgcttggcttttactccaagcaccaggagatgccacttgagcacttgtgaaggaacatgatctgacttggagctttaaaagctccccctgggccgggggcagtggctcacggctgtaatcccaatgctttgggcggctgaggcgggaggatcgcttgaggccaggagtttgaggccagcctgggcaacagtgagacccatctctta

SEQ ID NO: 196174 - DNA, 233 bp, Homo sapiens
tttatcagcagcgtgaaaattgactaatacaagtatgcattgagcaactagtatgttccaggcattgagccaggtgcttgagatacagtggtgaatgaaatagtcacagcatctgcctctagaactttcggactatggagaaagacaatcaaacaagtgattacataatacgtgaggagtgtttcgacagcgggtgtatcggagaacgcgtggactaaccagccatgcaagtt

SEQ ID NO: 196175 - DNA, 576 bp, Homo sapiens
ccatagtgattaaatcgaaagaacatctgatttacatttatcttttggccctgttgatcatcaagatgaaatgtttatggaatcaacatatacttattgacttttgactatgtttaagagctatgctaagtaattatatgtgaggttaagatgaagattttgattaatttattcagaatgtctttaaaacaatagagcaaatgtttgcccaaatgatttcagtcttgtaggtcatagaaattagtaaaggaaaaattcagaaagacattaagaaaagtcataagaggggccaggcgcagtggttcacaccggtaatcccagcactttgggagacccaggtgtgcggatcacgaggtcaggagatcgagaccatcttggctaacacggtgaaaccccgtctctactgaaaatacaaaaaattagctgggcgtggtggcatgcgcctatagccccagctactcaggaggctgaggcaggagaattgcttgaacccgggaggtggaggttgaagtgatcctagatcatgccactgcactccagcctgggcgacagagtgagactccgtctcaaaaaaaa

SEQ ID NO: 196176 - DNA, 772 bp, Homo sapiens
  misc_feature (108)..(108): n is a, c, g, or t
  misc_feature (129)..(129): n is a, c, g, or t
aaaggaatttggggggagccccccccccggcctttggaaatggggtcacagccccccccccatatgttaatgggcaccacagccttatgccggcctttgaaagttcangggtccttcttctgtactctntttttgagtgtgtaacacatttattttaagaaattagctcacacaatcatgggagttggcaagtctgaagtccacaggacaagccagttaggctggaggctcaggtaagaggtgacactaccgtcttaaagcctaaagcctggaaactcaggcagaattactaagttgcaaccttgaggcagaattccttcttcaggaaacttcggtgtttactcctcagaccttcaactgatcaggtgcggcccactcacattacctaggctcatctcctgtcctgaaagtcaactgtggttgttgacatgatctgaaaattacctttctagccaggtgcagtggctcacacctgtaatcccagcacttaggggggcagaggcgggaggattgcttgagcccatgagtttgagacctgcctgggcaatatagtgagaccccgttctcaacaaagaggaaaaaaagaaaaaagacaaaaaagtaaagaaatataaaatacttttctttctttctttctttcttttttgagacagagttttgctgttgttggccaagctagaatgcaatggtgcgatcttggctcattgcaacctcagcctcccaggttcaagcgattctcctgcctcaccctcccgagtagctgggattacag

SEQ ID NO: 196177 - DNA, 268 bp, Homo sapiens
agtagctgagattacaggcatgcactacgactgcccggctaatttttgtatttttagtagagacagggtttcaccatgttggccaggctggtcttgaactcctgacctcaaatgatcctcccacctcggcctcccaaagtgttgagattacaggcatgagccaccacgcctggccccgaatataaatgccataagcccagccttctcatacatgccaaagcacaggtcctcagagacctttttgggaagaggccaaaggaactcagag

SEQ ID NO: 196178 - DNA, 466 bp, Homo sapiens
atcgctcagagctccagcacccgggactgaggcagaagggctccgccaggaataacgttttttaaagcacaggattgctgtgtgtgtgtgtgtgtgtgtgtgtgtgagagagagagagagagagacagaggaaagaggaggaggaggagagattgattgattgatttttttcttttccttctcaacatgtcactttcctgcatgggaattcctgatattcctggcagcccggagagaggggagaggccccctggtgactttatgacccccgcaggagtaaccagagagcgcgcgcgagcgcccagcgcctggctcaagacgaagatttaaccgagaacaaaagaacgtttgccaatcagaaaacgctacccgagaacgaggataaccccgctttgtgttttgaaaactctttaattagcctggtttctaagacgcattaaaacattcctacgcagattctaaaaaa

SEQ ID NO: 196179 - DNA, 474 bp, Homo sapiens
tctatatctgtgggttctgcatctgtggattcaaccagtctcggcttgaaaatattcatacaaaaaaaggatagttgtgtctgtaataaacatgtacagacttttgtcttgtcattattccctaaccaatacaatataacaatcttttacataacatttacattgtattagatattataagtaatctagagataatttaaagtacaccggaagatgtccagaggttatgtgcaaatgtgatgccattttgtatcaggggcttgagcttctgtggattttggaatccatgagaaggtcttggaaccaatctctaacaggtactgagagacaactgtactctcctatcatcaacacagaagagaggtggcacagagaagaaatgcatgggcagaaaaattgcaaagcatagatgagtcatcttttagaaagtgattttgtgtagttatttggaagcataaataaaacataagtatt

SEQ ID NO: 196180 - DNA, 451 bp, Homo sapiens
attcctaggcaaataagggaggtatggtcaccttagctctgactctagaaaactgctagaagaatctgtatcagcaaagttacagtcccagagcaaactactgccagagattagaccttaagagttaccccagtcagtactattagatgtgactgctttatgaaactggccaagttttattcttattcatctgttttgcctgtgggaaatttttttaataacacctttttgaaatccatttcatacagcataaaattatctctgttaaaatatacaatttattgatttagaatattcacagaggtttacagtcatcaccactatctatttccagaacatttttatcactccaaaaaagaaacccattagatgtcattccctattctcccctcctctagcttctggcaactgctaatttattttctgtctgtatggatttgcctcttttgga

SEQ ID NO: 196181 - DNA, 587 bp, Homo sapiens
gaggcatcagggctgagggactctgagagcagcggacaggcgtgtgtggcgggggaggaacggcgcacacctgtgccccatccgcagcccctcttcttgtcaacatcagcttccccggggagaggcagtgatgttggtgggggaaggagggaagggcccaggccgggctgtggtggagacggttgctatggaggtttctctgggaaccaggtgaaggcagccagaagatgggggcagggtggctttcattatgagaactggaagcaaacacagccccttcctgcctcggcggacatctccacacccacatttcatggcatttctcacgcgctgggctgtttccagggcttcacctgttctcactcacttaactttcccccagcaatgtgacgaagcgaaactatcatggctcccatttataaatgagcaaactgagaaaggggagaggacttcagtcacctgcgtaaagtcccacaaccagtaagggctggcccaggtgtctggccccacagctgagctcctaaccgcaccgagcctctccaaaacatggtctttttttgctccccactgccaccaccatcaccgtc

SEQ ID NO: 196182 - DNA, 379 bp, Homo sapiens
gtctgtgtgtgtgttactggcacactgaatggggcctctgtgtgtaaatgcatttgcatctcagtgtgtgctttgtatatgagtgtctgtgcccttgtctaagatgctgtgtatgtgccacagtggattttgcccaatttttatatgacctaggaccccctagactttcttagattaaaactggatgtaggcagctttcagtttgggtatgtaggggggcaggatagggccagagctagggtagaaggtgagaggatgccttacatccctgcccctttctgcagatggcccaggcccttctctcctccggctgtggcctggccaggcccagagccctcttctgatctcataggcagggccaaacccgtatcttctggag

SEQ ID NO: 196183 - DNA, 512 bp, Homo sapiens
gctcagaacaaattatcactgtttcccttatgagatcctaatgaaagaaattcagttgatactactttttaaaatgggttttaagagtggcttgttgatataatagcgcatccacttgttctcaagtgattcaaaccttgagtaaaaaggagagtttctggagaatttagaagaatctttgttgacatttaatctagagaagtcttcaggagcaaaccacttcaagttcagtgtaaccaggtgccatgagtcagtcatgtgctacttgtggttttaaacgaaacatgattctgggatgagaagtgcgaggctacactcctaatataatcaaattgccaaagcactgttttgagtcctcggtatcccaattaaggagaaacatgaagacattggagaatcacttagcttagggcttttagtagggaataattaaacatgtagggaaggtgaaggagttagatgggaggtaagaaggctgaggagatttctagtaacaatgatccaaaagttct

SEQ ID NO: 196184 - DNA, 376 bp, Homo sapiens
acatacgtccctacagaagaagagaaagaaagcaggagtggttgctgccttccaagagtctatcctccgctacagaggcaccatgatcaaaccacccattaacttttatggctcctcactccttgtttctgtttcactgtgtttaactggctggtgtgggaagggttggggctataggcaccacatatgaaggagatagaatcttgattctggctgcctagtttttttcaggtgaactgtgagggaggagaaaaaatatttcagctaaagtcttattttagttgagtgatttatttttagtgaattataagattttacaaattttaggactccatttcatttacatttatactgataatttcattcatccatccac

SEQ ID NO: 196185 - DNA, 477 bp, Homo sapiens
agcctaatattgggagaagagctaatcattctcacgtgtttggagaggcacaagcaggcaaagatgagtaagaaaagcggtgctgagaaccacagtgtaggatgtttagacaaatgacccatatagacaggaacccaggcgagtccctcatgctcaaatggaaatatttttatcacccagctccttattttgtaaactactactaagccttttgtatggcagaaaaagggataactttattaggaccaacccctcaggttcttaagatactctggctgcttaggaccttatcaatccatttaaaggtttctgaggaaatcatatatgccaacaattagtctgtaatgcccttagacccaaacgcagctagaaagtcaaagaaataagtggttacagctaccagcttgccttttatattggaattgctttgtaggctttttagcagttgctggattaaaaaaaaaaaattacctaact

SEQ ID NO: 196186 - DNA, 405 bp, Homo sapiens
cataaatagattcataccattaccctgcagcacctttagatgtgacaaaacaattggaatttgctttattttcttgcttctggcagctagaaatatttatatttctgttatgaatggcttgctattggccacctacctgcatttctttatatatttctttagaacttaaggttaaggtccatgggagaaacttgctagagatgaggctagaaaggtaggtgttgccagattgtgagtgttattgccaaattgtttgaatttatcctcctaatagaataagccataaagtgtgttattttagtagagaagttgcagtatcagaaaagttatttttatcaagataactgatgagtatgaagggtgaattgaagaaaagatagactaaaggtaggacggtgaattttt

SEQ ID NO: 196187 - DNA, 495 bp, Homo sapiens
gcaaaaaacacaatgagaaatgcacatagagcttagcgctacttggggcattacagagaacctgccattgacatgtatggtctgcacgtgtgccattctattaccctttgtaggcgtgcttgcatcggggaatctgggtgtgtgaagacaagatatattgcagctgaaaaaggctgggagggtctttattcacttagggatgctgaataaactgtgttgtgtgcctgtgttttgactgtgactcatcacataaggtcaggtgtggaattttccacttgtgtgtggcatcatgttggtgctcaaaaagctttatattttgaagcttttggggttagaaatactcgacctatactatttcttcataatcacttgtgggatgtttacttgacatagattgagtggaggaaggttaatgagaccttgaaataattgtttctttttcttttctttcttctccatcccctaaatggtacattaaagtatacttttctcctg

SEQ ID NO: 196188 - DNA, 440 bp, Homo sapiens
ctaatttctattcagctggtcagagacacaggtgaaacaacctggggcttgctattggtatcagaagtgaggcgactgagccctcaacctgtgggatctgatgctaccaagtagatagtgtcagaattgagttggaggtcacctacctggtgtctactgtataattgattgcttgcttgttggtggggagaaatccccacatatttggtcacagaagtcttctgtgttaattgagtgcgagaatctgaatctgagtttttttcacttatctatagattcattcattcaacaaatatgtgttgtggaccctcctatgtggcaggcactgtttggtaggataggggacagccataaacgaaacaaaatcgctgcctcggcctcccaaagtgctaggattacaggtgtgagccactatgcccggcccgcaagatcttatctct

SEQ ID NO: 196189 - DNA, 594 bp, Homo sapiens
tgtgatgtggtgataatgactctaagtagtgaacgccaaagattttatattctgcctgcaaatcatgatgggttctaatgacacagcatataaaagttctcaagtattgctttgccacctccactgctcattaacttaacttggtaggagtttcttgatggaagacaatcaaacatttttatgaatgagtcacaaatactatcacactgattctttggcaaatataattcttattgttttataagaaaacagtcatcacctgcaatagactgatgtttgtgctctcctcacccccaaccaaatttatatgttgaaatgttgaaattctaacccctagtgtgtatcaggagatgggacctttggaaggaattaaggtcatgagggtggagccttcatgaatgggattaatgtccttacaaaaggggaccccagagagctctctggccctccttctgctatgcaagaatacagcaagaagatggctgtgtctgaaccaggaagtggaccctcagacaccgactttgctagagccttgctcttagactccccatcctccagaactatgagaaataaatctgttgttgaagccactca

SEQ ID NO: 196190 - DNA, 562 bp, Homo sapiens
tagagaagcagcgatgtctcccctccgggtttcccatgatgttacgttgccctctttgttaccacccctggtgcggtggacacagacattgcccaaacactaacggagagggaagaggtgcggggagctcagggcgttcggggtggtgttctggtggaggggacgctggtaaagagcaggtctggctcagtgcttatttcagggaaaactcttgtgatgaatgggccatccgggataaacagatgggacggagagtgcaatttacataacaattaagctagtttagtacatccggcaatgctgctgaaagcaggcctctccctgggcgggctttccgtgttattaatctactttatgacccagtttccccaaatggataatttcgccttggtagtgttaagatgtatttagcgactcaagtatctgcagcagcgagagggtgggtgtgggagtcggtgaattgtctcttacgccttcctttccgggttttcctggagaaggctgcctcactgggtctttgcagttggcgtgttccccggtgccattcgtatctgattcatgc

SEQ ID NO: 196191 - DNA, 478 bp, Homo sapiens
ttctatcccaaagtatcaattttattctctaagctcctgatttttcttcctaaagccctagggttctttttaagctcctcatacttctccactgactccgtttcctatctaaagttattgattgacatatatctacactctgcttgatttcctgacatcaataacacaggggagtcatgcagtccacaacatttcctaaagcatttcagaaaatcttagctctcttgtttctctatagactagaccaacaaggtgaactgtatgaaggaaaacaaaatgtcaagtcttgaaaacctaataaacaaaaaggtaataaaagcaatcacacataggtccttgagtttagaaagtcctttccagaatctcaagtgccatcttcattgttgcaaacaagcaaggcttaacaaccaaattatcttaattgctaaaaccaaaccaaacaggctgggcacagtggctcatgcctgtaatctcagca

SEQ ID NO: 196192 - DNA, 334 bp, Homo sapiens
acctggcatggtgccacatcactgtatttaaatccctcctttgaggctcccaaggccgtctaatgtcccacatctttaacaaactactggacaggtgtccccttctatagccactgccagccagcagactcaataaatatatgttaataatagccaggactagctacatagtttgcagagcccttgttcaaaaactattaagaatttcaaggctgcgtgcagtggctcatgcctgtaatcccaacactttaggaggcaaaggcgggaggatctcttcaggccaggaactcgagaccagcctgggcaacatagtgagaccctgtctctaaaaaat

SEQ ID NO: 196193 - DNA, 747 bp, Homo sapiens
tattgatttcaagctttgtactcgtaaggggtgggagggtcacaatatttgttcaattttcagcattaagaagtcctaaacattaaaccaaaatggatccttcatgatttgactgatgtttatgttaacaatgagctatcagattccattatccaacaaagtaaatatctatggaaataatatagaagtttaggctgaactcaagaaataataagatatgacctggatttcctttcatttattatattgcttttattattattttagagatgaggtctcactatgttacccaggctggtcttgaactcctgagctccagtgatacttctgcctcccaaagtgctgggattatggatttcctttgaaaataattttcctagtacaatgtgttctcacaaaatttgaatattctaaaacttaagtacagaggaaaagttttctgaaattacgtatctcaagagtcaaagcttgaaatcactttgttttctaggccttcttcaataaagaatttcggatgaagtacatgttattctgtatgacagtctgttgtttccaagagaataataacaagctgtccttgaaaagaatggctggtgatggaattagctctagagaatttaaggtagtatttgccaagaaagaaggtcagtctgatattgtgtcaaacatatcctttattaacctgaataagtaaatatatgaataagtaaatatacctaataaattacgagtgcttggtgagttacc

SEQ ID NO: 196194 - DNA, 478 bp, Homo sapiens
caggaaggaactgttgcaagccctggaggcccgtccataaccgtggatgagtcttctacacatgtggcctggccctgtccaaatgggctctgaaggaggggaagggccctcgtaggcccccggcatattcgcacctcccacccagtcccctgggcagcgcctcgccctgggtccacgtcggtccctttccctctccagagtcctgggcaagcctctttcctcttcctctgaaactccgacttcttccggagggcttcgctcgttccgagggtcctgcgactggaggaggcacatccctgagcagccactccctccccgcagcggcctgtcgccgagctcccgcgccctgcttgagctcgggagagatcgctgcggggcagtccggcccgggagcgagagaaagaacgaaaatgcacagctctctccgagtaaggcgaacagatggagaggaagacgaacaattaaacgaaacaaacag

SEQ ID NO: 196195 - DNA, 225 bp, Homo sapiens
agacccagccattgccagagaagccctacttcctcatcaaccaccagcaggcagcagcttcatgctgtagttctttttttcctttaatagaataaagattgtggccacactttaataattgccagaaatatgtgttcattaagctttttaagaaatgtgatcgaaaaatgctgatgatacattgtgtttaatagctttaataaaaaactgataaagcatctaata

SEQ ID NO: 196196 - DNA, 282 bp, Homo sapiens
cgttcctgcagctccttcgtaacgcgtctgctcaagcccctcacgccgaattcatcgggccatttgttttcttatctctgatttgtaggagttctcaggcctgctgatcattatatattcccccagaaagatgagcagagattgctggatacactgaagtcgccaataagccatcagaactggtgaggctttcagaagccagccacggcgtcagacatcaatcaaaactgacacagcttggaaaaatgccagtccttaagaacactgtgatatttttctttt

SEQ ID NO: 196197 - DNA, 648 bp, Homo sapiens
aaactgctgcccccaaaattggagcgacagacaggtgagtgcagagaatcacaacttacaggagcagaaggaacccatgagcagaaacctttatgggaaccaatgcccaggcaagggaaaactgaattgtaattgacaaattgctggaggctgtgtggacaagtgtgagacattaaaaactcccaggggacccagtcattaggggggctcccacacttttgtaagttttacttcctgaagctctaccaagttcttacggtgaatattgaagaaaaatcccctcatggttctggcaagagcagggaaaaaggaacaattctgatgtatgccaggcctgtccttgggagaaactaggtgactagagcctaacctgctgggattatcagagagaggctaactgatcttgggggaaggaaactccatctgcctctagccatgctgtcccacctaaggagggcaagaaaaaaacagcaacaacttagaagcatttgtgaaattaacagtccagggcaaaggctcactaaaagacggagacctctttgtaggactatagaatgcttcccctcttcccacatcttaccaccacatcactaaaagcctacttacagcagtttcttttacccagtacattatttccagctatcaaga

SEQ ID NO: 196198 - DNA, 538 bp, Homo sapiens
caatgaggcaggagaatcagttgagtccaggatgtcaaggctgcagtgagctatgattgtaccatcacactccaacctgggtgacaaagtgagtctctgtcttaaaaaataagtaaataaacaaataaataaataaataaacaaataaaattaagcagtgtaattcaccactcacaaactaaaaaaagggaaaatgtgattgtctctatagattttttttcttatctcaatagatttttttaaaaagtgtttggtaggccgggcacggtggcttatgcctgtaatcccagcactttgggagcccaaggtgggtcgatcacctgaggtcaggagttcaagaccagtctggctaacatggtgaaaccccatctctactaaaaatataaaattagccgggcatggtggtacacgcctgcaatccctgctactcgggaggctgaggcaggagaattgcttcaccccaggaggcagaggttgcggtgaaccgagatcacgccactgcactccagcctgagtgacagagcaagactccatctca

SEQ ID NO: 196199 - DNA, 363 bp, Homo sapiens
atttttaatcgaaccattagactgttggagagttagatagtctggttaagataaaagaatctctcaaccaatacactgcctctttatgcactattctgtaattttaaggcagagaaatataaagacccaaatagtctaatttgagtctgatttgatgatgcaacataataagggtgttgaatatgtagatttctttaggtgacacagacctgattctaccacttggtagtttgttatgacatggacaaactgatcttttgggcagtcatgtcttcatatgtaaaacaagaataattaaaaaataaaaaataaataaaacagggataatagagtgaaacttttccaatggtgacaatgggataa

SEQ ID NO: 196200 - DNA, 336 bp, Homo sapiens
tgcctgtcatcccagctactcaggaggctgagcccaagagatcaaggttgcagtgagttgtgattaccccaatgcactccagcctgggtgccagagtaagaccgcctcaaaaaaaaaaaaaaaaaaaaaagcagagaatagaagtgggagtctaaaacatacaggagaaaaacagttctaacagagacagcactgtaggaatttcctgaactcctgcaatttgccatggcataatttccctaaggaaaaaaaaatctagaactgtttggtgatcacatgcatggcagaattagtagaacaaagcctgaagcttctacaagtgcatcaaagaaagaa

SEQ ID NO: 196201 - DNA, 435 bp, Homo sapiens
aagaattattccagagagtagtcataaccaaccgttccttctagtatcagatttcttatagtgaagaataacttatgtataaaatatgctgccttttttgtaggaaaatatcactagtctttgcagtagcaaggtgagttattgttaagccacttcttttggagggaaaacaactggagatgatatgtatacatatttttaaaacagggaaaaacatttttgtaggactttgttcttgcataccataaaatgcattctttgttgaaaaatgaaatatttaattacatgtataatatttcctattaaaaaaataaatactacttaaatacagttcagttgttttgaatagtttctgtatttatgtaaaaatcatcttctaacaaatacaacaaaacatttcacatcttaaaataaaatgtccaaatccaagacatg

SEQ ID NO: 196202 - DNA, 508 bp, Homo sapiens
ccacttgcctcagcctcccaaagtgttgcgattacaggtatgagccatcgtgcccggaccttttaaaaaatgtagacaagaggcccacagggagatcttccagcacagcttgatctggtgacccagatgatgtctccatgactgttctctctcttcttctcttgactgcttcgtctgggttggctccaccctcaaatgagccctcattttgtggcaccagcctatgtcctataaggctcaagtgtagcagagagagagagagagagagagtctctcccagagtttctctctaattgagccaactcgggtcaattgtctgagtaatttgggctgggcatagtgtctcatgcctgtaatcccagacatttcgagatgccaaggcagaagaattgcttgaacccaggagaccagcctgggcaacatagcaaaacccctatctctacaaaaaaaaaaaaaaatttttgaaaattacctgagcattacaggtggcatgtgcctgtagtcctag

SEQ ID NO: 196203 - DNA, 249 bp, Homo sapiens
agcaatttacctacagaaataaagagaggaaccacattactgggacaaatacagtcactgcaaatatcagaagaatactagaacatattaatatattaatttttacccccaaaaaactgaaaatatttttagacagcaaaaatagcttcattatgcttttgattgcataatatatctctggaaagatgaaaaagaatcaggtaacacctatttcctccaggaaagaaaatgtggtggccagagaaaaga

SEQ ID NO: 196204 - DNA, 644 bp, Homo sapiens
ccatcacgcccggctaatttttgtatttcttttagtagagaccgggtttcatcatgttggccaggttggtcttgaactcctgacttcaggtaatccgccctccttggtctcccaaagtgctgggatacaggcatgagccactgcacccagctgtgacttttttttttttaagctcatcagctattgtattagtgtattttatgtgtagctcaagacaattcttccagtgtggaccaggaaagccaaaagattggacacccctgccctagagcatctgacgcctggatacaaaagagcctgtggctatgactatcaggattctggccatgaggaattccatgacatggagggaaaatggcaacttcaaatttgcacccccaggtatcatgtgggcaggtgctccatgtggctggtgatagttgtgagtgagccttgcacgggctttccccctatcggctgttccagagcgagaggctgcaggtgtccacttacgtacctgtggctaagatgcgcctgagcaagtgagggccagttagtatacataatttttacaaaatttggatcatattacataaatatcttgcttcatgcacttaatatgaaattttgcccatgatttattttttaccttatttttaagggcc

SEQ ID NO: 196205 - DNA, 160 bp, Homo sapiens
tgctgggattacaggtgtgagccaccacgcctcgtctaagtgaaatggagcatttctaagtaaaatgaaaaaccactttgtacagcagagacatagtataacgtgtattaaaagttcatcctaaaacaaaaagttcatcatagctgctgtgtagagaata

SEQ ID NO: 196206 - DNA, 688 bp, Homo sapiens
tgacaattctagcatccctaaacacttgtctttctctcactttccgcctaaccagcagcatcattagttattttacatctttttattgaagctgtcatggactgccagatgccttcctttttggcaagtagaaagaacactgcactctaaaggatttaattcactttctcctcccgagtctcctgatgaagctttaggcaaattgcctaacttatctttccttattcactttcattttttaaaagttattttgaaaaaatacattctgggccgggcatggtggctcatgcctgtaatcccagcactttgggaggctgaggcaggtggatcataaggtcaggagttcgagaccagcctggccaacgtagtgaaaccccgtctttgctaaaaatagaaaaattagcctggcgtcatggcatgcgcttgtaatcccagctacttgggaggctgaggcaggacaatcgcttgaacctgggaggcgcaggttatagtgagctgagattgtgccattgcactcgagcctgggcaacaagagcgaaactccatctttaaaaaaaaaaaaaaaaaagatacattctggctcttataaaattatgaaggtaagctaatttagtacttccagcactattagaaagttcattttcttggaataccatgctgacacccaaatccacgtgttgatctccag

SEQ ID NO: 196207 - DNA, 3048 bp, Homo sapiens
  misc_feature (347)..(347): n is a, c, g, or t
taaaagttcggaaaatttgcagcctgacaatgtgatagaaaagaaaaattcccattttctgaggagaaattcaagctggctgcagaaatttgcatgagtaacaggagccaaatgctaattcccaagacaatggggaaaatgtctccagggcatgtcagaggtctttatggcaacccctcccatcacaggtccagagatatcaggaaaaaatggttttgttggccaggcccggggtcctcatgctgtgtgcagcctagggacttggtgccctgcatcccagccactcccaaccatgactgacaggaggcaaggtagagcttgggctgtagcttcggggagtgcaagcnccaagccttgacagcttccatgtggtgttgagactgcgagtgcacagaagtcaagaactggggtttggaaaccttcgcctagattaaagaggatgtgcggaaatgcctggatggccaggcagaagtttgctgcaggggcagggccctcatggagatcctctgccagggcagtgcagaagggaaatgtggggtcagagaccccacacacagtccctactggggcaccacctagtggagctgtgagaagaggtcctccagaccccagaatggtagatccaccgacagcttgcaccgtgtacctggaaaagttgcagacactcaatgccagcccatgaaagcagctgagagggaggctgtaccctgcaaaggtacaggggcagagctgcccaagaccatgggaacccaccccttccatctgcatgacctggatgtgagatgtggagtcaagaggagatcattttggagctttaagatttgactgccccactggattttggactctcatgggcctgtagcctctttgttttgaccaatttatcccatttggaatggctgtatttacccaatgcctgtacccccattgtatctaggaagtaattaacttgctttggattttataggctcatagatggaaaggacttgccttgtctcagatgagacattagactgtggacttttgagttaatgctgaaatcatttaagactttgagggactgttgggatggtgtgattggttttgaaatgtgaggacatgaaatttgggaggggccatgggtggaatgatagggtttggttgtgtccccacccaaatctcatcctgaattcccatgcgttgtgggagggacccagtgggaggtaactgaatcatggggacaggtcttacccgtgctgttctcgtgatagtgataagtctaacaggatctgatggctctataagggggagtttctctgcacaagctgtctttgtctttgcctgccatccacgtaagacgtgacttgctcctcattgcctttcgccatgattgtgaggcctccccagccatgtggaactgtaagtccattaaacctctctttcttttgtaaattgcctagtctggggtttgtgaacagactaatacaatggcttttcaccttgcagaataaaatcctacgagatcctcatgctctagctcctggccaggccacctcctcaggagttagatcacttatccgtctctccctggcccacccttctctgtcacatggcttctttgctgaccgtgatacacaccacacttgtcttctctacctggaagttgtattccccatacccacatggctcacttcttcacttcattcaagtctctgctcagatattaacctcttcagagagcccttccttcacacactgtcttgcatagcagcctctcctacaagttgtcttctttctccttaacttttgtgatggttaattttaggtgtcagcttgactggattaaagaatacctagagaactggaaaggcattatttgttagtgtgtctgtgagggtatttccagaagagattgatatatgactgaatgggctaagagggaaccatccgccctcaacgtgcagttggcttggaacaaaaacggaagaaaggcaaattggtcttactctcttggagctggaatacacgcttccattcctgcccttggatttcaggatcccaggctgttgggtctcaggacgccaggacctacatcagcctttccgtcaccgctggggttctaaggcctttgggctaagaattatatcatcagctttcctgattctgagactttgggacttggactgagccatgctaccagtatccctgggtctccagcttgcagacaatctgttgtgggacttctcagcctctgtaatcatgtgagccctttctaactcataaaccctctcttatatatctatgtatcgattggctgtgtctctctggggaaccctgactacgtatacttttgtttgaattcaaagtatttatccctacctgatattacatcctatatctgtttgttttctgttttttccattagaatacaagtttcatggggacagggactttatgcatttgtttactgctgtatcttaggctcaaagttggcactcaataaatattggttaaataagtgaattacaagcaggttggattattaggtaatatggttcgcagtgtgggactcctgaactccaagatgtctttgaaagtagccatttttttttaatttctaatggtttagtcagactacggattacttaataacagggactatagttcattcatggatatatccccagaatcaggaacagtttctagaatacgcttgagtgctcaatagacatagctattatagttaattgaaatggaattggcaatgtgggaaataagaaatcacatttttggccaggcacagtggctcacacctgtaatcccagcactttggaaggccgaggcaggaggatcacttgaggtcaggagttcgggaccatcctggccaacatggtgaaaccccatttctactaaaaatacaaaaagtagctaggtgtggtggcgtgtgcctgtgatcccagctacacgggaggcagaggtgggagaatcgcttgaacatggtagaggttgcagtgagccaaaatcataacactgcactccaggttgggcaacagagcaagactccatctc

SEQ ID NO: 196208 - DNA, 492 bp, Homo sapiens
ctggattcatacagaaaatatgatatacatatgcaatgggatattattcaaccatcaaaaagaatgaaattctgccatctgtgacaacatggatgaaccttgagggcattatgctaggcgaaataagtcagaaagagaaatgcaaatactatatgatctcatttctatgtggaattttaaaagtcaaacccatggaacatagaatagaatggtgattaccagagcctgcagggtgaggacatttgagagatgttgatcgaggaaacaaacgttccgttgtaagatgaataacccctggaaatctaatgtgcaagaataattttgctttccaagattatacaaaatatttcttgtatttcattaaaaattcatagtttttaactcttgttgcaactactttatttttttccggatttattgatgtacaattgacagataatattgtacacatttaagatgaacactatgatgcttagatatatgtatatattg

SEQ ID NO: 196209 - DNA, 421 bp, Homo sapiens
tgtctggagctctctgcagagtgcccatgactggctctatcttcttgatgggacctggggttcctggagccatgtcttgactgctcccgagcagatccataatggtttctggaagccgactcagaccgcctctcagagtcttctgagtgtccctcactgtccctgtcctgactaacactggatccctggcgcctgcttgtcttggaccccgctgattctccctggcccacctgtgagtgtctagagctgccggcccgagtggaaggttcatggtgacgtgaccctgagtgcctggagccgtctcctgattgttcctcatttcttgtttgcctgcttgcacttctgggtcctgactgcccatgggaggcatcagaccttccctggggtgtggtgtggctgtgatggtaccctgagtgtccag

SEQ ID NO: 196210 - DNA, 744 bp, Homo sapiens
gcaaaagatccacagagaggataagccctaaaatatgactatagaatttgtccagactaccactaccctacacaagctcaagctcagcagagaatatcagggagttaggctaaaaaggagaagctagaaaccaagaaactgagcagaaacattagctgctgcaggtatgacagatttcacagtttaagtaaattaactgcttactagtgccaaaaaaattaacaattctcagaaaaacaaaacagattccaaagtcactacaacatattaccttcaaccaaaacttgctagacatgtaaagaaacaagacgatgtgaccaatgttcaagataaaaagcagccaatagatactaactccaagtggatccagattacacatttaacaaagacttgaaagtaaccattacaaatatattcaaaaaagtgaaggaaagcatgatacaagtgaaaagagaatcccaacaaagaaatggaaacttttaaaaaacaacaaaatagaaatccaaagactgaaaactacagtaacggaaataaaaattttactaggtgggcttaacaggagtttgagtgcagcctgagagcaacgtaacaagaccccatcttgaaaacccaatttttttaaatcaattgtctttctataagctagcaacggacatatgaacatcaaatgtttaaatacactacttacaatcactcacaaaatgaaatacatagaagtctaacaaaacatgtatataggacttg

SEQ ID NO: 196211 - DNA, 556 bp, Homo sapiens
cgcctgcgactagccggctctgacttggaaacacctgcgggaaaaagttcagtcaatgcactggtatatacaattggagcaatgacctctctcacccaccctgtctatccacccccttgaacttctaggctagattctagtgtatcaaaatgaacaaaacagggttctgcataaggtctcagttggggtgggggatcaggcaaataagcaaatgatgccaatagcatgtgtggaaagggctgtgagagaagcaagcatgggacactctggaaccacaaacacagtggtcataacccatttaaaatgttcttacacagctgaggagaatgtaaattagtacaacctctatggaaaatgaactagaaaaactcaaaatagaactacttatcaaagaactcaaaatagaactaccattcgatccagcaatcccatgactgcatatacgcccaaaggaaaacaaatcattgtatcaaaaagatacctgcactgctatgtttatcatggcactactcccaatatccaagatacagaatcaacctaagtgtccatcaatgaa

SEQ ID NO: 196212 - DNA, 227 bp, Homo sapiens
  misc_feature (25)..(25): n is a, c, g, or t
tcttagaggatccccacactgtatncatgagtaccatgagatcttatgtgctgagagctaaggagagctttaaggatgatgtagttcatacccccactttgcagatgggaaagtttagacaggctgagcaacctgaccaatgcgactgagttagtcaagtattaaagcttggaatataattcaggtctcttgatgccgacaatttaaaaaacagccaatgatctcat

SEQ ID NO: 196213 - DNA, 412 bp, Homo sapiens
gttttcactgcctgcatccatactcgttacttccttcactttaagtgaagatattttctcgtctctctaaaatgagcctctctgggtatgttcttaagattaatcctgtcacctcacaactatctaagaatctattattattatgaatacagacagtattaataattagtaattaataattactaatactgacagtattattactaatacagacagtaatctattactgtctgtatcttcaacttctctactgattctttttttctcaagcaagacatgctcacctcttattcatcttgaaaaaaactctctcttgctacaatgcactgtttttatcctaaaatctcctctcatcccttcccctttaaaaccaaacaatgtgtacctcatcattcaaaatttctcactcttg

SEQ ID NO: 196214 - DNA, 485 bp, Homo sapiens
tatttgacaatagtgccaaaccattcaaagtgaaaccacttcctctggggcaatacctgtagttagttgtctcgcgccgatgattaacaacatggacacacacgtggagtgggttaaggagcagaaagtttaacagacaaaaaggaagagagatagaataagcttcctcatgctgagaaagcgggtcacctgagagagggtttctgggttaggtgcagaacgtgatcaattttgtacaaaggcttgaggaggcggtgattgatttacatagagcccaggggattggtttgaccaggtgctccatttacacagtccatgaaaagactggccctccaaccctaatcttttattatgcaattatggcttctatctgactgtcaccatgacacctgcacatgtgactttacctggctagtgccatgacacccgcacacgtggccacaaagaaaagggagcgagaatcgccatattgaatgtacctggct

SEQ ID NO: 196215 - DNA, 293 bp, Homo sapiens
aaacctgaaatgaaatggcagctttgagggtttctcagacacaccagctactactggacaccaaacttttctttgattgcttaacttctacatgccctacttaaggctcaagtgaggctcttacctcaggctccccagtagctgggactgtaggaatgtgccactgtgcccagctaattttttttttttttgagagtctcgctctgtcacccaggctggagtgcagtggtgcagtcttggctcaccgcaagctccacctccctggttcatgccattcttctgccgcagcctcc

SEQ ID NO: 196216 - DNA, 177 bp, Homo sapiens
atctcaggaagcaaaacaaggacaaaagtatgaagccgtagagaaaagaaattttattctagcagatctgccaaagaacagaaaccattctaataatttcatagatctatcaaaagacaaaacaggaatgtaacctctccttaagtgaatccaccaaaccatatggagattgaagac

SEQ ID NO: 196217 - DNA, 520 bp, Homo sapiens
attatggctttatctgtaacttcaagctaaattgatatagaacatagatctataagttatatagaatataattctagctgatataagaagtttctttaataaagtgatatttaaggtaagagtataagggtaaatagagaaaaatgtaagacttacatgcatattttagaaatcaaggtttattgagaaaaaagggacaaagtaaatgactcaagaatcaaaacaagaatttttaaaaataaggaaaataagaggaatgaattaaaaatataaaagcaaaaattgattaaatagaataaaaccacataatatttgaccaattaaacaaaaagtgatttctttgaaaaagccaaggatattttaggttctatatataattgatgtaggagacatgcacctttcatttggctccctctaaaaatgcactaagaaaacatgaacatatattttcagaaacataaacttaataaggatgaagagaataatgtagaagacaacagggaaaactcttagaagctgg

SEQ ID NO: 196218 - DNA, 511 bp, Homo sapiens
tctcagtctgcagatggctgcacctttcccctaatatcaagttcaattattgttccactttagcttgctttttttttcaacagacgcagaatgattttatttccctttggaactcaggatttctttttgagttcattaagtcttgggtaaagaatgtttgggatgcaaatgatgctgccgtggccaaggactatgatgtttttttctcccttgggtctgggctggtgagaactatgagctgtcttggctttgccctggaccttgatatcaggatcagttgtgtgaccttgagcaagttcataacctctctgagtttcactgtcttcatttgcaaaattaaagaggtgggtgaggagatctttaattactttctgagctgagagtctttgatttgattatttggatctaatttatccagaaatgctgtgcaaatgtccctgccctccccactcaccaccagggtatctaatcctcttatttcctaaacaaaataaaatgatcaaacaaaaga

SEQ ID NO: 196219 - DNA, 236 bp, Homo sapiens
gcggccggaagtagctgtactggaaatatttaagtcatttaacacgagaatgctctaaataaaggtctaaaagcattgattaaaacaaacactttacctgttttggtcctggcttttaaattataaatctgatcttttgcaccactagtctgcctttcccctctgttcatatattgctttgccccagtgatgtcaaatttagcagtaacagctacctttcccgtccgcttgtacct

SEQ ID NO: 196220 - DNA, 635 bp, Homo sapiens
gtgtgggccccgcaccagaccctgacgccctcaggggagggcttcgggagcacccaccggccaccgtcacctgcagccagggaccaagctgctgcagtgagatgaccaggctgtgaggatggtggtctctgggacccaggtatccctgggtctttgttgcctgcaggaagagctgcctcctgtgcccagggctgagtgccttcatggctcaggcctcatcaggctgccgccaccccagggcaccccacggggccactcgattcggtttgcaggctcctgaggacagtgttcctgctcccacagcctctgagcatgcccatgaacttgacctgccccaggcaccatgccactagggtgcccgtgaacccccagggccgacgctcatccatgtgctgtagatgcacctgccacggctgggcatgactcatatttggagcctcagggcaacagcatggtgcaggtgtcccagcagggcagggcggtacctgtgtgtggcaggtttataagaaagcagtccccttaaaaagaaagatggtggggccttgtacggtacaaggcccgcaggatggagctgggtcatggaccagggagcctgactcccagaggctgccacggggagaagcaggggcctccat

SEQ ID NO: 196221 - DNA, 288 bp, Homo sapiens
catctagaatagcaatacacaatttccttgtcagaggaagaatatagccattcagaattacaagtgctcctgtttaattagataggttggtgcataccaagaaagctaaggtgacattcactatgtaaaaataacctaagcagagttggctgcacctgccctaacgtgctaccataacaggaaatggtgctttttattgtccaataacattttcttcaagaaaaatgtatttcaattatgttagatgtcttattttttcatcagattataatgaaaggggttttttta

SEQ ID NO: 196222 - DNA, 437 bp, Homo sapiens
ccccaacccactgtccatggaaaaattgtcttccacgaaagtggcccctggtgtcaaaaaggttggggactgctgttatacagtgaacaaactacctctacatgcaaaaacatggaacattacaaacataatgttgaatgaaaaaagatagtcaccaaagagcacaaaagttcaactacatttatataaagttcaaatacaggaaaaactaattcataatgttaaaaattatgatagtgcttactattggggtgaagtggatagtgactggaaaaagcacaagaggtgtgtctgaagtgctggtgatgttctattttttttatcttggtgctggctacaagagtgtgttcgctttatgaaaattcctcaaatgtacacttattatttggtacatttgtctgcatttatgttatatgtcaataaaaaatgtaccctgt

SEQ ID NO: 196223 - DNA, 418 bp, Homo sapiens
cttggagaagtcttttttacagaggtaggtaggattgaaccccaataatttggaggaaaggacagagacaatggggcatggaaatttatgtcatatttttaaggatggtgggaaagtccactgcgcttgtctcaagacaatcaagtgatacttatcttgggttcttatacagtttcatagattttcatttctatgtagcgaagagctaataacataaggcaaaatgtgtaatcggtgtaccaaaggctgctataggatcatagagaataagcaccgagaaaaaaggcatctgattcagccctcagcaatggttggaggtattaggaaaggtttccatgaagaaacctgaactgaattcctattaaataataggaatatttgtcaagtaactagatggagaacaataaatggaccatga

SEQ ID NO: 196224 - DNA, 494 bp, Homo sapiens
tgtgacagccctgggaacttcaagtgaaggtaattttattgttattattggtaccattattatccccatccaaaagatgaacctgaggctcagtgagccctgactcctcatctctgtcccctagtttcccagctgatgaaaatcacctttgctaggctgaaatccaagttcaccaggtagccccttgagaaggagcccagatgaggccagatctggtaggaggcagagcacagagcactcaaagatcgagacttacaagagagcgtgggaaggcacggctgtgaggctggggagaaaagggccgtagcatcttgtaaccttacctgagctctggccagagattaacatctccttggttatgcgcagagtttggggtccaaagtgtgatcatttggccggggggtcccagcagtaaccaggcctggagggagaggaagggatggttgctctcacacacctatgtgcacacaagaatgcttttctcggtgaattgg

SEQ ID NO: 196225 - DNA, 894 bp, Homo sapiens
aggagtgattcaggggttatctttagctactttggctattgctcctgcaagatgtagagaccttaggtttctctttaactgcattctaatagccatcagtagctttgtgggtgttgaagggtgtctggatccatagatagcagtttgcgatatgttttcttgtagtcaacctgtagtggcctcctaattgctcatctcccctatggtggcagaggtagcagctcacatggaaggctaattccaggtctgggaatcgcctggaggcccagcctatggccatgttccccaggctttccagtgcttttgtaagcacctaatttacctgtgttgaatccttttccacttaaaattggtagaggagtattgtttcctgcagttactgaatcctggctaatatagtatttggttccaaaagtggttactagtaacaggccctcaaagatgggcttcttagattagttatgactaagctgcatttgaatgaaatgtagatctagtcaccattggaaaatgataaactggtaggcaaattgcttacacctgtggtcacctgaaatgaaatgtcttttggagaaaagacgttggcacctcaaagggctgccatgatagatcatcatgtaagaaatggggacaaatgatggtgactacactagaggggttaaaggaaaaagacaaaaagctcaaaagtttgacatttgcagctcaaggcatagtatgggagagacccaaaagaattttatcttttgtagccgcaaggctcatgtacatcaaaatcaaagggagattctggatcactgaattacatacaacataagttgaattcgtagctttaccaggcctcttatgtgaaaatggggctctgaaatgagcaatggggacccttgagtggatttg

SEQ ID NO: 196226 - DNA, 685 bp, Homo sapiens
tccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgggcgctattatcactagtgctgctgctcgaacgtgctcgcctccttgcgttgagctacgtagtcttactcagatcgacagatgaataacgtcttccctgcgagactgagactagctgtgcgtggcagggggcagggggtaaggacgaaagctcctcccccctgcgggtgaagaacttcgggatcttgctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaaaaaaaaaaaaaaa

SEQ ID NO: 196227 - DNA, 641 bp, Homo sapiens
tccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatcttgctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaaaaaaaaaaaaaaa

SEQ ID NO: 196228 - DNA, 1275 bp, Homo sapiens
tccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatcttgctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaaaaaaaaaaaaaaaaaaaaaaaaaatttgtgtgtgggccgctctctggccccccgagaaaaaagcttttctaaacacaatctgtgtgttgtggggcggggggccccagtagggtaaggggaccagggtggccaatacggcgggggtccccaagagaaacaccggggccaatggcaaatgggggggtgtggtcttctcccccaagtaaaaaaagcgcccgggggcataccggagcgggttctggaaaccaaaacccagggggggagttccgggagggccacatatagggggatcctaccaacacgaggggggccacagggaagccccgatatcaaaatataggccccccgctcttggggaaacacgtacggagcaacacaacagccacccaagcgcgacacgagagccaaagcaaggaaaaacagcacaagggcgcggccaagaacaaacaggacgaagcagcaccaagccacgcaaacggccagagatagaaaccagcaccaaagacagaaccaacgagacacacgacgcagacagacagacacgccgcaacagacagagagaacatcaaaacacaaagaaaaacacacaggacccccagaaacacgagaaagcagacagaaccaaacagaaatgacccaggaagccg

SEQ ID NO: 196229 - DNA, 742 bp, Homo sapiens
  misc_feature (72)..(72): n is a, c, g, or t
  misc_feature (94)..(94): n is a, c, g, or t
  misc_feature (99)..(99): n is a, c, g, or t
  misc_feature (132)..(132): n is a, c, g, or t
aacaacttatatagtgtgtaaggaactcaagagaaaccagtgagcgagcctttatgtgaaccactgaaacantctcttaaaaataaggcaattnttttntaagtcaaattcatctcgtgccgaattcggcanagggccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcgggatcttgctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtgaaaaaaaaaaaaaaaaaaaa

SEQ ID NO: 196230 - DNA, 490 bp, Homo sapiens
acttactagaaagtcacccaatctctctctatctctgagtagcgttatgaaacataaaccctaaaagcccctgagcacagacagcaccagcacaaagacttgtgtcctaacagtatggcaaaactggacaatatcagcacacgtcatctccactgaggaggctgtccctccacacacggactgcctggtgctgttaccagctctcccggcccagcagcactgacacaggccggtggtcactgagcctgagaaaagcccatgatgtcagtcagaactgtcacagcagacaggtgcccttgtgctgcactaggcacgtgcgctaaacacctccaaagagccgcagaggggccgggcgcggtggctcacgcctgtaatcctagcactttgggagagtgaggtgggtggatcacctgaggtcaagagttcaagatgagcctggccaacatggcgaaaccacatctctactaaaaatacaaaaatcagctgggtg

SEQ ID NO: 196231 - DNA, 438 bp, Homo sapiens
tcttgtaatgcaagcggagggaccctttcccttgggttttatatttttcactggctccctcatcccatgctcagtgccttcccggtcttcactcaagaaccagaatggcatcaaacccctctactaacctctggtcatactagcgatgggtgattagggattaaaaaacaattaaaattgagtgagtttaaatcatgtattcttaccaggcacagtgtaatcacacctgtaaacccagcactttgggagagtgaggtgggtggatcacctgaggtcaagagttcaagatgagcctggccaacatggcgaaaccacatctctactaaaaatacaaaaatcagctgggtgtggtggcgggcacttctaatctcagctacttgggaggctgaggcaggagaattgcttaaacccaggaggcggaggttgcaatgagccaag

SEQ ID NO: 196232 - DNA, 244 bp, Homo sapiens
tataagcaacttcataatagcctatgtacaaagaaaaccatttcttcctattttaatgataattctgaaaatttttaagttttgtgaaaagttctttatactttaacaatttactaggccaaaatattaagaattcatatatcttacaaaataaaaagcaaaataaattcactgtaataaaattcatcaagtgcctactacataaaaggtattaaatgctatgctaactataatgtatttcggt

SEQ ID NO: 196233 - DNA, 596 bp, Homo sapiens
cccagtatcaaggctaaatgaagcagtgtaagacagagtagctgacaaccatttcagccattctcaaatgccagtggtacccagagggggctgagcttccattccccacctggcatcaactcaggggaagtggtatgaggtaaggagctttttcttcaccctgcagcatcagtgcagtgtgagatagcctccctacttctctcttgctgaggcagcatggcccgtcagaaagttcatcttatacccctactcagaggcaacaaggtggcataaaatggtgcccaacttttgttaggaagatgtgagggtaagggaggaattgaacttccatcccaccagtctgcattaaggccatatgacttagtgccccactttttccacagtaattatcagcaggacccagcaagaagctgaatgaacacacccacctaacccttgcactacacttcaacaagggaactgcctagtataaaaaagaataggccaggtgctgtggtgcacacctgtgactcctgctactcaagaggctgaagcagcggattacttaagtcctagagttcaagaccaacctgggcaacagagcaagaccctatctc

SEQ ID NO: 196234 - DNA, 440 bp, Homo sapiens
aattggatggcatctatttcggcttttcatgtctttctgcattttatactcttaagagtccagatgtttttttgtgtccttgcctttgcaagtcagggcagtcagaactgtgtgtagtgtagaaacactgtaactgcccaaagtagtaatatcatggctttattattgccatcagtaatttttaatcacattcttgcaccctgagtttaaaaagatctctacaacatctgtcaataaactggttttcatttacttagctatatatgtgattattcatttttattcctactgtttgtattaattttttatgtgctcaccaattgtttttaagaagtcttaaaaggcagcttatatgtggtttgttcttaccataaaataattctttctatttttccacaatatgagtgctatcattttataagagagctacaaataataac

SEQ ID NO: 196235 - DNA, 662 bp, Homo sapiens
agagtccaggaatcactctagcttctgaagcattagcctcttttacaaccaagaaaacaaaacctatctgctggaaggaagagcctcagaaacacactcttattaccctcacttcctccccaactctgtgaaatgaatccattcgatgttggaaagaatatcaacttatttcccagttgttctactgttggttctgggtgacattccactccaggcacaagagaaaggtgccaccttaggtgcaattcatcccaacttgcagtctattagcttcacccactactaagatctttgcaggctgttactttcagtctgaggggaatatgtatgcgttaccacagtgttttcctttcaaggatttttcagatgacagtactaaaagttataacaccatcagtagtttcctttgtcggttctgacacgtattgggaggatgactttgttggcattttctgttaaaaaatacttatatgacatttttttttgtctgtggatttttaggtgttgaaattatcctcacaccagaagacaccatatatgggaaactccacttgcctgcgtattcattagcaggattataattgctccactgctaaaatgagctaacaacccatttacagctttaagccaatgggaaattctctgcctgcctactgcctctc

SEQ ID NO: 196236 - DNA, 1457 bp, Homo sapiens
  misc_feature (812)..(812): n is a, c, g, or t
  misc_feature (861)..(861): n is a, c, g, or t
ggctcaggacccccgtggcgaggatgcacctcccagccctcggcccagccacacggaccacagggctcccgagtctcagcaacaccagctaaggggcatcatgcctctcctgccacacccagggcccgtgccttgctgtccctgcagcccccagacccaggcagacagggacagcccttctgaccaccgcacacactcgccaccgcaaagatccccggggatgcccctcgcctgtgtgtgtccctcatggctgtcacagcaaatctccaggagcccggaggtgcccatggaaaacacccccagcttccggaacgttctttcggacagggccataccggagcaagactcagctttctggtagcgggtggctgggcactgcctgtgagattctgtcacactcgctccagattcaaggggtccaaaaagtgtaaacaagtcaagtgcccatccagggatgaacgaacacagcccggcccggccacaccatggagcaggactcggccatgaacaggaaccaggctctgacaccggccacggcgcagatgcccctggaggagtccaccctcagcaagagacacacagacaccgacacggcgtgcaatcccatttgtgtgaatgtccaggacaggccgattcagagacaggaaggggacacgtgggtgccagtgactggggattatggggactgggggaaatggctaaagggcacccacaaaagttaatgataatgttccacagttttttttttgagatggagtctcactcttgtcacccaggctggagtgcaatggtgtgatctctgctcactgcangctctgcctcctgggttcacgccattctccctcctcagcctcccaagtngctgagattacaggcatatgccaccacccccagtagagacggggtttcaccatgttagccaggctggtcacgaactcctgacctcaagtgatcccccacctcggcctcccaaagtgctgggattacaggcatgagccaccgtgcctcaccagaattgtgtacttttttttcttcttcttcttcggcatggagtttcgctcttgttgcccaggctggagtgcaatggtgcaaacttggctcaccgcaacctcctcctcccgggttcaatagattctccagcctcagcctgctgagtagctgagattacgggcgcccgccaccacacccagctaatctttgtacttttagtagagacagggtttcaccatgttggccacgggcaaaagaattttgttgagggcaaataatatgagaccacaaaactgccttccctgctcagttttaattttcacagttttaatttttagccttctctggttaccaaaataaccacgctcacggccgttcatttgaagatatttccagttaacgtgtgtgaagtgggttttttgagatgtaatttacaagcaataaaatgctcctgtctctgctgtcct

SEQ ID NO: 196237 - DNA, 244 bp, Homo sapiens
acagagctgacccacagcaggtgcttgagatgtgggaagtgaaaagaaaagcaaaaagcaccccaagtggtagaaacctggtacaaaagcagctctgcacgaacccagcaaaacacagaggagcaactccaacctctgacttagatacatctcctggcaattaactcagtaagctctctcttccacatcacgtctgctcagctttgttcctcacctgaacactaaaattgagatcttccgcctc

SEQ ID NO: 196238 - DNA, 525 bp, Homo sapiens
agtaggtgtctctcaacacaatgctcttctctgtctccctctcttcctgctgcctccctaactccatcctttatacccaattgcctgacggagataatctttttttatttttatatttttttgagacagagtctcactctgtcacccaggctggagtgcaggggcacaatcatggctcactgcaaccttgacctccccaagttcaggtgatcctcccccctcagcctccctagtacctgggactacaggtgcccaccattacacctggctaatttttttattttttgtagagatggggtttcgtcatgttccccaggctggtctgtatttatccaccagtgtttgcgctaatcctttcttggagggcgtctgtagggcaagatcgtgctattgttgaaagcagctgcgttataataataggtgatgagtctttcaagtactggatatgggtgagcaatgagtccctgtcgagaggcagtggatagtctgtggggagcgtcataatatgaggtcggcatcttcatt

SEQ ID NO: 196239 - DNA, 524 bp, Homo sapiens
gagtgacccctgaacacctggtggaaaccagccgggcttacactgggcaaagctgggttgtcagggaccctggtgagaccctgtcttccccccattcctctctgccagtcttggggccctgggctcccacacagaccggctttctgcgtgggataggattatcagaccctttcctgaaatcgcgggtgggaaacaggtgaggtcatgaaggcagcctgggagggaggaagggacaggatgtggaggggagagggaacacagcaaaggaggcttactggtccaggtcctctgcgtacatcatctcactgcctcaaaatgtttggggaatgaggcacggtataaactttcttcacttttccttcactacagtcttctgcaggtattattgtccccattttacagacaacgaagctgaggctccaagggattggtaaccttacaaagatttactaagtttttaggtgtaaaactgagatactaacccagatctgtgtctctggggccaggctctctggggaaatcag

SEQ ID NO: 196240 - DNA, 1212 bp, Homo sapiens
ctcggcagaggccgagcctgggagacgccggaggcggcggctgcggcgcggggacctgatcggcgccccgagaggagctccccgctctctggacgcggccctcaagctggcggggctaaggaagagcgcccgggaggcccgggagccactggggtccgtttcagcaggaagacgggcacgcaccgagaggatggcagtgcccagaagaactcgagtcgggggcacggtggggagaaggggcggatcccctgctggcgaccgggcagagccacccacttcctctaagggcgcgggactagaggtgggatttagggagggggaagggaggagcgtgggctggacgactcttgcggccagaaccgcgttcagagccacagagccgggcactgcggccggccctggtcccggccccggccctggcccagcccttgccctggctcgcctgccgccgctttttccttccagatgcggaggctgcggctggagcttggggtttgcggattaggcttgcagttattcagccctccctcttttacacggaagcgggggcggtggagacttcttttgctgaaaggcagagtgcagcgctttgatgctaaatgcagtacacaagtcatgtaaatctggttttacggttcttaaccccttactgagactacctctttcgcaacttttcggaggaatgttagaggaaagaggcacagtttggctttggggtcattgcatccttccagcgccccttgctccagctggagagagatcaaccttttgcagtggaaggggagagtcccccagcctttgtttcatcagacggctgctgtagtacagggattcaggccagggcccgcatggccggacttcttggttcaaatcctgcactgccactcaacggatgtgtgagcttgggctagtgactgaacctcccagcctaggtgactctgtgcctcggtgtcctcatctgtgagaaccgacctaagaagtgtctgtctgataaagctgttgtgatgagttagtgaattcgtacacatagaacctttagaactgtctttgacatgtagtaagtcagctgtgtagatggtgggtttctccagtgtcaggtccctgcccacagcaggaagatgacctgtgctagaagatgggggctagggtgttggggaagacttcagggacttgggagagaaaaggagaaatattcagagatgagaaaagtag

SEQ ID NO: 196241 - DNA, 253 bp, Homo sapiens
aggtcacctcttgaaggtggtagggctttcactttttactttctatgttgtttttattttctttggtgcttttctataatatattttctacttcttaaaatgatgaagatggttcatttctcttatcagaacacaaaattttaatttaaaaagcttcatatctacttggaaaaccatataaaaattctttatattgtatttccagagaagaaataacaaaaatctcctagaatcgttgagagggctgtcagcg

SEQ ID NO: 196242 - DNA, 377 bp, Homo sapiens
tcgagggctcattatagcattataactggactccatttaggcgttgctaatggtaggaaacttaggcttgctaatttgatacaatgcagtccctttaggtttaaaaatacttttatctaattgctctgttcatttggcaactctcctatttcctcttttcctttccttctccttgggggaggcctgaggttcctgggaagtgttctgacactgggggaggaatgcccgtgcaggggctggcctctgcccctgcacctctctcttgagcttggccatgcactgtgtcgaccctgctcccttgctgacatcttcagctccacatggcttatagtcagctggtccaccgatgttgcttcccctttgtcccagtcatagac

SEQ ID NO: 196243 - DNA, 155 bp, Homo sapiens
atagggatggcattaatgtggtgaatgcatgaggaggagcacactggaagcaaggtaatgagtgtgacatgttgagtttgaagtcctgttacacagctgggtggagaggtccagcaataagcagttaagaaaactgggccagtgcctaggaggag

SEQ ID NO: 196244 - DNA, 372 bp, Homo sapiens
cctgaagcctccccagccatgcttcctatgatagagcctgcaggcgtgagccaattaaacctcttttctttataaatgacccagtcttggttatttctctatagcagtgtgagaatggactaatacagatggcattttccttttgtgatgactgccaagaatatcagtcctgggtgcggctcaatttcaacagccttaaaatctactatccacacatacaagcttcacaaatcatttttggtgctgatctgccacactaactatattttacaggacaatgtctatttccacattcccattttaaagtatgaatcctggctgggcgcggtggctcatgcctgtaatcccagcactttgggaggctgaggcagg

SEQ ID NO: 196245 - DNA, 650 bp, Homo sapiens
acccaagatgccgaaaggaaagaaggccaagggaacgaaggtggctccggcccctgctgtcgtgaagaagcaggaggctaagaaagtggtgaatcccgtttgtgaaaaggcctaagaattttggcactggacaggacatccagcccaaaagagacctcacccgctttgtgaaacggccccgctatatcaggttgcagcggcagagagccatcctctataagcggctgaaagtgcctcctgcgattaaccagttcacccaggccctggaccgccaaacagctactcagctgcttaagctggcccacaagtacagaccagagtcaaggcaagagaagaagcagaggctgttggcctgggccaagaagaaagctgctggcagaggggacgtccccaccaagagaccacctgtccttcgaacaggagttaacaccgtcaccaccttggtggagaacaagaaagctcagctggtggtgattgcacacaacgcggatcccatcaagctggctgtcttcttgcctgccctgtgtcgtaaaatgggggtcccttactgcattaccaaggggaaggcaagactgggacgtctagtccacaggaagacctgcaccactgtcgccttcacacaggtgaactcggaagacaaaggcactttg

SEQ ID NO: 196246 - DNA, 284 bp, Homo sapiens
tacctatctcctactactaaactttctgcttttttgaaaaagcagaaactttgttttgttcccagttgaatccccaggatctagaacagtgtctagcctatagtaggtgctcaaatatatatgttggggaaataaatgaatcaagatctgaataatgagcaggcattgtatgaccttcattgtttctttcttgaatattaagacactatcacaaaaaggacaactctacaaatatatataaaattcataaaattcctattatatcccagcagctggggcaaaga

SEQ ID NO: 196247 - DNA, 231 bp, Homo sapiens
aaaggaaaatattgcaataaagttaaaataaggagagaaagaactaattttaatagagatagaaatgtaacaggcaacgtttatttttttaaaaaagctatagaaatacagtaatatgtggtatgatgatgttttggccagccacagaccatgttaagtagggatcccttaaggttataatcaagctgagaaatttatatctcctagtgacatctttgctgtcataacatt

SEQ ID NO: 196248 - DNA, 363 bp, Homo sapiens
ctgcctcagctgccctccctctgcagggctctaaccagctgcaggccaccaaccactagggactgggagctgctgctgaccctgccctctctggggaggggcctcaaacagaatgcaagttggcaatcagatgtccagcctaggaggaaaagaaccaagcgaagacagtagggagtgaccttgtggctcaaggggacaaactgcagccgggattattggggaagaaagaggagcccattccagggaaaccagctgtccagcagcctggcctcctggaagcctccagagcctgtcctctggggtgtggtcctgctctcagcaggaaataacagattcccacttcatgccctgagggcaccaaag

SEQ ID NO: 196249 - DNA, 407 bp, Homo sapiens
ttattttatttttgagacagtcaaagtctgtcaccaaggctggagtgcagtggcgtgatcatggctcactgtaacctcagcctcccaggttcatgtgattctcgtggctcagtctcctgagtagctggaattacaggcatgtgccaccacacccagctaatttttctatttttagcagagatgtggttttgccatgttgaccaggctggtctcgaactcctggccttaagtgatcctcctgcctcagcctcccaaagtgttgggattacaggtgtaagtcactgtacccggccgatacccattttatagatgaggaaatagaggcattgaggagtgaagcaagtcagtgcttctcaaatttaaacgtattcatgaaatgcctaggaattttgttaagatgtagcagt

SEQ ID NO: 196250 - DNA, 602 bp, Homo sapiens
gggtgaaaccgtcctgcagctgtgggatctacgaagcgtaggtggcagtaacgctggactccactgctttggagcctgcccagtcgaatttggaagcctgcgagggagctgaccacagtacactggcaaccagaagatgcccaaagatagggaggcaacggatactgcttaagttcagaagatcctctggccgttgctggcccaagtttcccccagagacatccaaagcctcagttttctcatctataaaagatgtgattgttatgaagcttccataaggtaagtgagtaaaaaccatggcaagatgcttgtaacttaaaagagagggttcctatgaggcttctataaggtaagtgtgtaaaaatctggtcataatacctaaaattttttagtgttcagtatatggagaaggaggattatttttttcatctaatttttaaaatgagtttataagattggtgatactcatgtatctttgacaatcaaaccaatgatcagaaaaaaataaatagatcaccaaagtcacaaagcagttcccaatgcattcactgggtaatttctagttaaaagtagcaatgatgatcacattgaaaattctgtat

SEQ ID NO: 196251 - DNA, 271 bp, Homo sapiens
ttggttaatttcttaattctaactccaaatatttggggaaagaggttgggtatttttttaagtaaaatttaatatttttatgcttcaaaatactaattcctttagtactgtccaaaaaaggacaaatgtcaaatttaatcaaatgatttaagctttatagggaattaccaacagtttaaatgctttttaaatttttaaaaattgcctcagttgctatgatactgtcaggtattaaatagtgaatcacattttaattttttaactttgcagc

SEQ ID NO: 196252 - DNA, 452 bp, Homo sapiens
aagccggatgcctcgcctggcacccgccccagcccagacctgtccccgcccgcaacttcccaaactcagaaaatgacaactcctttcctcccttttctccccacgcaaactttacacttgtccctgactcccctctttctctccagtctcacgtttattccgtcagaaaatcccatggctctcccttccagacatggccagaacccggcctcccgggctaagccaaggcaagctgcctttgctcttcctgatggtcacggctgcaccttccctgggctccctgcccctggtgtggccaccataagtccccacccatcatcctttctgaacctaagtcaaatcacatcattcttctgccaaaaccctccaaagactctcagcttgctcagcgcacagcccggtgctcctggagcccacagaaggggcactgccctggcttccccttctgccgc

SEQ ID NO: 196253 - DNA, 360 bp, Homo sapiens
ggctctgtggattggaagcaccattgctctgggctgtccactcggatacggagagtgctgttggaaatgcagcaccttgaaagtgtctttgtagttgagattttttcctggaaacatttacagcttggaactgttctatctggccaaatatgaggaggctagagttgccccaaaagtggcagcaagggagttgcctcaaaagacttccccaaacagtcccgcgatggaattggttgggattccaaggaaagaagctctaaacgccagggtgatcagtccagagcatttcttccggaaattttcacatggagcttcagctttcttgggatcgatgatgaggcaagggatgctccacccagg

SEQ ID NO: 196254 - DNA, 101 bp, Homo sapiens
aaaggagggagtcaagagcgcagactagagaaagagcctgacggccgcagagctgaggaaagaggcaggcagtgggcgcttcgccgctgctgcccccgggc

SEQ ID NO: 196255 - DNA, 645 bp, Homo sapiens
acgtcagtgtgtgagctttaactcacttgctttttttctcctccatgctaacacgttcagctgggatggtaatgtcatttttaaacattatttttctgataatctgacttagaaaaagctattacttttttgagtttgagcaactacagacattggcataatgacagtacatgggcagaggaaagcaccctcttctggacattttaaaaagtagaggccagacatggtggctcactcctgtaatcccagcactttgggaggccaagatgggtggatcatctgaggtcaggagttcgagaccagcctggccaacatggtgaaaccccatctctactaaaaaatacaaaaattagctgggtgtagtggcacataccctagtctcagctactcgggaggctgaggcaggagaattgctggaacccaggaggtggaggctgcagtgagccaagatcatgccactaccctctagcctgggccacagagcgagactccatctcaaaaaaaaaaaagtagaaaaaaattgaaacgattagagaaatgaatgtctgaataattaagcagaacaggagggactcatgggaaccgattttcagagaaaacttgagatcttttctgtggagcctccagattcctatagaatggaga

SEQ ID NO: 196256 - DNA, 544 bp, Homo sapiens
gaagattaagttaaataatctatgttaaaagccctacttgaactgtaaagcccttaaatttttagctattatcagtgggcaacagttgatcatgtttaaaccttctacatactgacagtctggatttaagctgaaaagtatttttaatctaaaagaaaattacctaagaattctttttgaccttctaagaaagtgtgtttcactattctagagaattagaaactggcgcagtgaaggggggtgttgtatgcctattagcttcctaactttgatgctgtggtttcttagattattacagttgcaaggtcaaatccaaagaattagaacaaaacattgttatcctggaacactcaaaaattatagctttaagcttagattaaaagccaaaatgactggtttgaaagttcccggaaatcaagctttgtattaaaaagcaaattaagaagtcacatgtcagcattttgtttgtttgttttgagatggagtctcgctctggtgctatctcagctcactgcaagctccgtctcctgggttcataccattc

SEQ ID NO: 196257 - DNA, 367 bp, Homo sapiens
ctctgtttgtctctctgtttcttggtgctcgtctctgggcctcgctttgcttgtctctatctgtctgtttctcattctctagctccctcagtttctgcttgggtctcctggtgtctcgccctctcccatttctttctctgtgtcctctctctgtgtcttgttttctgtctccccctttctctgtctgctccctagtgtctctctctgtctcctcccaccctgttctgggaccccacccctaacacccttctttctgtttctctccttcctgctccttcatctgcccacagagatcacctgcccagaaaacagccactatgaggtctgtgtcgacgcggccgcgaatttagtagtagtaggcggccgc

SEQ ID NO: 196258 - DNA, 428 bp, Homo sapiens
cccactgtgttgggacgaatgtcgggggtcctgcccaacgtgccctgaggaccggttggagcagtacgagggccctggcttctgcggacccctggcccccggcacagggggccctttcaccacctgccatgctcatgtgccacctgagagcttcttcaagggctgtgttctggacgtctgcatgggtggtggggaccgtgacattctttgcaaggctctggcttcctatgtggccgcctgccaggctgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtt

SEQ ID NO: 196259 - DNA, 483 bp, Homo sapiens
cctcacacctagtcaaagctaggtgagaccaggtcaccctccaagcccgggttaccagtagggggtaggtgccaaactggagagtagactgtgatgaatgggtagcagagatggcagaggacatggctcatcacctggggtcggggaccccgctctcagcagctcccttccctgagtgccctggcattggtgtgtctgtgtgttcgcgagccctggcatgccactgcggcttcacagtagcctcctgggcagcggctcatcagcttccagcacagcctttgttgttctataaatctgttaatgtttgtgctacctagaataagaaggaaggagtcattctacagagaggatttattcttccaggcgccaaaaccttgttccttacgattatgtcctgttctttaatggggtcccctgtactccacagtgtcattcgcctccacactagatgtccacacaatgctgtgtattttcactgatttt

SEQ ID NO: 196260 - DNA, 343 bp, Homo sapiens
aactaaaaaaagattttttaattgcttaaattaattgaatcttaaatgcattctgaaacagaaatatgcttaattttaattatcctaagtgtaatattagattccttcgtaagtaaattttccatggaactgacactcatgtgccaacattttgtttaatttgggattttttttttcattatactttaagttctgggatacatacgcagaacatgtaggtttgttacataggtatacacgtgccatggtggtttgctgtcatctacattaggtatttctcctaatgctatccctcccctagtcccccaccccctgacagtccccattgtgtgattgtccccct

SEQ ID NO: 196261 - DNA, 2452 bp, Homo sapiens
catggctgataatggagggcaggcaccttccacctcctccttgggatctggagcctgagcaggtggtgggcagggatgtgtgggtgctgctgccagccaaggagccaagcagatcggggtgtccttgcttgtcaccacccagcatgtagagatgagttagggtgtggcttaaggagaggatgggtctggcctcccaggtaaggcctaggaatgatagctggacacaggaacatggggccagggctggctggtgagacctaagtggaggcctcctgggccaggctagacagcccacaacggctggaggagggacctgcctgagttactagagtgtatcctgctgaatcaagaaggtgatatctgaagaacccagggataggagcaggcgaagttcctgcaggtggggtctcgggtgagctacagccatcagctcaggcctagggatgcagtgccggccctcaggtgagatcagaagagtcccgtctggtaggggtatgtagaagaggtaattcttggtccgccagggccagttttgcggcagccatgggtgtcgggatcaggcaggggtgtggtgggaaaccatggggtctctcagggctcggccagggtcagcgcacgccacagggccagttttggctggagaggcctgaagcagagccagagcaggtccaggtgagttctgaagaggagccaggacaggagagggacccataggtctgtgaattccagaggagaggcaggtatttagaggtggttctgtcaggtgaagtctgaggagccaaagctatgtatgtgcatatgtcagccgggctctgtgggaggtggtgtagacctatggcatgggacaggtgtgcacgctgggatctctggccggttccgaaaagtgaggatcaggtagtgggtggctgattgcacaagtttagaacccaggattagggacacacaggtcagcacctgcttctcagcatcctgactgggtgtgatgggcagagctcagggcgtcagaggcctctgagaatttgtgactgaagtccaagtctgtggcatcagggtctgcagagcccagatgcgggagaggtaggaatgtacctggtgatatgaggcaaggacaggggagctggggcaggtgaggcaggcaggtggcatgaggagctgtgctgggtgggtgcggtctgagtggctcaggttgggtaaagggccagagacctgggtctacagggcagacatcaaggctgagccagtcagacagtgtttgtcaacactgggctctcaccaggctccctcaggccgaggtcagcagccagggatctgtcatgtgtgaggaaagtgtctgttcagagttaggtgtgtataatagcagcctttcagagccgcgtctgtctgaggtcctaggagctggaatcagacaggtttgtatggctgggtttctaggggaggcctgaggagccaagactgtactcaggtaggcagaactggaccagtctggtaaggacgttggagctaaagataggcagacaggtcgagctgggtctgacaagtgagggctgaaaatctgtgattgggtccaggttggagctgtgtccttgggcgatgtctgagcagctctggtgggtgagcctgggtcccctgggaagagaccagacaaagggatggggtcagacaaagggatgacgaaccgcatccatcagaaaggtggatgaagcctgggtctggtcgaggtacgtagagcagatctagcaggcgaggtttcaggggttaaggtgagacacaggtatgtatttttgggtctcacaggttaaggtctgagccactgaggtcaggctctggtttgtatcccaagaccgagaagctgtgttaagcatggtgggtagagtttgtcaggtgacatctatgaaaccaggagcatgcaaagataggttgaccggaacagccatggtcaaaccaattaaactgtcctgcagttgaggtcaggcacaggtagaacggatctatcaggtgaggcccaaggagtccggattaggctcatctagaaagacctggatgtggtagatgacctctgaggatatgaagtgaaggcaggtggatagagccaggtctctcaggaggtctgaggagctgggatctggcacagtgagcaggtctggatttcccaggtggtgtcaagacagatgggtaggccaggcacagtggctcacacctataatcccagcaatttggaaggccaaggcaggcagatcagttgaagtcaagagctcgagaccagcctggccagcatagcgaaaccccgtctctactaaaactacaaaaattagccaggcatggtggtgcatgcctacagtcctagctacttgggaggctgaggcaccagaattgcttgaactggggaggcagagtgagccaagatggtgctactgcactccagcctgggtgacagtgagactatctccaaaaa

SEQ ID NO: 196262 - DNA, 883 bp, Homo sapiens
catggctgataatggagggcaggcaccttccacctcctccttgggatctggagcctgagcaggtggtgggcagggatgtgtgggtgctgctgccagccaaggagccaagcagatcggggtgtccttgcttgtcaccacccagcatgtagagatgagttagggtgtggcttaaggagaggatgggtctggcctcccaggtaaggcctaggaatgatagctggacacaggaacatggggccagggctggctggtgagacctaagtggaggcctcctgggccaggctagacagcccacaacggctggaggagggacctgcctgagttactagagtgtatcctgctgaatcaagaaggtgatatctgaagaacccagggataggagcaggcgaagttcctgcaggtggggtctcgggtgagctacagccatcagctcaggcctagggatgcagtgccggccctcaggtgagatcagaagagtcccgtctggtaggggtatgtagaagaggtaattcttggtccgccagggccagttttgcggcagccatgggtgtcgggatcaggcaggggtgtggtgggaaaccatggggtctctcagggctcggccagggtcagcgcacgccacagggccagttttggctggagaggcctgaagcagagccagagcaggtccaggtgagttctgaagaggagccaggacaggagagggacccataggtctgtgaattccagaggagagacggggtttcaccgtgttagccaggatggtcttgatctcctgacctcatgatccgcctgctttggcctcccaaagtgctgggattacaggcgtgagtcaccgcgcccggctcattttaaaatttttgtagatcagtgtactgttgta

SEQ ID NO: 196263 - DNA, 443 bp, Homo sapiens
aggatctggagaaggatcccttgtgatgtggaaaatgtgtgtgtgcacacgtgcatgcacaggcacatgcacgttgttcaatatggcagccactagccacatgtgactatgtggctactgggtacttgaaatgtgactactgtgactaaggaacttaattttaaatttttttttaattttaattcatttaaattcaaatgtaaataatcagcctatacaatcagggtcaattgctttttgacaagacaattcaatgggaaaagaatagtctttttcataaaggattctaggactactggatttccacatacaagagaatgaagttggaccctgctatggtctgaatgtttatcccccctgtcccctgacacacatatattgacagtccccagtgcagtggtcttgggaggtggggcatctgggaggtgattaggttatgaggg

SEQ ID NO: 196264 - DNA, 707 bp, Homo sapiens
gaagaatacaggttgtctactgtgtttttcttattttttttgtggaggttatttgatcatgtttatttgaaaattgacccctatatgacaacccattctgttgagtttattgttaaaagagcaggaatgattaatgactatagtgaaattatggattcctattgttgctaagctaatattgtaagaaccagctaaatcttataatgtatgatacatttacgtgtggcattctttggtatagaaatgattgtgtaaatgctgacgctatggggtttaccttctgcctaaatcaacatcagtgctaaaaatacatataaataaggtgaatattttgaatttatttaaggcccttctccaaaaaagaataataatttaaatttttttgtagaactatgagaaaagctaactaatttgcataaactgaggagcacaattggaaatagagcaaaattatttattatttttaagtgaatgcaagtttattaagaaagtaaaggaataaaagaatggctactccataggcagagcagcaaaaattattgaatttttaagtgaatataatcatattgctttgacttattgtcatctatttataagaaatagctattccacaatcttcttaatgtttaaatattttgtaataaacatattaatattgtatattatatgttattcatatatattaataataactaataaatatatat

SEQ ID NO: 196265 - DNA, 351 bp, Homo sapiens
cagtgccttaatcccagctacttgggaggcagaggcaggagaatcatttgaacccgggaggtggaggttgcagtgagcctagatcgagccattgcactcaagcctgggggacaagagcgagacttctctcaaaaaaaaaaaaaaaaaaaagaaagaaattgactgtgcaagtagactaaaatgactggctttttacatcatatatatgtgatgtcatatggccgaaagaccacctcactagaatatagctgaaagactgcctcactagaaatcaagagactaaggcttctctcttccatacccttacctctcttccatacctctcttccatgaccttagctaagccgttta

SEQ ID NO: 196266 - DNA, 210 bp, Homo sapiens
ctatctcccctagtgcccaggacagtgcttcatgcatagtaaatcctcagttaatgtttggtgaattaataaatgtgacccttaagaaattatactggaaatattttccatcagtgggtattaaattgttatttatgcaatggtgatgaagtcatctttctgataaaaactacattcaattgattaagtgttaaatctttggttctccat

SEQ ID NO: 196267 - DNA, 664 bp, Homo sapiens
aaggctcatcactatccttggcaatgagaactactggggtctccggctattgtcaaaccccgacatgtgcaaaaaacatcagattaaaccaagaataaatccatctgcaatattacagattcctttaaaaaacatgcataattaaaaattttcttcttggtgaaaagtaagatgctcctggaatctttgttcatgctcagaataagatttgattatctagcttatggggactcctgggctgaagacaggtgggtgtgtgtatgttggggaggagtaggaagggggagagaaagtatcttccaaactcaaagcaactggcagggaccgcaacagcgagcaggtcaagagcataaggaaactccctcgttaagcaccagggtgccctggaaacagccatttcaattagtgccagactgagctgaaatgaagattaagaggtcatttcaaacaatagctcaaggataatttgcttagcatacagatctctactaccatatacttctgctctgcaatgcagcattaacctcatttactgtttagttctacagggcacatattactagtcagaaagcccccttgtttctcatatagaaaactctactgaaagtctcacgtgcacatgtcattctcagtggaggccactgatgatgttgtcccacatgct

SEQ ID NO: 196268 - DNA, 426 bp, Homo sapiens
aatgattacttcaacaatggacggggtgataaaaacaggatcaaagttcccaggttctagtgtaagctttatctgtgactttactcaagacacgccctcagctaggtcctgaaattgtcgtgctgttctatggaacacagatggggagctgatttttcatagtcccttgagatgtgccataatgctaaggtctacaactcagaagccatgatgggagccactatggccaagcaattgaggtcttgttaattcatacaaaagtggtgtcttggttctagcttctgggcctcttgttttctagaattatttgatacaagaaagttctggcacaaccacaggcactttgtcatcccatggaatgtcaccatcatggatgtgactggtatcaaaccagtctcttggtccaagtgtacacaagtagtcaat

SEQ ID NO: 196269 - DNA, 143 bp, Homo sapiens
caaatacccattcaacagaattcatacagcggaaagctaaagacctacatgcatcagcaagaatgaatcttgtaaacatcgtgaggatgaaggaagcaattacaaaggcatatagccaatacaagcttgaaatggtcgccaat

SEQ ID NO: 196270 - DNA, 361 bp, Homo sapiens
acatttggtatccaagatggtatttgacgattttctctctaaagattctctgctcagacattctgtctccttacaaagtacatgggagtccattgagaacaggaataaaatagcaagtcaattggagaatctgattagaattagattgtatatcatttcatgggcacttttattatgacatggctctgaagtgtagtcatttgtttgcctgtatcttgagctcccctaaaagagagaacatgttctattcaacattgtagttgtagtacaaggcactcgaccaatgcaaatatatgaatttgcatgaattcactgatagtaaatcaatgacactgtttttacctagaactaaaaaaaaaaa

SEQ ID NO: 196271 - DNA, 534 bp, Homo sapiens
gaagtagctcaccgtgacaaagctgcctttgcctttattgatttgcaaatcaaagaagagagacatgttgggaacaggccccccaaaatctggccataaactggccccaaaactggccataaactaaatctctgcagcactgtgacatgttcatgatggccataacacccatgctggaaggctgtcggtttaccggaatgagggcaaggaatacctggcccacccagggtggaagaccacttaaaggcattcttaaaccataaacaatagcaggagccatctgtgccttaaggacatgctcctgctgcagataactagcccaacccatccctttattttggcccatccctccatttcccataagggatacttttagttaatcttttatagaaacaatgctaatgactggcttgctgttaataaatatgtgggtaaatctctgttcggggctctcagctccaaaccttttctgatttcccacttcacacctctatatttctgtgtgtgtgtgtctttaattcctctagcaccgtt

SEQ ID NO: 196272 - DNA, 337 bp, Homo sapiens
aaaattcgagacacctaggagtttgtggtctgcaagcctggggccctggatttctctttatcttactttctggcctgctctgagtctcctctttctcttggttcttccacatgttcatgctgtctctgactcactgccccaatgagccggcgcattgaggggctcttggtgggctcttagcgtggcgcatcggggggcgcttggagggcagataatttcatctgttaaatccaacacacatttctttcagggaaaaacaatgtcaccaaattttcagagttctaaactcctttccttcaagccggaattttccttttttcagcaccagcacaaagag

SEQ ID NO: 196273 - DNA, 478 bp, Homo sapiens
aagttcaaccttaccaggacgttttccctgagccattagaagtatttccactcctagtcttctacctcaaactttcctttttgtactacacttacattcaactttccctcaaaaacatcctcccacttcagaggtgttaagttattaagtcagccctaaatgtaaatagttttcatttctctaaccccaaaaacctcccttcccgccagcatgctttggtcttgtcacccagaacatcaaagccattgttttccgtaaaagcgttctgatcacttgggtgacttgtgcagataaacaccacccaccacatgccaggctgtgcagcaccttcctggtgccctgtcaggaggtgaacgcgccaggaaaaaatgccgaactctactggcaaatgctttgcacatggtcacatgccctgcacctctctccaagctctttgggtagccttggccagtcccttccccacaagggccctcttgca

SEQ ID NO: 196274 - DNA, 263 bp, Homo sapiens
taacatcacacagagtaaagtataagagagctgaagtcaggtctgacttcaaagccctcattctttccagaacgacagaatactcccacacttttagcaaaactcagtgtctgcttgagaatgacaaaagcagtgattttctagttcatgggtccctcagagacatataagaaacactaccaaaaaaatgagcaaaattgaggcaccatagaatatctaggacaaatacacacacacacacacacacacacacacacacacac

SEQ ID NO: 196275 - DNA, 401 bp, Homo sapiens
ttaaaactcagaaaatttgacaatttgttggttggccaaattggttatccaccggttgatttttggcgagctgacctgtttcaagatggcaggtgtggatgggactctgtccagggctggccccacacacccacattctgatgacgcagaggtcatgggactgtgccagggcccccagactacatccactggtccccaaataactggtttcactggcttcaacacatggaggctgcttgatgtggtgggggtagggaggtgttgctgtcacttgaggcagagagagaaggaagcctggccacgctggcacagtgtgccaatcaaaccacgtggcctcatgcaatagagtgcaagggtatccgaggtcaatggctgtttgtatttaaggatctgattcttta

SEQ ID NO: 196276 - DNA, 238 bp, Homo sapiens
caaattcaaaagcttcctatgatgctgggttccactgctacaaaggtcaagtacattaacagcgtatgtggcatcaacttctgaatcatggggccaggtgtggtggctcacgcctgtaatcccactacttgggaggctgaggcaggagaatcgcttgaactcaggaggcggaggttgcagtgagccgagattggcgccattgcactccagcctgggaaaacaaacaaacaaacaaaca

SEQ ID NO: 196277 - DNA, 354 bp, Homo sapiens
gacaggatcagtacggccgtttcacagaaaaggagacagaagccaagaatgacaaaataataatgcctccatcatacagccagcatgaacaggagttgggaatgaaactcaggactttgggctccctgccctgcgttcctcagcctgtggagggagagggatgacacagagatgctccagggaacaagagcatagctgaaccagggcgacctctaaaaaccccaggagggccagagcccccaccttccctgcagccctcacaggaagtgctcaaggaatgatcatcagctgactccagcacttcagtaacacaaaccaatcagaagacatggttctcggtctcagggaatccaa

SEQ ID NO: 196278 - DNA, 343 bp, Homo sapiens
ggtctctatcatttcacggcaccaatgacagataaaacagaggtacctaaagaccttcagctggtataacataaagctcattattaagggcaaaaccctgtgtttatgcaatatcacaacagctaaatttaaatttgccagcaggggcccaggaagtgtaaatgtgtgacattggtaggagcatttgcctaccgcaaacttccttgcttttgaatacatcgcactgtattattggtcctctgcatgaaagtaccataatctttaaagtaaacagacaagaagaccaactgccatctgtcccagtgggaacatgaattgccgcttctggcatatcctattaggt

SEQ ID NO: 196279 - DNA, 287 bp, Homo sapiens
ttgcggtgagccgagattgcacctgggcaacaagagtgaaactccgtaaaaagactgtataaaactgtggttaattctttaaatgttgggtagatttgtccagtgaaatcatctggacttgaaattttctctattggataaacttttcaattactatatcaataattttaatagttactaggctattctaactgtttcattttgagtgagttttgggagtctgcattttttgaggaattgattcacgtctcaagctgtcaaattcatttgtattcatagtaattccc

SEQ ID NO: 196280 - DNA, 353 bp, Homo sapiens
agtcaaatatctgtttaactagcaacatagttactcgtgcatatttaaaatactacatgagtatggcctggcacagtggctcatgcctgtaatcctagcactctgggaggccgaggtgagcatattgcctgagttcagtttgagaccactttggacaacatggtgaaaccctgactctataaaaatacaaaaatgtagccaggtgtggtggtgcgtgcctgtagtcccggctacttgggaagctgaggtgcaagaattgcctgaacctgagaggcagaggttgcagtgacctgagattgtgtcactgcactccagcctaggtgacagagcaagactacatctcaaaaaataaa

SEQ ID NO: 196281 - DNA, 715 bp, Homo sapiens
aaatgagaggtcaaaaagggcagctggcagggcaatcccatggctgtgccaccaggcaggggagggagtgagttctccaagtttcaggtcctcctcttctatcctgggttagggtctctcctgccttttgtagcttcttagttaattacccagcaatcggctgcaggtgaataggtgaagtgatgaagtgagaggctgaaatcctgcctaagactcttagagtgtgagcataggcccaagcacttaggacttcttaggccttctggccatcatatggcagtcatgtgaaataaggactcaacctctcagatattggagaggactgataaaggcattattttctttttaatttagcaacttacagtaggccttagactctatgtatgtcaggaatgtctgggaaggtttctctgtagaacattagttctatttcttttctttaaaaaatacattaaatgtctgggcatggtggctcacgcctgtaatcccagcactttgggaggccaaggtgggcggatcacgaggtcaggagatcaagaccatcctggctaacacggtgaaaccccgtctctactaaaaatacaaaaaattagccgggcatggtggcacgtgcctgtagtcccagctactctggaggctgaggcaggagaatcacttgaacccaggaggcagaggttgcagtgaaccgagatggtcgagatggtgccactgcact

SEQ ID NO: 196282 - DNA, 394 bp, Homo sapiens
ttacatatgaaagctagcttgcatagctatgcttgcagcttgaagtttcaggctgctttctgttagaaaagaaatggtttgggggctgctttttattaatggaaaattccaccaagaactctttaccctttctaattgcctaaaataatttttaataactgctgtattaaaaggatatgtgtaccgaaactaagccaaaacacaactttaataggcttaagatctctgtgtgtttgctcctagacaaaacaaatggggtacagaacaaacaaaaacatgttgataggagagagaatggatcatggtctttcatagagcattctgtgcttctggactcagaaaagctgtcagacacctgtttatggtttattacagctacagaaaacacattaaa

SEQ ID NO: 196283 - DNA, 361 bp, Homo sapiens
tcggtagatgtctcatttatttatcactacacaggcctatccaagtccaatgttattgcattttaaaggaactaaatttgtagtcagttaagacttgtagggagaaaagtaaatggtctccaagttctgttaatagaaatagacttcaaattttacataagagttacttctttttctccccttctgagttaaaatgaaagataagctactctggtagtaaatggttaaaatagtactgtagcattctgcttcttacctcaaatctaacagcattaatgtgtatattccacaacaactaagaagctaggtgaaaccatcaagaaccaaaatggtgatcctttgaggcaaggatcacaaagca

SEQ ID NO: 196284 - DNA, 692 bp, Homo sapiens
agaaacaaggagccaacagagagtctacgcagtgccacaatgtgacttttgtttttaaaagatggctgttgagaatggattgcaagggaagcagagagtccaggtatcaggctagtgcagtaattgaggtgagagaggatggtggcagtggaaagagggaggacgatgcagattctacatatatttgaaggtgaaacaggatttgctactgaattaaaggtagggtgtatgagataggggagtgaagatgattacaaagtttaggggttttaccactagaagtctgtggggagaaggagtttgggggaaataagaaattctgtttgggtgacgttgaatttgaggtggccaccacacactcgggtgtagatactggggaaggagttgggccttacagagtggaactggagaaaaaagtcagagctggagacctaaatgtgataatgattggaatatcaaccacacttaaagccatgagagaagatgaggtcaccacgagaatgagtgtctacagaaaagagatcaagaactgagaccttacagatgatcatgttttgcattatccatcaatacaagcaaaaggctaacattaactcagggaaggcattttcatgggaaaccacagctcagcagtgcaggcatttagcttttgggccaattctggcttaattcccatgagctgtcagcaccaa

SEQ ID NO: 196285 - DNA, 426 bp, Homo sapiens
ctacctttttcttcttaacaagttacaaaaagatttattagggaaggaagttgagaatatgtaagtagggaattttgttcttttgtatttttatcaaagtattttagttttcatattgcattaaaaaataatactattgaacagtatactattagtaatcactttttatcatgctgtgtcttcatatagtctgaaagaataatttttcttgttacaaaataatgcatttttattgttgaaaatttagaaaatctatctttatttgcaatcttctgtcagtatttctcagcctttttcatttctgtctacttgaacttgatttgcatcattttttcttgttactccaaaccaatttatgtttctctgggtataaatacaaatttaactatatatagatgcaccagctcttatccttttcaccgttta

SEQ ID NO: 196286 - DNA, 383 bp, Homo sapiens
ccaccaatattcctccaccacactgagtatatatcatttctagcagaagcagtattattcacgggggctcaatgaattgcaatagagaacattcataaaagagctctaaaaattaaagcaaagaggcagataaaaacgttgacaactaagttcctgaaatttatagaatatgactctgcaatgtatgaaatacatatgaaaatattttgtttggtacattggtgcctcatattttttccttaccctaagaaagggtaggtttgttgtatagcagcacagattgatatggatatagaaagagaaaatatttttagttttagggtagacttgtttgtttgcttataccttagcaaagaaacatacttgaacaattgggagaaaag

SEQ ID NO: 196287 - DNA, 381 bp, Homo sapiens
attctacttcctaatgcttccgctacagtaacttcttcttgtcttatcacctcaaatccatgtttttggtgatgtgccattatcttgctttaagctcttcaatttcttccagtggctggtagaaaaaagtgaaaattccttcgtgtgacatttatgagccttgcctggttccagctatcattcatcatgccccacctcatggcctgtgccccagccaatcaaactgcctgtaattttctcagattacagtctgggtgaggcctgcaaggctgctagttcagcgctctctgttgtatcttcctttggtctctgatttcttttactctcccacctcccagaaaacttggtccaagaacagtgcttctctctttaaccttcgct

SEQ ID NO: 196288 - DNA, 302 bp, Homo sapiens
agtcccagctactcaggaggctgaggaaggagaattgcttgaacctgggaggcaaaagttgcggtgagctgagaacgcaccgctgcactccagcctgggcgacagagggagacgccacctcaaataaaaaagtctccagatattgtcagatgtctctttgggataaaattgcccctgattaagaatgactgtcttagggattctaattgctaaagggagaatggggcccaggattctatttttaccaagctcctcgggcaaatctggttcctttgtatgttctattggacctctcttcattt

SEQ ID NO: 196289 - DNA, 290 bp, Homo sapiens
cttggtgccaaaaaggttggggactgctgctatatagaatttaatattcttgcatgcattttctgaaccttctagtcacttgttaaatcccagttcagaacatcacattagatatatgatctgcactgtgctaggacgtgctccccaccaaaacgtcagcgtcttaagcttgtattcatatgaccataggaaaacctacatgcagaactttgatagtagttgttagaccaggtcaagatccatgtcaaagagataaattacaaattatcatctctctgcttaacggtctc

SEQ ID NO: 196290 - DNA, 376 bp, Homo sapiens
tcatcttcatctttttctaccagatctctcaattaatttatacaactccggctttgccctctttcctagttctgtttttatattagaacctcaatctgatgccatgactttatataaaatttataagctgaagaaagccaaatttaaatagatagatatagagacatatttatatcaacaaacagatatataagtatatagataatagatatacagacatatatttccaactcaactttctcaagcataatatctagcagcttgggaaattagtgttagatgcattatagcatccactttagtgttccttggatatgctaggtttcttaccatatctaggccctcaaatttgctttttatttttattattttttta

SEQ ID NO: 196291 - DNA, 462 bp, Homo sapiens
aaggaataatacgttccagccttcaggagcaggtgaacggatgcaaacgtatggtgagatggaaggaatatgttccaaccttcaggagcagagagctggaagagaaagtcatgttcccaacacaaagaaatcatgtctgaagcggtgggcatcccagcgaccctgatttgaacatcacacattgcatgcgtgtatgaaaacttcccataaatacggacagcgcgctggacaggtgagcaatactgcctgggctctgcagcttctggcctggtgcctacctggctgtgacaagcaggccaggacaggcgtcgcctctgaccagccctgcctgcgacgaaggccaccacccactccccaggacaacggaggtctcacagtgtccaccgcagctgtgccatgggaaccctgggggtcccgcaaaagaatattgtcaagaaatacagtgtgaattcctctgagaag

SEQ ID NO: 196292 - DNA, 451 bp, Homo sapiens
gagtaaaatcctgattggctgcccatgtcttaaccctcagaacacataatctattagctacggtctgactgccgtagaggcagaggcgaggctgaggacagaaggtaatccatcagaggcatctagcaatgcatggaacattgtttccccactaactagcagttactttatggccattatttgggatgtataaataacactgggataaactcctctgtattaatgtttccactccccttgtatcataaattatttactttgattacatgcccagaagtagaattactaggtcatagggcaaacatttttaaggctttttgttgagaaggagtctcgctctgtagccaggctggagtgcagtggcgcgatcttggctcacggcaacctccacctcctgggttcaagcaattctcctgcctcagcctcccaagtagctgggatttcaatcgtg

SEQ ID NO: 196293 - DNA, 679 bp, Homo sapiens
ggaataccatacaaggccaggcacaattcctcatgcttgtaatcccagcactttgggaggccgaggtgggtggatcacctgaggccaggaatgtttgagggtgtggaaagtgcatatgtatctattcattgtctgttggtgtgtaacacattaccctgaaaatagccacttaaatattatctcacagatttttgagagtcaggaatctgggagtagcttagctggatggttctggctcagagttcctaatgaagctataacaaaatgttagctggggctgcagtcatctgaaggcttgactggagctagaggatctgcttttcaagatgactcacttacatgactgctgaagacctcagttccttgctggttcttggcaggcaggtcttaattgttgaccatatgaacctctccataaggctttatgagtgtcctcatgatgtgactgctggcctctaccagtgacccaagggagagcaaggcggaagccaggatttcttttatattctaactcagaagtcactcagaacctcatattctgttagctgtgattctctaactccagccccacagtcaaggagaagagaattaggctccctattttcttcttttaagggaggagtatcaaaaagtttatggacaaattttagagccactgcagtctatttcagtggtagtg

SEQ ID NO: 196294 - DNA, 111 bp, Homo sapiens
ggactggatatcagaccaagattctgataaaaggggataacagagattaaccggagcagaaaaagtacttttctgagccagagataacaagagaaacttaaagaaagtgct

SEQ ID NO: 196295 - DNA, 844 bp, Homo sapiens
  misc_feature (42)..(42): n is a, c, g, or t
  misc_feature (45)..(45): n is a, c, g, or t
  misc_feature (48)..(49): n is a, c, g, or t
  misc_feature (53)..(53): n is a, c, g, or t
  misc_feature (57)..(58): n is a, c, g, or t
aaaaaaaaaaaaaaaaagaaaaaaaaaaacaggcaggagagncgnggnnaatnggcnnagggtgtctctctgtgtctctgtctctgcatgtgcctctttctggtctctctgtggggtgtgtactctttgggcttccctgctgtttctcatcatctccctgtctgcccgtgtccccctctgtgtcactctgcctctccccgtgtccccctctgtgtcaccctgcctctccttgtgtccccctctgtgtcaccctgcctctccctgcgctcttttggcctctgcatctctgagtctcttgtttctgtgtctccttgctccttctcccaacatgatatttggggagggggcaggtggaaggccaccctctttagacccctgtccttccaactaactgcataggctgaggtctgatgagaggcccaggctgcaccctacaccctttcattgccacagcctgggcccgcccctgacccctggctgagtgtgtggacgctcggacccctttcttcctccctccctcacctcccatcccccatcccttttccccctgagcctaggggccctagtcctgcaggctggggagctgtgggtttgaaggtggctccatttctgcctcctgccgcccctgcacagagccactgtaattacatgtggctgcggttcacctcttccccagtgctccggccggctccttgtcctcctcctgactgtagcccctccctgctcctcacccccaggttcctctgactcctctatcatcatcctctctgacccagtttctcccgtctccctccgcgctctgtatcacacagtgctaccttctctgtcgcctctgcccctgccc

SEQ ID NO: 196296 - DNA, 440 bp, Homo sapiens
tcaacgctaagcccttgaatgttcaaattcatgaaatggagtagttaccctggggcagaggtggtggtgagaaaacagaaatgtccaactgaaaataaataagccactcaggagttcctgcctctgccccagtattgagaatgggatagcttgcttcttctcaataaacagtgttatagaatgcatttcatactcaaggaggaaatagttataagagctaggatactaattttaagatctaaagatagcatagtttgtggtgaaaccttagaaaaatctaaatactttcagtaagccctttacattttatatgtagaccaatcattaatttatagcctttttttccatacacttggagcatataacaaacctaagaaagtttaaaagtattccaaagaaagcagaacttagctaggagaatttccctggtgagtcacctc

SEQ ID NO: 196297 - DNA, 762 bp, Homo sapiens
aaaacagatgaatgatttagtagacctgacaaatcaactaccagtcatgaagtgggaagagctgagaatcgatcctgttcagactgtgggactagaataaattctgtttagatggtgggacatatagaggcatctgaaatgtcaatcctagttcctcatgccaaataagaaggattgtgttaaagattcctgtaaagcagttaaatctctagcagttagatcacatttccccattccagtcactgagtaacctacctacccccttgaccctaacataagtctggagttttattttctgaagagcgcaaaaaggagggttattatatgagaggttctgccaacaaaatggaggtcatgggtaatatgggtagcaaaagtaagtaaccatctaaatattgaattctggttgattgttaaaatgctgtgatagtcatttgaaccaatcacaaatattttggttctccccttcttggacatatggtagaatttcaattctatttctgtttaaaattatgtgtagccatgtaatttcctttggctaataaaatgtgagaagtgacatatatccattctgggctgaagtttttggaggcacggtttaacacattttcttttcccactacagtgatcacggaagtatatgtgaagatggaatctccacaagtttagatccttgactgactgctgtgaggagggccccaggctgaactatataggatatatagtataagaaagaaatcaactttctttcttttttttttt

SEQ ID NO: 196298 - DNA, 579 bp, Homo sapiens
aattacacatgaatatatatcatactattgatacaaaatgtatatatattaatttaaaagatgtatgcagtagattataaactcctttcaagggactttttttttcttaaatcacataagtgagataggttaacaagttgcaattataacatctctatttggataattgttcaagaaatttaattacaggattttctgtatcacgaataatctattaactttgatgaagctatgaaggtttctttctatgactgtttgaaataggctttttgtttccatattacttgggggatgcctgcaataagtaaaattcagtgagatttagtcatttaacaaatatgttaattattactatgtacccagcacagttctagatgcccgagatatatcagtgaatgaaatagacaaaattccttgccctcctggagtttacagtctaatggtagattcagacaacaccctaacaaatgggttaaataatatgttagaatgtgtaagtgctatcaagaaaaataaagcaggctaagggggcttggccatgctaggataggagttagggtacaatatgagcaaagattt

SEQ ID NO: 196299 - DNA, 396 bp, Homo sapiens
ccattcatggtagcaaaaaagcacctgcaaaatcagtaaaggaaagaattgcagacagtcaagaacatatatcaactagctgaaagtgagaagatctagattcttatttgtgttggaccactaatgaccagtatgacttcgggcaagttacctgctgttccagagtctcagctgctacatttgtaaaattggtgtattggtctaatgcctctatggtgctttacaattctgtgatctgtgacttatactcactactaatataaggaacagggcacctacttttaaaagctgttattctttaaaaaggaggaaatggtttcacattgattatcagtgtttgatttttgcctcaataagaatattggaacaataaatgttaatttagagatggaatta

SEQ ID NO: 196300 - DNA, 121 bp, Homo sapiens
ccctaaagaagactcagggcttctgttcagtcatttgtgccatgtgagaagttaagtgctctatttcccatttattactatctaagtgtaacattcctatttttacccaaatgactggaaa

SEQ ID NO: 196301 - DNA, 493 bp, Homo sapiens
aggaccagtcttacaaacaggcccttctaaagattgtagcatcaggcctagctatgttaactctcaggtaaagctcctatgcctctttcccagttacaggctaccatattgccattctgtatttttgactctctgaaatgccatcttaacctttattatagcttaggtttcactggatcttaagatttttactttcctttctgattgtggcctcaatgaaggtcttcaaatgttagaaatagagaaaagtagatgtgcttttatataggtagtctttaaggaatggaatggcttctctctggacgtagaataaaaagaagccagagattctcttcctctgcccagtttaatgacagtcacagagcagtggcatttttcaaatgttttctttttctgtgacttttatatttacagttatttgtatatttctgcatatgtcttacagttaaatttttttatttttggttttagagcatttactgaggtttttaga

SEQ ID NO: 196302 - DNA, 182 bp, Homo sapiens
gcatgctggaggattcacttctaagtcacatcgagagggaaaggacatatactgaggcttgagagggatgaaagtgttcaaaggaggcagaggctgtggttgggggtattgagagagtgttttcaggatgcaggtatctgggttctacttacagcccacccccctccccgggaaacaatgag

SEQ ID NO: 196303 - DNA, 881 bp, Homo sapiens
gtatttagtagagaaagggtttcaccatgttgatcaggctggtctcaaactcctgacctcaggcgatccacccgccttggcctcccaacgtgctgggattacaggtgtgagccaccaagcctggccagtttgtatctttataatgaccccaccagatcagagaggcaggtgatattattcctgttctacaggtatgaaaactgagactcaaagtggtttaggtgtcttgcccaaaggcatatgtaaaggaagcgggaattgggtcttctgactccaagaccagctttctttttgctgttactgtgctgtctcacatttgttatacattccctgaagactcctgtgagggaaactttagaatttcatcaaagcaaatcctaaaggtacatgataaatttgttgtctgttttattgagtaaaaatctgtctagtcagcagtccatacgttaggtcagaggtctaaagtaattgtttactgggcttttttggatacattctgaggcatattaattctttcaggcttttttttttttttttttttgagtaaattactcttgaaagggttcttattggtaccctctagaggttcagaagagttaattggcttacaaaacatatgtggatcgaacttggggaatagttcagtcatctcttaacatctggatgtactgttttattattttaccattatgtatttgtatctgaaaactgcagccatttaaaaataaatatggtaagtaaacagtatgtatataattaagaataattcactgtagctcttcaagtttacagcactgttaaaaataacctggtgtatccatgtaacttatgaattcaatgaaatttaaataactgaaaaacaatttttacagtaacatgcc

SEQ ID NO: 196304 - DNA, 221 bp, Homo sapiens
tggtgctgtcaacagccagcatggagtgcccggggctatgtgtccagcatctttgatcttactggttttcagtctggttattgtaacagggactcgctggacataccgtcaccctctgtggtacacacgggccgtcaggggttttgtgtctgaggatgcagctgtcctaggttgctggaaatggaattgctgggtcagagagaacgtgcgcgtggtcaagc

SEQ ID NO: 196305 - DNA, 836 bp, Homo sapiens
acaactactgctaccatctggcgtgccattcagaggttgttgcacaccggcaaagttacccagtgcagagatgatgtgccaaaacttctctaatgtggtcttcacttagtacctcgtctaggttttggtcgagaggcagaggcggggtagtggcatgctgaactgagaagacctggcttggaatcctggctcttctagttggtaattggtgatcctggacaagcaaatgacttcttagaactaactttttcctcttctacatggggacacttagaaataccggaaggtttaagtgagagtaaagtgaaataacacgggaaaactcctgacgtgtggtaggtttattcatggtagcagtgctttgttgtaatactgaaggttctgaaaccgggacctccaaggcagcagtccaagctagaaagtgcgtgtgttgcactttgtacatacctcagtcttgctgcgcagatattgtagttatatgtcaatatgtcctggtggagtgtgagcctttcggggcaggcttttagcccctgcatcttctgtgtttagcacctagcaaaaagtgcctggcacatagaagctggtcaatcagtgttaaaagactgcaggagtaaatgagcgaatgtgttggcttttcatgtcctgccctctgagaatgatagtggaaatagaaaaggggtgatcatagcactcatcagcaataggtggggctcaatttgtttactaatctcacccatgtgtactttataaatctgtgcattttaaaagggacctttttaaaattacctttaaactttatatattcagtaataccacacacacaaaaaaacaagaga

SEQ ID NO: 196306 - DNA, 499 bp, Homo sapiens
actttgtcccctgggctggagtgcagtggcataatcacatctcactgcagccttcacctcccaggcacaagtgatcctcccacctcagcctcccaagtagctgggaccacacacaagtgcatgccaccacatccacctaattttgtattttttgtagagacgggttcttcctatgctgcttaggctggtcttgagctcctgggctcaagtgatcctcccaccttggcctcctaaagtgctcatattataggcatgagccaccacccccagcccatgattctatttttaatgtataaaaatgcaataacaggtataacaaaaaccctccttctgccctactttctcgtccctgaggtaatgctactgtgtgtttagtatacatgcttccagacttttccccatttacctacatacatatttacataaagcaaaatagatttgttgtgtggtttttaaagtcgacgcggccgcgaatttagtagtagtagtaggcggccgc

SEQ ID NO: 196307 - DNA, 442 bp, Homo sapiens
atatgtgtgattccacagtcctcttatcacgtgtacactcatcaaacaccacggcaatcaagataaagaactgtttcatcaccacaaagatctcctgcactcctatataatcaacctacccctttcgctctctgccattcctaaaccctgacaaccacaaatctgttctccatttctataattttgtcatttcaagagaaatgttacataaatggaaccacccaggatgtaaacttttgaggttggcttttcttccactcagcacaatgtccttgagacccatccaagttgttgatgtatcagtaacccactcccttttgttgctgagtagtattccgtggtatggatgtaccacgttttgtttaacgatttgcccattgaaggacatctgggtcattttcagttcttggctattgcaaataaatctgcttggaacatttgg

SEQ ID NO: 196308 - DNA, 270 bp, Homo sapiens
cttggcttcccccttgatggtgctgacaggcagacccctctgagggaaagagggctccaaagtgacaggtgttcatgggtccctgtggctgcatgttggaggaggacggggacagcaggtaagaggctgctgccgtagtgctggtggcagaagaagaaggatggaccaagatgagggcccagggtagcggtggggagagtgagatcctggaaatcttttggagatggagctactggacctgtgcattagaaggatgaggtgttcaaggct

SEQ ID NO: 196309 - DNA, 437 bp, Homo sapiens
tcaactttttctcatgggagttttggtaaattttcatgaattaaaacatgaatattcaggttaccacaagatggcgtcagatcatttcaagtaatgccaggtagggggagcctcagttcaataaatctttaaagaggttgaaatatgtgcctttcatagtatggtagttagctattgcaaataaacccctactttcttctactgttcttctatggaaacttgaggctcttggctgttcaactccaaaaattatgtaagtgtgaagtatttgagtttataatgtttaagaatttctctgatagcttagtgaagtaatcagaacttgaaaaatttgatcatcatgtctccctggtgtttacattttcaacgtcttttatagtttagttatctttctacaacttatgttgaatttgtaatattcagtcaatatatattta

SEQ ID NO: 196310 - DNA, 257 bp, Homo sapiens
caggatgcagctgcctttatctctttgtcaaagtatggctagatcaattcactagcttcctgtgtttacaaggcggaagaaatggcaacttggtgaaaaaggaaagtggccagacaaaagctggaggccagcattgatggctgggaaattaattaacaagagaaaatcagcaagtaatttttcttgagcaaatgtgctttgtctttgagcttttttttaaatgttatgttagttggttaattgccttcggacactga

SEQ ID NO: 196311 - DNA, 235 bp, Homo sapiens
agctttgctagattcacatgactcgcatttggcagagttgagattccagcctggatttctgcagtcttcagtgtcaaagcaaacctccagcccccataagctgccctcaaggtcagacactgataaaactgacaatacttcttgatcttttgccaacattgggattatcactcttttaattttaaatatcagcataaattgaacgttaaacatgaatctgtaaaaattatagttg

SEQ ID NO: 196312 - DNA, 762 bp, Homo sapiens
caggtttttacttccttaggaggacgtgctagcatcaccggtgttgtgggccttgagccgagggcctcaggactgtgatgaggctcagggccacagtaagagcagggtttcctgaacacaacactgcacttaaccacacctgggtgaaaatttcattttcttcacacaaagactgggctctaaagtgtccagtgttctatgagtctcgataaggtgaaataattctgttattgttgactcatagattttctgcttgcatgtatacctaaagactttttgcaattcttgccagggtatatattttttaagatacaaaactgtcttacaccccacagcaagctttaatcctgtgaggacaatctgtttctcctggcaacactaaggctactagatgaacaggggtcagccgggtagtttgaagagaagccttggtaatctgttagacaaagctgagaattctctaaagaatgtctagcaaagatacttcagtttgaagtgaatagaaagggttttgttcacaggccctgccttgctgctggattcaaagaatgtgcagcaccagaaaaggacatcaatgtccttcttgaaaatgaaacacacacgcgcacacacacacacacacacacacgtgtcttcttttctgcctgcattgagcattgcataactgtggaaaagttcatcacgcctgaaaatatgtatctttcctttgatccaaagcaagtgctatattggaataaagatgccatatcttccgcctttagt

SEQ ID NO: 196313 - DNA, 276 bp, Homo sapiens
ttcactggggcttaaatgttgttttacccttctttgtaacttcaagaacaccaagtttagtagtttgtgatccattaaaaaattaaagatgtaaatattagcttttcttaagtaccactctatgaaaaatgtagtcaaatgggatttaatttaattaacacccatggaaagaggcaaaatgtatcctgattagaatacaataaagtgatactgcatatcttaaaaatggatataccaattgaaagacaaggcttttagggcaaaaaactatataat

SEQ ID NO: 196314 - DNA, 673 bp, Homo sapiens
tgaggctgcctagattaccccggatggcgacatttcaatcatagtggcccagaatgagctccctcctcatgacttcttgacctcattttcttctactctccccaccctgctcattccattccagacacagtcctccttgccgtttctcaaaaccatcaatctctcaccttaaggcctttctttatactgactgtccctctgcctggaaccctcttctcccagatatccaaattgctaaccctcttactctttagaatctttgctcaaatgtcatcttctcaatgaggcctacctctgaccatctatttaaattttcaatctgcctttcttcctttatattcctacagcaatttcatcttctggtatagtatctaatcattatgcttattgtctatcatctctctctttcctgcttgcatgaaagtgttatgaaggcagaatctctgtgtctttttgtacaccaatgtatcccatgcgtctaaaacagggcttgtcacataatagatgcttaccaaatattaattgaatggaacgaatggattcaaaagcatgtaaagaatgtggcacttaaaatctaagaggaagttgtatgctaatgctatgagttttaacttccctttaaagtttttgcttgaaatggtcgccaatccgggtacgagctcaattctatctg

SEQ ID NO: 196315 - DNA, 557 bp, Homo sapiens
gagcatttcaagggatagtcacgtagaattagaattgtgaagatgataagtgagcaaagattctaaagagtaagagggttagcaattgggaaccctcttctcccagatatccaaattgctaaccctcttactctttagaatctttgctcaaatgtcatcttctcaatgaggcctacctctgaccatctatttaaattttcaatctgcctttcttcctttatattcctacagcaatttcatcttctggtatagtatctaatcattatgcttattgtctatcatctctctctttcctgcttgcatgaaagtgttatgaaggcagaatctctgtgtctttttgtacaccaatgtatcccatgcgtctaaaacagggcttgtcacataatagatgcttaccaaatattaattgaatggaacgaatggattcaaaagcatgtaaagaatgtggcacttaaaatctaagaggaagttgtatgctaatgctatgagttttaacttccctttaaagtttttgcttgaaatggtcgccaatccgggtacgagctcaattctatctg

SEQ ID NO: 196316 - DNA, 621 bp, Homo sapiens
aaaaaatcaccccaaaaaaagtgccaggcactggggtagaacacaatgagtaaaacagtttctattcttttgaggagcataatccattttgttatcatggtaacagctgacaaagcactttctcaaatgtattaactgatcatcctgtaaatacatattatgattccacgttgatgtgggagcctcctactttttgctatgccctttcttcctggtctttcttgttttctgtgataaatctgttctagggagggtcagatcccacccttccagacccaagaactgtctctacccaactatgatgttgagtctagacaagtacttacagagggccttacagatagtctaaattcacatcttcacccttctgttaaattgtttttacaaatacaaaaataatacatatttgttcctgatttttggcaccaaaaattataatacatagtctttaggaaaattcaaagatttagaagaataaagaaaagcatatgtagcatattagtgggggggggagaatgaaaagcaaaactctcacttcaccctaatcttcctctacttcccccaaaagtaaaccttctgaaatatatcctctcagacctcttttcatacatttataaaatg

SEQ ID NO: 196317 - DNA, 536 bp, Homo sapiens
caaatcattggtgttttgtggatctaattctgtagtttatgtgttttgctgtcactgttaccaggaatggcttgtttactgagcccatgttccttggatttttatctctgaaaaatctttagacctagatttaaagttcattcctcaagagagaatttgtatttgcatttttcagactgctgatactactaccaaactcagatcaccttaaaatttcagcttgattatctgggagtggggagggaacgctacataggtattgtggtttctagccctaaatcaggtagaatgcaaccattttattaggaatagacaggggacacatttgggggttcatttttttgtttatttttacccggagctaagactgagataggcaaatatactgacagttttgctctgtggagcacagtttctttctagttcacctattgagtatgttgtctttgcaagttcttggctttatgcaaaggccttggattacacacacacacacacacacacacacacacacacacacacacacacacacacac

SEQ ID NO: 196318 - DNA, 416 bp, Homo sapiens
tgctatccccaaactgccacacttaactcctgaagtaaacaaacaatcttggctggcaggactatgctgaatctccttaggcactctctaatcagatgtcctaggtcctcccaattcttagaccttttatacctgtttttctccttcttttattccatttagtttttcaattcatacaaaactgtatccaggccatcaccaatcattctataagacaaatgtttcttctaacaaccccacaatatcaccccttaccacaaaatcttccttcagcttaatctctcccactctaggttcccacgccgcccctaatcccgctcgaagcagccctgagaaacatcgtccattctctctccataccacccccaaaaattttcgccgccccaatacttcaacactattttgttttatttttc

SEQ ID NO: 196319 - DNA, 936 bp, Homo sapiens
aataaacagtggtgagatcatgtgaggtgaggtttttgtacttcattccaaatatgatgaaaagccataggggggttgagaacgagggaatgatgtaatctaactctggctacatgtggaaaataatctatagagggatggggcaaaatggaattgaggagactaagcaggggtggaggggagtggctgttgcattattccagggaagatctgatgtttgctttgaccatagaggtagctgtgaggtaaagaagttgtcagatttgggaatgttttgaaggttgaacctacaggatttattggagtgtgagagaacaagaaagactaaggtgaaatcaaggttttgccccaagcaactgggttaatgatgacttcgttgtttgagagcgggaacactggggcaggaacaggtttggaggaagaaattaagaatttggttttgtacataattttaagatgcccagtgaataaccaaatgaagatgttgagcagacagcaggatatacaagtctagaaataaccttatgggaaatattactgcatatttgtatgctgatggaatgatctaaaaaaagagggaaaaattgatgtttcaggagagatgatggcaggaggggaatccttaattaagcaagaagcgttcagattcaggatcaaatggaaaagtgagccttagatagccgtgtgggcaattcattctgtgcaataggagggaaggcagaggatatgggtacagatgcagatagactaatactttggtggtggaagagtgtagaagttctctcaagtactacttttttctcatcaaaaaagtctgaaaggttggtttaacattagaaaatcagttaatatactgtatcatagaacaaaggacaaaaaccacacgatatctaaatggacacagaaaaagcatttgagagaattcaatactccttc

SEQ ID NO: 196320 - DNA, 191 bp, Homo sapiens
tcaaaaaatattttcctaagaaatgttatttggcagtaagactatactatatactatagactacactgttattttggcgatacgactatactatatactatacgatttatacaatgaagcttatattctaacacctttccactggaaaatttaaacgccaaataaaaacttattggtattcaaaagatttg

SEQ ID NO: 196321 - DNA, 305 bp, Homo sapiens
tagagttcaacaccaaacaaaataaatcttaaatctgagacagctggccattaaattatgagtaaaattcatcatcagcttatattacctattatgtgaccttcctctgttcctgtggtaaaaacccttgggaacaatcaagtacaactatatatcaggggtgtccacactaaaaaaagaattgtctcgggtcacatataaaatacactaacattaatgacacccgatgagcttaaaaaaaattgcaaaaaaaatctaataatgtttcaaggaagttttcgaatttgtgttgggcgataacaacg

SEQ ID NO: 196322 - DNA, 326 bp, Homo sapiens
tattagttgggaatctgattttccaagtcttgtcatttaaacctgtatgacggtattgtgttcaagatatgaacagccaaggtaaaatacaatttcccatgactcaaagatcactcaaacatttgctcctgaatcttgaaaataaattgtatttcccctagaggataatcacagcaagtatcaacagcctggcactacaaaataaatcttgtagagtcattgctcatcacaggtgctggaatgtcaaatgggcaaaaacttgcttctctgatgtcttatcttgactgatttctagaacataatgttacgacaaagctctaatgacc

SEQ ID NO: 196323 - DNA, 156 bp, Homo sapiens
atactgttatagataggaggaataagtttcaatgtttcatagcagtgtagggtgactatatagttaaaaacaacgtatttatatttccgaatagctagaagacaggtcttgaaacattcccaacacatataaataaatacttaaggtgatggatac

SEQ ID NO: 196324 - DNA, 693 bp, Homo sapiens
gaatgcatactatatgactgcatgtttatgaaattctagaagaggcaaatctaatctagtgatgagaatcaaaatggcagaacattccctgggggaagaggactgactagggaaaagaaccaagactttccaaagtgataaaatctatatatacgtatctcattgccaccacagccaaaaaggaatcaatttctttgcatcagtattttcgcagtgcttccctatccctgtacaccaggtgattttggtggacttaagtaagggttgaaaaagaatctctcaactagagatttttagaatctctaagttttgtcaccaagcacgatttgtctttaattttaccaataggaactaaaatatgcctaagtgaagtagttccttacataaatttaaaatgaaacaacaaataatgccactattttatactcgaaagaatgtaaaagattgctattagtactaaaaaaagcatttctgtctctggataaacttgcaggcttgttggctggctgaagaatgcataagtactatgcttctaatttttgcctcggctgtcaagaagttcagagccaaattcagtgctcagtttagtgattaatatcccagctgcctgatatatcaatttttcttgattaggtagggtatacaaggtggggtattaaattatcctgtttcatactgtaaactacctcaaat

SEQ ID NO: 196325 - DNA, 696 bp, Homo sapiens
gaatgcatactatatgactgcatgtttatgaaattctagaagaggcaaatctaatctagtgatgagaatcaaaatggcagaacattccctgggggaagaggactgactagggaaaagaaccaagactttccaaagtgataaaatctatatatacgtatctcattgccaccacagccaaaaaggaatcaatttctttgcatcagtattttcgcagtgcttccctatccctgtacaccaggtgattttggtggacttaagtaagggttgaaaaagaatctctcaactagagatttttagaatctctaagttttgtcaccaagcacgatttgtctttaattttaccaataggaactaaaatatgcctaagtgaagtagttccttacataaatttaaaatgaaacaacaaataatgccactattttatactcgaaagaatgtaaaagattgctattagtactaaaaaaagcatttctgtctctggataaacttgcacggggtgttgcccagtctgagagcatgcaaaaggacgaggcagtgccagctggacggcctgcagatgagagctttagaggatcactccaagtgcgtactagaaatagccattatgagggccagcagcacggatatagccagttgtgtggcattaggtatgtactatgtcacgctcgcgaggtatctaatgatcctgttataaga

SEQ ID NO: 196326 - DNA, 472 bp, Homo sapiens
tcaacaacaaaaagactaaatttaaaaatgggtaaaggacttatatagacatttctccaaagatatacagataaccaaaagcacatgaaaagatgctcaacatcattagccattagggaaatgcaaatcaaaacaataatgaagtaccacttcacacccactagcatgactataaaaaaaacagaaaataagtactggttagcatgtagaaaagttataaatctcacgcactcctggtgggaatgtaaaatggttcaatgcagtagaaacaagtttcatgactactcaaaaagttaaatatagaatttaccatatgatcaagcaattccactcccaggtccataacaaaaagaatttaaaacaggtattcaaagaaacacatgttcatagcagcactgtttactattgccaaaagacagaaacaataaaatgcccatcaagaaatgaatggaggctgtcatggcagctcaca

SEQ ID NO: 196327 - DNA, 644 bp, Homo sapiens
attataaatagtatcataggctgggagtggtggcttatgcctgtaatcccagcactttgggaggccgaggcgggcagatcacttgaggtcaggagtttgacaccagcctggccaacgtggtgaaacccagtctctagtaaaaatacaaaaattagccgggcatgatggcgcacacctgattcaggagaatagcttgaacctggaaggtgggggttgcagtgagccaagatcgcaccacttcactcccttctgggtgacagagtgcaactttgtctcaaaaaagtaaatgaataaataaatagtatcatttaaaaattttgttttctaattgtttattgagagtatatagaaataaaatggctccatgctgaaacccatttctccacctctttcacccaacaaactctaaagtcattgatttattcatttacatgctcattttaaagcctctcatttattaatttacatggcataatctctcctaatatattgccctagtattttaccctaactagtcttctaactattatcttagcctctggcttaatatacctctaatccatctttgtaaaagcccaaacttatcatgtcactcccttgatttagaaacttccataatctacagataaaactctttaacgtgc

SEQ ID NO: 196328 - DNA, 244 bp, Homo sapiens
gaataatccatttcatacagaaaacattctattccatggtcacaaactctacccttacatgagttacgatcttgcagatgattaaacattgggccctgggatggctttgtatgaaagtgtggagagagtatacagaaagtcctaggtaaaacctcacctctagttggggcaaaacaacccaaagtgtgtatttagctgcagataggtcaaggaaatttatcatgggttaaattatgtgcccttt

SEQ ID NO: 196329 - DNA, 442 bp, Homo sapiens
ttgtttcatgttcctgagaaggcactttttttcttgctggtttcaatgtttcctctttgtttcaaaaatttgattatatctcagtatggttctttttgagttcagcatgcttggaatttgttgagcatctcagaagcgtagatttatatttcccataaaatgtgggcagtgttctaccattatttcttcaaataagctatctccttttctctctttctttgtgtctcttcatcttgctctctttgttttgctcctctgagactctgaaaatatgtatgttagtctgcttgatagtgcaccacagccccccttatactttgtttacttttattcattattttttcttactgctcctgggattgggcactttcaattgccctatctttaagttcacttgttcttctgcctgctccaatttgctgttgaaaccatctagtgaaat

SEQ ID NO: 196330 - DNA, 771 bp, Homo sapiens
gaggttcaactccagacctaggccagctgaaggtcaatgacaagggcaagatgctctctgcagtcaacatcacacacttgtctcaatagaaggaaggaatttatataaaataagaagtggaaagagaataacatctgtgacagtgagatgacatttccacccgattctgattccatctaatagccagtgcaggtgtgggggagggaggagggagacagggtggttggggctggaataaatgttttcagcagaaccatgcctcagatggctctcagaactcagcctagaaggcaagccagttcagaggcacagggagacttatggagacgacataaatgaacagaaaataaactgtacatttggcaagactggcactgtaagtctgtgctgtgatgaacagagatgtcaaacatgccccatgcctgccaggtgtcatgtttccaaaatccctttctctgtcagagtttgcagaggaatgagctgggctttctaattcctgttactggtaatggatcacatttgtagagtacttactatgcaccaggcaccatgctgagaggtttactatctactactccccataatcctcacattgctcttgagagagagagggatggagctcatttacctcaagcgatggagaatcccgaggagtcttcattctccccttgactgcacatctgtgcatctagttaaggaccaggacacaatgggaagagttccaaagccaactgaccaccaaataagtctgagcatgatgtgctcctgagg

SEQ ID NO: 196331 - DNA, 297 bp, Homo sapiens
tggtggccgccgcctccacagcctgggcctcgccgcgatgccggagaagaggcccttcgagcggctgcctgccgatgtctcccccatcaactgcagcctttgcctcaagcccgacttgctggacttcaccttcgagggcaagctggaggccgccgccctaggtgcaggcaggcgaataatccagcattgtgctgcaattgtgctagatatagatattcatcacagctacatatgcacccagaaggcagattgcaagaaatacatgcatacaggcatttacctcatcagaatgacaga

SEQ ID NO: 196332 - DNA, 307 bp, Homo sapiens
agaagttctagaccagccttggcaaaacactctctcaacaacaacaaaaatacaaaaaattacctgggcatagtggtgtgcgcctgtggtcccagctactccagaggttgaggtgggaggattgcttgagcccaggaggttgaggctgcaatgaaccgtgttcgcaccactgaactccagcctgggcgacttgtgtgtgtgtgtgtttgtttgtatgtatgtatgtatgtatgtatgtatgtatgtataaaaaacctcctgtaattggttttaagtaaacttcaagtttgacaaatgttattatgcc

SEQ ID NO: 196333 - DNA, 336 bp, Homo sapiens
actgagacactgggtgtatcaagcttgaaagagatcttgcaggtaattgagtttcatctgatacttgacttccttctctacttggcccttgaatagccacttgttcctccaatgtcctagagtacattccactgctatcagtgctggctgttaggacagtggttagggcagatggcctgaagccatccccactgtgatctttacccatttgtcctgattttgccttctcatgccacctggcacaagtaggatccttctttctcaggaaaacccttcacagtcccctgactgttttctttccaggctgggcactccctgttccttcaattactgctt

SEQ ID NO: 196334 - DNA, 208 bp, Homo sapiens
gcccaagcagatcatggagacacgcggcagagctgagcaaatttgaggggaagtgggggaagcctgggtgagtgttttcctgagaaagaaggatccttctcatgccacctggcacaagtaggatccttctttctcaggaaaacccttcacagtcccctgactgttttctttccaggctgggcactccctgttccttcaattactgctt

SEQ ID NO: 196335 - DNA, 689 bp, Homo sapiens
cataggagagtgtgaagatacaagatagcaacttgatatataactcacatcaagaaaactttcaccagcgtttaagggaaaggagttgtagatgtgggtcatttaatacccacttccaaattcactgaagtggacagcgccctacacacaaggctagagtgcagtggtgcgatctcggctcactacaactcctacctcctgagttcaagcgattctcctgcctcagcctcccgagtagccaggactacagtgtcgaggtcatgaaagccactgaaagactgagaactgttccagaaaggagactagagagacatggcagccaaatgctccacataatcctgtcctggattcttctcctacaaaggaaggggtctgaggattaggtggtagtactgaatcaaggaactatcatctcctattgtgctgtaggcaaacttgagtgacatggtggaagccaccagagagaatatctgaagcaattcattaaaatcttggcagccagaccccagctcccactttccctgaaagctccctttaatgaagctgaacgctgtcccagcaattccctccacagaagacctactgtcaccacctctggaggggcaattcctggaggaaccaagtcagccaatcgaaggtcctgaataagcaaaaactaagtaaataaataccatctcgaaagtgatggg

SEQ ID NO: 196336 - DNA, 117 bp, Homo sapiens
gggcagatagctctgtgggagatatgggtttagtgtgagattgctctagaaaagaaataaacaccttaactagggccatggtagccggaatggagaagtaggatggatgtaatattt

SEQ ID NO: 196337 - DNA, 428 bp, Homo sapiens
cagttaggaggctggtgtaatattctaggagagacatgatggtggtttggagctagtagtaggagtgcaggtggtgagaagtgctccgattctgggaatattttgaaacttgaaccaagaggatttcctgctgtattgaatgtggtgtttgagggcaaataaataaatttttaaaaatgagtcaagggtgactccagagtttttagtttcagccatgggaaggatggcattgccaatagtaaaatgagcaaagaacaggtttgtggacaaagaaaaggaattcgattgtggaatggtaagtctgagaggagatggggtattcaaatgtaggtgttgagcagcagttgaatcggtgacgccgggttcaggggagaggttcttcatggaaatataaatatggaagtcatctatgtatctaaaagcaatga

SEQ ID NO: 196338 - DNA, 604 bp, Homo sapiens
gtccagggcaccaggcacaagcatccctgtcctctccctgtggagccacaatggctgtgcttagttcctccagcaaagtgacgtgacggcacagtgagacgtcgcccaccagggaagcccacggagactcagcgcccagcgactagggggctggtcacgggggcacctctgcttggcgcgcacagacattccaggaccccagaaggaaacgggctcaggataccacgtggtttccacaggagtttagacacaggagctcctcgctattgagggaggttgtgtgtctccacagggaactgctgcagccagattccaagacaccagccaagggcaccctcaccagcaggcctttcccaggaccaccgtctcaggcccgccaggtcactctttctgggcactttctcaggaggttgctccagggcaggatggaagcacagagagtccggggttgtcacattatgctggctgagtgtttagacctctagagaggagagcacaaaagcggaacaggaagcccagaactcctcccggcagaaacaccaactcacaacagcaaggcccagaagcctttctgaggcagctacaaagttctgcgaattgatac

SEQ ID NO: 196339 - DNA, 411 bp, Homo sapiens
aaaaccatatgtaaggttaactcgggaatggaaaagccaagtactaaagatcacaaagctgttttgccttttgtggttctgggaatgccttggaagaggttggcttctgaaatgaagaaagatcagaaaatgaaggtgtagtgatacctgttaatgagtaatttaacttttctgtctgtgctaccttgaggaatgtagtcatattttgagaaacctgaggcaacattagtttcttgggattctttgatttagctaatttcagttatgatacactgcctttttacctactatatttcatttatctctgaaaaatagaaatttttttcttgactttattatggggcacatgatacttctagtagtattttcatttaaaatatgtctaatttctttgattatttgtcttttaag

SEQ ID NO: 196340 - DNA, 790 bp, Homo sapiens
gcctaccagtggtcttttcaaatgtaaatctgatccacctccacttaaaaattcatcattgctgctcattgcttttaggataaagactcagttgaacccagtcatctccagtgtagtcccagtcactcatattgatctttcatttctcccatgggccatccacctccctgacacaaggcttttgcacatgttccttttatttatacctgctatttccagacattgttttggtgctggggatatgacagtgaacaaagcaggcaaacattcctgccattctagagctcactttctcgtggttgctttttggttggaatgttcttgacctttttattttgttttgttttgtttttgtgtttttgtgtttgttttttcatagggagtttaggatttatttatttattttagaataacagctttattgagatataatgcacacacattaaaactcataaaattcacccatttaaaatgtgcagttcaatttaggatattcagagttgtaggccaggtgtggtggctcacacctgtaatcctggcactttgggaggccgaggtgggtggatcacttgaggtcaggagttcgaaaccagcctagccaacatggtgaaaccccgtctctactaaaaatacaaaaaaattagccaggtatggtggcgggtgcctgtaatcccagctacttgggaggttaaggcaggagaattgcttgaacccgggaggcgaaggttgcagtgagccgagatcgcgccactgtactctagcctggatgacagagtgagacttggtctca

SEQ ID NO: 196341 - DNA, 290 bp, Homo sapiens
cattaattaaatacagaagactctaaatgaaagcattttttgatggtagaaggaggttatcagatgctaaaggtagaggcaatcaggagattaaaaacgagaacaagagcgagacggagagaaagcgaagaaaaatgaagtagggaagtgctatagtttggatgtttgtccttccaaacctcatgttgaaatctgatccctaatgttgtaggtggagcctaatggggggtctttgggtcatggggatagatttgtcacgaatagattaatgcccttcctggggggagctg

SEQ ID NO: 196342 - DNA, 331 bp, Homo sapiens
ctgttaatgaatgctgatgcagtctaagacctctctagtgttaatcgttgtaagtatcaaatagtctaaagggcatttcaaattatagtatctttaaagcagaactcttgatttctgtctcccctagaggctagtccttttccaatgggtaagtagcactaacaaaccagatgtttgcacaagccccaagccccgaagcatcctagatccctctctttaacagtacctgtccccagtccaggctggcgggaggtcttgtcagctccaccctctgctgtgtcacatgtcataagcccacagctctgtccccctgctagcatcctgtgtcaag

SEQ ID NO: 196343 - DNA, 142 bp, Homo sapiens
ttataggtaaggaaagttattttcagatgggctaagtaacttgcccaaggccacatagtgatggagcgcatccgtctgacagcacagcccatgctcctgtctgcaagtcaccatcagtggctctttgaaagcaaagtgagga

SEQ ID NO: 196344 - DNA, 524 bp, Homo sapiens
caatggtaggcctgtgaccaacaaatgaccccatgtgggctatgagcctacatggagaacaaacacccactagtcctgagaaacttcagataagaaagggagtatgctgtggaacttctcaaacctcgagaatctggccagttctctaggtttcagaacatcctgagacacacaaagtaaaaccttaagcattattgattaaactttcagagctgcacatttgcacgttagctgttaattttagctagggtgagcaacacccttgttgactattgctcctagggacaccatgttccattaaccatccccagaactccctgaaggtaaagcccccgtggctgtccttcagaccttgtggttcgctctggtaatataagctgggaccctccaattgctctctgaagtctcacccatggagtggacacactgccggggacctgttccaactaggactccagatgtctgtatccaggacttcccagcactgcttgatctgggtgtaggtattctccccagtttgttga

SEQ ID NO: 196345 - DNA, 391 bp, Homo sapiens
gactccaaatatagggccccgcagaagagctctgcctgggaggcagagatttcaaatgttgaattttccttgtttcagaatacctcctttaatgcagtgaagttttggtaatgtttcatagaaaaaataaaaggtgtagcacagacagatatgtcaagattacttacatggtggctataataaaaagtaataactaagatatataatgagtatttcctataaatcagaaaatatgcaaaagatcagaaaatatgcaaaaggtctgaaaatatgcaaagattccccaaccatgaccctctaagaaagtttcttctctgctctgcgtttctttccatgtgtaagacaggggtgttagggctgggagcaatggttcacacctgtcatcccagca

SEQ ID NO: 196346 - DNA, 460 bp, Homo sapiens
aagccgtcccttttcaaaatgtcatcttgccatgaaagcttcttcaattcgttacctagaagtgcaaatgtattgaaagttttactcattaaataagattattttgaagctaaaggccaaagatcctacttactttggagaacagtgttgaatccagcccaatctctcctttcagcccaggcatgttttagtactgggatgttttctatctttttaagtgtcctgtgctctgtttacactatattaatctgctcatttaaattggtgttttgttttaatgtttggccagagtttatgcactgccactttggagagaatctaagattcattcattcattcattcattcactcactcaacaaagcatttgttgacagcctgttggcatgggagacccttgcaattggcaccaagaatacaagaatgagaaagggactcaacttgcacccaaatgctcacagt

SEQ ID NO: 196347 - DNA, 497 bp, Homo sapiens
tgttgttgcttttatgcttagtgcaaaaaaagtctcagagattctgtactgcgttattttatttatataacattctcaaaatgacaaaacggtagggatggagaacagattagtggttgacagggtccaaggggatagagagtgcaaagataaaggggtagcattagggaagttcctttggtggtggttacacaaatctatacatctgtattgcgtagagctacacacacacacaaagcatgcatgtaaaaagtgaaaactgaacaaggttgacagtctggttaatagtattgtaccaatgacaatttcctctgtatactattttgcaatttcatatggatctataattatgtcaaaataaaaggagtttgaaaattgttaatttattggccgggtgtggtggctcacgcctgtagtcccagcactttgggaggccaagatgggtggatcacttgaggtggcacgcctgggcaacatggcgaaacaccatctctact

SEQ ID NO: 196348 - DNA, 861 bp, Homo sapiens
  misc_feature (789)..(789): n is a, c, g, or t
  misc_feature (792)..(793): n is a, c, g, or t
  misc_feature (797)..(797): n is a, c, g, or t
  misc_feature (801)..(801): n is a, c, g, or t
  misc_feature (806)..(806): n is a, c, g, or t
gggggggggggggggccggaggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacacaggggcactggcatcgtctccgcacctgtgcctaagaagctgctcatgatggctggtatcgatgactgctacacctcagtccggggctgcactgccaccctgggcaacttcgccaaggccacctttgatgccatttctaagactacagctacctgacccccaactctggaaggagactgattcaccaaggttccctatcaggagtcantgnncacntgtnaaganccaacagagtctcgtgcgcggactcagtccattgtggtacaatagggtctaacac

SEQ ID NO: 196349 - DNA, 708 bp, Homo sapiens
ggccccaaagcactgcgaggcgctgtgtagagggactcagactccgtgtcgcaggaatgaatgagtgagtgagggtgcaagcactggcctgagcctggcttccacctgggggtatggcgggggccacaccacaggatccagggaaggtatggggtacagtgtagggcccggttctgagcaggtgctcacggccagccccaggtacaggagcagtacctgggatcccagattcttaggtcaggtgcctggcaagggactgtgtggctgggaggatgtgggttcaaggctgtggcaccccacgagctggaagcactccggccactctagtgccgtgacagatttgagctccactcttggagcttgtcacagttcacattggggacgcctgtcgcttagtcccatgaagagcagtttgggtgccccatgcagtgggctctgcagggtgagggggagggcataccctccctgaaaggccttgggcacgaggcaggcaggcagctgggctgcagagcagagcccgggaggggtgggcagaggaagggcaggctgggcgccctgcaccacaggccaggctgggccgctggggccttgggcagcctctttgtgtttccctgtgggcctggtaggagagctggggccatgttgctgcccagagcacctgctggctggcacaccccctgccctgtgggtataattagcactgtgaca

SEQ ID NO: 196350 - DNA, 499 bp, Homo sapiens
taatgctctgctgttactgctttgaaattcttaatgtattgaacaagaggtttgccaagcatgtagctggccaacccagagggcaagggtttctggtttctgtggtgctcagctctgaaaggatgggtggaaggggaaacgttgggagaatttgcagtctgttcctcaccatgtgatcatgatccttgggagatatgtgacagtcttccctgggatttgtggttcttccagcagacttgggtaatttctttgccaacatctgtcagcatcaatgaagttagcttggtctgggaaatgttttgtttttgttttcaactgtgataaaatacacataacaaaatttaccatcttaatcaattttaagtatacagttcagtaatgttaaataccttcacattgttgtgcagacattaccaccatccatctccagaactttttcatcttcttttagtaaaactttgtacccattaaacaataacttctcattttctccttccct

SEQ ID NO: 196351 - DNA, 450 bp, Homo sapiens
taggcatgtttactggaaaagtaaataataatttcaaatttaaactacaaaaatatgatcatattttctctcatatttaatttgaagaacaaaacaactttctgaaaaagtgagaggtatatccaaagagtctcagttctaaatccttttcgagatttatgctttagctttgctagcctgcaagtgtctttaagatttagtcattgcttcaatcattctaccatgtgcagagtacttggaagagagggatgcataaaacaaggtcagccatattgaagaaggttagagacttttggcggaacccaaagtaagaaaaaacaataatggcacataaggcaaatggaagagagggcagaggccagaatctaagcatttttaaagaagaattcagtacttctttaagtgaaaaactgtaaccatatcttttgtttgtcaaatatttaagagtta

SEQ ID NO: 196352 - DNA, 746 bp, Homo sapiens
tttgtttgttttggctacctatcttaatcatattttgccttggtagaatttcttacaaaaatatatcgtggctgtcatgagaatgtgcctggaagacctttaaccatgagagcataactgaccatcggcctcagctgctgggctctgaaatccatcactgtgtttgtggtgaggccacgtaccaacaactggtcatggcaaagatactaaggctcattcctgtcctatgtcagttgacactggctccaggacccccaatgccctagctgaacactccttaactgcatggcagcctagaatatgtccaactaccttttctccctctttccttcactcagatcagccttgcatcatgatctgatgacttgcccagccttgtccatctctctccccattttctgccacaggcatctcccctaataatagccttgcacatttaatcccatcttagcatctggttcttggagcatacacttctctctgcaaccaaactctgttcccttctttgttccacatcctcttttcatggcagataaaatcagctctgggctcagtgcatacggagcaaagtctgacagcaagaatggtcatgggccactgaggataacaggtttgcttgctggagcgtgtaatggagtctccacgatgcctcattggcaaagatcacctctgtatttcagcaggattggagtctgaacattcctgccttgattgcacaatgtcatggtttcattcatagggactta

SEQ ID NO: 196353 - DNA, 758 bp, Homo sapiens
acagcacaaaaacctcctgactacacatctatttgtaagaaactttgcttaatcccagatgagatcaatccacaaatacttataatctagaaaagggaaaatgaactaatatccattcatcaaaatggcttgtatataactcaattactaccttatacctcaaggtagaaggaacctgattcacaagatttctcatgtaaccttacgatatacaattgggtaggatatgggccatctctttgaaaacgatgaaaagtgagtgggtgctaccctatgtatcaagaacatattatgacttttccccttctttaacaaaaatgtctgtaaaccataccaaatgtccatagtttaggtattaagttttggtttaaatgagatagtgaacaggggtgactttattacaatatgaacaatctggctagaaaaatctgtcattttttagacttatctctgttaagatcacgcagtcaaaccaacagtagtaattagatcctttctcactgacttagctaaagctaatgagaaatacacaccccatttttgcacaagccttggaggagacagatcggctagaagacagtctgagatatggagaggagaggggagaaaaagtatttaaacaagcctgcacctaagatccacactcagactgcagacatcctggtcaggtgacagctcaggccacccaaaacatggcggaaaggaataggaaccttccttggggaagggaataggatgggggaaagggataggaatgg

SEQ ID NO: 196354 - DNA, 475 bp, Homo sapiens
gaaaaggaagcataccccaagtcaaaagggaagcatctgatatcttcagccattttcgtagtcaaatattgtctttttctttaaattttttttctattttcactggttatagtattaaatctgcctttaactttttctgtttttgcttttacatggaagttttacacttttagtaatatttttattttcaataaactatatttgagggattctctacttttaaatttttaattattttgttttttaaaaaattaaggaatacttctcataaataattttaaagtacataaatctcaataaatttttgcatacgtatacacccctgtagccaccacctagatcaagatacagacaatttttagcaccctgcgaggctccctccctgtcagtaccctcaccatcacctagaccctcatccctgtgtaaccattttcctgacatctgtttccatttgtgacttttacctgtttgatga

SEQ ID NO: 196355 - DNA, 514 bp, Homo sapiens
ctgaggaccgattatgccacacacatcttatacagagctgagtgcagagacagatgattattttagggtaatggagttgcctcaggctcttggttcacttactggttaaaccattgtctgcagctatcagttgagggattgcagttgataaaatggctggagaggttaaggtaaggaaaatactgtttactcttcacttttcagtctagtaagtaaaaacaataacctggttgtaattatagtgttggggataacatctgtcaacttaagcataaatcaggcaacgacacaaaattgtaccagtagtcactgcattgcttcttgccatgcatttgcactaaaagaactagtccttagccaggcttggtggcttagacctctaatcccagcaacttgagaggccgagatgggaggatgtgcttgagcccaggtaccatatctgaataaccagagattgttgtatcagttgttttttgtttgtttgtttgttttttgagactgagatctatggaag

SEQ ID NO: 196356 - DNA, 312 bp, Homo sapiens
gtaggtttattaattggcctaatttcaatgttatgtctcagataatagggtggcccaaaaagaggaagagagatgggggaatagtctcttggtagagctatagaacacataccacatttattaagttcactatcttatatggacatggtttatgataccccagaacagttacagtagtaacatcaaagatcactgattccagatcatcataacaaatataataataatgaaaaagttggagatattgtgagatttaccaaaatgtgacacagaaacacaaagcaagcacatgctgttggaaaaatggtgcca

SEQ ID NO: 196357 - DNA, 518 bp, Homo sapiens
ccttttcctcccaaagttctccctcttggagctcacttctttctgttctaattcttactaatgcttttaaaaatgacatcttttctgtgattcgctccaattgatatacttcttatagaaacacattatggctttcttcttaactttatgtcatttagacagctatggtggcattaacaagccacatttgtagctagtttcttgttttggaacatacattgtgtagtcattgaaattatccacaaaggaaatggtgctcttaggaaagtactcccattatccaaaatagaaccatattaaggaataatttggccttttacttttggcttgacacattgcaaatgttcacggaatagtagtatttttagaacttgaagtgaccgttagagtccatctaggccaactctcttcaaagattggtagattaagggacaaagaagctaagtgatttgcctaagggtcatacacctgtttgaagacagaactgagactaatctccagatactctcactcctagt

SEQ ID NO: 196358 - DNA, 573 bp, Homo sapiens
tcagcatttctgagggtttgtgggtttgagtcaacattatgctatcaccttttagtgcacttaataattaagcttacagtaggtagcagacaatggcatcgagctgggtgtggcttcagagccagccgagtcctttcttgaagctctacaaaagcctctatgatatttctccccaccttggaaatttttaaatagtttaaacatttaagcagattttaatgttttttatttaaaaaatggaaggaataaaaaggccacagtagaatcttcaggaaagacagtggttgcagttctgtacatgtgaaagtcaaaaagtggctaagaaaaagatgctccgcctgccactactaaaaagaaaaaacgtttgccataagccaccatgactcagagttcacagatgggaagaaacagataaattagagcaaagttcctgaaaatgttctgtgactgatactgcttcctgtaagtgactggaaagagctagtgctgatttgagtagacattggttcttctagaagagccagaaggtttcacatggatttttttaatgttggaaaaaccaggcaggagaac

SEQ ID NO: 196359 - DNA, 248 bp, Homo sapiens
catcttcatattctcctgaacactgcatatgtgaatgaacaaagcacattttgatgatatcgtatttcctttataaaaaggatcacctttctgattcattatttttgtatttcctccatatcactttcagacaacatcacctctccccattgcttctgtcttgggctccatatttaactagctgctactttctggtgaattttttccaagttcttctctctccaataataaacatgtcttgtaccccc

SEQ ID NO: 196360 - DNA, 539 bp, Homo sapiens
tgtcttcttggtgatggtcctaggcctggaagttcaggtgtctgggggttctgttcccagttctgaattgatctttttctcattattcaatgttcctgtttatccctggcaggtgagaattgccagtaagaagttatagcactgtctgattctcattccactgtaggtagcgaccctttattttcctccctagaagtttgtaggaatgtcatattttctactttttcttagtgttctgaaatctgatggtggatgtgagtgtgcgcttcctttgcacattgagctcattgctctggagacccctccagactgaagcagcttccacttcaagaaggtattttattacctccttgacaattccatcgcttcctctttcagttcagcctttctggatttcctctattagaccatttacgttctccccatttgtcacttattctttctcaagatttttttctttgccttcttgctctgtattctgggaaatgtccttaacttccaacctgtctatgtaagttattattttgtcaatcacactg

SEQ ID NO: 196361 - DNA, 519 bp, Homo sapiens
atcagcatgtgtgttcacttattcacaacgtggcactacttgttttggttcataagtattcccataaaatagatatctagaaatgcaatcagcttttaattttgggagatattgttaaattaccctccccaaatgtaccatttatcttcaataatggataagactgcttgttacccatatgtaaaacaatactatttgtggaaaaaaaggatacattatattctacttaatttgcatttttctgaatataataagagctgagtggtattgactattagtattttttcttctgctcctttgtattttttgcctactttcgacttgctttaaaaaatatttttctattgatttataggaactctatattatggatattaagtctttgtatcaaatattttattctagcctgtcacatatattttaatttatattctattgcaatttaaaattttttatgcgatgagacttgttagtattttcctttatggcttcttttataaaaacaatctttctttggat

SEQ ID NO: 196362 - DNA, 415 bp, Homo sapiens
gaaactggcagggtctagtgtaacaaatgacatgaggaagtggggggctctggtgacagatttgcaatttgtgacagtgaaagaatcttagagctacttatagaaaaatgggatatttaagggaggatttaaaatcaagagaaggcagcaagtaactaacagttcatcactgtctacctttctgattcctacaaggattgattgagccagagtattgtgggtagagatgattgacaaatagtcgtcatcaccactctgaggacactgaagcaagaatgtagcaacaagcagaggggccataaatatacgcttaagaaaaaggttgtattctgcttatacgtccagttcccagcacacagcagatattcaatatataaacgaatgaatgactgtcttctgtcagcaagaaatcaag

SEQ ID NO: 196363 - DNA, 131 bp, Homo sapiens
gatgcaataatttatctgataatttataatgtatactgtatcatagtattgttcaataaaatattcaccaagaactgaaatttctataatccatgcttcccaatatagcagccatgagccacatggaacta

SEQ ID NO: 196364 - DNA, 411 bp, Homo sapiens
cgagggatctaggctgtgtgctccttatgagaatctaatgcctgatgatctgtcactgtctcctatcacccccagatgggaccatctagttgcaggaaaataagttcagggttcccactgattctacatcatggtgagttgtataattatttcattatacattacaatgcaataacagaaataaagtggagaataaatgtaatgagcttgaatcatcccaaaaccatcctctactccagtccgcagaaaaactgttgtctataaaaccagtcccaggtgctaaaaaggttggggactgctgatttagaggactactagcagaaaagacattagcaccagcagcctcaacagttgttaccactgtccagtactggcacagaatccagcagtagcaacaggaacaaattggtc

SEQ ID NO: 196365 - DNA, 677 bp, Homo sapiens
gcatgttagcacaaaactaaatgctgaattatttgcatgggagtgggttactgtgagattaaagaaaaaaatctcgtatttatgcttcaagcagcatagctctttgcttatctaacaaattcatatttgattataagccattagtgacagttaatgaaagggactctgtttgaattaagcggttatgagtatccatctcagaagcttacttctcttgatacttgaattaagagcctattctcattaatgccgacttattcagataaagttcacagtgtttttgtctttttcatcatatttatatcttaagtgaaaggtttcaaccgtaacgacacattggaagcaactgggtccccccgcaccaattcaactggaaaatctgggggtggcacgtagaccttggtattttttataaagatccccaagtgattttaatgtgaggcagaatttaaaaccattggcttagagcagtagtgattaaatatatacctacattgtttagtttctgaccttgatagatatattttgtcatatttaaataaacaaaataatggccaggcacagtggctcacgcctgtaatcccagcgcattgagaagctgaggtgggtggatcacttaaggtcaggagtttgagacctgggcaacatagtgaaatccccatctctactagaaatac

SEQ ID NO: 196366 - DNA, 325 bp, Homo sapiens
cagaggaaaacctgcatctgagtccccttgtcatccctcctgtggattcctggggaagcatggaaaacaagtatttaaaatgacaggacaatccatctgccacccgtgggaatggtagaaaataagggatattcatggaaggctgcttttgtacagtctcacaaacagcagcccttagacctaagaggacattgcctatcagtcttctcagtgtagaggaagaactgtcagggccagggagtttgggatgagagaccacaaaaggcagagaaagaattgtcctctccccaaagtgcagatagctctagaaaggaagtaggagttg

SEQ ID NO: 196367 - DNA, 526 bp, Homo sapiens
ggcaattccaaaggtataatttaatgactcttaatatattcattcagtgaattttgaccaaggcatagatttgaactgctgtactggagagatacttagctaggtcataagcctcgcagattgcctggtattcacatctcaacccctctgtgttgtacttttcttgctatacgtgtagtaattcttgtgaagtaatttttaaaatcttgtttatgaaaaaggctatcaagtaggagaaaactttagtaaaactgaaaggcaattccattgtgatgtgaggataagggcatgaaatgtgactctcaagaaaataagatttaggagacagaagcctgtataaacagttccatatttatattttggggattcacaaaggttgaaggacataacccttggtttgttttttgctttttgttcttgttttttgccacacacaggatatatacatttaagataatgaacgctgattgccatttagtatatggcttttacttgcagtgtccaaattcattatatcttgtctaaa

SEQ ID NO: 196368 - DNA, 143 bp, Homo sapiens
gccctgccaagcttcctcccctcccttcctagtccaagcactccaccgtctgtgcagactgcataacagcaatttctggaaacaggctgaagaatctgggccagtccagaggcagtggattcctggtttatgtgtggtggggt

SEQ ID NO: 196369 - DNA, 134 bp, Homo sapiens
ccagaaggttaaagagtttaattgatatgtatatcatttttttaaagctgcatttagacaatttccctgtacatgacaactcaatgcttgtatatttctgaaaccacaaaaaaataaaaagacaagtggacata

SEQ ID NO: 196370 - DNA, 429 bp, Homo sapiens
ccataaaatactgcctgagttaatgaaaaagagaaagatttaattatattatttaaaatttaaaagataagcaatatgagcattaaatactaatataagtctataacttgggaggcaagaggagggaaagtgtgaagtaatgttagtgagctaaactattttttgttcacagcagggagttattagccactgtgtaaagctgttatacgaaaaagtacatgcttattatttaaaattataatgatgaatcctggaagaactgaaaacagaaatggttaaaagttcttatctctggctagcattcaggagcagagggtaaaagtaaatctcagtttagtttaggcttggcaagtggcattatatactctattataaaaaatactgcgtatatattttctctttgaaaaaataaaaaaaatatacattcta

SEQ ID NO: 196371 - DNA, 374 bp, Homo sapiens
ggatattatcttgaaggcactatgaagttatggagggtctctgttagtttgtcaccatcacacctgtaccctgaaattgaggaaaaggttaatgtgtgcaaagtaatattctggataggttgtcaggcagcactctgcaaaggcaagcggagggagaagaaacctggaatgatagaaagatccagtagcaatgcactatttcaggcatgttatagaaaaggcctaaactaagatgatgtgggtacaagaaaaggaggagtcatgacaccattatgaaggaagaactttgaatgacagtgctggtcaaaaaaggaagatgactgaaagttaagtgactctcattctgcatgaggacccctgtgacggaaatttgg

SEQ ID NO: 196372 - DNA, 459 bp, Homo sapiens
ctttcaaaaaactttttaaatatgtcattaaaatggtaaatttgcaagtttaagtgaaatctagtttagaattgatgaattgttagtgatgatattcacatcatgaaagtactcaatagcaactagccaaagacattactttgaggcatgaaaatatcctgtgtctgtttctgcaatatatgtttatttcaggataaaaaaagaaattgtttctataatggattttcacatggaacaagtaaaatgttcttgactgaatatgttggctgtcttttcttccaacaaaccattagtttaccagtgttgacattagaaacagctccttactaaaaaataaaaatgtaccaccaatggatctcagctcttaagtggatttctagtgactatgatacttgcatgaagttcagggattggaatctatcactaatactatcctagaataaaaattgaaatacagat

SEQ ID NO: 196373 - DNA, 488 bp, Homo sapiens
aacctatgccagccttcaaaatgttcacttgggatctctgcacctgcttcagcatgttgcactgtctcaatattaatagtcataattttgggagtcctcttttggaattgcctcagagtctgctgtggatccccatgaaatgaaatcactttgctttaatcacacttcaggtttcaggtaatacatagattggtgaatgaaataaaataagcagttttttagcattgtatttcttttgatttcatccttcctgtgaaacatactgttagtgtttaaaataatcatgatcagtctaaattaaacattgtatgtttcacttgtaatgataaagttagtgtttattatgtatgttttatatagtatatacatgtgtatgtgtatatatataaaataaacacaaataccaacagttgaaagaaaagagaaaacgagagcaaatatcttgtgacatcttagtatgccatgccatagtacatgtataaaaaggg

SEQ ID NO: 196374 - DNA, 290 bp, Homo sapiens
cccaacacctctctattctgtacacacctaacagagttctaaactactaggtgtgtacatggaaaggaggtgataaatcattgtgtatcacagtttttagctctatgttttcatcctcagcaatgaaggacaatgtggaagaagccatcacgaaactcagcctggtttgggactgcttttgcttccgaagggctatttgtctgttcttcaccatcccaggtagcaaatggggagcaaattgggaaatctgcgcaaaattaatagccctatcaggaatcaagcgggtatgc

SEQ ID NO: 196375 - DNA, 178 bp, Homo sapiens
tctttctcacacaaggatgatcctgtatgacagatttttatgcaaattttactgtccaggaggtataagacataagctggaaggtttccttttttcactttctttttttttttttttttttttttgagacgtagtctcactctgttgcccaggctggagtgcagcggcgcaatctcgg

SEQ ID NO: 196376 - DNA, 347 bp, Homo sapiens
atgagcaacagaattctagataagagaacttcctgagcctgagtctgaaagcaagaaatcataggtctctttgagggtttaatttgattagtgagtaggatctatgaaggacagtagtagaaaaagaatgaaaagttaggttagggctagatcatgaggatattgatcaccacacagagaagttggaactttgataaatggtgagcaagccattgagatggaatttgactgtggtcgtcatttagaaaaattactgtggtgaagtagactggaaggaagacttgacgttgagagacctgttatgaagttacaccagaagtcaggtagagacataatgaaggcctggt

SEQ ID NO: 196377 - DNA, 526 bp, Homo sapiens
gagtaatgctggccttagaatgagttaggaagtgtgccctcctatttttggaaaagtaggatttgaaggatcagtattgttctttaagtgtttggtagacttcaaagtgaagccatcatgtctaagattctttattgttgggagatttggattactaattcaatctcattactagttacaggtctactcaggttttctatttcttcatgctttagttttgctagattttgtgtttccaggaatttgtccattttgtctaggttatccaattcattgctgtataactgtccacagtatgctcttatagtcatttttatttatgtagaattggtagtaatgtccctgctttatttctgactttagtaatttgagtcttttctctttaattcttagtccatctagctaaaggtttgacagttttattgatcttttcaaagaaccaacttctgttttcattgattttctctattgtttttctattatatatcttatctctgctcttatctttaatatttccttccttcta

SEQ ID NO: 196378 - DNA, 386 bp, Homo sapiens
cagcctgaaaaataacatatattggttgtataatccacttaggaggtaggtcttatcttgtatgttttacaggggaggaaagcaaggtatctcccttctacccaatgttgaggttttcaactttgactaatcctctttttagataaaaggtagtctgccccaggaatggagagaattagggggctccattatggtgacatgtgtggtaccatggtcatcttcttttatggagatggggctgtcatggggccagtcctggcaccacatcgcaaagtccaggacaaagctaacatgtttgtgctggcttgacgtgctgttgactacccagcacgcggtcctactctgaggttccactgaggtcggcttccctacaaactccctgtttg

SEQ ID NO: 196379 - DNA, 143 bp, Homo sapiens
atgattggtaaattcaggaagacagcagcataacttctgagctgcattggtccgaaggtgatatttctcaggcatgggatcgggaagggttgaacattaactttcagcaagaaaggaaaagccctcagctcagctaatgcaca

SEQ ID NO: 196380 - DNA, 570 bp, Homo sapiens
taggtctgagtttaaatatttcctctcaggggtctggtcttcccatactctctacataatcttagttttctctgtcatgtgctgttgtattattattattatttttctttttgagacagagtcttgctctttcgccctggctggagtgctacagtggcacgatctcggctcactgcaacctctgcctcctggtgtgattctcgtgcctcagcctcccaagtagctggaaattacaggcacgtgccaccacgcccggctaattttttgtatttttagtagacacagggtttcaccatgttggccaggctggtcttgaactcctgacctcaagtgatccacccgcctcagcctcccaaagtgctgagattacaggcatgcaccaccgtgcccgaccacgtgctcttatattaacaaccagtatttactaagcacatactatgtgccaggagatagtctacatattccatgtctattagtattcttaatacttgcaggaccccaattaagcaggtgttggtgttttcctcaagttcacacagctgatcaaatcagtgagggctgtgaccctag

SEQ ID NO: 196381 - DNA, 159 bp, Homo sapiens
  misc_feature (15)..(15): n is a, c, g, or t
  misc_feature (29)..(29): n is a, c, g, or t
tgatctgaaccaatncagctcggtacccnaggtatcttctgagcagcctgcacagaatcctcattctcctcatccacgtgtccttctgtgacattcaggcattgactgtacccttttgcttacccatgcctatgtgcctgcccttccggcaggccaagg

SEQ ID NO: 196382 - DNA, 281 bp, Homo sapiens
agataagatcacagaatctgtctggatttaactttctcaaacagactagggaagaatggctttcattctttctaatcaaaacacctgaatgaagtttaaagtgttttaagtgttgagtcagttacattgaaaacaaatggtttctcagaacaagagctattattcctcgtactatatcctttgaaactgttttgacaaaactagtaaaccatgaagttgtaccagggccttgtttgggaatcttaaactaaaaacagtgaataaatctacaagatattcgc

SEQ ID NO: 196383 - DNA, 478 bp, Homo sapiens
agagttggatctcttgatctcttcctctgctgtctaacctaatatgtcctactgtaattttaggctagtttctctagtctagacctcaatcaaaatgtactagagctattcagcacctccagagtttcttccccatctcttcttcctttgtagatgtgtgagtaacttcctttcctatacagaggtttctttagcatttggagatttctttctcaaatattttaaaaatttcattctttctctggaaaagatggctttagctataggttcagaaaaatggacacgtaatatttgtcacctctgttaatgctgaaaatgaaaataaatatcacaatgtttataaagtgttattgcttttttttttttttttttttagacggaggctcgctctattaccgagatcacaccattgcactccagcctgggcaagaagaatgaaactccatctcaaaaaaataaagaaagaaaaaaatgcaaa

SEQ ID NO: 196384 - DNA, 433 bp, Homo sapiens
tgtaatcccagctactagggaggctgaggcaggagaatcgcatgaacctggaaggcagaggttgcagtgagccaagatcgcaccattgcactccagcctgggcaacaagaacgaaactctgtctcaaaaaaaaagaaagaaagaaatatttccctgttcttattgctcaaaggaaaggttatggatcagtttatttaaagacaagttttggctgacagcccaactttttttttttgctcatcagcatggtataaagcatgtcatttaatacaactatttaatgtatatttgcgaccactttcttctggattatatattagaaggttatattgttcaaggcaagagttcagtgagtcctgtttttgagttccttttggggtatgtttgagtttgcgtttttttgttttttttttttttttttttgagagttttg

SEQ ID NO: 196385 - DNA, 356 bp, Homo sapiens
aaatcaatcacagaagcaatgtctacactctaaaaataatttgaaactgcaaaggatttagagttgccaagacagcgttgagaaagaaaaacaaagaagactaacactgcctgattttaagtgttattctaaagccacagtaatcaaaacaaagtggaattggtgtaaaaatagacacatacatcaacaaaacagaatatagagttgagaaatagacccacacatatatggataactaattttcaataaaggtacaaacataatttagtaaagaaaaggaagtctcttctacacttaatgttgaaagagctggatatccatgtgtaaaaaacaaaagtaaaatattttaaaaagta

SEQ ID NO: 196386 - DNA, 238 bp, Homo sapiens
cagctgccatgccgtgaggcagcctgtggagaggcccacgtagtgaggaactgaggactgctggcagccgtggcagtgagtgcagaagcaaatccttccccagttgaggctgcagatgactacagccctggcaaacaccttgactgaagtcttgtaagagattctgaggcagaaccacccagctaagaagctcctggactcctgactcacagaaactgtgagatgacatttgtttttt

SEQ ID NO: 196387 - DNA, 510 bp, Homo sapiens
agaaaagtcttctcgatagataaatatcaaaaagtagatacatagtatgtgttataaaaaaaacatcttttgtcagagctggcttcataggttttatcattcttgttgctactgttgtttttaaactgcaaagagaaaaaaaatcatttcttaaggtcatctttatccaggtctaccagaagtactttatggattggaacttgactctcacacttgtatgatgcattctatcccaaagctcttcacatcttaattctgagtagagaaacatatcaagtcaaaaaataagccccaggggttaatgaaaaggaaaattcaacttataatcatcaacatttgaaaattctgacaatattctgttaattaaaagaaagaagaaagaagcacttctagagctactaagcccaaagtattgactatttttgttaaaaattcatcattcaaaatgaagtcaattcatagtttttgttatattgataggtattctgaggattatccaaatgtttcatg

SEQ ID NO: 196388 - DNA, 490 bp, Homo sapiens
gttttgtattgtatctattttttagagatggggtctttccatgttgcccaggctagagtgcagggggggcatgatcatagctcattttagcctccaactcctgcactcaagtgatcctcgcacctcagcctcccgagtagttgggcctacaggtggtgccaccacaccaagctctgtctgttgattgggatgcagctagggtggggtgagtggtagaggtagattcattggcacaggaaggcccccacacacatgagaccagaggaactggctccatccctgtgtctgacttgcctttgttgtagaagcaatggtccagctcccaggtctagaggcttgagtttgttaaaatgtgctggacatccagacaaatcagacactttttatggaaagctatataaaggacaccatccttcctaacaataccacagagattcaagggattcaaaaatcgagaatgaaatccgttccaaagcacgatactgatggc

SEQ ID NO: 196389 - DNA, 322 bp, Homo sapiens
aaatactacaagagcgggggagtcgggtctcaggctcccagagcctttgttaggcaattgcatcaatttacaatttcataacattgttacttatctccttcacatgacaagtaataggaggtttccattttgggtaatgattgtaggctgtggaagaagagtatgttggtttaaagaaaatattaagtaaatgagactgagatggtacctatgatggaaaattctgggctagttgactttaggatggagatgctgtgtcatgaaaatcagatttgaaatcatgttcttaaaaatcagcttgtcactttcttgttgggagctt

SEQ ID NO: 196390 - DNA, 662 bp, Homo sapiens
tcagtcggtaccgattacgctcctagatcaatacacaaccatcatttctcatcttaaattcataaccacaaacctcatagagatctgttaatgctagtcaggcaattacactgtttcccattcctttaattccttcactatcctgtttcaatttcacacctttttctgctttcttatatgtaaaacacctcctccctgtccttactttcaagtgatcactgtacatcttatttcatgaagaatattcaaatgattaaaagaaaacatcacagattcccatcaccacgtctgcccccacaccgtttacaaacccacactccctgctgcccatcttgttgccccgggtgaactatctgaactactatctaaagtcagtttcttcccacgtgcactacattccagcagcttttacttagcaaagaacattttccagcaatttccttatctctccttaacaccattttctccccttttcctactggatcattctcatcagcatgtaaacaagttattacttgtttcccaacctgaccacatttttcatcttccgtctccgtaaatctgatctgtgccccactatttatttcctgaatttctatgatggccttttacctgatcttcctgcatgtgtcctctcaccctacacaatctattcccagcat

SEQ ID NO: 196391 - DNA, 535 bp, Homo sapiens
ttggattgggatcctggctgctgcttcaacctcatctaatttcctattacacctcctctctctccctttttgtacatttgtccctctctctgatttccaccatctgtctttccagtttactttctctagttccagacaacaaaaattctttaatcccactgggatctccaatcaattgattcaatcaacttttcattatgcctcaaccctttgatcttctaatctaacttctcataactcaagataaattccatgggaaatccttaacaatcacttccacatatacatccttaactgcctgcctccctcttattgcttttacttgtttggaaaaaccacaacttggttaaatccagatcaccattctctatgtctataattctgcagctaaacataggtagagatcaatacacaaccatcatttctcatcttaaattcataaccacaaacctcatagagatctgttaatgctagtcaggcaattacactgtttcccattcctttaattccttcactatcctgtttcaatttcaca

SEQ ID NO: 196392 - DNA, 768 bp, Homo sapiens
ggcagaaatgctcgatgacctcatggagaagaggaaaaagaagcttgattctgtgattgaattcagcatcccagactctctgctgatccgaagaatcacaggaaggctgattcaccccaagagtggccgttcctaccacgaggagttcaaccctccaaaagagcccatgaaagatgacatcaccggggaacccttgattcgtcgatcagatgataatgaaaacgccttgaaaatccgcctgcaagcctacgacactcaaactaccccactcatagagtacttcaggaaacgggagatccactctgccattgatgcatcccagacccctgatgtcgtgttcgcaagcaccctagcagccttctccaaagccacatcctagtatcagaaggccaggcgagactgcaccactgcttatcaccccaccgcgtgatccctgctcttaggtgctgggcagaagggaagggtggtcagggtgaggatggtgagggagggctggtgaggggctcagaggaatacctggaacaacagcagtgttattgtagtgtggcagtttcttttatacataggtgggagtttttaaagtaagggaaaaattaattttttaaaaaacaccatgcttggagggtgggggtagaaatacagagatacaatattatttctaaggaattgggttttcatttactctggactggtgaaaatattttttaaagccagtgctctgagacctcagcttttaactcagaactccatgggttccagaccaagagt

SEQ ID NO: 196393 - DNA, 232 bp, Homo sapiens
ggcagaaatgctcgatgacctcatggagaagaggaaaaagaagcttgattctgtgattgaattcagcatcccagactctctgctgatccgaagaatcacaggaaggctgattcggcgctttgagtcgaagtcttgctctgttgcccacactggagtgcagtggtgcaatctcggctcaccgcaacctccgtctcccgggttcaagcaattctcctgccttagcccccacgag

SEQ ID NO: 196394 - DNA, 584 bp, Homo sapiens
ccgggttcaagtgattcccctgcctcagcctcctgagtagctgagactacaggtggcgccaccacgcctggcttattttgattttattttattttatttttgtattttagtagagacggggtttcaccatgttggccaggcttgtctcgatctcctgacctcatgatccgcccgcctcggcctcccaaagtgttgggattacaggtgtgagccaccgcgcccagctgtatttctatctttgtttacggttttgttgttctgcttcctaattcttttatatacttctcttccataatcttcataaagaatcctttagggctatttcattccatttctatagccagtcctgtgcttacatagtcactgggctcctgcccacccccatcccagctagggttgtaagctctgcctctaaacttgtggggcagtcagttccagcaacagcttacagaggaggggcatggtggtccttctgaaaggaatggtcattgctgagcagcacgataaaaaaggtaattgtgccatttaccatctctcggacttactatcttatttacagacaaggaaactaatgatatctacct

SEQ ID NO: 196395 - DNA, 1084 bp, Homo sapiens
gaagatgatgggttttatttgagaagttgtggatttgaactgcggtgctcctagagcctgcaggcagtgggggtgtgggacttgacacacatagagatcaggagagctgtaaagactcactgtgatggctcatgtgggtggtgactgacccgtgtgagagggtgctgctggcaggcagagctggcagaggaagatagggttgagggtctcaccgttgggtatacccacacatgagtgacagggaggatcatgccaggacattgctgcatgctagtgccttgtttcattctggcctttgcaaatgtaaatattgaagaatagccagcatggcagctctgggttttatctttttgtctggatctgtactgtccagcatcatggctgctagtcacatgtgacgtttacatttaaattaaatactattcaataaaacctgaaattcacttcgttagttgcactcgtcaagtactccatagccacacgtggctagtggctagcccatctctgcttgctggttagggccttgcgaggctgaaatgttggctcttattttctcatttgcctcagaatccaaagctgggctttaggctgtcagctgttaaggcatctagagaaaggtgtgctggagtgcagcgtggttgggcaccagtaaccaaatctggccgttgctgagaaccaggcttgtggggtgtctcctggaaagggaggtggggtgtgtggctgataaggatcttatctttagagattctcttaggcatcctgtgttggatgagtgcttcccagatctttaaacaaaataaaacaaaacacccacacaaacattttacaaagaaaaagaacaaatccatacttagaagtagaatgtccactaggtcaaagtaagaacaagagatgtgccaggccccaggactcatggaaattagatcatgtggtcagagttgatatcaaatagggggaacatagcaaaagatcttcttcttatcccacaggactctagttaggcaaattcttatgttttaaagccagctaggaaatgcgtaaataggggtgaatgcccatggcaagaaacaggaatcaggaaaaa

SEQ ID NO: 196396 - DNA, 2247 bp, Homo sapiens
gtccctgtaagcatcacattgctggaggaaaatctcatgccagagcttggaccatccctagctcaggggttaggggttgtcccttggtgacctaaatgaaaaaacaggtccagaacagagttcctgatgctggacactcattcagtctttgaatcgtgggaggggaggcctggtactaggtagacctaacctctttgaggaaccacagagcccaaggctggaaacctccagaatcctccaccccctgatcctccctggggacccctgtggcctgtctcactgagcactcttccatctgtagatgtctgggctgctgtacaagggagtcccctttcaggtgtggtgctagacatggtcactcctgctggatgtctaggtggtagaaaccaaggacctagggaaataccaggtacagcctttccatgctcatccagagcaggacaaacaggccaggcggtgtcaggagcccaggtctccagctggagggaacgtcaacccttcggtgggagcaggggccctttgcacatcctaggcacagatggtaatgtagacaccacaggtaagctgggcttggtacctacccctccccggattcagaaagaaaccaaacaaggagctttgtgcggaatgaaacctcctttcctcccagaagcactgctgactgtttggtggttgccatttgtggcagtgagcctttgtttgttctgaggttgggctggtttctcctcttggccctgccctacagatcataaaggagaagagcaagaggtccccagcaaacatccacagatggccttggaaataagtcaccttcctcaccctgcaggaatgccagtgaacttattgctgacatcttggagctcagtaccctcatagtgtaacggcgtcagcagatctgcctgtgctgggacttcctgtactacccattcctgaggggcaatgcttctgcagggcctgtgacttggtgcacaacttcagacaccatcatcttgcagcagcaccgcaccctcactagccagggtgttgatgacttcctcaaggccaaggccacattcaaggcttcggacttcattgatgcgcttgtgctgagcaaggtggcttctccaggatcttaattcaggaggtagaatggagcttgagatcaagtgtctgatcaagcctcagtgtatgggcgctgttcatcctctggtgctgaagcagccaagagacccaagtctgcctggctgcctcttaggatatgacagcagagccagtggcctctactagatcctgtacaacctcacaaaacacccagacatcgggagtgctgccagcctgtgatgcaagagtcctaatcctgaagacattgaatggatcatgaggatcagagaggaaaagtcacttgcccaaagtcacacagctgaacagtggtggagttcaactttgaccgtgggctgtctggccccaaggtgtatgcttgcttctctcccaagagacaactttcttatcaggctcaaatgaatgaaaggaggatgttaaagttcctagaagctttaattgaatgaaagttcctagtagatctgtacctactaaaaaccacacttctgaagctacgtggccaccagaagacacagctagtctgccatgtaaaaaaggaaaggtggcgtgtgccctgaaggtgcaggggtgagagcagggaaatggagaccccaacagccagcagcagtggccctcatcacagccctccaggagatatcaaaggaggtcagaccttggacagtagtcttgacttcctgctatagaacacattgttaacactgaaaaagatgatctgttctaggggaatggtgaaagctgactctagcacttgtactttttgtttgtttgtttgagattgagtcttgctcttgtttcccaggctggagtgcaatgggtgatctcagctcactgcaggctctgcctcctgggttccagctattgtcctgcctcagcctcccgagtagctgggattccaggtgcccgcaagtgtgcctggctaatttttatgtttttagtagagatgggatttcgccatgttggccaggctgttctccaactcctgaccttggccaaagtgttgggattacaggcataagccattgtgcccggcctgtgtttttaatttcatcgtggcacagcttcaaaatgacatctaagtagctgacataaaaatgaaaattctgtgtactttgatattagcaggcttcaaatacaaaccagaatatgagt

SEQ ID NO: 196397 - DNA, 760 bp, Homo sapiens
  misc_feature (11)..(11): n is a, c, g, or t
  misc_feature (18)..(18): n is a, c, g, or t
ggtaccacacntcgatcncggagaagcggcgggagcttgagatcaagtgtctgatcaaggtacttgaacttgatctggagggctctggggagccatggaagatgctggataaaggagtgacagtcagctatgttttcgagatgactgtagaagcctgcctggaaggagtgaacaagagccaggagaccagggagggagcttgtggggcaggtctggagatggtgagggagggatcctgcttggatgaaaggtcttcagggactgtctcaggttacacacaggtgtcctcagagctagtgtgttcagagtcttgcctccaggatgaaaatgggaaggagttgtcagacgaggacatataaatggaggctggcatattcatgagtgctggtggtggtcccggtgtgggactactgtgggaacaggggtctctccatccagggatatgatggatggaccctacatcactccattctgcccttcctttccctcctcccattctcccgaaagcctcagtgtatgggcgctgttcatcctctggtgctgaagcagccaagagacccaagtctgcctggctgcctcttaggatatgacagcagagccagtggcctctactagatcctgtacaacctcacaaaacacccagacatcgggagtgctgccagcctgtgatgcaagagtcctaatcctgaagacattgaatgacacagtaagatgataatggaaagcagcagcttgttggttgtcacttttctggacattg

SEQ ID NO: 196398 - DNA, 513 bp, Homo sapiens
gtaggatctctgaagcctgtgccagtggaaccgcagctcatggctggcacctgtgttctcattcttacctcattaagagtaaagtttattgagtttattgaatttaagtatctttagtgagatcatatattattagtaagaactgggaccaaacagattttctgactctaaaagagagattttcacagaaacagatatatacctgtaagtatacagacacgcatacacacatttctttactgctcataaaaattagtccttattagaatgtgggatgtataaatgtaagagaattttcatgttaaaattgacagatacatttttaaattgtcctaaaataaatttaattatttttcttttagaattttccattattaatgttatttttatgagaaactatataactttattgataatacatacaataaccctttgtttttcaaattgaaaatacagtgtattttgcaaataactaagtcctaattttgtattaaaattttaaattttcaatct

SEQ ID NO: 196399 - DNA, 220 bp, Homo sapiens
gggaacacaaaatgcggatctgggggagttaaccctctcggtggaagccacgccagtgcccccaaaaccaggcagaaagcagctccagcaggcagccgatgggagcagccgacaagataccccatcttcctttggccagttcacacctcagtcctcccaaggaaccccctacacgtctcggggcagcaccccctactctcaggactctgcctactccagc

SEQ ID NO: 196400 - DNA, 1222 bp, Homo sapiens
ggcagatgggggctgtagccccggagcccacaaggacacctggggcctcaaaaatgaggcctgggatggctgatctgctgggggaacagagggaaaggctttagatctgggcatggagagggaccgaggctggcctgtgtgggctcgttctaccggatgaggaaggcaggtgtcccaggctcaggtggtgggcggggcaggtgtggctgggagccagggtgctctctggaggtgcagccagagatccaaggtcaaccctggagggacaggcagttcctggttttttctaaacattagcttcgaaacttccagagttaacacgccggaatcgtgttgcatattattgagcttccagtctggggtgctgcgtggaccacgttgaatgcccagggactccgttgggcagatagaggggtgtcaggagcatggagtcagcccggctggcctgcaaactgcagatgctggaaggcccgtcaggtgggacctcccgtcaccaagcagatcttaacaggcctctgcttcttggtggaatgttctggtacattggcaggatgcactgggaaaagctaccatcctcaggccatgtcccccacacagtgtcattttcctccatttctgaacacttctctctcacctccctgtcaagatataccttgctgggaccgggcatcctggagttccctgcttggcagaagcccagaaaggcccagataaacgctgccccttggagccaccaacaccagagggacagaagtgggggctaaaaaagaacttaaggccaggtgcagtggctcatgcctgtaatcccagcactttgggaggctgaggcgggcagatgacttgagggcaggagtttgaggctagcctgggcaacatggcaaaatcccatctctactaaaaatacaaaaattagccacgcatggtggctcatgcctgtaggaggctgaggtgggaggatcgcttgagccctggaggccaaggccgcaataagccatgattgcaccactgcatttcagcccaggtgacagagcaagactctgtctctgaaaaaaaaaaaaaaaaaaaaaaaaaaaagaacttaaacctcagcatggcagagctgtgtgcagacccttataactaacacaccgaataaccataccacgttgtgaaactaattcctccttttcatttgcaagtaactctcccctctgcctttttttttttttactgttagaagctt

SEQ ID NO: 196401 - DNA, 474 bp, Homo sapiens
ccggaaggtagctgtactgcatagcaccaaccaagggactatcacctacaatcctggaaagatctctttcctttgcccctcattctttctttttaattgaaattgattcatcacacaaaacctaactatagatgggaatattcttgctggtgagacatagctaaaaacatatgccagctgacattgtacaaataaagcatagatagcaaatttatgcatttttcttctattcatgttccagttataaacctgagtgttagctggtcatgcattctgttgaacagtaggataatatgtggaaagtttacctgacatagctttctagtaccagttaagatttcagttttatttactaatagactagacttcttcaagatgcacaattaacaaggggcccttatctggggtctgtgcacccccctaagcagtccacagatgtgtttcaaggggatctataaactgcttaaattgcca

SEQ ID NO: 196402 - DNA, 445 bp, Homo sapiens
atttgacaaagagtatctgtggtagtggaaagatctctttcctttgcccctcattctttctttttaattgaaattgattcatcacacaaaacctaactatagatgggaatattcttgctggtgagacatagctaaaaacatatgccagctgacattgtacaaataaagcatagatagcaaatttatgcatttttcttctattcatgttccagttataaacctgagtgttagctggtcatgcattctgttgaacagtaggataatatgtggaaagtttacctgacatagctttctagtaccagttaagatttcagttttatttactaatagactagacttcttcaagatgcacaattaacaaggggcccttatctggggtctgtgcacccccctaagcagtccacagatgtgtttcaaggggatctataaactgcttaaattgcca

SEQ ID NO: 196403 - DNA, 211 bp, Homo sapiens
ttttactttataaatcagaacttgcctctgtttggcaggaaccttgtttgggaaatgaaaatatggtaagtatgtgtttccttctagttaaacaagggaaagtatcgttcttaaacgccaaacttaaatggttaaaaaagttaagtcttaggccatgtcttagaacgaacgttcttatctttaaattgtgagtcattttttcagatagaga

SEQ ID NO: 196404 - DNA, 155 bp, Homo sapiens
tgtatattagctaacaaggaggtgctgacagttttacaggacagtgtcacattaagactgacgttttggaacaatctggtatttaatattgatggccataaaaatcagagatagaagattaccatatagatataaggaaatgaagttcaaaggca

SEQ ID NO: 196405 - DNA, 665 bp, Homo sapiens
cccaaccacctatattgatttttaaggaattatctttctaatttagaatatggaaaaagaatggttgatacagatatatgtctttttttaatctctgaaaataaaaagtttgaccattttttggacagaaaatagacttattatggcaaattcaacatgggccccaaaatgctgtaacagtacactgcacactcatttctccttgtcggtggctgtgctctcttgcacaacttcaaagcctcccatcatctgtggagaaaacttttttttcttagtgaatagcatgaatacacttcctttttctctttttctaaccttctggcttatgtggaacttgtgccaaattcctcatcatgaaggcatctgatttatattttgacaacagtgatagcttcaaatgaacagttgtaaataatatgtcttcttctttttagttatggattgcatattaattttaaccaaactacataattatctcatcgttccgaagaaataatatatacaaaggaggatttttttaaagtatgagacactaggaccgtttgttgcaattattatcactattattatcatcttcctctgtcctggtatcctttattttctgaattaaaaaaaaaaaaggctgtatgatgtgctatctagggctttgataaatactcttttta

SEQ ID NO: 196406 - DNA, 328 bp, Homo sapiens
gagcttgttacctatatgtagaaggaaagctaaacattttgatataaaattagaaataattcaccaaaataactgtaggtaaagtaagaagagctcagacattcgattcataataataccataagggaaacacactactttgctgtagttcaccaaaatagctgtaaaggtcactgttaactatttacctttctcttaagaacttgtttttccctgtttattagtacataattaaaaattcttattcaggcccagatgtgatagcttatgcctgtaatcccagcactttgggaggccaaggcaggaggatcacttgaaggcagaaatt

SEQ ID NO: 196407 - DNA, 507 bp, Homo sapiens
catgtatgtcagagtttatttctgggctgtctgttctatcccagtggtctatatgtctgtttttatgtcagtgccacactgtttttattgctttgtagtaacttgaaattaggaagtgtgagacctgcaaccttgttctttttcaagattgttttgactattatgggtttcttgagatcccataggaattttaagatagatttttctatttctagaaaaaaatgtcactgggattttgataggtagctaatgtctaccttttgaatacctcttataaaattcatctcaaggggcatctcctttgtgaagcctgttgtaaactactatatagaattaactgtttttttattttgtcccctaagcatttctaacatctatcacacttcgttaaacttacttgtttctttttactagactgaagaattgccatgtgtattagttttctgttgctgcataacacattgccacaatttttccagcttaaaacaatgctcatttattatctca

SEQ ID NO: 196408 - DNA, 593 bp, Homo sapiens
gaaggatcaccttttcaacatatggttctgaaacaaccggatttccatgtggaaagtaaattaatttcaacccttatcttatatgcggaatttaacttgaagcatagacctaaatataaagtccacaagtgtaatttctggaacaaaaaatgtaggttaaaattttgaatccttgcagtaggtaaagataccttaggatataaaaagcgcaaatataacaggagaaaaaaataaataaattggactttataaaaattaaatttttctgctgtttggaagacattgttaaaaaaggtgaaaaggcaaaccatctaaccatccacttgggaaaaatagttgcaaaaatatttttacaagtccagacttgtatctagaatatatgagaagactaacagctcaataataaatgactaaacaggtagcatgaaaagatgttcgactttattactcaccagaaaaatgcaaatcaaagccacatagaaatactactacacaatggttagaatggctaaaaataagaagaatggcaataccatgtcaaggtgttgccatgacaaggatttaaaactctcatatgttacttgtgaaacttg

SEQ ID NO: 196409 - DNA, 432 bp, Homo sapiens
ttgagataatacatgaaaaacacctagcacaaagactagcacagagtaggtgctaaataagcattagctctcctcattatcctaatagtccttcccaggtagctgtgattccagaggaatggtaaggctattcaagggctagaagatgctgcttgagcaagatgggtaagcatttttgtcattcaacgcattcaatcaaatgcttactgactgcctattgtgtgggtgtaagcactgacatttgttgactgcctcaatatgcctcccctcttctctcagtaacaatcttggattcttatttgagaagattcccttcccatccaaatcctacattctcagccatgcgctgttaagtggaaccgaccctacctccaggggtgacaagcagaacactagcccccagccctgcagcctgatgggagataggcatgt

SEQ ID NO: 196410 - DNA, 609 bp, Homo sapiens
taaactctgattaccaatctgaaagtaaggagtctgctctgtatatgggtgcatttcaaggcttttgcattgtattttcagtgccagatgtcaacaaagggcttaataaatacttgttagataaaaatttaatgaaagatgattttacatattccagtctcacttcagctgaactacattggtcctttgtggactaagtaatccaggcagctctgagagcaagccagtctttaggggaacagatcatacccacaagaaagttgagggagcctccgttaagttaaaaaacatttcgtttattagtaagtcattttcagcatataaattaagtttaaacagtcattatttttaacttaatagtttcatcacagccaaaatacaaatttttaaattctcattggcagatcctaattggcatattgtaagtagtggaatccatttatagactttaagtatgtgggctttgatgtagcgaatggaatctgtaattagcccaggattggaacatggccttcctcaattgtagctaagatcaaaagctaatagctggagtttgggacagctgtgtcacattgaaaacagacctaacctccttcagtttcctcgctg

SEQ ID NO: 196411 - DNA, 520 bp, Homo sapiens
acatcccctccctgcctcacccatgctcccaatgcccaaagctctggaatctcttcccgcgtggcccaagcctgcttccactgcttggcaggatgtctcccaagcccctgggcccatgggctgactctgctcctggagtagcatccataggctgaaaagtgtgggagggaataaaggatgcacagcacttggacatgaaggatggggtatccacagagctattggagggagaagaggtgtaacaaaccagggtcaccccatgtccccatgttcagggacaaaacacagacgagtctgagaattttaaatttaaaccaggtttcccaagtcctcgtaaaggcacatttgtcgtggtaggagaatagaacatactttagttaacagtttgttctcttgatgtataatttttttaatattcagacataaagtataagtgaacttccatctgtcctcttgcctcagtccctgaaaatgccagtgtccacccagcatcctcatgggtggcacgaaaacccagaca

SEQ ID NO: 196412 - DNA, 405 bp, Homo sapiens
tccccatctcatcccaggtcaccacctggctgaccccaggtccccgacccaacaacaacccctcccaagtccctaactccctcacttggacttgagacccttcacaacccagcagcgctccgcctccaacgtgacatcatgctttctggaaacttccccgtatgtcccactttcccacacttggtgccctggagcaccttccggcctctacatgctgtacgttcccctgtgagcaccctcctctcggcctctggccaacacagtcccacccatctgtgggtaacaaacgggtgtgtgtgttcttttcagccttgctaaactgtctgaatcaaggatcacaaactacagcctgcaggccaaagccagcccacagcctgtgtttgtaaataaagctttattggaaca

SEQ ID NO: 196413 - DNA, 227 bp, Homo sapiens
ggatagtaatatctgcatgtgcaggcactgctaatctcctaagcagtatctcttcttcttcattaacagtaccccaattttgtttggtggaaaaatgtgcccagctttaaaagaaaaaaagattctcaattttctagggtccttagtggatatggttataggatagttctggacaattagatacaaatacaagtctacttggtggagctgccaggaaatttggtgtt

SEQ ID NO: 196414 - DNA, 371 bp, Homo sapiens
atccacccgcctcagcctcccaaagtgctgggattataggtgtgagccactgtgcccagccgaggttttttttttgtttaaatcatagagtaaaattgatctgggaggagtataatggtctgcgaatttttaaattttattagatttatgtaaacacctccacaatcagaatacagaacagtttcatcaccccaaaaaactttctcgtgctaatcctttatagtcacattctttcctacccctagttcctaaatggaatcatatagtatgtaaacttttaagatggctgctatggtctgaatctttgtctgtcccccaaattcatatgttgaaattctaaaccacaaggtgttgctactaggaggtggagc

SEQ ID NO: 196415 - DNA, 457 bp, Homo sapiens
ggtggaaatctcttcaaaaacattgttttaaaggttacttcgtatttgttgatatcaatttaccgtattgcttcacttaggttattcccaagttttactcttataagcactgttgcaatgaaattctttatatctaaatctttctttacatctcatattgtttccttgagatatcctccttgaaataaagccagtatgtcaaaggtcctttcatacatgcttgctttaaatcttcaagaatgcagaaacactttgcaaccatcctaagaatactttttttccagtggagaatcattgatggaggcaaaaattaaaggatggaagtttaatgagaaacagggtatttacatgatctcaaaatatctccctgcatattacttgtcgattaccaagaaacgagtaccaactttacattggagaaatctggcagtactgttaattgagtaatcaaagttaa

SEQ ID NO: 196416 - DNA, 302 bp, Homo sapiens
  misc_feature (24)..(24): n is a, c, g, or t
ttccacgtgcgaaatatttgcgantattgaagctgcttaatgtccatgtgaggagaaggcaatacaggaccagatcactgcccaaaatgataccctgcttctagaaaaaaggaaacttcaggagcaagtcatagagcaagaacagttgatccacagcaacaaatggacgatatcttccatccagagcagggtactttacatggataaagaaaataagcaattacaggaaaatagtcttcgtctcacacagcagattggcttcttagagcgaattataaggagcatccatattcgcagaggag

SEQ ID NO: 196417 - DNA, 629 bp, Homo sapiens
gggagatggcctgccctggtctcttggctgccctaatggaaaggctccaagttgcagctttagaaacaagggctggcactatgagcaggctataacttcttgcttacaccttctctcttcacatcgggtgccgcctgtcaggtgagggccacagtccttcattccaggtgtttttgccttcagccttgctttactaccatgtttttctccttttctgtcttccatctgtccttccataaatccattcattattcatccatccatccgtcctttgagacatccatccttcaagccaccgtttgaccccttcatcccaaattaatgacttactatatgccaaactgtgtgctagaaactgactctacagatgagctagaacagttcttgccctcaatcttggaagaacaactcattggtagcagctccactgtttattggcagaagggaggattgtgtccagggccgcagtatgcagtggggcagttcaggcactgcacaaaaaggccctgcagagccagcgaatgggcctgaaatgcaagctctgtgtcctgacctggagatgggtctttccagaagaagggacagcaggaggtgccctgtgagttaccaaacgtagttcattttgtagc

SEQ ID NO: 196418 - DNA, 571 bp, Homo sapiens
agaaacagaaaaaaatcaaagactaatcctacaaattctcctttaatcttagagcttccagacctagtttctctttcatctaggacttcgaagttatctagttattttatgggtagtgaaaccacaagacgaagagagggtggtgggggggagattaaattaatgagcaggtaagcaggtttattatttcgtctgatccttccttcctgctaatttctctgagccaatttgggaggcagagcctaacatgttaactcagagacagagtattgtatccatgttctttctgaagccatttatctgaaggatattaaagatccaatttacatagacattatggcattgtgaggagggtgtgtgcatgtgcacaaatgagagagagaaagagagagagagagcgctagggtatccatccagttgggcctgtgtttgtgtacatgctcaacctccaatgagtgccatccctcatgaggctctcaaagaagtttgcaatcactcagcaagttagttcaagaagtcattgggccttgacagaaatcaggctccaggcaacggcggaaatgtttattaa

SEQ ID NO: 196419 - DNA, 152 bp, Homo sapiens
attttataattatttgtaggtttactttttaaaacttcatggtttgatgccaaacccattcctctgtactggaggctctatgtctgtccttttttttttgagacagagtctcgctctgtcgcccaggttggagtgcagtggcgcaatctcgg

SEQ ID NO: 196420 - DNA, 224 bp, Homo sapiens
  misc_feature (202)..(202): n is a, c, g, or t
gtgacgttatcgcccaacacttgtttcattagaccaggaactattttcaagatattttaagagaacatattttgaaaactgcttttatggcaacataagtagaagtagcaggttatttttaatcttcatgatttaagattttattcactaccaggcattttctttttcttttctttcttttttttttttttggaaaggggtnccgaccctgaatcgtaactcat

SEQ ID NO: 196421 - DNA, 356 bp, Homo sapiens
tgcagttcaggatgtcatgcccccatggcccactcagggcacgaggatttccgggtgattcctgtggtcagcttcctggacctgacagtggggtggggctgcaatgagacgccagttgcaggaagtggtttgcacagccttcctggtgtcatgggtcactgtcttgccgagtggctttgggcaggtcccttcccctctcagcctgcaggttcctatgccaggagctcccttcttgccccaccagggccttgttttcccagatacagaggtggggcagatcccagcccgttgaaacagacaaggctttggaggccacattgggcccatttctcagaggggcagtgtggctgggtgct

SEQ ID NO: 196422 - DNA, 276 bp, Homo sapiens
tcagggccatctgtttgactaaagaaagcagccctggcttaaataaagacacaattaaggctccaaatgaggaactggccctgcagaaaatgccaggccacaaccacggttcttggtaactttgctctgcacattatccactaaagaaatcaaatcaccttttccatctcctgacacggtgttacagggagccacagagcaacagggggaggctcgcgctcatgccctgcgggggaacgagtggagcacccacacttccggtgcaaccccgcgaga

SEQ ID NO: 196423 - DNA, 302 bp, Homo sapiens
acgttgcactcgtaagataggagagacctgagcacttgtaaatgctcatgagaaggaaataccaggagagaggtttacatcggaggtggggctgggcgcggtggctcacgcctgtaatcccagcactttgggaggccgaggcgggcaaaacacaaggtcaggagatggagaccatcctggctaacacagtaaaaccccgtatccactaaaaaatacaaaaaaattagccaggcatggtggcggacgcctgtagtcccagctactttggaggctgaggcaggagaatggtgtgaacccaggag

SEQ ID NO: 196424 - DNA, 332 bp, Homo sapiens
gtaaagatgatagatcgaacacaggtacctattttctcttcttcctgaaatctcattaaaccaacagtaaaagtgggactacagacggaagcacacctgagaaaacaatccaaaactggcaaagggaaaagccaagatttacactccagaattccccaaaggctaaggaattggtactctgatgtaggagtagaggtagaagctaaaaaccgtttcctcccctttggaaggattaaggtcttcatactcatgcacaaactgtgcacagactcaaatgcgtagctctcagaaatactgacttaatctcaaaaacctctgaagtgtaactgcac

SEQ ID NO: 196425 - DNA, 500 bp, Homo sapiens
gccagttattaggtgatcacttacctaactgaacagagacttcagtggccacatatgacaaggaatacagactttatagaattagtggaggaaagtcattaaacaaatagcaacactttggaatcttatttccaaaattgacacgttatattaattttgaatgcacagttttgaacaaaagattacaagttaggcaaagaaacaagtaaggatggcttatacctaggaaaaaaccttactagacatagattttaaatcagctattaaaaatatgtgcaaagaactaaaaccatgtctaaatatttaaaggaaagtatgagaacagtgtctaaccaaatagacaatatcaataaagagatagaaatcataaaatagaaattctggaactgaaaagtataataacagaaaatttgctggagaacttcaatagcagatttccactgataagagcaaaaaatcagagaatttgaagatggttggtattatccagtcagaggtac

SEQ ID NO: 196426 - DNA, 476 bp, Homo sapiens
  misc_feature (433)..(434): n is a, c, g, or t
  misc_feature (436)..(436): n is a, c, g, or t
  misc_feature (439)..(440): n is a, c, g, or t
gaagaaagtgcctgcttcgccttcaccttcggccatgattgtaagtttcctgaggccttctccgcctgcagagctactggaactagttcacagacccaaagatgcttgaatgaaggaaaggcagccttccctggaggaagaactcaacagcgcttccacaaatagtacatttttactgattatcaaagaaggactgtgactaaactagaaggagaattaacactatccagagatggctacagttctgaagggaaactttgagtctccacctttccaagagtggataatcctctctccacaacttgataatgcacaaactgcaaatcttctggtactcactgctgcaagcaaacttgaagtctttctgagcctgactcttcattccttccttgtgtgacccaggtatggaggactgccctcccaatcatatctnntngcnnagagctgtgtgagacagatggtcatgcagggagaat

SEQ ID NO: 196427 - DNA, 796 bp, Homo sapiens
ctttttttgtttgtttttgagatgaagtctcgctctgttcgcaggctgtagttgcagtgagccaagatcgcgccagtgcactccagcctgggagacagagtgagactccacctcaaaaaaaattaaaagctcacgctcaaacttccacccctattgtttggaagcatgatttggcttgtagcatgaatttttaaaatagtagacacccacaatcaaatgtaagagtgggacaaaacagattaccccacaacaaatctaggtggcttttggactgtccacactgctgttcattccctttctataggtcatggagagtttcctatttgccaaaatactttttgtagcaatggcatgcaaatccaatgcactccttgtttgtaataaactcgaattatatactacctcacacctcttctagtcttaaaaaaaaaaaaaacttctattctccacttttcagatcattcttaaacatgtcctaaattcttcagcgctgcaggaaatgtctgcctcaaagaccagatttacccaattctttagggttcaattctgtccctaagcagttccgtaacctcagacaaatcattcaactctactgggactcaatctccttgtgttcacattcagtgagggagtaggattaaatgctaaggtcccttccagctctaaccttttatgattctgtaactatacagatacagtcaacccccatatctgcggagggattggttccagtcctcccttcagataccaaaatccatggatgctcaaatctgatataaaatggcatagtgtttgc

SEQ ID NO: 196428 - DNA, 792 bp, Homo sapiens
cttgggagcctgaggcaggagaatcgctgaaacccgggaggtggaggttgcagtgagccaagatcgcgccagtgcactccagcctgggagacagagtgagactccacctcaaaaaaaattaaaagctcacgctcaaacttccacccctattgtttggaagcatgatttggcttgtagcatgaatttttaaaatagtagacacccacaatcaaatgtaagagtgggacaaaacagattaccccacaacaaatctaggtggcttttggactgtccacactgctgttcattccctttctataggtcatggagagtttcctatttgccaaaatactttttgtagcaatggcatgcaaatccaatgcactccttgtttgtaataaactcgaattatatactacctcacacctcttctagtcttaaaaaaaaaaaaaacttctattctccacttttcagatcattcttaaacatgtcctaaattcttcagcgctgcaggaaatgtctgcctcaaagaccagatttacccaattctttagggttcaattctgtccctaagcagttccgtaacctcagacaaatcattcaactctactgggactcaatctccttgtgttcacattcagtgagggagtaggattaaatgctaaggtcccttccagctctaaccttttatgattctgtaactatacagatacagtcaacccccatatctgcggagggattggttccagtcctcccttcagataccaaaatccatggatgctcaaatctgatataaaatggcatagtgtttgc

SEQ ID NO: 196429 - DNA, 457 bp, Homo sapiens
atcagattgtaagatgcttgagggtagggaccttgtctgtcttgtcactgctgaacccaccataacactgcctagaatagtgcttcaccaagtcagcactcactagaaagttcttggataaatgaatgagcactgatgtttcttggctaacgttttgactcttttaaaatttagaaaggctgtgcgtggtggctcacgcctgtaatcccagcactttgggaggccgaggtgggcggatcacgaggtcaggagatcgagaccatcctggctaacacggtgaaaccccgtctctactaaaaataaaaaaattagccagacatggtggcgggcacctgtagtcccagctacttggtaggctgaggcaggagaatggcgtgaacccaggaggcggagcttgcagtgagccgagatcgcaccactgcactccagcctgggtgacagagcgagactccatctc

SEQ ID NO: 196430 - DNA, 431 bp, Homo sapiens
tcttttgttttcttttacttagctaaaaataaaaatatatttaatgacagacagatgaaggaaaaataggactttgataaggtttaagcattttcaatgatgactacagaagcatttagaaaacacaagaggatgtgaatgtgtcacatgcttgggtttcatgctaaacagacagcaggagctatggaatggagacctcacttggggccaagagactatctgtttccattgaagttcctaaaaaaaccctttgtggggaggcggcctccaagcgggagcagaaggccaagtgcaggcctcagcctggtcactctggttagtgttctctttctgtcctccaagtgggtgattagaaagcccaaacataatgatctgttatggacagagatcacagtgctgcggtttccagaagctgctgctgacatggtctt

SEQ ID NO: 196431 - DNA, 461 bp, Homo sapiens
taagagacctaaggtccctactctcatagaaattcaattctagagaaggcatttagacattaagcactaaaaactttaagatatactttggaggcaaagctggcagggcttcttaatgaattggacatggagaggggaaagacttttctctagagggtgaattttctgtgtacagtaagttcatcacctgaggcaaaggagatggaggaaaataggatgatgatgttcagaggtttgacatgagtgttcaaagattaagatagctatttcaggaaactgggcagcaagctggctaggaaaatgtcattggattgccaggcaatgttgaggcttcatttgatcttactgatcaagtatagtcagtcctccatatctgcaggttctggggttctgcatccatggactcaatcaactatgaatcaaaaatattttttaaaaaatttaaaaaatacaacatttaa

SEQ ID NO: 196432 - DNA, 575 bp, Homo sapiens
gcctcagcctcccaaagtgctaggattacaggtgtgagtcaccatgcctagtgaaagtcaactcttttatcttcaactctcactgttcataagctgatccagaagcctacaggagaagaaacccacaagttaggggtcagataaatcaaactatttattatctatatatgtttttattacaaaacttaggctatttatcttatatctagctctccttgagattcgactctacattatgtatatgactttattttttccacttctctcatctcacttccccttgtagtcaaaatggtttcttcacagctctcaaacctgcatattctactcctcgtcacttagcttgcactgttccccatccttttttcctcatccccacccatcctttggcagctgggttatgcttgttataaagccatgttatcgtttgggggcgttacatgcagcacgcattttggcatagagcatcactgtccaatttttatcccacactagttgtcgtgttgccagattggtttaaagtctctagatgacaaagatggctcagacgtgcccatcctcccttagtgctaaat

SEQ ID NO: 196433 - DNA, 627 bp, Homo sapiens
tataaaccttcacaacagccctgcaaaatgggtactgcaaactaagatctagaaagattaaatgacttgactaaggtcaaatattaaaaatgcagagataggattcaaaaggcagacaaccaattcaaaacctaggctttagcctgtaccctaagcaataaagacaaaatgagttactataaatgagcagagaataaataccctaacacaatacaaataaaatgctacaagaagattctcaatttaacatttaaaacagaaatctgtattaattcaaatcattacatgtactatgctgactcttagtagtagtatttccgtttatacaataatttggaagatcaagggcataaaattaaacacattccacctcaagaatttgaacaatggaatcacttcatcgttctacaattagacacttggtttttatagaatcaacacttgaagctcccttcttcttttaaaggttcaaaacaaatttagataatttccctctacccaaagaaaaaaggggcaagattaataccaatttacaaatgtaaacaaaataggcatgtattttttcagcatgaaaaaacagtaagtgagaactcaatactaataattccaactttaatgccataatca

SEQ ID NO: 196434 - DNA, 1075 bp, Homo sapiens
ctctctcctctattgcccaggctggagtgcagtggcacaatcttggctcactgcaacctctgtctcccaggttcaagtgattctcatgcctcagcctcccaggtagctgggactacagatgtgcaccacatgtctggctaatttttgtatttttagtagagacagatttcgccatgttggccaggctggtctcaaacccctggcttcatgtgatctgcctgccttggcctcccaaagcgctgggattacaagcatgagccactgcacccagcctagttttattctcacgtagtatatttaattgccataccaagggaatccaagtcccaaaggtcaagttgagaagacaattaccaatatttttatgcaagattcatataacataattattttttggtcaataaacaattgtgagaataaagcttttttaagcttttgatggctattatgttaactgttaatatatgacgggtaatgaagtgtcagaggctcattagatctttgagcctattgctgccagaccctgatgatactgaaatcctatctatcccatcaaaaacaacacataacaattggaactgagaagaaagaaaaaaaaagaaagaaagaaaatattttttcagcttcaatcagggtcatttatggttcctttttctatgattaggactttgggacataaaagattccctgaactataagggtatcagtttaaggaggtatgggagtaagatcctccagataacatattagccaacaataagcattgcatccttttgaagctttgtactaacatcaaaagttttatgattaggagttgagaatttatacagtcttcagaatgtaaaagaaagtgttataaaagctagtagatgttaaaatttattgtaatataagaggagtaatcctgaatgtgggagaaaaaaatagaaaccattagttataataattcattgtgaaggaaatacagtaactctgatacgaaatctgtttcaaaagggggagggttaggtagactagaaaaaaactcagtacttcaaccaaaaggcggcagaaatatcggcattgaaagaggatt

SEQ ID NO: 196435 - DNA, 131 bp, Homo sapiens
atgagtgggttcacatccactttttaatgttgcatcagcctgaagccaggaagtgctagagccgtaagactcctcacactgtgacctggccacatcctacatacatgtcagcttgcacgccatctacttaa

SEQ ID NO: 196436 - DNA, 559 bp, Homo sapiens
tggcctttaaactggttacaaagtatgtccttatataaatattgcttttgttagtgttgctacttcttgcaacatggagttttaaaaaatgttttattttaaaacattatgccctatgtgaaactgcttgctgatttctgtggttgacttctccgtaaacttgaacggagtgattcaaagtacctctagtccagtgctctgtaaatatccattgacaagagcaactgcaactcagctgcaagtcaaaaccaaagattcagcaaatggacagccaagaccacaagaaagaatcagggcctaataaccatttccatgtaacttatggctgccccacgcagcctcaggggcgtgtgattagcgtgaccacgtaatccttaagggtgtggggcacctgaccctggagctgaggcaggacaaaagccccattcagaagagcttaagaacctttcccaggaagccctaaggaccttaggacctatatgtttatacacatataaaaacatgacctatctcacgcacaatcaggaaatgcaaattcaaacaacagcagggggcccat

SEQ ID NO: 196437 - DNA, 151 bp, Homo sapiens
gtgaaggatgtgagttaaaggtaagatatttcaggaagagaaagtatttatgcccaagatagcaaagatcaagtactgcctatttcatctgtaaaatattccattttctatccatttttagaaatctttagctgtaatacctgccattact

SEQ ID NO: 196438 - DNA, 1071 bp, Homo sapiens
gcccgcccccatcttttcatttttatagcttcacctaagttttgaattaaaagaaataaataattaatacccaaaatattgttttatatcaatgaccaacgtaatgaaacactcagcagaaactaaagccctgaagtggttaagaaaaagctacctatcactaaatcaggcatgcttataagcaacctagaagaaaacttttatctgccttgttttggctttcctggcatacttccttacttcatctccattttataattaagttttgggtcacaagtctaaggcaaaggagcttccatactgaaaatctacatttttaatgcttattttatcataaaaataatttgggtaattttctgcaagtgacttctaacttaacagtagaagtttaaaactgttcaaagaccaaagcacaacatttatctagtgtttgatcctagtataaaagaatggcaataattatgtgaacaggaattacatgcccttagaatgtgcattttttaacctattaaatttgccaatcttgcaaactattgtttacttgtattgcataattagatactcatattaacatattgaattcagaaaaagttagcaagccaagatgacattctctgtagcactattttaaattataatgaatgatcacataaaactctttagtatttatctaaagtaattattactctacttcatttgtttatctaaatcagtgatcattgatgtttgaactttttggcttaaatgtttattttgtttatactacttgctagagtaaaataaatttaatacatgaaaaactctacacaatttaaaataggttataatttgtcaatacttatgttttaaaatatttttagaaggaggagtgctgtatattattaaaacaattttctgaaattgtttaatattatctttgattttaaaatgacatatatgtggatttacaatgaatcaaattgtcctaaaagatgtcagataagaaatgcaagtgctttgcaagtctaatacttaatgttcttttatgtacaacaaaaatttaataaattaactttaaagcaaaaaaactga

SEQ ID NO: 196439 - DNA, 335 bp, Homo sapiens
gcggccgcctactactactactgctcgaattcaagcttctaacgatgtacggggacatgaaaaactctacacaatttaaaataggttataatttgtcaatacttatgttttaaaatatttttagaaggaggagtgctgtatattattaaaacaattttctgaaattgtttaatattatctttgattttaaaatgacatatatgtggatttacaatgaatcaaattgtcctaaaagatgtcagataagaaatgcaagtgctttgcaagtctaatacttaatgttcttttatgtacaacaaaaatttaataaattaactttaaagcaaaaaaactga

SEQ ID NO: 196440 - DNA, 625 bp, Homo sapiens
ggtagagatgaagtctctctatgttgcccaggctggtcttgaaatcctgggctccagtgatcctccttcctcagtctcctaaggtgctgggattacaggcatgagccatcattatttaaaaaacaaacaagctatcatttttcagccctaccattgtttcctgacttatgtaatataactaaactgtttttgaagcttaaaatcaactcaagcttaattgagaagatgagctagtttgtttcctcaggtgtgtgtgcgtgcgtgtgtgtgtgtgtgtctggaaagttcttaccctttctcctcaggagtcaggagcctgggaatcaggagcttagggctgggagttctgccagagcaagagcaagatgtggcttgaggcccttcagaagcctccctgactcacagcaagaagcttggggcctcttactgatgggtggatgaggttcttttctgtcttaaaggggcaactcctatgttgtgtttttttttttaagaaaaaaggccaggcactgcgactcacacctgtaatcccatcactttggtaggctgaagcaggcggatcactttaggccaggagttccagaccagcctgggaaacacggggaaatcctttctctacaaaaag

SEQ ID NO: 196441 - DNA, 467 bp, Homo sapiens
tggtttggtagatctgacttgtaagcagttcatagaagctgctcaatactcaagaatcttgcaagacagttattaaacattcatagcttgaaattgcccatggtgggagagtttacatcacaaccactacaaatcagcacttgctttcttcttcttaaagagagctgcttaccatacatagcacccacagtgtctcccttctcttctaccccaacccctgaaacacactgacccctattctccagatgacagcacagctgtttgggactgatagggtcacagttgccaggttgggaatgctagatgtagtcttcacccatcaccttctgtcgtcctcccaggggtgtcatatttacagaggcaaactcttacagcttggatgatttctcatcaagcaactctactcacctctttttcccctttccctgtgcgtttcttcttcttgtcctcattttccttgagaaaac

SEQ ID NO: 196442 - DNA, 518 bp, Homo sapiens
acagccaaaccataccagaggctgaggtgggaggattgcttgaacccaggaggcaaggttgcagtgagccaagatcatgccactgcactccagcctgagtgacagagcgagacccctatctcaaacccccccccaaaaaacagatacaggtggatgattggatgggtcagggatggatgaatggttggatgggtggaaggatggatacagggtgggtggattgttggatagatggtgggataaatattcgggtggtgtatggttggatggatggtaggatggtggatggtggataattggctggatggatagtaggatggatggatgttggatggatggatgaacagtggggtggtagatgggtagataaatggttggatggacagtaggatggtgggtggttggatggatggattgatggatggatggatggatggagggttagatgaatgcatattggctggatgatagaatggtggatggatagatgggtggtaggatggtagatgtttaggtaa

SEQ ID NO: 196443 - DNA, 88 bp, Homo sapiens
gacaatggcactaaaacgaatggcccctgaactctgtcttctaaattatacataagcagagtgcaaatctaggctaggtcccaccatc

SEQ ID NO: 196444 - DNA, 511 bp, Homo sapiens
accctctccctaggtccccattttctgctccatcgtctgcctccccagtccctggagttcactctactgttccaccagctccatgattcctgctgacacctggcattgcctcttcaccttgtcctggtctcatatatggtttaactcttacccatttctttttctgaaaaaaaagttcaatgccactgtctttgtcctgcagcaggggtttggcaagagtgttgagatctgatggccattaagttcataagatgtggggctccttaagactggagcagtgctaaggagaacttagaagtcttagaggcattcaatgcacggttggctggatttttcttcagagccttcagagagggttacaaagaaaccctccctccttcacctcctttgagttctgtgataacttgagaagtaaagaaatgaatttgtatctcatttggaatggaagacacattgtaatttttttttctggaagaagaataaatattgaaactattggttctcaaaggaa

SEQ ID NO: 196445 - DNA, 389 bp, Homo sapiens
  misc_feature (368)..(368): n is a, c, g, or t
atgggcgaccatttcaattcaaccagagatccaacacactttcgaataaagagagaaaaaatgtattaactgacttaacaaaaacgctatttatttaactcacgcagtattgcttaaagagtatctacaaaattcttacctcaatgttttcttgcaagagacgtggaaaccaaaagtaaacagaccctctttaacaatgaaccactgataaacataaaatatttataactggtataacatttcacttaggtgcattttttgagtgttaacttgcatcaggcaatccaatttaccaacatttatcagatttctccccagtgagagttttcacttaacttttttttttttttttttttgggaaggggccncaacccgggggaaccgggagc

SEQ ID NO: 196446 - DNA, 194 bp, Homo sapiens
ttctctttccaaggctttaatttcctgcctgttgtctgagctgggcattaaggaggttgatcagggagcactgtcatctagttgaaatgagagatgctgcagttacgtctgaatcctgaatgttttggcggaagacccagcctggctcaaggccactgcagcagtgggacctttcagagcttccaggaggctca

SEQ ID NO: 196447 - DNA, 598 bp, Homo sapiens
ttggatgttgaagtcaccaactattattgtattggagtctatttagatctaataatatttgctttttattatctggaggctccagtgttgggtacatatatatttagaactgttatattgatccccttatcattatagaatgaccttctttacagtttttgacttaaagtctgtgttatctcatgtaagtatagcttctcctgcttggtttgggttcttatttgcaggaatttttttccatcccttcacttttagtctatgtgtgtctttataagtgaagtaagtttcttataggcagcaaatagtgatgctttttaatttagccagccagtttagtgaggagtttaatccatttacattcaaggttattattgatggctaaggacttatttctgccattttattaattgttttctggttgttttatatatccttttttccttacttcctcttttaagttttatcattgcagtttgatggttttctgaagtggtaatgtttgaattctttctctttcccatttgtgtatctgttctactagtgagttttatactgtcttgtgttttcatgatggtatatattgttctttcacttccat

SEQ ID NO: 196448 - DNA, 278 bp, Homo sapiens
aaaaattggctaggcatggtggcgtatgcttgtagtctcagctacttgggagcctgacgtgggagaattacttgaacccaggaggtggaggttgcagtgagccgaaattgcaccactgccctccagcctgggtaacagagtgagaccctgtctcaaaaaaaaaaaaaaaaaaaattataaacttttatcttcaaaagcaaaagcattgtttactgtttcagtcagagagaaatgatgcgtaattaaaatccatttgggatgaacagagaatgtttgca

SEQ ID NO: 196449 - DNA, 394 bp, Homo sapiens
gtgagaactgggctgagccatgccagtggcctgtgaccctccagccctggatgccaccccccacctgcccaaggggacccccactgatgtggtctctgctgacacctgtgcctgtgcctggggtccctgtcatccttccctggtctgagtggcaagtctcctgccatccctgtccccgctatgcggtgagctcttcagcttgggcccgcctggtggctcacgctactctccaccgtgcctggattagggcgagtgctgaggctggagctgaccctgccctggccttcagggtcttggcttagttccacctgcactggtccaagtccagcctggttgcctagtgaaggatccacagtgggtacataaagggccaagcgctgtccacgtggacaca

SEQ ID NO: 196450 - DNA, 240 bp, Homo sapiens
tgagttgtagtgagttaagatgtactgtctgatgagctgtagtgggttgagatgtactctctgatgggttgcagtgagttgagatgccctgccctacctatgcatgcctggtggttcccaaatctctgttttgattcgcactttttgggactaaccagccatgcaagttcggactaaccagccatgcaagttcggactaaccagccatgcaagttcggactaaccagccatgcaagctcg

SEQ ID NO: 196451 - DNA, 1156 bp, Homo sapiens
agcggggtgttcagaggaggagagaaagagatgaagaggagtgagccaggtttcaggagggggcacgcaggagaccagccctggattcagacttgagcctggtccacaccagaggccgatagaaggcttggattacagcaggggcaggttctttcacgaaatcaaatttctccactgatttctgaattcatagcaagctaactagaagagatttttaattcagaatgctgcactccaaaaaactgagaaagacattgagggagggaatatggaaatttgatggtatctcggctaagtttgatattgagatttttgtaataaatgttgttgaataaaaaaggcatcaagatgcctaaatcagagagataaaatgaagaataattacagtatacaatttttgaattattgtccaatcaactaaaattagaagtttttaacatgctaaaatggaaagttattcaacagaatggaatcctttaaaatatgatggaactgccacttaagcatcagaagtctgctcaggtgtgaccctgggagcccaaacttttcacggaacagcaaggaacatccctgtgctcctccttcccagtctctttttttttcagagggagtctcgctctgttgcccaggctggagtgcagtggcgagatctcagctcactgcaaagctccgtctcccgggttcacgccattctcctgcctcagcctgccgagtagctgggacaacaggcgccagcaccatgcccaggcatacaaaacctgccttgcctctccccagtttgaacagtgcttttgaactttgatggaaaagccacatttggaaggtaaattcttacagggaagagattttttttcttttgtctctagttcatggtaccttggatagatgtgtgttcactgcagagtcctacaaagtatgctctaatgttcaaaggcagggtagtaggttctagtaacagcgtgggatttgcacatgctttgttgactttttattatgcaacagcaccttttaagtcatgtgctaatctagcacattcagttgtcctatatgagagtgtgattgttcctaaaatattcaccaatcatttgttctaagtgctaggctcttctgtagtattttcagatcttccttattaaaatttgggagctaaaaaaca

SEQ ID NO: 196452 - DNA, 250 bp, Homo sapiens
gggtgggaacttaagggggttcatagcttagggcgcatagctctggataatccagcaatggtttgtaatcctggagtcgtttactccatctttttaggcctatccctcagccaaggaaagagactgtgagaacagcctcttgccacagttcccctggtatgttgtgctcagggggactgcaaaggccaatgttggtgctggcaaaaagccgaaggagtaaaggtgctgcaatgatgaactgcttgggctg

SEQ ID NO: 196453 - DNA, 268 bp, Homo sapiens
cttttgtggtataagttgcttctggatagatttagtggtgttgtattgataatttcatttactcatgtgcattctctaacagattgtaacttccatgaaggcagagctgaaacctttctagctttaatgtaggctagaaggtatagggcctcacatgtagtatgtgctttaatattactgcaaggataaatgagttccaaaacccaaccagatgacagctgagacttgacaagcctcagaaaatctgagaaatattttctcttctttg

SEQ ID NO: 196454 - DNA, 522 bp, Homo sapiens
gctcggtacccggatggcgaccatttcaagcttctaaaagtgagattaatgagtcagaaggtatgaatataaggctttttgtcaaattgatttcctagagggtgattcattatactttttcaccggcattgaggtcaagtgtcctgggagtaggactgttgaaaatgtaaaaagtcacttcagttctggaatttatcttgctttgctttgttttgttacacttttttgccctctcctgatgctcacctggggtcacacattgcctctggttgtcatatgtctttcatctctttcaatctagagcagtggttctcaattagggagtggatattgtctcctagaggtcatttggaaatgtctggagatagttttgattgtcagaatcaagggggtggctactggcatctagtgagtagaggccaaacatgctgctaaacttctcacagtacgtagggtggtcccttgcagcataaacgtgtctggcccaagatctcagcagttgaaatggtcgccaatctagaa

SEQ ID NO: 196455 - DNA, 502 bp, Homo sapiens
agtccaccactggcgtgggtgagcagccaggtaatgggaattgatcagtgccaccacccttgaccccaactaccatcccagatgcccagattccagtcctggagttttattctctcagcttgatcctttgaccaagaagatccagtcccaatatgtcacctgtgcttcatctttggactatatctcaggtgtttacgtgtcaactaatgggagcttactgggttagaagtcaggacactgagtttcaatcctcacttagtagtctgtggccctctttggcacattaacctccctccttgatcctcaggctgcacctctggcaaatgggagaatgcggctccttttgacttcaagggatctttgtgggaaccaatgagaaaatgtgtgtgaagatagctttttggtatattttaaaagtgcacaaatttaagatcttactgctttataaagtgctttatgaattataggaaaataaacacattttagatcttagaaaaaaaca

SEQ ID NO: 196456 - DNA, 190 bp, Homo sapiens
taaagcagagtcaggtgctgggaaaatgctggactcttgtcggccattaaccgactgaccatgtgaccttcagtaggttattctctctttagacttccctagcttgtctttagtgagagctaatggttttcaaactgtattccttggtgccccatcagatgtcactgtggaagttaggaggaggccagag

SEQ ID NO: 196457 - DNA, 279 bp, Homo sapiens
gggtcggccaatgttgacatgagatcccagtaaaaaagtgggataggggaaataaagagtacagtgggctgggcgcggttctttaatattttcagggacttttctttcttcccagaatgaagtgtaacttccctcggttagctcaaaggtctctacaataagtatatgctactgtctatcctcatatgttaacaaattttatgcttttgctattccagaatcgtcatcaatcctggactcattctgtggaagagatgtttccactctgatgtttctttg

SEQ ID NO: 196458 - DNA, 739 bp, Homo sapiens
tgatttttttaaaagaaatttcccaaaatcttgatgccagtgggttctctagaaatgataattttgctgaccatttttctcagtgctcttggcttcatccagtctagatagggggaaacactgatttctgattcttgagttctagacagttatatcttcttgaaaggggcagagttaaagatggaaggattggtatcttgtaaatatattcagacactcatatgggaaggaaagggactgtccattttaataatggagacatagacaggtttatggttcagctttcaaaatcagtctgagaaaagttaagcctaaagttttcttccctttactgtcattaattctgtggaatatctggaacagtacttttgggtgagttggagaaagctacacgctctggaacgatgccaacagggaggcactcagatgatttagcaaggtaaaggcctttgatcaaagaaaaaaggaatgcctttatccttggacacagtcaaatggattccataacaactcccacccactatcgcagcctggcacccttgtgcagtgtacatactgcacaaccaatcatggttgactgtgttactagatattctgaaacttagctctctgacatcttgaccagtcctacccaaggcacaaagccaagaaagaaatgatcagaagagattcccaggggccaaaatggatataactacatgtgtactctcagctcatttactttgcttgaaaaagaatc

SEQ ID NO: 196459 - DNA, 392 bp, Homo sapiens
aataacaccgattcgtattgatgtatgtattatcatttgtcattttctgtgagacttgattttcatatcttttgcacattttttagtgagttttgttactgtattaagatctctgtcttttctactatggcatttgtgttacctgtcttgtttgagaaggcctccctcacactgagattttgttaagttagatttttaattcatatggaatttattcttttatggtttccagatggagtccatattgagattgtgttacagctattaagaagcactcacccttcttttaagctttcatctggaaatagatatgtgattagtgaaaatgcaagttgtagatttatccctgtagttaaacacaattggcatatgtgcacaaagaggaagggggt

SEQ ID NO: 196460 - DNA, 403 bp, Homo sapiens
aataacaccgattcgtattgatgtatgtattatcatttgtcattttctgtgagacttgattttcatatcttttgcacattttttagtgagttttgttactgtattaagatctctgtcttttctactatggcatttgtgttacctgtcttgtttgagaaggcctccctcacactgagattttgttaagttagatttttaattcatatgtgctcttgtgttgtgattagggtggatagagtatatgatccatttattaggagcactgatagaaggatgattgccagtgttacttcatatgaaattgtttgggctactgctcgtagggccccgatgagtgcgtattttgagttagatgctcatcctgatcataggatagaatagactgctaggctatacatcatta

SEQ ID NO: 196461 - DNA, 197 bp, Homo sapiens
aaggacatgcaccccctcaaatccgcttcccccacccccttcaatactgagaagaccacggaaacaaatcacttcgaccacttagaaagcgatcaaacctttataaaaatccatcgctcccaaatcgatgggtgaatatttgctgggaatttgttccagaggaataaatgaggagccttgagtgtattaaatgcaaa

SEQ ID NO: 196462 - DNA, 281 bp, Homo sapiens
tcggttaggaccggaaggtagctgtactgttagttagaaagccggggactagagcctcctcagtgtaattgcctgccacttaattattctcacactccacaggggactgattttcccctgcatttttcacatgcgttccaagcggggtctcaagtgtacctcccagccccattcctccagcctaactctggcctgcagttagatttaaactgcaaataaactaaaatactaaatttctagttccttctgacatttccagtacagctacctttccggtcatt

SEQ ID NO: 196463 - DNA, 1060 bp, Homo sapiens
  misc_feature (760)..(760): n is a, c, g, or t
  misc_feature (772)..(773): n is a, c, g, or t
  misc_feature (777)..(777): n is a, c, g, or t
ggagagagagagggcagcaggagcctgggactcgggagcgggacccggacaaagccacccgcttccggatggaggagctgagactgaccagcaccacgtttgcgctgacgggagactcagcacacaaccaagccatggtccactggtctggccacaacagcagcgtgattctcattttgacaaagctctatgactataacctggggagcatcacagagagctcgctttggaggtcaaccgattatggaacaacctatgagaagctgaatgataaagttggtttgaaaaccattttgagctatctctatgtgtgtcctaccaacaagcgtaagataatgttactcacagacccggagattgagagcagtttattgatcagctcagatgaaggggcaacttatcaaaagtaccggctgaacttctacattcaaagcttgctttttcaccccaaacaagaagactggattctggcatacagtcaagaccaaaagttatacagctctgctgaatttgggagaagatggcagcttatccaagaaggggttgtaccaaacaggttctactggtctgtgatggggtcaaataaagaaccagaccttgtgcatcttgaggccagaactgtggatggtcattcacattatctaacttgccgaatgcagaactgtacagaggccaacaggaatcagccttttccagggctacattgacccagactctttgattgttcacggatccttatgtgtttgttcagtgacatcangagggcggcacnntacntagtgtctacgaaggaatgactggctcactgaaggttccgaaaatgctgtgccacggcattgcgtgtacaagaccgatgctactcccggtgcgcagagggtgcccaaacagtggacccgaagcgcaagcaacaacccttactcgtcaaccacggggggcacctaaccccggtcttgagaagctccacaaaggcgtgggcaaccagcggcccataggaggagaagcgacgtgtgcacaagtcgccagggcacaaacacaacgcagcaggcgcacatgagcacag

SEQ ID NO: 196464 - DNA, 448 bp, Homo sapiens
tgaaaacacagccattctggaaaaccatttggaagtttctttaaaacaaaaacaaaaacaaaaactgaatatgcacctattataagaatctgggtaaagggcacgtgggatctctctgtattacaggctgagtaacccttttccaaaatgtccaaaatgctttagatcagaagtgtttcagattttgaattttttcattttgaaatatttgcattataccatttgagcataccgaattcaaaaatccagaatctgaaacgctccagtgagcatttcctttgagaatcatgttggcactaaaaaaattttgaatctcagagcattttgtacttcaaattttcagatctgggatgctcaacctgtatttctgataacgacatgtgaatccaaaattatctcaaaataaaaagtttagttaaaaaaaattttaaacaacaacaacaacagc

SEQ ID NO: 196465 - DNA, 290 bp, Homo sapiens
gctgccctttctctgcatggcccggcccagcccgggaaggaggaagggaggaagggagggatgctggagctgccatcttggctcccggggacttggtgtccatgctgtaacacatctgtcactgcgtgggtgtggatgaggctgccacatgctgtgccctttcctgatgcagcttgtgatgcgtgagatgctggaaatgtatttaactcgcagcacaggtgtctctgatgttttcttcaccccaccccaccccccgactcactaataaaaacagctccgcacctggccca

SEQ ID NO: 196466 - DNA, 357 bp, Homo sapiens
agcatggtatgcgacctttcaaccactggaaggggcattgtgaagtttgcatatagtatgccagtcatcaccaattatggggcctgactaagccttttgattccaggcaggcacaactaaacagaccagtcctcggggacacaaagacaagactggccctgcaggaaaaacaaagatcaaacaaatcctggccaagccacagccacactgaacggcttgcttatctctgcaggaaagagtgtgtgtgtgtggtgtagcaattgaactcaatttctacattgaattctccatttacaataggggcatcaaggtttctattaccctacattctatagaccataatccaggaaggtatac

SEQ ID NO: 196467 - DNA, 639 bp, Homo sapiens
agtctagaagtactagtggagaagaagggcatgtagacttttcacttctttaggagtgaatggccctgacatgattcggttgggaaggaagtaggaatcttaaggaaaacaaatgattcaattaagatgaagagaataaaatggtcaaatattaaaaaagaatttgttttgggggccatagtgattaggcttgcagaaaatgccaacaggttggcagaaggttagagctgtgctgaaagggatgagatcacgagacaacagccatgaagaaagggtagtaagtgattatgtacctcaggactgaagggacaagaggtcaggaggcactctgtaggggcctagatgtctacagggatatgtttaaagggggtgttgtatagatagaaaagtactttgtttccaggttccaaatataatgttattatgttggtagaagcatctccaaaactctggccctagaaattaggtcctaagtaagctttaaaagtggtactcccagtcttgggagattcacgttaaaattaaactataaaaaaactaagagaattcagaaaattatttgaatgaagaagtgctttataagtatgacaaaaagttagaattcttaaaagatttttaaattaaattgaaaacaatttc

SEQ ID NO: 196468 - DNA, 608 bp, Homo sapiens
aatttgtgagaaatataggcagtgttccacaagaaaagaggttaaactttggtcttatgtagaaatttggaatggcttataatcttgaggtatgtattttttgggaagaactatgtagaagtgtaattctttacaatagaaatatgtccttcctatgtattcacgaacacatagaatttatatattgggattagcttactaggtatcgacaagtaataagatgtattaaatgccattagggcagggcttaaaacagtttatgaaggggagaattaactttgctgtaaatatcttctgtgactgaaaaagttgaactcttgcttttttcagagtttgatttttgttagaataaatttcatttcctctacatgtgtggtcacagtccactaatacttgtcatcgaatacttgtcatagttttgttgcccagtgggttctttatgcatgtaacaattcattatactttctgaagcatggtgtacagtcactttggaaactgattcctaaggaatattctagccaaatcatgtatctgtggtttagtttttctacagtagggctgtgcggttgctgcctgctttatagggcatgtgggtttatatggtatct

SEQ ID NO: 196469 - DNA, 705 bp, Homo sapiens
gtaaccccacacccaaagagctcagagacgtggaaatctgattacagacctccgggaaactcagagacttcacaatcagggataaagatccaccaatttctcagagaactcacaaactgggacaaaaatggaccaacagttcagagacctcacaacctcttctcagaccaccagacagcccagagacctcgcaccacggacacaatgctagagagccctaaaatcacttatgctggaacacaggcccgaaaactactcagaggctcacaccctggacacagattcctgttcagagatgtcatatactggacatagagttccccaaaatagctcacagcctttatacaccgagacagatccccaaacagctcagaggccccacagacctgaaagtgtggacataaaccctctatagagcttaaagacttcacaccctatgacaaaaaccctgaggaactgagatcacaccccctggacacggaccccaaacagcttagaaacctcatatcctaggctcagacccccaaacagttcggagtcttcccactctaaacgcagacctctaaatgcttaaggaatatcacatcctggactcagtcctcaaaaccattcatggaacttgccctttgtccttatccggaaagatttcagatggctgatagtcatggacacagatcaccaaacagctttgaaacctttgtgcaa

SEQ ID NO: 196470 - DNA, 333 bp, Homo sapiens
actacggttgcacaccaccacacccagctaatttttttattttttgtagagacagggttttgccatgtgccccagactggtcttcaattcctagctcaagcaatcctccctcctcgaccttcagaagtgctgggattacgggcgtgaaccaccacgcctagctaccaccttttttcttaattggggtactagggtctctagtataacatgatccagaagtaatctttgccttattcctgagtagagcacacacgctctctctctgtctctccatctctgtgtgtgtgtgtgtgtgtgtgtgtgtgtgtatctctttgtgtgtgtgtgtgtgtt

SEQ ID NO: 196471 - DNA, 344 bp, Homo sapiens
gtgactggcttctttccctcagcgaactgatttttaataatagtgagcacagatagttcagtgtttttatcataagctaagcagtttacattaattcattgaaatagtaccttgtgaagtagatactcttattacctccatttacagataaattgaaggcacagacaagtttaagtaacttgccaaatgtcactgaggtagaaagcaactgagccaggcttcaaatcaaacctgtattagtgattacccaatgttgcctcccaaattgtagctcttggctgggcgcagtggctcacgcgtgtaatcctagcactttcggaggccaaggcaggtggatcacctga

SEQ ID NO: 196472 - DNA, 412 bp, Homo sapiens
caccataatgatttggaagttcctgttgtcagcattaccagcaattgatactgtcattgtgttggattttagccattctcttaggtgtgtagtggtatctcattattttaacttgcagttgcctattggcaaatgctgttgagcatcttttcatatgcttatttgccatctgtatagcttctttggtgaattgtgtttgtgacttcctgacatacaattcctaaaatccttagaatctgcaaagtgttgcctttttgtatgctaatgaggtgactgatggctggcagcctctaggtagcttcaggatgggggctggtgacctgaaagaccaaggcaggattagaggtttgcaactttaagcccatcccccagcctttggggaggggagagaggctgaagattaggttgatca

SEQ ID NO: 196473 - DNA, 328 bp, Homo sapiens
aagaaatgaaaacagcttgattgacagcctagtaacattaataaacttcgaaggtagagagctgctcttactttaaacatcccagagcaattctatcagaagaataaatactctgtattccaaattcaaacactttcagttgcctttggttgaggcaattgtattctaacagcaacatggcagctttaacaaggtatttacatttctatgtaaaatctcaatattccctaactctgattctatcccctctttcctttgagggtgctttatttgacacagtgtggtattggatcctgtaggtacccatatcccctggcctctttaccat

SEQ ID NO: 196474 - DNA, 462 bp, Homo sapiens
ggaaacaacagagtgaaaaggcaacttatgaaatagaaaaaatatttgcaaaacatacgtataattaatatccagaatatataaaaaaaaactcctacaactcaacaaaaaacaaatagctcgattaaaaaatgatcaaaggatttgaatagacatttagccaaaaatgattaacaagcatatgaaaagatactcaacatcactaatcattaaagaaatgcaaatcaaaaccaaaatgagatatcacctcacatctattaagatggccactatcaaaaagacataaaacaaatgttggtaaggttgtggagaaaatggagcccttgcgtattgatgatgggaatgtaaaatggtgcagctgctgtggaaaacagtatggagattactcaaaaaattaaaaatttaccatatgatccagcaatcccacttttgattatatacaaaagaaatgaagaaggatct

SEQ ID NO: 196475 - DNA, 528 bp, Homo sapiens
atcaaagatatgcaaattaaaccactcaagccccccaaatgcaatataaggcaataatataccattttatagttataaattagccccccaaatggagttaataaatcaaatgctggtaggactgtagacaagtgagaacatttgtaaacggctagtgacattaaaatctggtgcaatatttgggtaaaatatttagcaaaacacatcaagacctataaagatatctgtactctataacctagtaatcccactgttgggacttcatcctaaaagaaggaacagaaatctgcagtcccaccattgctgagtcagcagtacctaaggcctgtgactgttaatacctccagtgcgtgggtgacatctctacagtcaattaatgagccagtcttcataagatattacattagccagcctggctaacatcaattacagtcagaagctgagctgtaatcatggggcgaataagactgagctgctcattgtttaaaatgaccacagaatgaaatcacctttatgagcacaactggg

SEQ ID NO: 196476 - DNA, 404 bp, Homo sapiens
aactgggtctattctgtgcccctaactttattctttattatcctttttctcttgtgcagacaatggactgggctgccgttcatgccccactgccactttgttgtttttgcctccaattataccaaagattatgatcatgtgatctccaagtaccatcttagatatttgcatatcttaggtaataactttggaaaggggtttcacagtaccttatgtctaaaaattagctaaaatttaataagttggcacctataattatacaacgtgtaccttttctccctaaaagtttagccctacctcttaatgcttattacatttattttaaatagtatgtctctatcttaactatagggaaagtcagatggtctcacttgagggaaggtagcatgtgctaaccacttttg

SEQ ID NO: 196477 - DNA, 574 bp, Homo sapiens
aaacatggaagcatataattattatattaatagtattctgttgcaggtgtccagaattcaatagcaacaaaggggcattgggtgctgaagactctcatccagatggtcggcttgctggcgcctcctagctggatttatcaagggtatcccttcccacacacgtggcctttctagaatctgctgtgaacagcaggacctgcagagacaccccagggaaaggcttatggtaatcactgagggactgctggcaaccagaggcctcctcatcccctttggttgtttgcatgtgatttgatgccggagtcgccactcatccccagggggtgtgtgtgcatatgtgtatgtgtatgtgtatgtgtctgtgtatgcgtatgcgtatgtgtatgcgtatgtgtatgtgtatgtgtctgtgtgtgcgtatgtgtgagcatgcatggtcagactgaccttggaccaatttgggtgttttatttcattttttttttagatggagtctcgctctgttgcccaggctggagtgcaacggcgccatcttggctcactgcaacctccgcctcccgggttcaagtgattc

SEQ ID NO: 196478 - DNA, 485 bp, Homo sapiens
aattctagcactttggaaggctgatgtgggtggctcacctaaggtcaggagttcgagaccagcctggccaacatggtgaaatcccgtctctactaaaaatacaaaaattggctgggcgtggtggcaggtgcctgtagtcccaggtgctagggaggctgaggcaggagaatttcttgaacccaagaggtggaggttacggtgggctgagattgtgccattgcactccagcctgggtgacaagagcaaaactccgtctcaaaaaaaaaaaaatgctacatggccttgggcaagtcacaccaattcttaggcatggttttatcatttgtgcaattaagatacactcccccactgggtccctgaaaggattaagtgaaaggataggtataaaagtgcttggcaccttgtcagtgcttagtcattgatttcctcttatgtcttgcaataaatgttattgaataaacggtaatttaccaataatatatcta

SEQ ID NO: 196479 - DNA, 282 bp, Homo sapiens
tcactcaattgctcaagtcaaaaagcctggcaattatcccacgttctcttttttcctcacctgcaatatccaatccatcagcagagtcaataaatcttgaatgcgaccacttctcgccaccaccactgctgctaccctgccctcatctctcagctggactcctgaactggtcctcttgctgctggactgtttccatctgaccccacagtgctctccttaacaaccagaggaaaaggcaaatccgattacatcagtgccctcggaccagccagccaagattgg

SEQ ID NO: 196480 - DNA, 347 bp, Homo sapiens
attttcatctcctatcttccagctctgccatccactgtgtcaagctcaccctgcagctagatctcctcatgggcatagaatggctgccaggagcagcctggatcattgcatcctcattcacatctggcagaagagtaaaagctaccagcaaaccattttttgtgtgtcattaatctgaatcctgtcacctgcccattctcttatcaatcacgactaaggaaaggatttagattatttgcttggattaatcaggggcacccatagacctggcatagaatggatgttggggagacaatcacaattttcattataattagaattgcttaaggagttcaagatcagcctgg

SEQ ID NO: 196481 - DNA, 168 bp, Homo sapiens
ccttgctgttctcgtgatagtaagcgagttctcacgagatctgatggtttaaaagtgtgtgtcaattgcttcttttctacccatccccatccttccgctgtgtgagatgttcctcgcttcctcttcgtcttccaccatgattgtaagtttcctgaggtctccttcccc

SEQ ID NO: 196482 - DNA, 517 bp, Homo sapiens
gataatattagggaatttcccaaacctggagaaaaatattaacatcgatattcaataaggttataatcaaactcccaaaggtcaaagataaagaaagaacctcaaaagcaacgagagcaaaaacaaataacttataatggagttccaatacgtttggcagcagacttctcaatggaaaccttacaggccaggagagagtggcacgacatatttaaagtgctgaaggaaaagacctttacccaagaatagtatatccagtgaaaatgtccttcaaacgtgatggagaaataaagacttgctgacaaacaaaagctgaaggatttcatcaacactagacctgtccaataagaagtgctaaagggagttctttaatcagaaaaaaatagatgttggtgagcaagaggaaatcatctgaaggtacaaaacctgctggtaatagtaagtacacagaagaacacattgagtattataacactgtaattgtggtatgtaaactacacttgtcttaagcacaaag

SEQ ID NO: 196483 - DNA, 243 bp, Homo sapiens
taaaatcagcagcacatgaatttttgtaggtggctcgtatttgctattaatattgctcagaagactcaggaataagaaataataatgcagggtttcttcaaaatatggttctggacagtggattatagttacctggagagcttgtgttaaaatatctgaggatgattccaagtaccagggcttatacacaggaatacttgagaaccactgcactcaagcatttaaaattttccttttacctaa

SEQ ID NO: 196484 - DNA, 539 bp, Homo sapiens
gagctgttactgcgcgtttctggcttggaaagcttccctgaggctgctcaacaaatctgcagccaccctgtaccaggaagcttgggataatggacaataattttaggtaaatagatagaataaaagacctttcatttatataactatgaggcctgctgtgttatgttatgatttctgaaactcagcaaaaaatgtttatctggcaggcagctttccctgtagaaagattagtctaaaatctgaaattccacagtctggaattcagggactctcaaacaaaattctgaacacacagttacctgtcaattaaattaagtatgaccatcacatttcaccatgagttaggggttcttattttggggatcatctttaaaaccatatccaataatttcagaactagtttctgttgcttattttcataggacttatgaaacataatatctaagaccaacttattggatggtttggaaaatattgggacatttcatatcctggccttcttctgagtctttttttgatgttactgcgtgcatacactt

SEQ ID NO: 196485 - DNA, 545 bp, Homo sapiens
  misc_feature (451)..(451): n is a, c, g, or t
ttatttatctgcttttaaaaagtctaactttaaatgcattttcatgtaccgactgggaaaaagaagggtgctacatcaaaatttcaatgaacttaaccactcgtccatattttaaattttaatatacaagaaggagaaactatgttcaattttccctgtacagttgagattttagcatttgtagactagaggtgaatatggaaaagataaataagttcaaattgcaagtccagtttaaatactatgttatcttttatttaaaacagttttaatgagagagagagagtaaatagctaatacggtagtttcacaggaaagagccattggttgaaaacgctcatttattttataaaaagtaggaagaaaaaaaaagtcccatgttaattttaaaataaatatttcagctttggctcttaatattttgtttaaaataaactaaatgtaattttcncctgagtgctgcataaagtattaatgcaacgttttggcacaggctaaaatgtaaaagcaatcacatctgtcttttcgggactgtgcaatcgttt

SEQ ID NO: 196486 - DNA, 443 bp, Homo sapiens
tccagcccagcttcaagtcctctattctgccctgccctaatcctgggcttccggagccttctttcaggacccaaaccctccatactccttccatctcagccccaacatagacccttcttccaccagcctcactcctcttcccatctgctcacttcttctcctctgatggtcccatccccaggaagtcccccatgaccccaaagagggttacaccacgtatattcccccagctctcactctcttccccaatgatgaaacaccattataatggaaagatcaattgcatcttaaggactgggtatctgccttcccgactagatctcaggctctaggagggtaagggcaggtcactatgcctgctttcttcaacactgccacccagcacttgtttaatgtctggttcttgatacatatttgttgagtaaataaatgactgtcattta

SEQ ID NO: 196487 - DNA, 621 bp, Homo sapiens
tctgtataaacaatgtgatgccagctgagcacctgattttcttctgaaagtcaggaattcggattgtggtcagtcacgcaagctcaatatgcccatgtggccaacccacaatccaaccccgaactcccaggctccgatgagcagcgctgatagatggtgttccgcacacccttgcaacgcatcactggagaggcaaacatgcccgtgtggctctcctgggagggagttttgggagcctgcactgtcttcctccagactccaacctgtgcaccttttccctttgctggcttagctctatgtcttttcactgtaatgaattctacctgtgagtaaaacctcatgctgagccctgtgaatcctagcaaatcaccaagtctgtagttggtcttaaggaccccagtgaagttggtgtcagaagtggggttggctaacatgactctgcctcactgaaatacgatgaaagctttctttgggaaaatgaaggatgaagaggtgaagatgagatgttagctcctgagtcttccacagcatgaaatgcagctgagctgccaaatgccgtgaaaggtaaaagtcatctatggagtttagaaatgatagtccaagcccaggagagctgggatg

SEQ ID NO: 196488 - DNA, 277 bp, Homo sapiens
cctctttctccagcatccatccattcagttaccaccctagctaagcacccattagctcttgcctcggttaccctaaaaaccttctagctggtccctatttctattctgccaaattcccactcccccggttctattcttcacaagtagttctcatgattctcttaaattctaacaggctatgtaacttctttactcaaaatttcccgtggttcctcatcaactgaaataaaacccagtatctttccatagcctacaaagttgtgacctaggtcctccc

SEQ ID NO: 196489 - DNA, 446 bp, Homo sapiens
gtctcatgagatctgatggttttataaatgggagtatcccagcacacgctctcttgcctgctgccatgaaagacgtgagtttgctcctcattcaccttctgccatgattgtgaggcctccccagccatgtagaactgcgagtcaataaaaattctttcctttataaattactcagtctcaggtatgcctttattagcagtgtgagaacagaggaatacaccatttttctttaaggatcaagtatttccaatgggagaaaatagagaagcattttctagagtcaaggaaagcatagtgcataagttaattaacctccctggcattcagaatttgttccttggggagctcaaacctaattctgtttgtgccaacctagagttggtgtggaatttattcttcccatatcctacacagaagcagcaagaacatggttataaatagtgtac

SEQ ID NO: 196490 - DNA, 833 bp, Homo sapiens
attttctggcaatatgtgacacactgtattctggtttctgaagatagggaggaaatgagttacaaaaggtccctttcctactgcttactttctcctgctgagagatcaacaacaacaacaaaaagtaaacatagacatcaacagttcagaaaactttcaatgctgacatgccccaaagacagtaaaacataggtaatgtaatagagggtgatgagaaattactttaataggggaagtcagggaagacgttgctaaggagttcacatccaaatgatgagaagccatgcacagacctggggaataactttttagacggcagtaagtacatagtccttgaaggaatgaggaactgtaccaaatgaaacagaggcatcacacatactgaggagtaaaacatgactagtaaattttgaaataaaaagttatgcatttttatagcgatgggattggatacggataaaatttcagaaaatctatcaaagaaagaaagaacaacagttgggtggtagatctgagctaacgtacagctcaacaacatgacagtatctcggttggttgctcaacatttaccaaaaagaagacttaatgttcatagactaaaactatttgaacccatttggttgataaatcctagaaatgaaaaaagaggtacagagaaagtgaatctagactactgtttctcaacatgagaacgaataaaataaattagtgtaaaagaggttagccttactccatatatattaccatgaaagtccctaaaaactgatcatgagagcttccgcaactttatcagttttcccatggttaacatatttattgcattttcctgaagc

SEQ ID NO: 196491 - DNA, 347 bp, Homo sapiens
  misc_feature (135)..(135): n is a, c, g, or t
  misc_feature (170)..(170): n is a, c, g, or t
tgaatgaatcacttctccaagatcatcctgtcggtcatatgggtgagagtctcccactaatagtactagcatttgagctagttcgagggcgaaatgtactccagttatcaaagtcatcattgctgtgagagccanggcttgcaggccatttggaaaactgtgatccaggnctgtccccagcaccctcctgggtctagccagggaaattaacatcaatgggaaaggtagggaagggtaataataggaaccccagagaggttgaggggaagctgaaataaaggaacttgtagcctacttcttttttgaagtgttgaaggaaactgacccatagagcattctggagccaa

SEQ ID NO: 196492 - DNA, 381 bp, Homo sapiens
ctggtatttacatgttcatcccattcatttaaaaactatgtattaataatagtctgggtatagtcataaggtatatcattttttaaaaacccatttaaactgtctgtctttaaactcattaggctgaaagtcacttataatcagcaacatcaaatgacatatttaagccaaaataagtactatgatagaattagtacactgtatgtgttacgcatttgtgaacttaaaattattgtttttattgatatagttatttataaagtcgacacactagtctcccaatccgcacatcaaaatacatcttaggcattctgttgatatactgaacaaaactctgagaaaaagaaggaaagaaaatataataaaaatgttcagacactt

SEQ ID NO: 196493 - DNA, 528 bp, Homo sapiens
aaatcaaaactaaaccaccatcgaaacccaaattcacaccttcaaagtcaagcatctaataattaacagcataccgaagtttacacacacgttaaaaacaagtaaatctggcatatgccacagcaaaatacaggcctccattatgaggagtactgagaagcacattcgcatccttccttttctggtgcaccacaggctctccctccagtggagacttgtcgtttcatctactttcattacatgtatttcaattgcaaagaggctctgatcaagcaaagcccatccttacaaaattggaatccacatgcaaaccaaatagttctttttccagctcacaccatgtcatgtgattacatcaacacatagcaaaaaactgggtattatattttccaaattgtcagatgatcccaaacaaaaaaatccaaacccctaaaatcaatggcagtcccttaaatatcactgtgacaagaacacttaacagtaatatacagaatcatccatcctactataccatccacagtccaacac

SEQ ID NO: 196494 - DNA, 509 bp, Homo sapiens
atggaagaaaatatttacaaattatatctctaataagggatttgtatccagaacatacaactcaataataaaaagacaaataactatattcaaaaataggctttttgaaatgaagtatgggatgaaaaaaatgggcaaaggatctgaatagacatttctgcaaaaaagctatacaaatgaccaataggcatatgagaagatgtttaacaccattaatcattagggaaatgcaaactaaaaccacaatgagattctacttccctactccctactatggctttagtaaaaacaagtgttggtgagaatatggagaaattagaaacctcagacattctggtgggaatataaaatgatgcagtcactttggaaaacagtctggtagtttcttaaaacacttaacatagaattaccatatggcccagcaatttgacttccttttcaaatgtttcatttgagaacacatattcacataaaaacttgcatacaaatgttcatggaaatattatttg

SEQ ID NO: 196495 - DNA, 654 bp, Homo sapiens
atcttaaattggactagccatatttcaagtgctcaatcaccacacagctagtggctactatactggacagcacaggttcagactttagcaaggaggttttcaagtaaggagagtctcccaaaacagaggttttaatgatgatctatacactttatgtgaaaatgaattaggctgcctccttactatcaaagaaatgcacaccgcaacctagagcttcaattatttaaccagtaataccattcttaaggcagagtcacaaaagagaccttttagtgtcagtgtcacagatctttagagggtcacaaacacatcaagttggatcataagcaaaagagctccagatttgataatataagcaatgaactctccagacataatggtttctaatgatatttgaactgaactaaaacaaaaacatagaatttttaaaaatttgaaccatatgctaggatttagaaattttaaaaaatcggttcttgaatatgactgaagtagaggtctatatatttaggaacacagaatctggctacctggctacatagttccattcactcttcaactagagaaagaaagttcattcagctactccaaccaatatttagtgaacagctattgagtaaatcctgtactctaagtgctgaactcggtgttggg

SEQ ID NO: 196496 - DNA, 896 bp, Homo sapiens
gactaatgatggatttatcaggacatgaccccatagtaagtcaaagaacatccatatatatatacaatggaaccttatttggcattttaaaaggatgaattactgacacagactacaatgtagaagacccttgaaaacattatgctacatggaagaagccagtcacaaaggctgtatgcctgattccattcatgtgactgtccagaataggcaaacatagtggatttcaggcaccaggagctggaggggggacagagtaggttaacaggattgaggagtgactgctaatgtgaatggaatttctttttggggtgatgcaatgttctaaaattagattacagtgagggttgtacaactctgaatatattaaaaaaccacttaattgtgagaataaaagataaacggggaaaccaatgaaatagaaaatagatatataatggaaaaaactcagcaaatccaaaatttaagcctctggaaaaaatcaataaaattgataaatctaacaagattgatcaagaaaaaatgagagcattagcatcaggaacaaaacgggaaacattatctggatattaaaataattggaggagattgtgagctattttatgctaaattaaacttaaaaatttagatcaaacagacaatttgaaaaacacaacagcagaagcagaactgacacaagaaattctgtatgtcttaaagaaatttaatcaataattcaaaaactttccttaaagaaaactccctggcctggatggcttcactagcaaatgctttcaaacacttaaagaaaaaataatagcaattttaaatgcttccaggaaatagaaggaataacttcagaattcctgttatgaatccagtgaccctgatatcatactttaaagacattaaaagaa

SEQ ID NO: 196497 - DNA, 166 bp, Homo sapiens
tagcattacttctgtaagaaaatatatttgtaggtcccaaaccatctgtttaaaaatgaacctttgttgtgtgtgtatacacacatacacacacacatgtgtatctttcataagtcattgcacactatacacaatactgtgcaccttgcttttttttttttttttt

SEQ ID NO: 196498 - DNA, 118 bp, Homo sapiens
ccagctactcaggaggctgaagtgggaggatcacttgaatctggggaggcagaggctgcagtgaattgagattgtgccactgcctgggcaacagagcaagacctcatctcaaataagc

SEQ ID NO: 196499 - DNA, 616 bp, Homo sapiens
cctcctcagagtattaagctggtggacgtttggggcttcagcgctacactggaatggacaccgccccaagatacggggaatacagcacttctgggatacacggtgcagaaggctgacacaaaatccgggctgtggttcacggtgctggagcactatcaccgcaccagctgcatcgtctctgacctcatcatcggcaactcctatgccttccgtgtctttgctgaaaaccagtgcggactcagtgaaacagcccccatcaccacggacctcgcccacatccagaaagcaggtaagggaggcacggggatcatgagctgggaagacttaaggataggccgggcacagtggctcacgcctctaattccagcactttgggaggccaaggcaggcggatcacctgaggtcaggagttcaagaccagcctggacaacatggtgaaacctcatctctactaaaaatacaaaaattagccaggcatggtggtgcacgcctgtactcccagctactcaggaggctaaggcaggagaattgcttgaacttgggagttggaggttgcagtgagctgagatcgtgccactgcactccagcctgggcaatagagtgagactccacctca

SEQ ID NO: 196500 - DNA, 144 bp, Homo sapiens
tgtgttacagtgtgttatagcatgtgttgcagcgtgtgttacagtgtgttactgtgtatgttactgtgtatgttgtagcatgtgttacagtatgttacagtctgttacagtgtgtgttgacagtgaatggatgtggtggggaaa

SEQ ID NO: 196501 - DNA, 509 bp, Homo sapiens
cttaattaggacggggccctattctctggaaatgattcttcaaagctcttggttctgtcctctggcctctttattccatcctctgagtcatccttccttttccatgataaatggtcagtgtttgcagctgaataattttctcagcctctttcctgcctacagcaatttagagatccaagggcctttttttttattttgtattctctgtaacttttaattcgaagtgacagtgtttaccccaatataattcttttaaaaacctatgggcttcctataaagcttcatattggctgcacttcactagacaaaatctacacccacaaacaagcccttctctagcttaagattcttggaaagctgctatgggccaacacttaataatcagtgaagccctattgtttaatgagatctgtgaagcacacccttcagattcttaaaggaacttttctttttccatttgaggaaccactttacatcttccttatttaataaagaattgttcagccata

SEQ ID NO: 196502 - DNA, 499 bp, Homo sapiens
caggaagtagtgaaacctggtagagagaatattatctttctccaccttcaattataccagaactgcctccagggactttggcaggtttgacaaatggcagaagaatttagaagattttctttgctggcaaagggagccaatggttgggcacaaatgtgctgctgcggttgtttgtacaatgaaactctagattgtaggcagaaatgtcaggttcctttcaactctcttcagagctaatctagttcccatgtgcaaactcaatctatagcatttgggtaaagaatactcagtcctctgctgtgacaagaacaaattcatcacccacaccatacattgtagctaagggcatcatcgtgcccacatgaatcaccaggcagagacggctgccaactctgaaattctttactcatggaagactcacgtatactaatgccgactatttacgcaagcacatttctccaggtggcctggagcagtttacaagatgctggctcattcc

SEQ ID NO: 196503 - DNA, 457 bp, Homo sapiens
ttgcactccagcttgagcaacaagagcaaaactctgtctcaaaaaatatataacaataataataataataataataataataaataaaagactagccctaaaccattgtgcatgtgtgtgtgtatgtgtgtgtggccaggtgatagaacacactaatggcttttctaaggttccttggtccaacttctggagctatggtacaactggcatccctagaagggaaaagcataaatgctaaggtggtggagcaaccaacaggaacccactttatcatgaaaaagatgaagagaggttaaataaacaaccccaaatcacactcctagtcaatagtggttatgagttttgcactaaagtccaactgatctccacagtcaaagcatttgacaagaagtcctctcattggtaaatacaaaacctgttattgattgctgcatcatacactaccccaaacaaagta

SEQ ID NO: 196504 - DNA, 294 bp, Homo sapiens
cttcttttgcaagatttctttagactatgctaggttgcttgtgttttcatataaattttagaattggtttgttaatatctgtaaaaatggcagctggaattttcataggtattgtgttaaatctatagattaatagtattaccatctgaacaatatgaagtcttccagttcatgaagatggatgtctttctattttttttttaggtcttcattagtttctttcaatgttgttttgtagttttcagtatatgagtcttacacaacatggataaaatttatttttaggtattttat

SEQ ID NO: 196505 - DNA, 306 bp, Homo sapiens
tgtttcaggccatattgtaaagaagtgtgtcttgtgattttgatacccagaaatctccagtggagggtattctctgccttccttttctttgcagatgctgagctgaagaatggaaatttggagcagacttgcagtgtcaattgtaaagcaaagagtaattgatattactttctgtgacactgagttactttcaaaatagctttataaaaatttaggttgcttaccaacacattaacttctccctgccgtccacacgctgaacagccactactttcagaaatagactgaataaatgtaatgcattta

SEQ ID NO: 196506 - DNA, 658 bp, Homo sapiens
tatcccatagaatgcccacacatgtggaacatgcattggtgttccagttgggagaagctatttttacaaatgcaggctgaaaaacctattttcaaatgaatgctcctaaacataaaattcaccttaaacctaagcccccaaccagcattcaagaaagaagagaaagtgggcaacattcaaccactaatttcatggccatgttgcctaaggtgaggtctctaagtgatttcttaaactcaaacctctggccccagactcgacttggctcttcttctttgtctccagtgtattcttgtgcccctgaacgctgaatcacaggcaaaggtttccagtattttcattctctttctgctttgaagtccattaatcttcatgttgattttccctccaccctcttgaaaaaaatatctgcgttccccagatggaaagccaggagcttgcctctcctaccattcccactccatgtgatcgcttcccaaggtgccaactcctggctttccatctggagaacttaaatgggggacagatgaagaaaagtttatcaccatctttggaacacgaagtgtgtctcattcgagaaaggtgtaagatgcttccctcaaaatggctggcaactatggattgtatacctggctgactcattctcatggtgtacggg

SEQ ID NO: 196507 - DNA, 388 bp, Homo sapiens
ctcactacaagctccgcctcccgggttcccgccattttcctgcctcagcctccccagtagctgggactacagccgcttgccaccacagccgactaatttgtatttttagtagagacggggtttcaccgtgttagccaggatggtctccatctcctgacctcgtgatacgcctgcctcggcctcccaacgtgctgggattgcatgcgtgggccaccatgcccggcctaggtaaggcagttttaaattagttaaacgtaggaagtaaagctactttgaactgatcctttgacaagacattcacttctcagcagagtgctatgagggactaataaattattaaattttattgtgctaaaactaaagtgaatttcaaatgtgaataacaaaa

SEQ ID NO: 196508 - DNA, 579 bp, Homo sapiens
tcctacttcagggtggtattatgagagttaaaagggttagcatagatagaacacttttctatgattgatctaaggttggcttttagggactacattatacatatgggttttgtcttcatgtttttgcttgcatttctctctctgcccactcttggggctatttggatgtcacctcttcttcttctgagctccagtctatgtattccctgttccatcatcacaaccactgaagtctacactcctcattagattcagggaacccagatgccagccaaagacatccctttccctcatgacccagttgaaaaaattctccacccttctgttaattctagaatatttaggagtaaagatcttttccctcagatatctgtcaattcccggccttatatctcaaagccccttttcatccaggtttcctagatcatttcttgtcgtccctgtgctataactcattaacccaggcataaaactcatcagctactaatgtcctcttccatcccagactcccctcacaccaataattcttgaatagagcaacccaaattgagaattttaagtaaaattgaaggtaaattt

SEQ ID NO: 196509 - DNA, 662 bp, Homo sapiens
tcttttttttaaccaagcaataatctaaaacaattaaaagcttaagtgcaacaatgggttagagccttgcctttaactcacaaaataataatgctttattggagacataaatatttaaaacactgaactattcttgaagtactcaaagttattacaaagacaaacagtattttagtagagtcaagattactttgcttgtgtcagagttcatcagtgttttgctaactggtaaaacaatggttttcttactgcagatctttattactggcaagaaagtcccagaagttcttttctctaacttatgactagaatgctgagtagcttgaaaatcaataggttctggtctggagctgacttattcattagtcacagtgctcagggcccatgatactttcagtggcctatggaattgttttaactttactttaaaaacagaagaaaaaaaatgaacatagtaataaggaacatataatatggaacctagcttgtattatatttgtctttataccaatgcagttgtaaaatttaatattttttcctggaggaagaggctcacaaaggccaaattgtccaagggccacaaaagtcatcatggggccccacctgtgttataggtcaggctcaccccccacgtgtatgtgagattcagtgatttgaatgcc

SEQ ID NO: 196510 - DNA, 865 bp, Homo sapiens
  misc_feature (865)..(865): n is a, c, g, or t
ggtgtctgccaccacgcccggctaacttttatatttttagtagagatggggttttgccgtgttggccaggctggtctcgaactcctgacctcaggtgatccacacgcctcgacctcccaagagtgctgggattacaggcacgagccacagcacctggcctttaataggctttcataacagaaaagtagacatcagactttctaagttcaaaacctggctctggtgcttaccagctagctgaccttaaacttaaactatctaaactttaatgttcttcctcataggaaaaatggggctaataatgtttcctgacataatgcatttaaagcatggatgcattaggtgctcaataattgttatctatccctttggcttagtaaaaaccattgtcaaagtttttgtgtatatgacttttaagttttctctaaattatatagacagtattttgaatattggaatcatggcaaataaaactgtccatctaaaaaaaaaaaaaaaaaaaaaaaaaaaaaaaaaaaaaaaaaaaaaaaaaaaaaaaaaaaaaaaagaaaaaaaagaaaaaaaaaaaaaaaaaaaaaaaaaaaaagagggcgggggggggaagctgcgactagaataaacaactcaaaaacacctggtagcccagggggcggccgaacgccaacgctgagacaagaacgcggctgacgaccacgccaccaagaagagaaccggaggagatagagcgtggcgcggggccgcaccaaaaaaaaaagcgcggaggacgacgacacagaggaaacacacacgacgagagggaccggcacacacccactgaccgccaagagggggcgagagcaaagaaaaaccgacacgaggacggagn

SEQ ID NO: 196511 - DNA, 512 bp, Homo sapiens
ggtgtctgccaccacgcccggctaacttttatatttttagtagagatggggttttgccgtgttggccaggctggtctcgaactcctgacctcaggtgatccacacgcctcgacctcccaagagtgctgggattacaggcacgagccacagcacctggcctttaataggctttcataacagaaaagtagacatcagactttctaagttcaaaacctggctctggtgcttaccagctagctgaccttaaacttaaactatctaaactttaatgttcttcctcataggaaaaatggggctaataatgtttcctgacataatgcatttaaagcatggatgcattaggtgctcaataattgttatctatccctttggcttagtaaaaaccattgtcaaagtttttgtgtatatgacttttaagttttctctaaattatatagacagtattttgaatattggaatcatggcaaataaaactgtccatctaaatcttgtcgtggtttagatttagaata

SEQ ID NO: 196512 - DNA, 617 bp, Homo sapiens
tggcagttgcttgtaaccccagctaccctggaggctgaggcaggagaattgcttgaaccctggaggcagaggttgcagtgacccgagatcacgccattgcactccagcctgggcgacagagcaagacttcgtctcaaaaaataataaaaataaagttaacttaatcaaaacagaggatgtattgactcctgtttagggaggaagagaaaacctctagtaaaggtcagagggagattttgactcagaaatgacttgattcaggggccggattacgggttgactgtctctcctcttctccctgtcttgaccttattctgttctactatagatgagctccatccttgcttaagtcacaaggatttggggagttgatatataactttttaatttatgtaaatttaaaattcagtaaggcgagggcagcccagatgacccgagcttgtgggacctctcatgaaaaaaaataaaaaattaacattaaaattcagtaagggcctgggtgctgtggctcacgcctataatccgagtactttgggaggccaaggcaggaggatcacttgagtccaggagttcgagaccagcctgggcaaacataatgagaccttgtctctaccaaa

SEQ ID NO: 196513 - DNA, 426 bp, Homo sapiens
cagcccctattcaagatggagtctctctggttcaaacatctctgacagactgatggacaataattcagtcagtttatatgcacttaacccctccatctttcattctgcaatcttaattacgaatgccgcataagagatttaataggccttgcaaagcaaaaccagtgatacaaacattttaaagcatacgtatacttagaaataatgcaaaacattagatagtaaattctgacaagaaaagctaatttgaaaaacagaaatagctttagacaaaatttaggtctccaaggtaaagtaaaaagtttccaagtatttttggaaacttcatttctcctttctcagtttctctacgattccatgctcccaaccaaacttcacagaggtctttctcctctgtaagctatcttacttggcattagccaattt

SEQ ID NO: 196514 - DNA, 341 bp, Homo sapiens
cctctgcctactctggttgatctgtggccacaccagtcaaaggaagcagctggaggtgtgtactgtgggggagactgactagagaggcccgcccggccgcaggcctttcttccaggagtggcctccatgtttgcagaagcctgaggcctgggaaactagggggaggagagtgtcctctcttgcacagcccaggaatgcttgttccctgggacccaaggaagactcgaacttaatcataattattgttttaattcaaagtctgtatttagagcccagatgctcttaatgtcaattatgttaaactattaatacatcctcttgcatacttcccttcacttggt

SEQ ID NO: 196515 - DNA, 219 bp, Homo sapiens
gaattttagcactttttctatcagtttatctgagctatgtatttattaaggattttaatacattgctgtaattactaaaaacatcttttcccattgattatttgcttttaaattccatacatgatttagaaaaaaacatataatgtattttattttatgtgcttcctggtgcctggtacataaagtatgctcaataaatatttgttgaatgatgtagtc

SEQ ID NO: 196516 - DNA, 577 bp, Homo sapiens
tacccgcctcagtctcccaaagtgttgggattacaggtgtgagccactgcacccagcctgaaggggtgttctaatgttgagtatgatcacacatgcatcagctctgttctggtactcgcatttcgtcaaccagaggctcccctcataaatgtcagattagtcccaggagacactagtctgcaatctgatttcccttgccattgtccctagctaggcggcagagctgagtttaactaaaagtttaagaaaactgggttttttgctcacccatctagctgaacattctcctgaacatctgcctgaacatcctcctctgaagaagccaatgagaattattgataatgtatgaacccccaggagacaaaccttttacaaataaactgaaagacaaggaagtaaagttatatacagttattaaggaacactcaaccacccctgctttttaaaaccacataatgaagctttagcacatttcacccttattctgtttttgtttctgttttaagctagagactctttgggtcagtggtttccaactggagaaagtacttttttgcctaggggactttggggaacg

SEQ ID NO: 196517 - DNA, 417 bp, Homo sapiens
ctcctgagcagctgggactacaggtgcacgccactatgcccagctaatttatttttatttttacagagacagggtcttgctttgttgcccaggctggtctcgaactcctgggctcaagcgatcctccccacctcagccttctaaagtgctggaattacaggcgtgagctgtggcgcccaacccaaaagtcatttttgattgtcacaacttggggagctagtattggcttcagtgggtagaagccaggggtgctgctgaaaccctagaatgcacagggctgccccgacagcgcagaatcatctgtcccaaaacgttaacagtgctgaggctgaggaaggctgccttaggcccaatcgtcacatcaggaatgaacagctagtcgacgcggccgcgaatttagtagtagtaggcggccgc

SEQ ID NO: 196518 - DNA, 540 bp, Homo sapiens
ctcctgagcagctgggactacaggtgcacgccactatgcccagctaatttatttttatttttacagagacagggtcttgctttgttgcccaggctggtctcgaactcctgggctcaagcgatcctccccacctcagccttctaaagtgctggaattacaggcgtgagctgtggcgcccaacccaaaagtcatttttgattgtcacaacttggggagctagtattggcttcagtgggtagaagccaggggtgctgctgaaaccctagaatgcacagggctgccccgacagcgcagaatcatctgtcccaaaacgttaacagtgctgaggctgaggaaggctgccttaggcccaatcgtcacatcaggaatgaacagctaatttggttggctctgatggcagcaccacatgattatattctttacagtcttcatctgtcaggacacatgttcaagtatggatgagtgaagtgacgtgttgtctaggacaggccttaaagtattccagaacaagagggacaggcagagctaaggaaacaaggc

SEQ ID NO: 196519 - DNA, 1036 bp, Homo sapiens
catgctgggtgctgggaatagcctgagtaggtaaaagccagaagcagggaggcagactaatgcaatcatgcaggctagaggtaatccgtttggaaaagtgtggtagtaaagctgctgttaagatgttgggaggttttgccaatagatctgcagacagggcatggggtaccagagaaagaaatgccaaggatcatgatgtgattttggcctgagaaaatgcaaggacgtatttgccaataacttagttggggaagactatagaagcaggtttcaggttaggagactatcagttcagtttatgtttgatatgttcgttatatagtcaagtaaagatgataagcaggcagcaggataggagtctcaagttcagggaagataatttgtgagtttgcagtatgtaaaggtgaagttatgatgaaatcagatgagcttaccaaggaagtgagtgcagctagaaaggagcagaaatccaagacttatccctgaggcattctaatacacaaagatgcaaggaactggttaaggaatctgggagtgagcataggaaagggagaatagaaaatctaatgtcctagaagccaagtgaaaacagtacaatgtctctaatactgcaaatatgtattcatatcactgaatcttagagcttttagaggccttggcgataacctaatggattaaaaacactgacacttaagaagttcaataaattggtaaaagtcacaaatcaaaagagtaacagagaagataaaaagtaagtctattccacactgctttatgttagaaagtcttgatctatatggaatatagaatatattgaaatacagatcaagaaaccagatcccaagagatgatctactgagggacaggatttactcagatatactactggaatagaaaaaaaaacaaaacaaaacctgtaactctagtctgttcatccagttactaagtaaaccactggccatacactaaatactgtcattcctatttgattttctttcaggtacctttttttctcccctttcttaacaaatcaatc

SEQ ID NO: 196520 - DNA, 636 bp, Homo sapiens
catgctgggtgctgggaatagcctgagtaggtaaaagccagaagcagggaggcagactaatgcaatcatgcaggctagaggtaatccgtttggaaaagtgtggtagtaaagctgctgttaagatgttgggaggttttgccaatagatctgcagacagggcatggggtaccagagaaagaaatgccaaggatcatgatgtgattttggcctgagaaaatgcaaggacgtatttgccaataacttagttggggaagactatagaagcaggtttcaggttaggagactatcagttcagtttatgtttgatatgttcgttatatagtcaagtaaagatgataagcaggcagcaggataggagtctcaagttcagggaagataatttgtgagtttgcagtatgtaaaggtgaagttatgatgaaatcagatgagcttaccaaggaagtgagtgcagctagaaaggagcagaaatccaagacttatccctgaggcattctaatacacaaagatgcaaggaactggttaaggaatctgggagtgagcataggaaagggagaatagaaaatctaatgtcctagaagccaagtgaaaacagtacaatgtctctctttatccctgctttctcttattccaggaggt

SEQ ID NO: 196521 - DNA, 334 bp, Homo sapiens
tgagtatcccttatccaaaacacttgggaccagaaatgtcttggatttagaatctttctggactttggaatatttgcattatatttactggtttagcagccctcatctgaaaatctctaatcttaaatgttccagtgacattttcctttgagcatcatgtctgcactcaaaaaactttgaaatttgtggggttttttttgtttgttttgagacaaagtctcgctctgtcacccaggctagagtgcaatggcatgatcccggctcactgcaacctccgtctcccaggttcaagtagttctcccgcctcagcaatggcctcccgggttcaagcgat

SEQ ID NO: 196522 - DNA, 494 bp, Homo sapiens
cagtcagtggagtgatctttttagaaagtaaaccaccctctgtttagataaaataggttaataaataagtaaatatcagggacagttttgaatgaaaattatagaaggaccattaataattggttaggataggagcaaggaacccgcatatattgtgtttaaatgctgatgaatacagaagtgaccatacatatgtgtgcatgagcatttgtaattgaaaaaaagcagagccaaggccgggcgtggtggcttacgcctgtaatcccagcactttgggaggccaaggcgggtggatcatgaggtcaagagatggagaccatcctggccaacatggtgaaaccccaactctactaaaaaatacaaaaattagctgggtttggtggcatgcgcggctgagacaggagaatcgcttgaacccgggaggcggaggttgcagtgagccaagatcgcgccactgcactccagcctggcaacagagcgagactccatctaaa

SEQ ID NO: 196523 - DNA, 561 bp, Homo sapiens
tctcaaacaaaatgttatttgctcctacaaatgaactagttttgttaacgtcgtatgctgaatgattaacttaattcattccatctttaatatattacttaggccaagggatttttttttcatggctactcttaagttcctaacatctgtggcaaataatattcttcttacctacctccccttaaatcagatatttattggataacattcagaagggaaaatattttactttattgatgggtgatgaggtgtacttgaactgcatatatattcttggtgctagctaaacttgttctcaggttaatttcattatttcttttttcttctgtctagagtaggtgcttgtacatacctctttataaaatctcaacaaatcatgccttttcaggagttttatttgattcttagtcttttttcttctgttggactgaagttgttttgttttttaatatgttgctttttaaatgccagaactgttaggaagggtatctcatagatactcatttctctctagtcccaattttatctggccttccaaactccagtccttctagtatggtt

SEQ ID NO: 196524 - DNA, 518 bp, Homo sapiens
ggtgaagggggaaactcacgtgggcacatcctgcagagggatcccacagaaggggagagccctgggttctctatccaactgcgtctgggctagggggcgcctctgtttcttggctaagtgggtttgagagaggtatgccggtgggtgagggagggctggggcagagtcacctgacttattcgaagaagcccttgagagagccgtggcttcttggaattgagagggaagagtgggccagacgcagtggtcatgcgtgtaatcccagcactttgagaggccaaggcgggcggatcacgaggtcaagagatcgagaccatcctggccaacatggtgaaacctcctctctactaaaaatagaaaaattagctgggcgtggtggtgcgtgcctgtaatctgagctactcgggaggctgaggtgggagaatcacctgaacccgggaggtagatgttgcagtgagccgagatcgtgtcactacactccagcctgggcaacagagtgagactctgtctcaaaaaaa

SEQ ID NO: 196525 - DNA, 235 bp, Homo sapiens
gtggttcgcccctccccactgtgagaacataagtacatttttttaagtcatataaatggacaccaagcaccggtaattcagtctctttaaaacctgcttaaaagttctagtaagatgtgctcaggttggaaactaaaaactaccttataagggtataaaagactgaaagcaggaagcggctttgacaaaactaaggaagttgcagcggcgctgctccactgtggggagaagggtg

SEQ ID NO: 196526 - DNA, 531 bp, Homo sapiens
atcctcctaccttggcctcccaaagtgctgggattacaggcatgagccaccacactgtgccttggaaaaactaattcttaaagctttacaacatgtgttattaaattaacattgtaagaaatcctactgtaaagaaatctgcttagctttttaatccaatgttttgtaaacatgactgattcctgtatccccttccttttatttttaacaataaggagatgtattctcttaagaaagaatacacagtccagagagaggacaagctcagggctagggcaggctccatgtggagaccattgagcctccaggaccatttctctgtgttttttagccccgtgagtcggaagagcttgcgggctgttgaccaggtgactgtatcagttttaggcaccacagccacgcaggatgatacccagaagaagaaagtccctttttggagcaaggaaaatgtgctcagaaatgcttctggcagtgttcccctcacatcttactggccaggtttgggcaggtgcccgtttgttacccgttgtt

SEQ ID NO: 196527 - DNA, 443 bp, Homo sapiens
gtttccaaggctcctcttgttattgatttctaattttattccattgtggttagataagatatttgatataattttgatttaaaaaatcttttgagacttgttttgtgtcctaaaatatgtttcattctggagaatctgaaaagaatgtatattatgcagctggtgggtgcaatattctgcaaatgtctgttaggtccgtttggtatatggtgcagtataaatttgatgtttctttgttgattttctgtccagataacatgttcaatcctgagaatgagaaatcccaaatattatttcacaagtgtctatctctccttttagatgtaataatatttgatttatatatctgtgtggttcagtgttgggtggatatatatttataattattatattctctcactgaatctatccctttattcctatataatgtcattatttgtctc

SEQ ID NO: 196528 - DNA, 139 bp, Homo sapiens
acggcgttgtcagtgtaaagatggtctagggcaatacttgctccaagatctatgatctaatgctttaatcacacaggatgcatctagttactcaaatcagagattctagaatcaccctgagtgttctcaggtaattgct

SEQ ID NO: 196529 - DNA, 387 bp, Homo sapiens
tgagttatacaggagagcattgatgttttctacctctgttctccattagctgcaaaaacttgccccttcacagactccatgaggggaaagataccacagaaagagactgcatactattttacttttccttggactctgaaagtcgaactttagcaaagtaaacttaccaaagacatagttaagataaatgaatgtgtccaaagcaaatcggaaaagggtggaagattgctcatcaaatgctttaaaagaagtcctagctataattcgtttcttggccttggatggctctcaggaagtggtgtgttggagccagttcttacctgctcttgctggtcacatgcatctcttcccagctcttcattcggtgacatcaaaattagtaggctg

SEQ ID NO: 196530 - DNA, 162 bp, Homo sapiens
tttgaggaatcagagtcccgctcgttgatatctagttgtacagttgggtgatcttttgtaattcctaggttggtaaatttgtcataaatggatgcagattttctgcatagctataaaaatagtttgtggtaaactgctttcttcatatctactcagaaactt

SEQ ID NO: 196531 - DNA, 418 bp, Homo sapiens
ttgatttctgaatttttatgttatgggggttgcctctttctgtccctatgacatggctcttggggtgtaggtgtgatgtgaatgctctgtagcgtcccttgggcatctggctagggttttgcctgacagccatgaaagcatgctagctgcatgaagtcctcatctgttccttccattcttatcctttccgagggaaggaatgaaggaaggactgagggggaaagtccctggagtcaggctgtggcctttctcccccagcttcccccttgccttttgtcttagccagagtcaagctactagtctgcaagttgttctgcagatggctcagcagcagacatccagctgggctgacttcacccacagagtgtctgtgtttgtgtttgacagccaagacagggagcaggaaagctgttttcat

SEQ ID NO: 196532 - DNA, 221 bp, Homo sapiens
cccctgcaggctgggacagtggcaatggagcatatggtgtgctggcccttcctttcacaaaggtgtggacactctaagtgccaaggctgtgggtggggtcccctgggcctgtgctgctctgattccctatcattgtagggttctcttttctccctgaagtgttctgactgtctttcttctctctaccccaaccccatttttttgttttgttttattttgat

SEQ ID NO: 196533 - DNA, 259 bp, Homo sapiens
caggaccatacattttctttcaaatcccttataagtttctggtgattttttcggttggttggttggttttggtttttgtttttgagacagtctctcgctctgttgtccaggctggagtgcaagaacctatctaaaaaaaaaaacaaaaaaaaaaccaagggccaaaaaaaggaaaaggacccttttggtagtggggggaaattgacggagggaaaaggatatttctagaacccgggaaacaaggacttaaagctgaagg

SEQ ID NO: 196534 - DNA, 336 bp, Homo sapiens
attcatattcaacgtgtggccaggtactatgtaaaacactggtgatacaaagatatatgatatatacatagttcttatcctcaaggagctctaggttttgtgggagaagcagacatggagacaaattggcaggcaattataattctggtattaaatagtttatgagaaacagacaaacttgtaaaatagtcttcaatcataaatgaaagcatattttaaataattaaaaatataataagacttacttaggtctttcctctgttcgcgaccagggtggagatctttcattatcaatgtttcctgtaatctataagggaacagatcgttgagaagctt

SEQ ID NO: 196535 - DNA, 148 bp, Homo sapiens
gtcgtctctacaggatcccgatgttatcgcccaacacaaggtgatgacagtgattgatgatgatgatgatgataaaaagaattctttttattcaactctgactcgtgtttattgtcacaatagtagttaatgtgttggggataaataa

SEQ ID NO: 196536 - DNA, 440 bp, Homo sapiens
gccacttcatactctacagtgtcctctgtgtgttcaagtgaaaggaagagtttcaccacgttgcccaggctggtctcgaatgatagcttacacttgtgttgtaattattaaatttaatacacaattgcataaactaatgaaatacgattgcatgctggtgcggtgactcatgcctgtaatcccagcactttgggaggccggggtgggcagatcacgaggtcaggagttcaagaccagcctgaccaagtgaaaccctgtctctactaaaaatacaaaaaaattagccgggctaaaaatacaaaaaatggcgcatacctgtaatttcagctactcaggaggctgaggcaggagaatcacttgaactcaggaggtggaggttgcagtgagctgagatcgcgccactgcactccagctagacaacagagtgagactccatctca

SEQ ID NO: 196537 - DNA, 565 bp, Homo sapiens
ctctgtactccagcctgggtgacacagcaggaccctatctcaaaagaaaaaaaaatcctctgagatagtgaaaggtgaaaggagttcaaaaggtgtaaaaagagtgggctgatgggtccaaagtcctgggctggagaggagtgttctaccagctgggggaggggcaccagggaggctgcttgtaagtcctagacttatcagatggaggcagcccaggggaaatctggggaaaatcccgtgaaacagaaggaatgaccaggggaaagtcctggaggcaggaatgaatttggtgtgctggaaagacaggaatggccagataagaggagagaggaggaactgagaggggagagtttccaggtcaccttgaacctttagaacaagggaggagttggaatctcattctaatggcagtggaaagccccttcgggaaagtgataggctctgatttatgatttaaaaatatcaccttggtaatgtggtggaagggatgcaagagtgaaaacacaaaggctatttatttgtgagactaatcgcagccacctgggtgagcaatggggccagcatg

SEQ ID NO: 196538 - DNA, 360 bp, Homo sapiens
tggggacagaaagcaaatattctacaaatgtgaatgagatgggccacgtccacttccacatttgactccaggactggcaatttctatgtataaggaacatagtactggtcaaaacaaataccgcatcaaggagttgagggccccaacccacaggtgtcatgttcctgccagtgtcttcactgagcattcaacaggctgtccccttgtcccatcaggctggcagcttctaggtgatgaggagcaaccaagcgagcccaatgactctgttgatcggcatcccatacaccatatacaaagatgaactcaaaaatggatcaaagacctaaatgtaagagcagaaactatagaagtccttgatga

SEQ ID NO: 196539 - DNA, 601 bp, Homo sapiens
taaagtagaaaaattttaactcaaaccattgtagtgagttggggactgtctgtaactccaacatctgtcatcttgctttttgcttctgttgatatagttgaggttttcctggatcttggtatgaggtgtgattttcaattgtatcctggacattttggctattatatttcaagtattagaacttcaaggttctgtatcttacttgaatctcatttgaatgggactcatctgacaccacactgatggggcaaggagcacaccatctaattactgccagttggaagtggaaatccagtcttagttgacaacctggttggagagggccaccttattactgcttggggagggcagaacttcaggctacccaataggcatctgctgataccatcatggctggataatggagggggacttagttaatgttccccactgggcttccattgacatcatggggagggggtgggggcttgttaggtataagtagtaattaaattccccatctctgcacttggcctctgaaattatcttgctcagaagggaaaggcatttcaatgctgaatggaggtggatatccaggttccctatgtgatctccaatgaca

SEQ ID NO: 196540 - DNA, 228 bp, Homo sapiens
gttttgccatgttgttcagactggtctccagctcctgagctcaagcgatctgcctgccttggcctcccaaagtgctgggattacaggcatgagccactgtgctgggccaggcatagattcttgaaggagtcagagtcaaaagtttagagcatggtcttgtccttgatcaagcctgtccttggttactttaaaggaaattggttaattttgacccagcttggtatgtta

SEQ ID NO: 196541 - DNA, 265 bp, Homo sapiens
taatctctctctccatctcacccgcctcatacacccagcatttgcccagaacatatattcaatatctgtcaactgactgatacaaatagctacaatcagaatagggaaggcaaaagaaagattaaaagaaaccgctggtggacatcaaccactaactaatcaaagggatgtcaacttctccatgtttcagttttttcaattataaaatgtagacagtaatgctacctcaaagggctattctaagtattaaatactacttatatta

SEQ ID NO: 196542 - DNA, 708 bp, Homo sapiens
aataatattgttactgatgtttttctataaattatacgtgtaccagtgagttaagacatactgatccatcagtagtttattctgtgcatttttggaagagttctaatgacctctgaggctaaagactgaaatttcagagtctagctaattggaacatatatcccagatttaaaatacatttatttggctgggcgtagtggctcacgcctgtaatcccagcactttgggaggctgaggcaggcagatcacctgaggtcaggagttcgagaccagcctggccaacatgttgaaacgccatctctactaaaaatacaaaaattagccaaacatggtggcaggcacctgtagtccaagctactcatgaggctgagacaggagaatcgtggggagcagggcaggcggcggaggttgcagtgagctgagatagcgccactgcactccagcctggcacggcaacagagtgagaaaaacaggaggtagagggcacaaggccccctgggacacagtagctagcagctgagtcccatctccataccttgttatctctaggtaccctgtgttctggcccctcttttttttatccatttccttctctttagatcttgtttaggaagattctgaacgtcctgaaaaataaactgccatttaatataggaccatgctttctgtcttttaaaaaataggtaaattaattttgaatatacgaca

SEQ ID NO: 196543 - DNA, 344 bp, Homo sapiens
ccctctaacttttcactaggcatgaccactgctctattttagatagagattcagtggggcaaaacctgagaattatctgcccggctagcaagaagatagctccttgcatttttgcggggagagcacttttgcttcaagggagtgtttcttcccaggattataaatctttctgtaacctcaggaaacactgctgatgaaaaccaggcatggtggctctggcctgtaatcccagtgactcgggggctgaggcaggaggatcacttaagcccaggagttggaggctgcagtgagctatgatggcaccactgcactccagcctaggccacagagacagatgctgtctc

SEQ ID NO: 196544 - DNA, 400 bp, Homo sapiens
agtattgctggtgctgaccttataaagttgtcaagatatttaagtaggttagtatgtggaaatcacttgggatagtgcctgataggggtggcttgataaatgtttaatactatttcctatttcaggctatgtttgtattagtaatagttatgtttaactactcactatattaatactactatgtttttactatgttttactattttatttttgtatgttttgtttaactactaactaaagttgtagttatgttattaataactactattaattagtattagttaaacaatactaattaatattattatgttctggccctccagtgcttaattgagtgtgggcaataggaaatttttttggaaggaaagggacaccataaacagactggcctttagaaaaa

SEQ ID NO: 196545 - DNA, 634 bp, Homo sapiens
ctgggattacaggtgtgagccaccgcccagcctattttttctatttttgataaagtgaactgaagtgacaaattatgtaaaaagctactgggccattatgaaatataatctggttgagatatgaagggctagtgggagtaaacgaaaggaagtgtgtgtggttcaaactcaccttgacacctatttgttgggccttcttagacaagtcacttattatttctatgtggaaatgtctttgtttctaaaatgggattaactatatgccatggccccatattgggactagatgcaatgatagatctgaagttgtgatctcattttgatggcactgaaagggaagacaaagaagcttaaggaggagaggaagaaaagtctagggtctgcctgggagctatgaaggaggagaaagcttggaaagagctcagtgcaaaggagctgagggttgaggagccaaggttatgaagaataaagatccactcacctgagacaggagaggggagacagttgttctaagaagtgtcccagggctggtcaaggctcaggagttcagggcctgaaactctcttcatggttctaaatggttggtatagactctgatggcaggtgggtcagaacataaggggtaccgagctcg

SEQ ID NO: 196546 - DNA, 451 bp, Homo sapiens
taaagaaaattaggtaactgtgatataggggtaaagataaagctaaatagggcctgctttgcttgaccaccaaaatattagctcagctgccttttgagagaatttgtgtaagtctacgtaatcttactaggcaaggaaaattcctcacagctggcttctgaacttctttgaatttcatgtattctatgatggcattcaagaagtttaaaatagtgttattcagaatcctaagtattcatcataactgatgctgtgtctgctgagtgacagaaacgtcactgccttaattctagcccccactaccacttacctgcataactgtattagcctcacatcccaaccctttaagtgttttagcttggggtattaggtgttctactgtacgtatctagtagtctttgctattcagcaccttgctgctcaactggctttccttatgtacggttctgat

SEQ ID NO: 196547 - DNA, 542 bp, Homo sapiens
ttttgtgccccctgtccctaataatatctcagaagccaaatgttaaaagtgtttataaaagggaaagaagaggtgtatcaaaggataacgtggagaaagatgaagactgagaattgaccattggacttcctaccttctggattattggtgatctgatgagagcattttttgtggagtagtggagaaaaatcttaattggagtttgtccatgagagaatgggaagaggtaaattagaaacagtaacgatagttgctctttagagaagttttgccctaaaggagagcagagatttggggctttaaagcaggaaaaagcatttcttaaatacccttaggtttttaatgaggtcacatttttgctgtggttttgttttgaaaatttatttgtgagtctctggtcttataattttacagtgtatttaaactccttaaggaatagaagaattatttttaaaaaccgtggtggcatatgcctgtaatccgagctactcgggagactgaggcaggagaatcacttgaacctgggaggcagaggttgcggt

SEQ ID NO: 196548 - DNA, 472 bp, Homo sapiens
gaaacatctcatttgaattactacatggacagatccatctacttacgcaatgcttaggaaattgctttcctttatttagaccagttctcagcagtggctgcatatttgaaccacatggcggagctttggaaagtcccagaaaacactcagaccaattacatcagaatgtctgggggaggaagcagggcgctagtaccttttcaagttccccaggtaatttctgtctgcagccaggattgacagatccctggttcagacagcatttccaggctggtgcagtctcggtctgtgttgttgtggcacagcgagcaaatcttgtgggaatagaatgatttttgacaatgtcttctttttggtaaagggtatgtgttaatgcataacataactaggataacttttgtaactttgtcagactttaatgtttatgcatcagaaagattcctttctcagataatgcttcctaattcctgag

SEQ ID NO: 196549 - DNA, 255 bp, Homo sapiens
tcttaaactatcaccagataatagttcatctctaagataattatttgtaaaagaaaattcatcagattacatttttaaatatttttataataaaaaataccataggtaggccttccatctaccctcgtgtgtgtctgggtcctcaaattggtcacaggatgatattaacagctgatttgtttttattgttcatatttatgtctcacagactgcatgagtatttgactcccaataaaactgaatattgaataccta

SEQ ID NO: 196550 - DNA, 242 bp, Homo sapiens
gtcacctggatcactgcaactatacccaactggtcccctgcttgtctttttctgtccagtgtaatcaccacattgctgcctgggtaatttaaaacagatgagaggatgtcgcatctgttttaaaatcttcagtgtcctgctctccacccccgcccccacattttagagtccaaacttctgggcctggcaatattaatgactactgtttattgagtatttatcatctaccagtgtcaagtgag

SEQ ID NO: 196551 - DNA, 645 bp, Homo sapiens
ccagctaattttttatatttttagtggagatggggtttcgccatgttggccaggctggtctcgaactcctgacctcaggtgatctgcctgccttggcctcccaaagtgctgggattacagacagacatgagcgaccacgcccagccccttcagatcttatgtggcctactccttgtcattcaagtctcaaatatctccttcctagagaggtcttccctgatcactaatccagagaggtgccctgtcactgttttaatttaattgcagcattcatcactgtattttatggtttgtttgtttattatctgtcttctcccactggcgtgtgagctccatgagagcagagaccttatgtgtgatgttggctgctgtaccccagtgcccagaatagtctctagcacatagaagatgctccataaatgtttgttgagtgaaaaaaaaaaaaaaaaaaaaaaaaaaaaaattctgggggctcttaattgtgtgggggggggaaaaaggggtttttggaaggggcccagtgggctcattagggggttctctggagcccacttttttttgtcacaaggggggaaaacttggggggcccccaatatggggggcggaattaaattgaaatagccggggttactgttttagattgaa

SEQ ID NO: 196552 - DNA, 1076 bp, Homo sapiens
ctctcttttgagagaaatatttcattttgaaaagaattatgctacaccaacttaaattttttaaaaatttgagatctcagtaattgagcacaccagagcacagaaaacattttgtacctttgcaaataaaattaaagattcagagaacctacataaaacatgggaaagaagggatgctttccataacagggtagaaggtaactttaaaatagtagactcataaggaaaattaaagaaatcctaatcagcaaaatacatgagattgttttttatggtccccatgtgaaaacgtttaaagctgtcaaggtacgtcagaagtttgcaggaaatgagctcataggatgtctcaaacagtgtacattcttttccatcattaatttccttccatgctaggggcatttcaggatctgcaatttctgaggatgtaaaaatgaacttatagcaacatctgttgtatctaatgtgccttttcccagaaaaccttgagctgtggatgggtataaggccaatgaacttagcacaaattcctacaaacacatcagctggcaccatcatgggtacttctttgaaaaccacatacatcattcgagccacatcttgggacattataaaggcctcaccactgcagtaatctgggtagtatttttctgggtactcactaagagggacaaagtctctgttctgaggatctctattgggtgtaacctgatgaagaactcttcctacatagatatcttctaggtgttctttcagattgagaagatagtctaccaagcttggtagattgacaaacgtctcttcatccaccttgagaatgaacagggcattagggcagaaagccacagcccactgtatcattgcaatgatcttcagggtttggttctcagaactgtccaagaagattccttcaattatatcattattcttacaggattctttgttgatctctttctgggtagttaccgaaacaggcattcccagagcaaacagtgtgagaatgggatgcccttggacactggtcacattgccccaagttttcctaatgaggtcccgtcttgttccatttcctgggctac

SEQ ID NO: 196553 - DNA, 291 bp, Homo sapiens
tttagaacaatggtttttgggtagtagtgcagtttacagaatggcatcatttataatccttttcttctactgaccagttacatgaatcacttaagaactaaccagatctgggtgcggtggctcacatctgtaatcccaacactttgggaggccgaggcgggtggatcacgaagtcaggagttcaagaccagcctggccaagatggtgaaaacccgtctctactaaaaatacagaaattaattagccaggcacagtggcaggagcctgtaatcccagctacttgggagactg

SEQ ID NO: 196554 - DNA, 445 bp, Homo sapiens
aaaggaggctgggaaattaagtccaactgcgtgcccaggaagctgaggaggacagcagcagcacaggggtgagccctgtggcttctgcaacactgactgttgttcatgatctatttcaccatttccctgttgttgggcacagtttgggagaggattattgttgacccaaccagtccagagaacaagttatatacctttttgccttttagattttttttttttattgatctctgagttgaattaatggggccaatcctaagggcctctgtttactcttatacagagaagaggaacagccctagctaaatcaccagtgtttctttgggaagaatctggtacaataaatgtcttcgggaatgactcgtgtcaggttcacctctagctgatcctggcctcagggcctggttggcccttgaactcaggcaggtgcaagtatgggcttaag

SEQ ID NO: 196555 - DNA, 443 bp, Homo sapiens
ttctgtactcatggtgttgcaggccagtgatgaacagggtggggaccagcagtggtacacaaacatacttcaaatagcactgctctcaaacaatgacaaagaacagactgcaactacacagagtagtgtgaatgaatctcacaagccaacacaagagtctgtattttatgattccatacgtgtaaagttcagtagcaaccaaaatactaacctgtgacattaacaagttagaattacccttgaggagcagaagatggtcatttgtagggggtatggaaagaattctgggattcttaatcttggcattgcatgatttttatgttggctatatgggtatgctcattttgtcaaaatttagctgtgtgcttatgatttgtgcacttttctgtatgtacattatacttaacatttacattaaaatttattgatgacctattaaacac

SEQ ID NO: 196556 - DNA, 203 bp, Homo sapiens
aaacagcaatctgggctggttttgattttgggaattctgatttgggaatcaattaatatcaatatgcaagccattgaagtaggtaagataacccagggagaatgaagagtatgaagaaaagacctgggcttgggataaggtctacagaagcaatttttaaagaacaagagtcagctgggtgtggtggcacacacctgcaatcc

SEQ ID NO: 196557 - DNA, 264 bp, Homo sapiens
tgctctgttcacaatagaatactttactcccttagtgattgatagtgaacatgactataagaaaatagtttttggtggcaaagtttaaaacaaaattatggtctttacctaaagtgtaaactttgtgtctaagtcttggagtggtgagaaagaaggaagggattcactttcatcttttcctctcgcctagaaggagaaatgtgtgggagggaatgaaccaggtgtcttcctggtgcctcctgggaatgtccccagcacacgtct

SEQ ID NO: 196558 - DNA, 370 bp, Homo sapiens
caactccactgatggatttaggctcatttaatccaaactcgactccatttcagccagaaccaggcacctctagaaaggtcaccctaactgccacatccagttcctgatctgccatctgcttcttttccatcacttgtggggtatttcccagcctaccactaatgtgagccctcctgagtcaaaagttcccctcttccaggcctcctgctcagctgacgtcctggaccaggcaggccacccttgttccacttcccctgggaagacacctgggtcttgtgcctgccctggattagggtgggcaaattagttcatccaggactagaagaatggaaataaacagacttgtgtcttggggctgactctgaaaggt

SEQ ID NO: 196559 - DNA, 386 bp, Homo sapiens
cactaagaaagacaacaagggctgttaaggaaatcatgacattgcatagtttgtgaagcccatcctgaccacaaaggtgttgaactgtgaagaagatctgcatctcagaactgatgaatgacttgattgcatgaattcatgattgattaatgcattggtgtgttaccttcattctaatctgataatttattctttttatttttgatctttattttaaaaactctatagcgataggataagttaaaaaagttttactgtgaaacgctttttgtatcatgggaatattgagtcttcacatttgtcagtctgaatcaagaacttgatgctaatttttgtcgtaaaagttcataggcattccttagctcttgattaaaaatatctaaaca

SEQ ID NO: 196560 - DNA, 461 bp, Homo sapiens
ttactgccgattcgctgagcgagggtttacacccttaaatggcgtgtaacatgagtactatttctatggggcgggatcacggtgcagatgggatcacagttgaggacatgtagcagataattgtaacaacagaagcagtcactcttcaccccacttcacagctttggggatgtggaatccatcttttttttaaccaaaggatgcccatggtgcagatctgaatgcaacggtcttccttacctttcatgatagcaacttaaggaatagcacataagaattttcttaattcatacaaagtttataatcaaatagaattactactgttattacacacacacacacacagtcctctcccaatcttaagacaaaagggtttcttagaaactggtgtggatctaatgccatccaagtattattggtggcgtttgtatgctgaactggaaggatatcctccaggcatc

SEQ ID NO: 196561 - DNA, 506 bp, Homo sapiens
cactgggattacaggaatgggccaccatgctcagccatagttttcccttaaaatgcaatttagctgccactttcttactcttgacctttcctttaagtttgtcattcacatcaggcctatgactttcttaaagagaggtgctcagtcttgtttttctttctttaaacttccctcttacagaaggtgttcagtcttaaatatctccatccttaatatctaatataatgcctggaatgtaagtacttaataaaggtttggatgaatttattgatgctgtaggtgatagattttgggcagcttaaaaatagacttttaaacaaaaatacccagatttcatttcaaaataatggggtactgtggaggtgcttagggaagtggtaggaatatgaatgagctaagtaatactagtctctacttttgtatatatttgaaatattccataatgcatagagaaacgtaagttctctatctctgacagttttcagaaagactgattaactatgtgg

SEQ ID NO: 196562 - DNA, 499 bp, Homo sapiens
aaataatacatattatttaaattaagtaatacatatatttaaataacacatattctttaaatatgtgtatactctttatatatactatatttatggtatgcatatgtatatatacgtatttatgacaaaaccatatatatataggccaggcatggtggctcatacctgtaatcccagcactttgggtggctgaggcaggtggatcacttgaagtcaggagttcgagatcagcctgggcaacatagtaagacctcattgctaccaaaaaaaaaaaaaaaaattagggctgggcgaagtggctcactcctgtaatcccaacactttgagaggccaatgtgggcagatcacgaggtcaggagattgagaccatgctggctaacatgctgaaaccccatctctactaaaaatacaaaaaattagctaggggtgggtggcaggcgcctgtagtcccagctacttgggaggctgaggcaggacaattgcttgaacctgggaggca

SEQ ID NO: 196563 - DNA, 178 bp, Homo sapiens
attagattgaatgttacttaaggtcttttctagcttaaaagtcatattgcttgtctacaaatgcatgcctaactctcctttgtaagggtgaccatggctcttggaaatgtcagggtataaatttttgaaagaattccagcgccttatgtaccacattgttctcagaactaatcttgta

SEQ ID NO: 196564 - DNA, 394 bp, Homo sapiens
ggtgactctagaggattcctccacactagtcaaagaagagaggaaaaggttagagtttcactgaggagagaggtcacgcacgttgtttagaaagttagttcactggtgctggcagcatcttacaacaaacagctggtgagttttgattaggagagccagtggttgttaggtggaagactgaaggctacaaattcaggaataacttacaaattacaacaaaggactgcttcaggagtggcacaaccactgccacttctgggcagagataaacttgtaaactgagagttatggttaggcctctgcagtttcgaattgggcttgtgagactgtgtcaggcacatgttcctgtataagcagctatctgtctttgtgtgatgctttggcttggaaaaat

SEQ ID NO: 196565 - DNA, 229 bp, Homo sapiens
ccttatgccagtggctacatttccagcctctcctgggtggtgtttgaggctcaataggggtagagtctcagggcagctgcagacatgacatagatgatattcctactattcctcaccccactctggctgcaaaaaggaagtgcagggaaaatgagtggggagttcctgtatgccagtctgtttcaatggaactatttttggaggaataaaaaagtatgctagattatat

SEQ ID NO: 196566 - DNA, 356 bp, Homo sapiens
aggaaggggaacatcacacaccaggattgtacgattttaaacagaggaggaacaggtagtagtatgatccaatttaccttgtaattgaatcttgttggcatgtatgtagagaatgaagtatgagggactagagtatcacatattcattagccttgtgcagtcagccctctgaattcatggattcaaccaaacacagattgaaaatatttttcttaaaaaaaccatctgtactgaacatgtagatttttttataatccctaaacaatacagtctaacaactatttgcatggcatttacattgtattagatattataagtaatttagaaaggatttgaagtatacagaaatatgtgcc

SEQ ID NO: 196567 - DNA, 135 bp, Homo sapiens
atgggtgtgagccgccccacccgacccccctacaggtttcagagggagcatggccctgccagcacctgggtttcctacttctggcctccagaactatcagagaataaatgtctgctgtttcaagccacccagctt

SEQ ID NO: 196568 - DNA, 527 bp, Homo sapiens
aataaatatcatttgggtagagtagtgtgtatttggtcttcagactatgaatctcacaatcacttgggacatttggtaaaaatttggggaccttgacaattttgcatgtttagttacttcccaggtgatgcttatgtactttaggatctcagaacactgagactgcataaaaattgtggctagggatgatctaattcctcgctactcaaagcatggtcctcaggcagtagcatcaacatcaccctgaagcttgttaatcagattctcacatgctatcactgacctcctgaatcacaatttgcagattaaaaagatctcccaggtgatgtgaatatagattaaaatttgagaagcactactgtagaaaaatggttcttaaccttggctgcacattaccatcacctggagaacttaaaaaaataaagactgctgcctgggcctcaccctagaccaattagatcagaatttccaggagttgaggtctgaacatcattaattttttaaagctccccagcggattttaatca

SEQ ID NO: 196569 - DNA, 207 bp, Homo sapiens
tgagcttgtgacctcacttggtaatgccctgtctcagcatggtgatgactaccttatgccttgtgtcttttccccatagaaagctctgttcatcccaaagccagatcatgggtactgcttccttctcgggtttcctgttgtaggtgctggggtgctgaggttctgctgtgtgtacttcccctgtctctctctgagcagcctcatgag

SEQ ID NO: 196570 - DNA, 420 bp, Homo sapiens
caggaaggaaatgaaaaagagaagaatatgaagtaaacgaaaataatgatgaaggtaaaaagatgaggcaaaagaaaatgaagattgcctggtgcggtggctcatgcctgtaatcccagcactttgggaggccgaggcgggcagatcacaaggtcaggagatcgagaccatcctggctaacacggtgaaatgccgtctctactaaaaatacaaaatattagtcgggcatggtggcgggcgcctgtagtcccagctactcgggaggctgaggcaggagaatggcaggaacccgggaggcggagcttgcagtgagccaagtgagccgagatcgggccactgcactccagcccgggcgacagagcaagactccgtctcaaaacaaaaaaagaaagaaagaaaatgaagataaaggtgaagaag

SEQ ID NO: 196571 - DNA, 286 bp, Homo sapiens
gcaacaggtttaggctgacaaattttgattttgaagaataatcatctcagattaataatttactgcattgttcctgtattttactacatgataaattctgtccctgtgtagaaattattatctggaaaattataaaataattagcctgttataaaattagatgcttttagagtacagtgtaattgaaaagtaaaagtgcatttacttacttaaaatgtcattttgctacttgatttttttataaaacaaatattggatagaaaaagtgttcttatccattgctttc

SEQ ID NO: 196572 - DNA, 223 bp, Homo sapiens
cagcttggcagggagtggggagtagaggactcaggaatgtgtaaccaccagaaccttcttagaaatgattccaacctggtctttggaacttagaatcccaaatgttggacctgaagatttcatccaagtccacacttttcttttccttttcttttcttttttctttttttattaaatcagaaaaagaaagatccagtttacatgactgtcagtcaatcatatg

SEQ ID NO: 196573 - DNA, 583 bp, Homo sapiens
aaaagtggggaacaaagttaaaatatagagttagggttacttttctttttgttagtttgtttatgctagtgttgttatcagcttagactaatgggttataagacagtatttgcaaaccagatggtaacctaaagtcaaaaaacatacaatggatacacaaaaaataaaaatcaagaaataatgccacctgagaaaatcagcttcactaaatggaagacaggaaggaagaaaagaagaaacagcaggccatcaaacaaccagaaaagaaataacaaaatggcacaactaagtccttatcaataataacattggatatcaatgaactaaactctccaatcaaaagacattgattggctgaatggataaaaaccaagatccaattatctgttgcctataagaaatacaattcttttataaagacacaaatagactgaaaataaaggaatggaaaaagatatttcatgttaatggaaacaaaaaaatagccagagtagctatactcatagcagacaaaatagatctcaagacaaaaatgataagaagagacaacaaaggtcattatgtaataataaaggagttgact

SEQ ID NO: 196574 - DNA, 518 bp, Homo sapiens
gatctagaggatcccgattagggtgaggaaagtgaggtgagtcatgccagtgcaaggttggattctatctttatttaaattccgatgtttgttcatcatggatttctgcattcatttttatttttaaaatattaaaatatttttatcttgattactgatagggtttagctctgcgtccccacccaaatcttgtcttgaattgtactcccataattcccatgtgttgtgggagggacccggtgggagataattgaatcatggggacagtttcccccacactgttcttgttgggaagctcccaacaagatcatagacatacgtggttcagtcctaaaacaatgtcacattcaaagaaatacaatttcgtaaatgaaattgttttaaataaatttttctttatcgttgtctttaaattctttagtctcacaccatagaaaatagattaaatgctaatccattcttaaactccacaacacctcttatttgtattctatttccaataaaaatcgggtaccgag

SEQ ID NO: 196575 - DNA, 392 bp, Homo sapiens
acagacacatgccaccacacccatctaactttaatattttttataaaggcaggatctcaccacgttgcccaggctggtctcaaactcctggactcgaacaatcctcccacctcagcctcctaaagtgttggaattacaggtgtgagtcacaatgcctggtctcatagtttttattctgatagtttatgctgttattcatgactccttcttctaaccttccctggctggtgttacttatgtagaaaaggaagacaggtcttgttagttgccttcaggaagactaaaaatcttgttcgggagagagaaaccatgaaatgaaactaatttattggccttgaagaagtgtcaacaacatttaagtcaagagcaggagaatggtgctggggaacaaa

SEQ ID NO: 196576 - DNA, 451 bp, Homo sapiens
gaccctgcttgaggtgctgacagtccagcagtaaccatgtagttatatggtcaactaacttttgacaagggtatcaagaccattcattgggggaaagaacagtctcttcaacaaatactgttgagacaacgcgataagccacatggagtgaagttggacccttaccttacacgtatataaaaattaacttagccactgcacctgagcttgtatttattcatctattttatttatttatttatttgagatggagtctggctctgtcacccaggctaaagtgcagtggcacgatctcagctcactggaacctctgcctcccagttcaagcaattctctgcctcagcctcccaaataactgggattacaggtgcctaccaccatgcccagctaatttttttgtatttttagtagagacggggtgtcaccatcttggccaggcaggtcttgaact

SEQ ID NO: 196577 - DNA, 343 bp, Homo sapiens
ataactgaccattacctcaatctctagccccttttccctttctgaagaatggggagtaggactgaaagttccaagctctaaccatggccatgggggctaccagctcccattctgaagctagcctagccagaagcctatccaaagttgcctcattagaacacaagatgattttatccccctcaggaaattctaagggatttaggccattctgtgtcaagaaccaggatcaaagaccacattatacaaaagatgtttctaatactcctagcacttaggaaattacaagggtgttaggagctctatggcaggaaccagggacagagaccaaatatattatatttta

SEQ ID NO: 196578 - DNA, 222 bp, Homo sapiens
gttaaattcatcacatcaacaggcttaaaaagaaaatcatatttaaattatatactaaacagattttttcaaatctcaataaattaagaaaaatttggtaaattcaacaactcatgactgtaaaacaaaaacgaaacaagaaacaagtttagtaaactaagaattgggtgaaagtttcctttatctgagataagtaggatgctataaacaccctacagcata

SEQ ID NO: 196579 - DNA, 626 bp, Homo sapiens
tcccaaagtactggaattacaggcatgagacatcatgcccagcctgacgtcttagatttaagtcttcaatctattttaattttatttttgtatatggtgagagataggggtctagttttattcttcagcatacggatatccagttttcccagcactatttattgaagagacttttttcccccaatgtatgttcttggcacttttgtaaaaaatgagtttactgcagatgtagatttgttgctggctggttcatcctcatttccctgaccactgaatattggagggccctaagattcaggctccaggcctttcctctttctcatgtatgtctccttggtgatctcatcctgcctgttggttccattggtctatgtgtctgtttttatgccagtaccatgctgtactatatactgtgtagtataatttgaagtcaagtaatgtgattcttcagttttgtcctttttgctcaatatagcttggctattctggatcttttgtggttacatataattttagcattttttttctaattttaattaaaaaaattttttttgtatagatgtggtctcaccatcttgccctggctggtttgaaactcttgggctcagacagtccacctaccttgg

SEQ ID NO: 196580 - DNA, 450 bp, Homo sapiens
ctcaaaatgttgagagaagggttctagaagaatccttgataactggaaaggtgaagtttttacattaacagaagaggtaaagagtaataatcaaaaataggaagatcttcagtcagtgatgctaatgtgtctgaagagtcagggtccccagtaggggaaggaagaggaagaaagtgaaaggaggctaaaattttcactggcattgtaggtagaaagactagggtttgagtggacatctgctatggaagtcaggtgacagtggaggccaaagtaacaaaagcaggcagggaaattctcagcagcatcagagtaatacaatgaaattcctcatagaaatactatcaaggaaagacagagaaagccattggacacctatgtcaatcaactagggcagctttgctaacgaacacactcttaaatctggcaatcgaaagctgcctgtttaaaaac

SEQ ID NO: 196581 - DNA, 494 bp, Homo sapiens
tgaatagttactactgccagtgctgctgttgctgctactatcactgctactaaagatgtttgtgtgtactctaagttccaagctggactgacacttaggccaggtgactcagcagtataatgagtgagttaaaaatttcttatgtataaagtctccacagataatcaaaagctggctgtttttggaaatcctaatcaataattgaagcacggtctgagagtgtggttgggaagtatccatgtgtgttcctggataacgcatcaagcttctctgcctctcccctcccccaggaagattggtagagtggctctaggagtctttcctgaggcccagctcaggactcatgacatggtggccagagggcacttcggcattgtcagatgaaacgcactgtgtaaagtgtttgttcagccagggatcttttcccctatgcctcctaatcaagtaactcttaacccctggcggaatttctctcccatagccctctcgttggc

SEQ ID NO: 196582 - DNA, 240 bp, Homo sapiens
aagagagataaggctaaagggttaggtaagaaaaaaaatgaaaaatatgaaagataaaggggaaaaaagagagttaggtaaggagcacatcttgaaggttttgtatatgagattaaggataaatggagtttgaattttattaatgggcaaaaaagagccacaagaggattttaagcagagaaatatcaccattgttctaagcaagaatgggaaaagtatcagatgggttccaaccatagg

SEQ ID NO: 196583 - DNA, 354 bp, Homo sapiens
attacaggcacgagctacggtgctggctgtgaatctagctctttcacttagcatactgctatttacaatgcagccatgttgttgaatctatcagtagtccctttttatgattgagaagtagtctagaatctactggagtcctggattaacagaagataacctcaaatgtttcttcaaagctaactagaatattagctagatgttaaagtctgtctcattggaaaatgacttacaattcgattttaattttaactgaaggtgatacaattcttgagttttctgttctagagtttgccgcagaagattctggtactctctctctttttcaactaggtgttccaaaagtctggttta

SEQ ID NO: 196584 - DNA, 239 bp, Homo sapiens
acttattctcttgggatttctctttctctgataaactagcaacttgttgagataaatcactggattccacatctttcattttctcataaaataaactttctattgacataacttggcaaagagtatcctaaattctgatcattctcattgagtctccaccatgaaacatttcagtgtgttgcttctttcctgtaactatataataaagtacagccttataatcttttagtcagcagtta

SEQ ID NO: 196585 - DNA, 439 bp, Homo sapiens
aaaatttggttcttgaataatatcttttcaaaaatacttacctttactccaccttcttttaaaaagaatttgaggtgagattctaaagtataagctatacttaagcatgagagaactcataaattatgtttcatatatgtggaacctcttgacattcagcataggcatttagtcacaatgaatgagctgttagctcctgggtgtgccttcttccagaaaacactggcagggttcaggcagcattgtctgagcatgtaatatgtgatttgtagaacaaataggttaaaaatcttttttatttcaataaaaatgactatctaattctgctgattcccatttcctcctgattatttcataaaagctgcttccagttctgaatagcttttaattacttactagttcttaaatactgttcccagaatcacttgggtggctttaa

SEQ ID NO: 196586 - DNA, 201 bp, Homo sapiens
gcaataggtcaggggcatttttttgtggaggatttctgtaagtagtaagataaatttaaatagtattctggttgtaaacaaatgttctgtagtcttgctttatgtttaaactaaatctattctaattaattcagtttcaacctcaacttaatattttaccatttgcttggactgttttcatttttctttagggaagaaaaa

SEQ ID NO: 196587 - DNA, 482 bp, Homo sapiens
agtagaaagactggccctgggaaaagcaccatttaagaggaagaagactaaagacagggaaagagactagaaaatacgaaaaaagataagactgaaaattatcaaggaagtcataatgcttggaaaactccattgctttcaatagatgcatatttaaattgacatctattaccaagacctcaaatagagtgggatgcagatgattcactgggctaacaaaatccaatttctttcacaagtcccaccttccaggttaatcagaatcctaggttaatcagaaaagtaatactccaaaatctcaaaaacctactgttactataggtataactgctctaagccaggggagatctaacctaggcaaatattctggaactttatagatgaggattatctattactcagagggtatatcatataaaacttcctaatatccaattagaaagcagcaactttaaaatacctagtgaagagagtccctatta

SEQ ID NO: 196588 - DNA, 432 bp, Homo sapiens
ctgaactttctctagatgggcacagatcatgaataactcagaaaccattagcatattgtgtgcttaattaaggctggaaagtgctgaggctttttgcaggcgcagttagcaggcgaactggtcagcagggtttctggggaacgtagatttgcgtgacaggggccctgtgttgctaaggaattactgcaggcactgagaaaagtctcagcgtcagacactcctccacctcccgggtcctgcttccctccctctcccctttccaggcaactcacagtttaggggtgtggttgtgtgtgttcaagctcttgggttttacatataaatgcctgagacttttctgcagggtttaaaaactaacatcttgtcttacagctcttttaggatttgtcttttagaatctccagtcctcacaggaaaaccccccaattaaaa

SEQ ID NO: 196589 - DNA, 331 bp, Homo sapiens
atgggtatggtatatgtggaaaaataagtacatgtccaataagaatgaattgaatgaaacttgtctgtagcctttggatccattcgctggagtcttacgctacttcaggtgaatcactgctatgctatctcatcaatgagagaaggaccaaagacattatatttcttgggttttattaataagcagataacttattaaaaagccaaataaaatacaatcccatataaatggacaattctatttctgcacttgtatataataaaagtgaaaatgtgatatttgaatctctaattaaacatcccctacacactatttctttttattgttaatg

SEQ ID NO: 196590 - DNA, 496 bp, Homo sapiens
gaaagctcttggaattaaattttgagatgtaaaggctggctgacaaattcacagaaaccctctttccgacaccaacttataaatcctaaggcatcctacaaccccgtgggtgctggtttctagtttgcaacgctctaacatagcttggtagagctcagtgggctgggaccataagcattcgggattgtgccactgaaaaactgatgtcacatcaaaaggaacacctttcttctaatatactaaaaaggttttgtacaggctgggtccagaggtcttagggctagccaattcctgctcccaggtattctaagaagccggagaaagctccctgcaggtaaggacccatcggcgcttcccgcactctgccgcgcgggaagcgaaggttggagtcctttccccacccccggagggtgggcggggccgaaggaccgcaccgccccagacccgccccctgcgcgtggccccgcccacagctgctcctggccgtgcggccgcg

SEQ ID NO: 196591 - DNA, 1082 bp, Homo sapiens
gcagagcaggtgctcaagagaagcccatcccccatcagtcccccagtgggactccccatccccaccagtcccactggatctacagggtctgctctcaacaccatcctccccctgcactgtcgatgggaagaagctgcgggctcagggtgctctggcagctgctgggacctgccgcacttttcccacgtggccctgccggtgtgtggacgagcctggcaggcctgctggtccatgctggcaggtaagtctcttggctacctcaggaggctttgaagtagagtctgggcaactgcaggtcagcctgctaagaggaggtgcaacttatggggccagccgtgtcggttccctcccatgccagccctcctgccaccagaccagcactgggctgcctgttgtggcttccggacctgggcttggacctaccatgggtggagattctgatgatttgagcaaccagcccagggcaaggtcatctccagagacagatgacggcccctctgggggcagcaggacatgtgcagggtctccaaggcgttgtgtggcaggtcttgctctcaggccagaccgaggttgccatcacccctgtcttcagtttacaccaggatcgagtttggaatctctatgaaatccacctttctctgctggaggacatgtggagttgcaggaggtggtcttaggggtagtggtgtggtatttgtccctgattgttgactgccagtggaagctccactggttactagatgtaaggggtcaggaggaaggactcactcccacacacttcttgtagtatgatatcggcgtgtcctgggacagcctgacgtgggctgtccagatagagacaggccagagccagcgccagcgccaagcttggataggcccacgctcaagccccatggactgtcagagggctctgctagagtggtctgggtgtccacgcccacacccctcccttgatggagccaccagccagacctggaatttgtaggcaggatgttcttcttggaatgctgctctttaaaacagcacaggccaggtgcggtggctcacgcctgtaatcccagcactttgggaggccgaggcgg

SEQ ID NO: 196592 - DNA, 544 bp, Homo sapiens
  misc_feature (40)..(40): n is a, c, g, or t
  misc_feature (152)..(152): n is a, c, g, or t
  misc_feature (194)..(194): n is a, c, g, or t
  misc_feature (378)..(378): n is a, c, g, or t
  misc_feature (386)..(386): n is a, c, g, or t
  misc_feature (388)..(388): n is a, c, g, or t
tgtatttaatttatatgtgtacttaatcacagatacattngtcaacatatttatctgtgtctcccagataagtttcttaatatctttagcctctgttactagcccgatctagaaacacttaataaggccaggcatggtagctcaagcctgcnatcccaacaatttgggaggctgaggtaggaggatcatctgantccaggagttggagaccagtttgggcaacaaagggaaaccacgcctctaaaaaagtttttttaaactagccaggcatcatggtgcaacacctgtggtgtcagctactcgtaaggctgaggtgggaggatcacttgggcccgagaggtcgaggttgcagtaagctgtgattgagccactgcacancagcctgngngatagagggagtactctgtctttaaaaaagaaaaaagtgaacaaagtgaacacctacaaccaactaatcttcacaaagcgtgcacaaataaacaatgtggaaaggatacctttttcaataaattatactagaaaaattggatatccgtatacacaa

SEQ ID NO: 196593 - DNA, 157 bp, Homo sapiens
aggagatcttggctctctcaaatctttgcactcttgatccaaattgaacagtcccatgatcttcgaattattcctgggcagttctgagcccaagcgaccagtttttacaccatctaagagagtactgccatgtgggtgccagaaggcctgttttgtg

SEQ ID NO: 196594 - DNA, 667 bp, Homo sapiens
ctgagccttgggagcagcctggggtgacagcttcaagttgtgcagcttttcccagacatgctgcctttccccatgtgagccctctgttaagtgaaacacactctttcaagaagcccccagatgagttagaatgctggaaataagttctgctctattccctcccgttcaagggagggaaatgagcaacactactgaaaagttctggtttacactgagattagaagtttatactataatgtaaataacactgctttcttcatctagaaagacttgctacaaaaagtcaactgaattaaatgaaggaggtacttactgatgtagtttatttttattttgatgtaaatgcctttgtggacaagaaaccccacggcagctcatctataagccacactgactagcactgtttcagagcacttttaatattaccttacttgaacttttcatggactattttctccatagttgcagaaataagaaaagaacgtgggaaagatagcactgattatttttagtaaggactactttttttctatctatctcataagtcaaaaggtgtttcatgtaacagaacctcacttttttgctttttaaaagcaaagtaaaaatagaacataactaaattcaactgttatgtaagttattttgtcttctcagacttaatgattta

SEQ ID NO: 196595 - DNA, 421 bp, Homo sapiens
tattccaaaactgaccacatagttggaagtaaagcactcctcaacaaatgtaaaaggacagaaattataacaaactgtctctcagaccacagtgcaatcaaaccagacatacttttcatctgttatactggaaacatgttaaagagttaagttgtatacctatgaaatttgtcattgttgaagcctcttgtgagaatgttttatatatggggaaaataggtatgctctatagaatggaactgcaacagagggcaatttatatctgctacaaatttaaacatgccggccatggtgggtggctcacatctataatcccagcactttgggaggctgaagtgggtggatcactgtaggtcaggagttcgaaaccagcctggctaacatggtaaaaccacctctctactaaaaatacaaaaaaaaa

SEQ ID NO: 196596 - DNA, 523 bp, Homo sapiens
ctcgtcatcccacaggatatctgacaatcactggagacattttttattttcataacaggggtcggggggcatatgctactggcacctagtggatagtcaggtttataatgcacaggtcaacttcaagaacaaaaaattatctggtcaagaatgtcaacaatgtggaggttgagaaccctactctagagcaactatttttttttaagtgtagctaccgagtcgaggaaataaaatggaatccttaaaaaaaaaatcaataaaaataaataaataaaagaagactggaaaagagaccaaaaggaacaaggaacatatgagacaaataaaaacaattgtcaagatgacagacttaaactcaatcctaccgataattaatattaaatgtaaatggactacaccttccaattaaaggtcagagattatcagactgagagaaaagacctaactatacaatgttcataagagatatattttaaatacaaaggcacagatgggttaagaatacaataatgaaaaaaagata

SEQ ID NO: 196597 - DNA, 864 bp, Homo sapiens
gcaatcaggaaaagcttcctggaagtggggataaatgagctgattctgtaggaataggtaagaattagatttatgggaatagagaaggcaggagaatattctgggctacaggaactacaagaattgtttacccagtttggctaaagcatgggcctggggaagggagggaagagaatagaaaataaggttgagaaggaagatgggggctggctggtgcaggaacctttgaggccaaagcaggttggatttttcctctctgtggacaaacagaacatttgaagatttctggacagtttagtgtaaggcagatgacgctggcagcaatagggagggtaggtgagcagtggagctgtggtgcacaactttatgggacatactggatgggcagcactcagccttcgaggccctgtaagagggaagggaagagctaggaggctcctgcatggatctttagggtatacctaagacactggcagggccatcagtactggacttgaaaagaacatgataaagctagccaagatacagttaacagaatctggcactgattagatgtgaaaggcaagaaaaagagaggcactgaaactagttctgagtttgagagaaaagggagatagtggtgtggtactggcagcactcaaagtacacacacaatagggtccgaatggaatcacaaacacatagccaaagcttgcagtacatggctctctccccatggacctggatgtcctgattggcaagttccatgtcttcagagcctagcctggaacctagcacaaagcaggcatatagtcagaaggaaaaaaaggaaggaaggagaaaggaaatgaataaatgaatgaattggatgagggcagctcctag

SEQ ID NO: 196598 - DNA, 468 bp, Homo sapiens
agggaaatgctgctaccccaatcctctcctccccctcttcctgccacccctcaatttatagataaggagactaagactaagaggtcaaataatttgttcaaggccactggcactaggaactaatggagctgagatttaaattgtggtctgactgcaaagtccccagcgcttaacccgtctatcagctcacactcactaagcacctttgtgccccacagtactcttgagagatgtacaacagacaaattagtgcagattctcagctctttaatcaagggacttgccatctggtttaaatggtgcatggtccacaatgctttgacataaatggcccagggtatcttcagtgggcctaagaacacttcctccaaccttatgtccagacacacaatggcacttcattacagtttgtgggagtccagtaatttttaatcactggaataaagactttgatgatgtgaactaaaa

SEQ ID NO: 196599 - DNA, 495 bp, Homo sapiens
ccacgagggtcccacgttcctattctctttgctgtggagcagtgtttgaaatagctaacactaaaagtggcaactattgttttgttttgtttttgtttttgagacagggtcaccctctgtcacccaggctggagtgcagtgatgcaatctcagctcactgcgacttccacctcctgggttcaagctattctcgtgcctcagcctcctgagtagctgggattacagatgtgcgccaccacgcctgactaatttttgtatttttagtagagacggggtttgaccatgttggccaggctggtctctgactcccgacctcaggtgatcctcccaccttggcctcccaacgtgctgggattacaggcatgagccaccgcacccggccgcaaatactggttttgttgagatgaacatcaaggtctcgtgtttagccaaagataaatactgattcatgacactccggaaaatttcatctcatccttgaaaatgaagactttt

SEQ ID NO: 196600 - DNA, 508 bp, Homo sapiens
tgcaggatacaaaatcaacacacaaaaatcagtaattttctatatactaacagaaaactacctgaaaaagaaatcaagaaaacaatctcatttacaatagctaccaagaaaagtaattcttaggaataaatttacccagggaagtaaaagacctatacactgaaaactacatgaaagaaactgaagaagacataataaataaaagggaatcctatgttcatggagtagaataattaatattgttaaaatgtccatactacccaaaacagtttacggattcagtgagatccctgtcaaaattccagtgtcatttctcatagaagtaggtaaaaaatcctcattcatatagaaccacacacacacaaaaccctgaatagccacaggaaaaaatgctcatcatcactggccatcagagaaatgcaaatcaaaaccacaatgagataccatctcacatcagttagaatggtgatcattaaaaagtcaggaaacaacaggtgctggagaggat

SEQ ID NO: 196601 - DNA, 823 bp, Homo sapiens
aatatggagatgccaaaaagaccaggcacacaaagctgaaggtgctggagatgccaagggaagtgtgtgcatttttgataactgtgtacttctggtgactgtacagtttgaaatactattttttatcaagttttataaaaatgcagaattttgttttaccttttttttaaagctatgttagtacacagaacacttcattgttgcttttgggggaaggggcatatgtcactaacagaaggtctccaaagctgcattgatgtggagaaaacacctttcccttctagttttgagagacttcctcttggctcccaggaggagggattccctgactttgacacacatggccaccttggcacaaaagccttgtggtatagaaaaacaaatttgtttttatgtcctcttctccctttccatctttcagcatagacttaactcccttaagcccagacatctgttgggacctgacccctagtcattggttaccagtgtgtcaggcaatctggactttccagtgatgccactgagatggcacctgtcaaaagagtagtggttccatttctagattgtagatcttcagataaattctgccattttcatttcacttcctgaaagtcagggtcggcttctaaaaatttgttaaacaatatgctaaatgtgaaatgtcacccctcactctaaactttccccgttcagagcatcagatgaagacttcattgggttttatagtggctttctgatttttggtagtccattgaagaagggagtttgaaagttgttgtatactgttaacgattatctgcccatgtcctgcctgaaataccgt

SEQ ID NO: 196602 - DNA, 243 bp, Homo sapiens
cgctctcttgctatgttccagcctctctggactctgtgttcctggagcaagccaatccgttcccaccccaaggtatcagcacctcctggaactttcttctcttctccagactttggtgtagcccctttttcttttatctaatgttcctaccccaatccactcattattttaccttaccccattttattttcatcattgacttcttctctgaaatgttcttgttcattacagttgtgtgtttat

SEQ ID NO: 196603 - DNA, 575 bp, Homo sapiens
ttttagagcaccgttagcaggtccttgtcttgtccctgactttcacaatgactctggttgcatttagtagtctttatcatgctggaaaataatcctctggctctcacatgttgggtgttttgaccaggaggcatcagctcaggctttggactcccacatcagcaccctgtaggcaccctcgcaccccagtggcctcctggtaaaggctgctggctttctctaatgaaacacaggccccattttcctggcaattaggatttataaattggggggggttttgatctgtgttcagataccacaccacattccaaaggcagttccaggtatttctgaccccacacctgttggtctcacctcagagagtggcagctgcacatgtcaaggttgggaggagccgctgccagacctgggctgtggcgaggttagagcccaatgggtcaccgggcagcaggtgcttcctgtaggtgtaacaagcgtcccaccagatctgtgaattcacagacaggctgtgtttccccatgcaccagcacagtgatgagagatcccaggcatttaaatgggttgtattctaggcc

SEQ ID NO: 196604 - DNA, 916 bp, Homo sapiens
gctcctgacctaaagtgacccacccgtctcagcctcctaaagtgctgggattacaggagtgagccagcttgcccggccccaaaacctgactttcagacacaccttcgaggtcctcactccccaccaggtgcagggagttttagaaataaagggccatgttggctcttgggaggaagacttgccgtgatcaggcgccctcctggactccctcaaggttactataaaaacctgtggtacccttaatccagcttctctcatgccagcctgttcctgggagaacctaactcgttccagggttgcaacatgggccaggccttccacagtagaatagacctcaggggtgcaccctctagaatcctggtgctgaatggctcacggatggaagtagttgcatggaaaataaaaaaagaggggcaggacatgctgtggttagtctacaccaaacaacagatgcccacactgccacctaatacctcggcgcaaaaagcagagtgagtcccctgaccagggcccggctcggggtcggggaaaggcgcttcacgggcgtgcggactccaagggcgcctcccttgtccctcgtgcacacacaacatttggaaagaacaggtcttctaaatgcaaggaaatcccccattacatatgcaaaagagatactgcggcttttagaggctgtgcaggagcctgagcgagtggcagcccttcactgcctgggacatcaaagaggaaactcctcagtgacattgggaaatgcaagggctgacaggaaagctaagagggaactccgggagcagtggcccagctagccttgttcccctgtgcccattctcttgacgtaaatccatcttaactacaaaagaactagcagctcagcgtggtggctgtaatcccagcactttaggaggccaaggcgagcgga

SEQ ID NO: 196605 - DNA, 379 bp, Homo sapiens
gagcaggtgtggagagggaggcattcttatggaggcttagtgaggggcagttgaggataggggcctcaagttagaggcagtatctgggctgagccatcagcgattcccagggtcctcaaggtcatgagcctgaattagatcacccagggtgtaggtgtcactggagaagagaagagatgaagaactgagccccagggctctccaaggtttagagtccagagagtagagaattgactaatagaagttcaggagatgaagctggaaagggaagggagaaaaccagagaagtgggatttcaggtgccaaataaagacagtgtttgaaaggaagagaaaggtgggtattgtgtgatggtactgttagaccaagtaaggtttag

SEQ ID NO: 196606 - DNA, 707 bp, Homo sapiens
aacaggtggttatgtcttccattatttaaacacatattttactgtgcttctcttatcagctactgtccttctctctgctccatttgcagcaaactccctgaaagagttgtcatatttcttgtttttttcttcttccattttatctttgcctaaataatcaggctttctctctctctacttcaccattgttgcttttatacatgtcaccgatgacctccaatggataaatccaatgatcagttttcaatcctcatcatactgccacatgcagttgataacattctcctccttgaaacactgtcttcattcggcttccaaggcacccaaaactcctccacccatttgtcttcatcctactttactggagctcttctctcctcttctctttgacttttgaatgctggagtatttcggcggttagactttagtgcttttccctgtctatactcacatacttgttgacattatgctaatgacttctaaatgcaaaactttatttccaaatataggctctcatcaagctaactgcctaattaatgatatttccactggaaggtctaacagacatctcaaactcaacttccgaaactgaactctttatctatctccccaacactctttcaactgcagcctttctaatctctgttgatggcagctctgtcctttcagttgcttgggacagcatcttgaattcgtctttggctgag

SEQ ID NO: 196607 - DNA, 437 bp, Homo sapiens
tttctgttgttttaagccacccagtttgtggtaatttgctatggcggccctagtagaaaaattcacacccccccactcttttacagaaaatgttaccgtgtgggccttggatctgggttgtggagtgaccatcaaagggcccagggaagcaacccagaattgtggaggtgtttacacactgtggtgtgaaccttaaccaactggaaacaggagggaaccagttaaacaatttcccctgccttcttcctcggactgttccatagtatgatttcctcttgcagtctttctgggaaagcctcagtgcctactggccacatctgtctagccaactgcattgtttcttcccaggtcattgtggagtggaagctagtacatcacatcacattacatggcattgttttgtgtttttattttgcctcattttcttttttcctcac

SEQ ID NO: 196608 - DNA, 161 bp, Homo sapiens
cacagggttgggaggggagttctacatctgccatcctcctctcttccccaatttcctcttgaagttcctatcactacacagaagtctcacttccaagtttcactctcatcctcttgactccctcatgtaattacccacattgtaatagtaatagctgccca

SEQ ID NO: 196609 - DNA, 354 bp, Homo sapiens
aaaataattgcttataacctgttacatagatttcctggtcaaccaggggttgaggcctgccatctgaaattgctgttgtagtccagctctcctgctgtagaggaggatgctgaggttttgcctcatattatgcttctcttagtcacaaatctgaggccaaatgcaactgtactgagggccacccctgcccagcctgcccctgctgttacacctgaggctttgttaagagtcttcctgggtcatgtctgacctatcctgtggttttatgcctacacatccccaccgcccatgcacacagctacacatgcatggctcccggggaggcccactgggctctctctggccatcaactgt

SEQ ID NO: 196610 - DNA, 541 bp, Homo sapiens
atctgctgtccatgatatagttagcagttaccttgcccagttgtctaggaacctagcatagagtcacttcctcttagtgcttctggttagtttcactgctgtgtcaaatctccagaaacaatgaaacaaagggaaaagggggatgaaactccaaattcgtccattttgatatttgtgcatgtccctggcagaggtgtacagtggaagtgttaggcagtaatgactgaaaagagatctgagaattgttcagattgcactgttttctccgttacttttgtcctttctgatgcctgataaatgagagctttgaaaggtgcacttttctccttgggtacttcttaattagaaattgagtatgttgaggacccctcggatggagacctaaagctgtgctgtcctccttctctcccctcattcttcttggccctagaaaccattaatcccaaatctccttctgcttcccaaatcacttcctgctggtggccctgtcagatgcagctaaggctggaaggtctgtggaaaattccaaaatggctgcttt

SEQ ID NO: 196611 - DNA, 598 bp, Homo sapiens
ccgagcagctgcttcagggaggcccgggagcccctagggcgggcagccccggagcctgcagctgcgacgcagactcggaaactacaactgcgcgtgaagccgactaaagttaacgcctgtgtgattgagtcagaagctccttcaggaacacaggagtggggccgactcctggaatccggccccgggtcgcttataaatgcgccaagaaaaaaacgtcaccgaaaaactttatacgcgttcttgctttggtccagaatggtaaaaagcctatcctttgagtgtgtcccgtgatggggttaactagcaacccttgaaactagtggaactcaaaagcaaaacaaaaagccattgtacccagccgccccgggacctgggccggcgcccttgggaagtctggcgtgaaaggaggggtggctttggtttcagggccgagctcgcctctcccgggttgggttcagcagccgggccgggtgggtcgtgggcaaccccgggaggcccccggtcccggcgcgcggcgaggccgccctcggacctggcacttgtcactcgctgtccccggcccgggcgtcagcggggagacgcagaagggcggagggag

SEQ ID NO: 196612 - DNA, 247 bp, Homo sapiens
aacttccttcaggaaatcttcatggattacctgaactacatcttaaactattagccatcaggctacatctgaaacacttagagatttgactgtattcctctcttcttgggggtccctaaaatacactgaagttcctgggcctgccagagagtgacattccttactcatctgtggttcttttttttttttttttttggcttttttgtttgtttttgtttgtttattgagacggagtctcactccgtcg

SEQ ID NO: 196613 - DNA, 313 bp, Homo sapiens
tctgcttacactgccaaacctctacaaccacagaggacaccaaaggagaatactggtggaacaagaacagtagggtacagctattcaccccaatagttgttagttatctaaccattcacaaaaacccgtaacacaaaaactacactgaacacaaaaataaatgtttaatccctttagctcttttctaagtatcaaaagataatcacaaatctatgaagaattgccaggcacagtggctcacgcctgtaatcccagcacattgggaggcagaggcaggcggaccaactgaggtcagaggttcgagaccagcctg

SEQ ID NO: 196614 - DNA, 488 bp, Homo sapiens
attcttgcagttaatctctttaccatctcaacatttcctagtttattactttttaaatccatttctgctgctgaagaagcactatccctataccttctcctttctcaaaataatccctttgaaggtgactttctgtttccctaactcatcttatactatacttcacatgaattatcttaatatatttgcatctgcttggcacaaatgtgcataatccacagtttctaccaaatagtctcagtctttcaaacatacaatctatacttaataccaatgaacttacttcatatccctcccagttttaagagtgtgtgatgtactaaatggttgtaaaatgaatggactttcaaatatgccttagttcctaatgtttattatggtttttaaagaaatttagtcagtctatttgagaggaaaaagttctattatctcatctcataaggtcattctaaaaattaaatatgtattttgtgggttagcagtgactc

SEQ ID NO: 196615 - DNA, 109 bp, Homo sapiens
cggcataagcagaggcaggaggagggagggcaaggtgccaaggatggctcctcagaacgagcagtgactcgggctgggctggagagccctgaacttgttctgtctaaag

SEQ ID NO: 196616 - DNA, 210 bp, Homo sapiens
atatggtgttttgagtattttagaacttggtgtagatctgtaatgcaattaatgaagatataaataatttatcagtatctcattagtttggggatggtggtagtaagtgtgcattaatgaaacatatgcattatataatgtatattttttaaatatttagacctgtaaagtaactcgtagttggctgataaaactttgtaaagcaaggat

SEQ ID NO: 196617 - DNA, 432 bp, Homo sapiens
ctccaaagtcttgttcatacaatttcaaaataaaataacttttctattccaaaacagtatttatttaagtgggccacacagtaatccaattaaacagtgactcagcctcagagggctgagccaatgttctcatcaattgacagaattccatgttcctatagtgtgcctctataacccttcaaaatttaattgaaaagtaagagatgtaaatgttcccagatgcccatggattctgtgaagagctgtgtttctcaatttgaagagatggaaggcaaggtatgtctaaatcaccaggggctcttttcaaccccacacaccctgacaattccctccccccagtgcaacagccctacactacaagagtatcttatgccttctcaagtatgtcaatgatagaaaaaaattttaagccactggccaggtgcagtggca

SEQ ID NO: 196618 - DNA, 110 bp, Homo sapiens
tccatactctgcagccaagaaaaacctccctctatttttgttttacaaggaaagatggtcacaacatattattggaccgaagtgtaggttataagacagtgtgtttaaag

SEQ ID NO: 196619 - DNA, 413 bp, Homo sapiens
tctgctaaaaattaatgtaactaattgtgctctattataactttttaaaaattaacgaatacaaataaaatgctggtcccaggatgctttttgttcatgaaagaaaaatgacattcaaaacactatgtagctggccaggtgcagtggctcatgcctgtaatcccagcactttgggaggccgaggcgggcggatcacctgagtttgctagtttgagaccagcctgaccaacatggtgaaacaccatctctactaaaaatacaaaattagccaggggtgctggcgcatgcctttaaccccagctacttgggaggctgaggcaggaggatcgcttgaacccaggggccagaggtttcactgagccgagatcgcaccgttgccctctagcctgggtgacagcgagactccatctcaa

SEQ ID NO: 196620 - DNA, 424 bp, Homo sapiens
gccccgaagtctgtgtccttaacctctgtgcttactgactctgcttatatctgcttatgaatgcttatattaccagcaggtacatcttatttttttccgtgttatggtactagcatttctaaaacatgttaagtatgataattttatgagtttatatatttagagacctaacaaaatgccagcagatatataaagtgtgcaaaatataagcaggatcacattacaatctaggactacttgtgacctgtacatatgaaccattactcagttgttgatgggtcaaggaggatggaggcacctcataaccagacatgcagacaaaacctcttccacctgctgccaaattccaccccctcttcttgtctctggttgttactttccattctcttttctgtctctttcaaggcttgatgagccttgggga

SEQ ID NO: 196621 - DNA, 614 bp, Homo sapiens
aggatcccccggggatagtgccacagcttcccagctggggtgagaaaactaatcttgaactatgtggctataaatattatttatcagaatttttatattcatttaaaattgagggtgtagagtcctttcattttaagatccagaaacagccttggtccaacatgtgctgtagaagaacttcatcttaatttatgtcacaaaataattcagcaccgtatatagaatttggtccctcaaatcatatccctcttatttgttatgattatctctctcatgccagcaaatttaacattaacagaattacattctgtgtagatccgcagatcgtaaagatacacatttctggttgcaaaagtgactctacagcctttatgcaattctgagaaatgtacctgctaaaagtcctaatcaaaatgacagttgaatttttctcctgtaatgcataatcaggtcaggccagcccaccccatcccatgcacagcacggtctggggctagaaggtaaaacatagtatggaagacaggtcaagatcaaggaaagacagttaaaactatcattaagcaacagggacctagtaacccacaaggctactttgtacatacatatcctcacca

SEQ ID NO: 196622 - DNA, 117 bp, Homo sapiens
gcacttaacattcatctctgaacaactcctaggagttgtgcactgaaattccatttcagatgacgagactgaggcccactgttttcacgtaactactccagcgcagaactgggtcag

SEQ ID NO: 196623 - DNA, 225 bp, Homo sapiens
ggggattgcttgagcttgggaggttgaggctgcagtgagcaatgattatgccactgcactttagcctgagtgacagagtgagaccctgtctcaaaaaaaaaattaagaaggaagtcccttggggccaggtggccaaagccacaatacactatgattgcagctgtgaatagcaactacgctccaccttggacaacatagacagactctgtctctaaaaccaatcaa

SEQ ID NO: 196624 - DNA, 339 bp, Homo sapiens
gcgcggacctctctgcttatggtcatctggagagatttccttcactttgcgcctttttctccatcgattgatttctttgttttacgtttaacaattaaagtcttaatttctaagagtgttttgtttcctcttcattatttatctagctttaagttctactacgtccttctaaccatactatgtctcagcaaaattatagtttgacatatgcataaatgaaaaattagtccatctaatgatctacagtaggcaaaaacttcaactcaatctgaactcattttttatgactaaaaatctgccctcgtctcatctattcctcagtcatcaggtgttttgtgg

SEQ ID NO: 196625 - DNA, 516 bp, Homo sapiens
ttatgaaggtcaaagcacccagaaatgaaaggacttagcctcaggtcacaggtctagtaaaccacagaatgaggaagagaagtcaggttttctagcaccagccaagcctgctctctcagggcatacataaaaatagaaaactccaaaagccagagctcctttggcctaaatcctatatttctttcttactggggtggtaggaaatggataatttgggatgttcatgttttgttagatgattctcccttctctctctcacacatctttccagttttcctagttttccagttttcttcctatgacagttttttttttttcccctcaaagtgtggtctttagacaacttgcatcaaaacggctgtggtgtctatttaactcgcaaatcctttgtacctcttcctacataagactgtcttgagggaagcctgccttttaacagatgccaacacccactgaaacttgcagcctctagccctaagggagtggacatgctcttctctggctgggtgaggtcaa

SEQ ID NO: 196626 - DNA, 152 bp, Homo sapiens
agaggttctttataagctgttgtgtactttggatgctccttagaaacatacaggcccctaaaatacttctgtagaccagtgcctctgttatgggagatttgtaaatgcttccttctctggcattgctgtcctaactgccttttcagaaggct

SEQ ID NO: 196627 - DNA, 168 bp, Homo sapiens
gtccatccgtccgtccgtccatccatccatccatccagccatccatccatccatccatccaaagaatgtgcaaaccaacccctatcttgggcaaggtgccaggaacagatgtggctccagccctcagggagcttgtccactggtggatgaaacagacaacaaataagt

SEQ ID NO: 196628 - DNA, 313 bp, Homo sapiens
agatggctaaggtcggctcttgcctgtgatagtaagaatggaggagatttgtttgacgtcatagactctggattataagaaggagacatgtcaagcagtaactacgtggcatgtggctgtgatgcgtctacagccaacctcctggtgtggccttcccaaagacaaggaagcgtcccattcaagtgtgtctcagtgcttgcatgacacagtgcctctggattttacgtcagttctgccttcagtgtaaagccctgattttcatagataacctaatctgtagggaaaaagaacattaaaaaaaaaaaagtatagc

SEQ ID NO: 196629 - DNA, 282 bp, Homo sapiens
gtgctgagattacaggcgtgagccaccgcgcccggcgacaattgggaatttttgaatgctgattggatatttgattacattaaggattttatgttcatttttaggtgaaaataatagtaaaatggttataatgagagagaaggagggagagtgagaaaaaagggggaggggcgtcatcttttaaagatatacactgaagttttcatggaggaaattatatggatgtctagtatttgctttaaaataattcaggggatgccaggcgctgtggcttgtcgacgc

SEQ ID NO: 196630 - DNA, 583 bp, Homo sapiens
tatatttttcagtaaactttccaagaactatgttgtaaattttcttttagcttatctactagggagatttaatatagtgatttttattttaggaactgaagaggagtttggaggtcttgtatcagctaatcttatacttttgaggaacagacttctggatatcttgctaaaactaatttatacatctaaagaaaagacaagcattaatttgcaagcttgtgaagaactggtgaagacactgggttttgaccggatcatgatgtttatggaggaacacttacattccaccacagttacagcagccatgaggattcttgttgtcctactaagtaatcagtctattctcatcaagtttaaagaaggactcagtggtggaggatggcttgaacagacagattctgtcttaactaataagattggaactgtattaggtatgggacttttctagtcagctgcttgaaaatgagctggtgtgttttgttttattttaaattttatgtaaacttatcctctgcggtttgatcaccagtaaggagatatttattttaattaatgatagaaggaagagcatacaagatttcaa

SEQ ID NO: 196631 - DNA, 419 bp, Homo sapiens
tttcttgcttctgaaacaaacaggacatttttagtcgctgaagtagctttccgcaattaatttgttgaattctgaaaaagaatataccctctattggaaaatcttagtgaaaggttcagacttgagaattcaacattttattagcatttaaaagaaaagggaaaaaatacagcaaaaaactataggttccaacttatttccaaaatctagcgggtgcatcccaaacctaaaaacatgcagtggaaatcaccatgtctgtatacacgtcatggactgaaacagtgattttaagtatgatttttccggtatgagtaaacttacattcaggttttgaatacttaaattttatgtgggggcataatttaatgctacccaattgctatgtctctgcattaacaggagcatctctaaaaaacacc

SEQ ID NO: 196632 - DNA, 350 bp, Homo sapiens
taaaaaaactgacataaataatgtataccctatttatgttcccgtcttgaaggagcaaatagagactccacacagtacttttattttaaaaataaaagtagaaagctcttagtaagggaggctttgtttggcaatgaaattgtttatgtgttaaacattaaactgcattccatggtatttgctgattggcacaactactgccattgaaattgattccctaatcatgatgataatgactgggattagcccagttcaatgggtgcgtgctttccccagggctcacaaaagccttctctagagatccaggcttccgtggtaatgaactaacaaggctgctgtattctctatgg

SEQ ID NO: 196633 - DNA, 513 bp, Homo sapiens
taaggctagagtttctaaacaccacccatttgtggacttgaacaattaggtaaaagaccagcaaatcgtctacgatataatttagttatcaaaatagttatgtaggctaagagatgttactttcagcatgatcaaataaaattgactgtcaagtcttaaacactattttctgtaagtgtataaaattatcaacattgtgttatcctagtaaaaaaaataaagagaaaggttagacatgaatataaggctgatatttctaattttttttaaaaggagaactctgtgtgataggaaaagcttagctgtgagataatatgagtatttctcagtggtaagttcatgttgaatgaatgactgttccattacggtactgagaagaaagtgggtgtgagagcctgaaaccaaagaatcttcctgttaagtggaaatggtcagcttgtaaaggagaagagacagagtagagtaactcaagtttaggggagcataaattaagagaaaataactgaggaagag

SEQ ID NO: 196634 - DNA, 550 bp, Homo sapiens
  misc_feature (35)..(35): n is a, c, g, or t
  misc_feature (173)..(173): n is a, c, g, or t
tgttctagaggatcccggattgggacatttcaagnatagtcagtagaattagaatgtgaagatgataagtgtagagggaaggttaatggttgatattgctagggtggcgcttccaattaggtgcatgagaaggtggcctgcagtaatgttagcggttaggcgtacggccaggnctattggttgaaatggtcgccaatccggcgaccatttcaacaatgaaaaaaaggactgaaagcaacttactacatgcttgggaggagtatcatttactgtatcagcaaagcaactttgtataagagagagaccgctggtctagaaggcagaagatatagactagaatcttctcagctttgtccttcactagttgtgttgccctagacaagtttctcaacctctctggagctcacatacctcaaatcaggaaagtgagctaaaaaaatccatttcaacaaccacccaactatctataatcactgcgcccgctcataaggggatggccatggctaggtttatagatagttgggtggttgttgaaatggtcgccaatccg

SEQ ID NO: 196635 - DNA, 409 bp, Homo sapiens
ttgtctttgtcctcttaactaacttctgatgtttctctgtgtttgatattgaactccctgaaatggtcgccaatccgcggattggcgaccatttcaacaatgaaaaaaaggactgaaagcaacttactacatgcttgggaggagtatcatttactgtatcagcaaagcaactttgtataagagagagaccgctggtctagaaggcagaagatatagactagaatcttctcagctttgtccttcactagttgtgttgccctagacaagtttctcaacctctctggagctcacatacctcaaatcaggaaagtgagctaaaaaaatcactaagatgtttctcttccaatactagaatccttctcctaccccagcctaaaacaagcttgaaaatgctagacattcatgaata

SEQ ID NO: 196636 - DNA, 631 bp, Homo sapiens
  misc_feature (5)..(5): n is a, c, g, or t
aaaancgcgtcgatgagctcgtcccccctgaagtgcgacaggagtagggcagaaacactgaagagggaggtaagaagatagtaggcctctggtggacactcatccacaaagagccgagtgtctagagtgaccagcatcacacatgtctgtggctcagcctggggctgggaccagtactggtcagtaaccaggtcagggacccagcctgggtaaggggtcttgtataggggtggaattggtgttcaacctgtggccaaggttggaggactagggcttggcttgtggctggaattgcaacttagtctgtattgggattagggctcaatctatggctggaaatagaaccaaagagagaatactttttgtttgaatagcctgaggagcaaactgttacctgtgttcacaggcccttggcattcttcagggctccgacacctcaggagcctgataccacacagacttgaacatttccatccgttagcactgtttctgaaagcacctaagatatcaccagatttctgacccacaacaggcttgagatctcacttaaactaagatgaggacctttgtaagagaccttcaaatagcatcttggcaaatgactataggatcctctttctagattcatagg

SEQ ID NO: 196637 - DNA, 414 bp, Homo sapiens
ttggcaatgaaccggtaatcctttaaaaattcatgtatatagttttttttcttggaaattataagaatgatttgatgagtggtttgatgcaacttatattacttggtaagcagttttaaaatattcatgtttacttataaaatttaaattttttatttgtattatctatatattatttaatgttactgttctggttgttaaacattttgagttatcttcccaggttgaatgatttatggattaaagtactattgtacattttcgtacattgtatcacgtgaataggccagattcctctttcctattctttggttaatttctttggtgtattcacaagcttatacttccatatattaaaaacatttatcttacctctgtaaagacaaaaaatgggaaataaaaagccatttatcc

SEQ ID NO: 196638 - DNA, 334 bp, Homo sapiens
atttgttgactgaaagaaaagaaaagccctcctctggctctcagggaaagaggaagcaggccacgaaggccagcctctcatgaagacaaggagagtcccttcgacttccatacaacttggtccatttgctgtgaggaagctgcttgactgtacctccccttatctgagaatccactgctaattgagattttggagattcctggtcccagacataactctctgtcttttcctcaaagacataagtaacattcagcttctaagagtaaaggctggcactgcttaataagataatgtaaaaatgtgtaagaccttggggagtgccccaaggtgcatt

SEQ ID NO: 196639 - DNA, 397 bp, Homo sapiens
gaattacggtgagccttaagtgagataatgtattttaagtgttgtcacacagcagataaccaattaatggtaataacaataaataaatattgtcacatataaaagattagttgtcaccagtggccactgagtttaaattcatctgagtgttatggaactcagatatgaaatgtctgaacacatgatcccatcccagaattgagagaataaggtgtatttgagggaagttatacacaaggaaggtgctgtggaaagtgaagaggacttataaagaaaagagcagacagagaagagagccttggacaacagtatatcactgaagaaataatggattcagggtggggcctatgaaagacaggcagatggaggctaggagaagaggaagctacaataagaa

SEQ ID NO: 196640 - DNA, 266 bp, Homo sapiens
aatgaaaggcctcacatatttattactgaacccagccaaccaatgcgttcataacagatgcagagagacaaaatatattcccaacaaaacatgtcaaactctccggatagtggtgacattttcagcctgatatggtaacatgattgtgaccttcagacagcataaatatgtgtgccatctcatgtgcaattccttatagacccagcttggttcttctccattgtctccttttggttttattttattaataaaatcctgattttatt

SEQ ID NO: 196641 - DNA, 87 bp, Homo sapiens
aggaacgctggaggccaggagatcaaggcggcagcaagccatgattacatcactgctctccagcttgggggatagcaagactctgag

SEQ ID NO: 196642 - DNA, 768 bp, Homo sapiens
gatgccaggcatattccatagtttgagtatactataatttaaaattttttccccaatttgtagacatttggattgttccccagtttttgctgctaaaacacaatactatagtgagcaactttatacacttttttttgtaaacatgttcaaatgaatctcccatcctctattacacagtatgtatttttcctctatggcactttctcagtttgtatgattatttgattaatatttgttcccttctttaggccatacatttcatgagtatacccattgttcataggtattttcctttgatttattaatatgcttatctgtgtatccatagtacctttgcccaataaatattagttgaataaatgcatttctataagtggaatcattgggttaaagaatatatacatttataattttgttagacactatcaaattgtataaaaatattttacctatttatatttctgctgctggtacttattttcacatttagcctcactggcccactcaacaacaccgtgccccccagccagctcttcaccccctctcctcttttccttttgttactttcttctacaaacatttttattgacacttacattccaggtttagtactaggtgtataggatatatcagagagcaaaacaaagatcctgggtgggaagaaatagacaattaacataataaggaaataatataggatgttagagagtgaaccaataaaagagtgaaaggcagttggtaatgctagaattggagttgagttgcaat

SEQ ID NO: 196643 - DNA, 183 bp, Homo sapiens
agccaagttatgccaagaaacaagaaactcagcgactggggtatattcacctactctatgaacatttactgaagcaatgttatgtgccaaggtaagtgatatgactatatttttaaaaatgtgttgggtaaaaggatctccaaatgttaagagagaaggataccatttatttcttctgcccaa

SEQ ID NO: 196644 - DNA, 511 bp, Homo sapiens
gaggtatccaagtgtgccaccaggatgtgaaaaatataagttcaaaccatgtactttgagagtttactgttctttctagattatttatatggtcaatacttttaccttttcctctttcctattccccttgcttgtaaatcccattactgttcattataccagtgtagatgtgaaaagtattttgtcaactttatcaaccttgttaaaaagttgaggaggagccaagcgcagtggctcactcctgtaatcccagcgttttgggaggccaaggcaggggcagggatggggaggattgcttaagcctaggagttcaagaccagcctgggcaacatagcaaaacactgactctacagaaagtacaattatccaggcatggtagctcatgcctgtagtctcagctacacaggaggctgagatgggaggtttgcttgagcccaggaggtggaagctgcagtgggctgtgattgcaccactgtactccagcctgggtgacagagcaagaccctgtctc

SEQ ID NO: 196645 - DNA, 458 bp, Homo sapiens
ttacctgatttcctcccatgtgagtgtgctataaatacagctcttccaaagcagaacacatcagattaaatacttgtgatctggcagggcacggaatagaatggcgtaggccagcacgtgaattggtggtaaactgaaggtcatcggggagaaaataacttctctaccctcttcggtgtagtatttaaggccagtgaattaaactaacaaaaggcacatctcacaggatacgagacatgcaattttattaacattttacatgcactggagttcacagaaaaggagtgaaagtcgaagtgggaggattgggggcttatataccattttaaacaaagaaaagggtgtctgcatttcacgagatgctgaattgcaggaaggtgactaggaagaatatgcggaagctaatggaagatgagggttattttagtaaggtgtgtttctgcatctcatctccatgc

SEQ ID NO: 196646 - DNA, 160 bp, Homo sapiens
tattcaaaacttaaaacatggacgaatccttaaatctcactctcctccaatttccatatctcagtgaatggcactatcatccagacagtagccaatcttttccatcattctcatatttcatctaatactattactaatctatttgatctacttaacattc

SEQ ID NO: 196647 - DNA, 411 bp, Homo sapiens
gcctcaaaatgaaaacaatctaaataaataaactatgatgtacctttacaatgggttttgcagcaatttttaacaatgaaatattgatacatgctacaacatagatgaattttgaaaacattatgctaaatgaaagaagccacagaggaccacatcatgtatcattttttatatgaaatgtccagaatgggcaaatattacacagacagaaagtagactagttgttgttcagggatgggaagagctggagagaaatgggaatgaccactaatgggtacagggtttctttctggagtgataaaaatgtaccaaaactaactggtgattgctgcacaactctgtgaatatcctaaaacctataaacacataaattgtatggtatgctaattctacctcaataaagctgttgtg

SEQ ID NO: 196648 - DNA, 425 bp, Homo sapiens
tacaggcatgagccaccgcgcctggcctccccttcttttatcaacagcattctcctttttctttgggaaactacctgcatgtagtcttgctaggactgctgggaaactggtacaccagtcaagactttttcccccagacctgagatcttgagaaatgacataaggtctgaaaactgaagttgatctgttccaatggtggcctaaagagatcactcccatcagtttctgctctccctacccacaggactgctctgacttctcttcttcttggagctgctgttagactgtccttttgtaaatggaacttcccctgtccttccagtaaattcctatattgcttatgtgaaccagtgtcctcatgtgttacttacgcccagagaatcctaatccatatactacctaccctaatctatacatgacctctc

SEQ ID NO: 196649 - DNA, 957 bp, Homo sapiens
tgtatttaaatgactcagaagctttcatccgtgatgccattttgccatcatgaagtatagagatctcatttatatcttccttttttcacacttcaagactattgaaggaattgatgccatttcagcctttaaaacaatacatatgtcatcaccaaatcatggaatcctaataagttgagatcatttggatgattctaaatttgctaataatagatttttttcacaattaccatgaaacagaagaatgatagtatatcctcagatccccccaggaatttgctgactgtcacattttcaggcaaattggccaaaatgtaggaaagtgtctggcatgtagtaggtacttggtaaagaaaagttttttatgaaattcatgccaaaaccatccagtaaagccagagatttccaaactttatacttaaagttccatcaactggacttcaatgattctatgtctcaaaaaaattaaaaagcattagggaaaatattactcaacttaaaccttgacaaagttgaattggaatattaagtaactagcaacactggtgccagaagtgagtaaagttatctgcagagtgcaaaattcgtcacggtccttgcccacagacttgtagtctacataagaaccaaaagggcgtgaagaaattactgtaaaacctatcacattaaggagcaagaggctatggaaaggacacccattctcacaatgagaaaggttgtccttgtagagaaactggaggccttcacccatagacgatccagagtgtgaaaattacagggccaggacacagagcagcttttggaagattcaaaccccagaagctgatagctgctcagactgtgaaagggatcctgaatccattctgccggcctcccccatcaagatggagttctctcaggaaaggacaaatggacaaattccaatttggttgtcagggaaacctctggcaaagcacc

SEQ ID NO: 196650 - DNA, 217 bp, Homo sapiens
aaggatggattgcttagcttaagagttcaagaccagcctgtgcaacatggtgagaccctgtctctacaaaaaatacaaaaattagctaggtgcagtggcgtaagcctgtagtcccagccactccagaggctgaagtgaaaggatttcttaagccccagaggtcaagactgcagtgagccatgttcctgctattgcactccagcctaggtaacaaagc

SEQ ID NO: 196651 - DNA, 709 bp, Homo sapiens
gttcttgtggatgaagcctccggctagcaggcttcagagagagtgaatgtgaatgtctactatcagggccttgaaaggtgtcagactctccagaaagacctagtgacggacagggattctccacagagtgcaagattccccaacagacagctttgctgggccatttcaaaatctgtcaaagaaatatatttcttcagggcctgctggccgtcatgtgatgctctactagagtctggtgggaatttgctatcttattgctatgaacagtctgtttggtcagccttaggagctctgtttttatgttaatgttggtcatgaactccaggaaaggagggtgtagtgaggcctgcccaaccccctctccctgtcatggcctgaactcgtttttcaggtttctttgggatccctttggccaagaggggagtccattaagttggttggggggcttagaattttatcttttgtttacaaaggcatattgagaactttggtcatttttctaagagcatcaggtaaccgcagggtttggggtgttcagcaaagcccgtgattacacacacactggaccttcagagaagtgtgccatctagctacgaccacagccatttctcctggtctaccccgtccatcgggacgcactgctgcaggggaagactcacccatcatgcaacccctcactgcaccctggacagtcacttctaaaatgcag

SEQ ID NO: 196652 - DNA, 204 bp, Homo sapiens
ttcatgacacattcaggtaataaggctttaaaaagagatacaagggggccaggatttgaggcagaaaagaaaggtggtaaatgctcagaatcggccacttctcaggcctcctctgcacacaccctggtccaagccaccatcctcgaggcccaggctactgcaacagcctcccctctggtctcaatgcttctgccccttcgccct

SEQ ID NO: 196653 - DNA, 147 bp, Homo sapiens
gccttggcctcctaaagtactgggattacaggcgtgagccactgcgcctggccacaacaccccatttctattttaataaaataaaatactgtgaaaaacatttacaatttttaaattttaattttaaaattaaacttatatttattc

SEQ ID NO: 196654 - DNA, 378 bp, Homo sapiens
gagaggatggggcaatacaggaactgagatacaggagttaatggagttcagtgtagagctagaaggcagcttgataaacttgggttttgtgagaaaataaaggggaaaagaaacaaacaaatgagtctggtagtcacagagggagagacacaaaaagaaattaagaaagaaactgagcaggaagtgggaaagcgaagggagcactgaggacaaaagtgctatgtcaggattgaagaatgtgtgagacgcaggaaaaggggctgtaggctaccactccctctgccctctctccattccaccctcagcccaaagacacagaaagcccagctgtcccttatcacatcgcctcccagacacagttccatttccctccctcat

SEQ ID NO: 196655 - DNA, 616 bp, Homo sapiens
agaggaagtagctgtactgtttgatgatgatatgatcatatacctaggaaacctaaagactcctccaaaaagctcctagaactgataaatgaattcagcaaagtttcaggagacaaaattaatgtacacaaatcagtagctctgttataccccagaagcgaccaagcttagaatcaaaccaagaactcaaccccttttctgatagctgcaaaactaaactaaactaaaataaaatacttgggaatagacctaaccaaggaggtgaaagatgtctacaaggaaaacaactttagtatttttaatgggttaaaatgagaggcagcaggtacagcagaagaagtcagtgcgtgggcatccgcatccaatgggtactgcacctttgatggtaaggctttggttttgacttactaaattactaggtacgattattttctagtttttgtcattaaaccttaaaactactaagtaaccccttccatttcttgttaaatattgtaaaatttcatactctcatttatgctgcctgacgttagagtgtttgtttctattttgtgactaccttaaataatacctataaagagtaaactgttagtagtgtttttgctgtaattaaatg

SEQ ID NO: 196656 - DNA, 307 bp, Homo sapiens
taaaaataaaataattagctgggtgttttggcacatgcctgtagtcccaggtactcgggaggctgaggcaggagaatcactggagcctgggaggcggagttgagatcctgccactgcaattcaacctgggtgacagagttaaaaaaataaaataagaacttatagaaatagaaaagggcattgaaatgaggaactcggtggtgggttccgcaggaggtagggtcctgtctggaaagatgacgagcaggtggtggctgcagtcgagtaggtgagccagggtgttccgggtggtggggacagagtgaga

SEQ ID NO: 196657 - DNA, 614 bp, Homo sapiens
cccgacctcaggtgatccgccctcctcagctcccaaagtgctgggattacaggtgtgagccaccgtgcccggccgacagctaggttttctaatgtgggtgataagagcatgaaagaggaattgggcatgagcccaaggtttttgatctttgcagctgtaaccatggacgctgcatctgctgacatgaagttggtattgacaacaatattcactgtggatagcaagagggttgttttggccatatgaagaatcagagaccaataagtggtggcatcaaatggataactagacatacaggatgggatatctgggagggtgttgataatggagacatccaatatatgaaagctaatgagcgaactacagtaagttagttatgggtccatttaggaggacatgcttcagattttggtggtaaatcttttcaggggccaggaaggtgtgactacaggctgaggagtggatctcttacttacgtccctgagtgatgttattgggcttcctaaacacctgagagggtgtgagtgaccatcatggcaggatgtatcagacagtagagtttggaaggggacatagacatccgaggagagaatagacgagatagatgcatgcag

SEQ ID NO: 196658 - DNA, 821 bp, Homo sapiens
agctattatatcattccctagagggaaaccccttgagttgatcatgcacagagaccactatcctccttgttttcacagtgcccccatcttgagacatttcctattgttacaactgggggtagggagtgcgactagcatctactgagcagaggtcagggacactgctaagcatgctgccatgcacaggccagcccccataacagcaaattatctgacccaaaatatcactagtgctgacgctgagaaactgctttaagtttgctcaaggacagaattaaagtaaatgcaaacaaactgcagtataccttgcctaaacataatacccaggaagaatgagatcttttaaccaacagaaaaaggtctgggctattctacaagtttagagtagcaggttttggcctggcacggtggctcacgcttataatcccagcactttgggaggctaaggcaagaggatggcttgagcccaggaggttgggaccagcctgggcaatatagtgagaccttgtctcgagaacaaaaaaattgttttaattagctcagtgtgggggtgagtgcctgtagtcccagctactcaggaggctgaggcgcgaggctcacttgagccctggagacggacgttgcagtgagccgagattgtaccacggctctccagcctgggtgacagagagagatcctgtctcaaaaataataataatataacaggtttttactggaaggtgtgtttaataacttaaaatcttcatcattatagtgattacttcctgtggcattttccttattgaatatcaacataagtacacactgtgagactctgctag

SEQ ID NO: 196659 - DNA, 455 bp, Homo sapiens
gctgagcacttgaaatgtggctagcatgactgaggaaacgaattttaaattgtgtttaattttaatctcaatgtaaactgccaaatatggctagtggtgaccaaaccggaactgtagctctagattccctaaattagggactttcaacgacaggcaattccctctaccccttgggggacaactgcccccatcttgagacatttcctattgttacaactgggggtagggagtgcgactagcatctactgagcagaggtcagggacactgctaagcatgctgccatgcacaggccagcccccataacagcaaattatctgacccaaaatatcactagtgctgacgctgagaaactgctttaagtttgctcaaggacagaattaaagtaaatgcaaacaaactgcagtataccttgcctaaacataatacccaggaagaatgagatcttttaaccaac

SEQ ID NO: 196660 - DNA, 399 bp, Homo sapiens
  misc_feature (381)..(381): n is a, c, g, or t
agtataagacatcatactgtaccccataataaacataattattatttcaattaaaaataaaaaataagtgtagcaggaggatattatttggggcaaatctgaagagtattttcaacacttcataagatgaaacacagtatactcaaggtcaataggaaggtcagaatgagcaaagcacaaaaaataaaggtaagagtagtaagatacatgaagaggccaggataggaaggagaaaaggcatagaaactgactgaatttagctaaatattaaaaaaaaaaatgccttatcaccaagtaggacttactctaagacacagaaggttagcattaagaaatctgtgaatagattatatcaccaaaaagatttatttctatagagantctaatagggaggtaccg

SEQ ID NO: 196661 - DNA, 991 bp, Homo sapiens
  misc_feature (990)..(990): n is a, c, g, or t
agctggtacgcccggattacgggatgcggctgcggcaacagcggggccgatgtgtagttggtgactgcctctccagatgctgaggtgcctgtatcattggcacaggccagtgctgaaccgtaggtggagtaggctgtgccttctgaagcagtatctattcacaatgaagttgcagtctcccgaattccagtcacttttcacagaaggactgaagagtctgacaggtataaatgctttccatgagaactgaaggaagaaggaaataggagttgcctccattgtgcacgttgcaaaacctgtctggaaggagcataggaaatggctttagctaagtgcctgactccagtagcttcttgctgttgccacagtttcattagtgttgattctcaatgttgtctgctgatgttgctaaagcagccacacagtagcattacaaagcctgtgggaattttaatagcaccttcataaatatatttagtagtatatgtagaaatatgacctatacagcactggctatctattagattcacctggggagcttttaaagcacacatgctcgggttctacctgcagcctactgaattagaatctctgggtgggatgaccatctatatttttaataaaagctccacaagttaattctgatgcacagaagatagacgaaccattactttaacatgactcaccttgtattagcttattctcaaagctactttcccattcttgaaattggatgatggctttttaggtacgtgccagagataaatggcccagaatatgttgattcttttagattgttttaggcagactttaagtagagggcttaaatgcatgtttggttttgccgatgcttcactatcttttttaattggagagagtgaaaattgctaaaaattgctgtccaatagaaatttatgagcccatatgtaatataaacttttttactaaccacattaaaaagatagaaatggtgaaataaattttaataant

SEQ ID NO: 196662 - DNA, 523 bp, Homo sapiens
catagtcctgtttacaaactgcataggatttatgcctcattacgattccccaccctaaatcatcatgcttcacactaagagagaaaagtctaaaggaaatactttgttatctcaatctgctaagtagaatgtttttaacttagcacatttgttaaataatttttcagagagctgcttacttgggcacacataatagaggcaaacttggtacttaccctaatatgaattaatgtaaggtttcattatcttttaactgttggcagtgatagaactaccatttttcatctcacatttttgctatttaaagcactcataggccaggggtggtggctcacacctgttatcccagcactttgggaggccagggcgggcagatcacctgaggtcgggagttccagaccagcctggccaacatggtgaaaccctggctctactaaaaatacaaaaattagttgggtgtggtggcgcacatctgtaatcccagctactggggtggctgaggcaggagaattgcttgaaccca

SEQ ID NO: 196663 - DNA, 207 bp, Homo sapiens
aaaaaatatctaatcatatattctatttgttaagtattctcatttacctttttctttcccagactgagtttaggaattttctcaggtctgtttttttatggctgaggtgggagaatcatttgaaccccataggcagaggttgcagtgagctgagatcgtgcggctgcactccaccttgggcgacagagcgagactccatctcaagaa

SEQ ID NO: 196664 - DNA, 509 bp, Homo sapiens
gacaatctaaccctggactcatgtcacttgtcagtgggctcaacagttatcctgtctggattggttaattatggataagtaagttgactgccataccagtttgcctcagatagtcctaattttcatcaactgtccttgtaataattatgaagtgagtgcctttcattctcaaacatgtcttagtttggatgataaatcatgtggtcatcttaagaaatcacttaagatttctttcttagaaatcttaagttatttcttgctcttacatgatatcagcagaaaaaatagatactgtggctcctgcctaaaaaggcccattttttagagagaatagacaccgtgtcactaaattcagtactgaaactcccaggagacatggattttaagaagttttgaaattacttggtgagaaatgtacctcaaatatgacctggaaatagggactgcctctattgcagatttttaactttacaaaaaaagcaaaaggtctcaaatgtctttgtgaaagg

SEQ ID NO: 196665 - DNA, 329 bp, Homo sapiens
cgccacccaacacatacaaaccatagaccccgcccaacctcccggcccctggccccacttgctaccccctcctatgcctgggggctgctgcctccacgaagccgggctctttctcctccgggtagccgcggctccatctgcagcccccgaggactcctcagccgggataaagggcggcctcccccgcctgccagcgcccaggatgctcagccgtcagctgcggggaggcgctgatttcattccggcgcggctttcgctgcgggcggcgaggggcggacaggccggggcccgcggggcggggcgggacgggggagggaggcagcggccgc

SEQ ID NO: 196666 - DNA, 153 bp, Homo sapiens
gctgtgacacacacccaggggagtatacagcggccttgggcatgggtaaaggaacttaccataccctttctctcatctcacagaacaaaagcaccctatgagggaaaaggagcacaaatactgttgccgtctggacactggtgaaaagtcact

SEQ ID NO: 196667 - DNA, 453 bp, Homo sapiens
catgagattccaggcaagatgtatcctagaggctaatttattatatagggatgatgttcctctctttttccttcatagcactggttgtcatgacatttcgacccaaaacattgtattttatttatttattttttaaaagagacagagcccctcacagagtcacccagtctggagtgcagtgctgcaatcagagctcaccacagcctcaatctcctggactcaagagatcctccctctttagcctcctgagtagcagctggaattacaggcatgcaccaccacacctggctaatagactcaggacattttcatgtaaccctgtggactttgtttatgttctttactccactaatgacataggctgttagtaaacaaaacaaaaaacattgtaagaataaagagtattgtgtttagaatttcaatactccattgctgggccaaagaatattccta

SEQ ID NO: 196668 - DNA, 305 bp, Homo sapiens
ctgtcagccttccgggaggtctgtcctcctgtggcagtgaggggaattgatgggggtttcaagcagccaggaggcttgccctgcactgctcctgcccagccgtccaggaggttttgtgtggctgttgccaatgccgtgcctcctaacccttcctgctgggatgcaggctagagagctgcgacacttacctgctggttgggaggtcaggttagagccgagtggaccaggtggaggccatggatgaggaggcactgcactccagcttgggcaacagagcgagactccatctcaaaaaacaaacaaac

SEQ ID NO: 196669 - DNA, 238 bp, Homo sapiens
tttttttttttttttgaggtggagtcttgccctgtctcccaggctggagttgcagtgagctgagattgtgccatgcctagcaacagagtgagactgtgtctcaaaaaaaaaaaaaaatgtagctagctgtttggcctaggtattacaaatttcaatgtttgttattgtaagtttctatattcaaaaatcacttaagtatgttacacaactattttgaaactgttagtgaaaaataatc

SEQ ID NO: 196670 - DNA, 717 bp, Homo sapiens
aagcatggctggtttgtgagggtcgcctcttagaggtgttgcagtaggtgggatccgaccgctgtgtcttaccaagctgtgctgttttagattcagtggtcatgacgtaatcgtgcccacatattgctgtagaaagaatgtgatgtgtgtgctcctgggtatctctgggtggtggccaatataacactgagataaaggtgataatggctaatacatattgtgtctatcatgttccagtcgcttgcctaacattaactcatttagttctcataacaaactctttgaggaggtacttttattatctctatatatgtggaaactgaggcatgggagtttgatttgcctgaggttaaaccgctgggaagtgtccagttggtattgaaaccactctcaaagttctctagtgttagaaagggctaagtgggcaggaggcagcggctcatacttgaaatctcagcacttcggtgtgcagaggtggaaggattgctcgaggtgaggccaggagtttgagaccagcctgggcaacatattgagacgttgtctctacaaaaaaatttaaaaaatgaggcaggcatgttggtgctcacctgtagtgctagctactcaggaggctgaggcaggaggatcacttgagtccgggagtctgaggctgctgcagtgagcaatgatggtaccactgtactccagcctggggcaagagagtgagatcctgcctca

SEQ ID NO: 196671 - DNA, 483 bp, Homo sapiens
gcacctgcatattccgtaccatgatgcatttcccttgtactgtaacccaattcctttaatctctacaatagtgtttgcccaatttcattctgcctgcttcaaagttatattcaatatttggtcaacaatattagtgaaccaacaacaatatctaaattgttccttttcatttatatcctattactttttgttgttatttttccttctttttgctataacataataagctaattcatgcttttgtcttagttttggaaggaattatatcctaacatttacgcaatatcccttttcctaacttaaaataactatgagcttgccactacactagtaaatttgtaatcaacttaaagataatgtcttaaaagtacaattaaacatgtcataacaggagaaaaccctggtaattacgaatagtgccatgcttgctggatttttaaatagtagtataaggctatgaaaactcgccacccagtgatgcaa

SEQ ID NO: 196672 - DNA, 301 bp, Homo sapiens
tgcacactctcctttctttaattatcccttagatgttggtacccccagggttgtctcttaggcagtcttctcttcttattccaaccctctgagggttctcactcagcccatggcttcagttacagtttgtgtgttgacggctctctcctctgtgcctctagtccagatgctctttctgagcttcagaacaacgcatcggagtgctgaccgggcagctcctcctaggtaccctacaggaactcaagtcagattcctcctccttctctctaaacctgcgccgcctgtgttccctctgctggtg

SEQ ID NO: 196673 - DNA, 415 bp, Homo sapiens
cagtgcgttgtcgtttacctttttgttgtcgttcaagcacacaaccttctaaaagggaacacagtatttttaaaactgggtataaaggtaataaattttttgttcttttatagattcctatattattccataatatagccaaccatatatttttcatgtatatgtgcaagtataggttacttagccataatagtgttatttattcattcactcaagatgaatttacacataggttctggcccatgttgcttatagcttattagaagagactaaaccacagggggagggttaacttctaaactacaatttacaatagcaaacctcctttatagacgtttgttttcagaagaagggaaatagagaaaggatacaagatgccatagcagaacaacaaaatgtatagactaccgtgaga

SEQ ID NO: 196674 - DNA, 603 bp, Homo sapiens
  misc_feature (383)..(383): n is a, c, g, or t
  misc_feature (447)..(447): n is a, c, g, or t
ggcctctctctgggaagcgcgttgttgttacatggtggctgccctgcccagggaggaggcattacgcccagaggggtggcaagttatcagtgacaagagagggaagagaaatacaatttctagaaaatttgccttttgggactgaccttcaagaaaaactgagagagaaatctccaaggtcaacaggaaagcaaagccactagatgtcaccacagccagtgctccggtcattaagtccccagatggaggaaagagcacatcagcatgcctgcacagacatggaaaagctggctaagacatgcacatgggtccaaggcactgcagaattccatttttcctacagttaatatttatggcacaaaaatgcaatagctacagtttangactgattcattgacacgtgacacttgaaactgtccctctaaatgtggatattatccacatgtnactggactaagcatccatgcaagacttggagaccttctgcaggcgcagcctgtacccccaaaccctgctctatcggatcccacctcgcaaggtgaaggccgcattctctcaggacaacctggtctgctatatcccctgggaaccatttcgccttgg

SEQ ID NO: 196675 - DNA, 741 bp, Homo sapiens
ttcttatttggggctgtttgtatccattgtggatttttatatgagctaagtggagaagggcaggatgccttgtgttaactgattgcggtagcttgaagagacataatgagaactgggcagcattaaggtcagagaagcccctgatagaaaatctagaaatatagaaggaaaatgaaatggcttaaactgatttgtacgccagccaaacgaaatatcctctctggcctagctacttaaagtgtcttcaagccagcaacatcacctggggcttgttagaaatgcagaatctcaggccccacccagaccaattggatcaggaacagcattcgtttccaaagcccaagttaatttgtatgcacattacaaatttaagaagactgccaacttgcttgagcccaagaatcattccaggcacttgataagactttttgattccctggtctttctcctggttgtatagctgtgagatggggcctggaactccatgtctaacaagggtcctcagtgattcatttgattctcaagttgtagccagcataaagtagtctaaggaaatcaaactttagggtcacactggaggtaagtagtgaaattttttcctaaaatgcattttccaatctgtagctctccagatgacattgggagcctcattttttatccaaaaacaggcactagcaacctaaagtcctgtttatggtgtaattctagagtgagctgacttggcttgcatgaaagttttgg

SEQ ID NO: 196676 - DNA, 191 bp, Homo sapiens
agtccctacaacaaatgctgacaaagaaaaataacagctcaaaattaaaaggctacagtccacagggaccacatctctgtcaacctggggatttgaagattctcattaaccacagggatagcaatgaatccatcaacccccatagcctgtcttcttttgagatgacacctcagagtcacagggtaggcacc

SEQ ID NO: 196677 - DNA, 491 bp, Homo sapiens
  misc_feature (1)..(1): n is a, c, g, or t
ntcagtcggtaccgtctgttatcgccaacacctccattaagctgggccccaatgccgcagacctggctgaccacccggagctcgggcctcatgcggtagtgaactggtgctggggaaaagggtcgctggcaagggaacactgagggtgtcttgcctgggtggtcagggaaggcttcatgagagagaagactgcttcagagacacaagggctactgccccgcctcccccggccgcagggctgacacacaggccttctgcatggacacgtggcccacactgtcactggcttctcctgagggttgacagcaggcagaagccaaagttgccaatggatggtacccacctccaggcccaggccacagaaggaatgcaacaagcagcccagagcgggatacatgcttggggtgggggcaagggggagccaaagcagggaaaaggcttcagtgatgggccaaagggccaggcaggcccaaggggttggggagaataca

SEQ ID NO: 196678 - DNA, 129 bp, Homo sapiens
gatgatctgcctgcctcagcgtcccaaagtgctgggataacctcgtgagccactgcacccggccaaaaaaagactgaaagaaaaataggctttgaaagggtaaaacaggaggcaacctaaggtagacca

SEQ ID NO: 196679 - DNA, 312 bp, Homo sapiens
agaaaagtaggtgggagtcagaaaaacatgaaatgagaaagaaaagcataatctgagtgagttctctctctttttttttttgttttctatgtttatctttccacagctttttcactggctctgttaaaaagcaaatatcactgcaaacttcatttcattttctctcaacagatgaaataaagcttgttaaaatgtttttcccttctgtcaggtgcaaactccatgttagcaggtttgaaaactttcacatgttcagatagcaatggaggttttaacttggccaacatcaacaaacaaaccatgagtccctca

SEQ ID NO: 196680 - DNA, 596 bp, Homo sapiens
ggtgagcaggttgtttaggttgttggttgtccaggcaagatacccagggcccttgggctggccatgtgtacatctggacggcagcctgaatggttcccttgtcccttggttgtttggggccctgagaacatgagaacccactgcaccgtccatagaatctgcagacccatagtaagtcaggagggacacagacccctggtaattttccccaacgtggcttgccccccatgcagaataaccacagtaacttgtggccctggttggttctcccaggatattcacttggacagagaattcagggaaatcttacatcccccaaggcctgaggagggccctggaatctgaactttccagaaaccagcagggccgccagggtcaccccagcccctggccactctttctcctcctcttggtccggagccacctgcggccaagcgttctgcctgggtcttggctcttggcgtttctttgcagctccatctctccgagtgctcccatctgatacacgtttcaaaagttcaattccagggtagccaaaagtgtgaagctgccatggagaagggctaaaaaacaaccaggaattccaagcggcctgc

SEQ ID NO: 196681 - DNA, 370 bp, Homo sapiens
ttaggaaaatatggtacgtttaataaaagacaatacaactcctgtttatacagtactttcacatcccagctggttttcacaacaacccgttttgggcatcacatgaatggaacctcagagactttcagttgtagagaaaaatagacacagtcttgaagagcagccataggtgacagacgagtcgtgcagcccctgtcagtcacatatcccacagccatcgccctttcttttttgcttctctaagactgattatgtcagggggcattgtgctcaccaccaagggatgaatcacaattagcacttttccctggtgtaggggtgggtgtaagacccatttctagccaatgtgatttatggagatttctgaaaa

SEQ ID NO: 196682 - DNA, 454 bp, Homo sapiens
tcttcagagccaggggatcaggaaacagcatgggtcatgttgagagacacaagctcacctctgcccacaggacgaaacagcctggcgggcacaggcctcacatccaactcctgggggtccctagcctgccctccctgaccctccatcctcacccagatcctccgctgctccccgggagccctcggcttgcacagctttcacctgggctgggaaagtctctcttctgcacactcgctgccatgtttgccaagcaccagacctttaagtaccatgtaccatttttttttcatatctgcataccacatgtactgttatttgcttgttagttttctttagagtgactctctttatattaattgattttacaagtgaaacgaaatgatgaaaaccagaatcacttgctataaatagacgatgcctgagtaacggaatacaataaaaacaaaatactatc

SEQ ID NO: 196683 - DNA, 209 bp, Homo sapiens
tggcctccgcatgtctcttgcaactcatttgtagacagcccagaaactagcagctggacttcatttttgttccagcagtcaccattttatagtgtttctctaagtcactgtgagtttcactgatgacaagtctaaaactccacaggtattcatatttagtgggttaaatcagagagaaaggattatgcttaactttctataggttcatg

SEQ ID NO: 196684 - DNA, 316 bp, Homo sapiens
tgtattatttttcgctactgctctctcttgggaggagtcaaattaagtgtgaatcctttaagtttagtaacgcagagaagctaaagaataaggacacaaacattcacctccaaaacacaaaaccaggccagtttgctaccaaataacggaaatccctcccctcaccctcgatcccaacccagattaagatagatcccccaaagtgacttttacatcttttcctcaacctggctttacaaaaataaccaggaaacgtgtgcccccaaaatttcagctgtcttttaccagcaaagagctcatctattttcatcactgt

SEQ ID NO: 196685 - DNA, 358 bp, Homo sapiens
tttaaaacttagcgttagccccattacacgttcccttctgagtcacagaggatgatttgcacgataagctgagcttgccttgaaccaggactcacgtggatttgcatgagaaagaactgggcagagattgcaatattaacagctgtttaaataattcaatggagaggctaaggctgaaggaaattatgggctcattgttaaaagtttttaattatcccaacagctgtcccatcacatggccttactttgttaggcagtggaggccatttgagagatcggcctgagttggcgcactggaacttccaacattaaggcattgcattgctaatattcctcaatttaggaggcagtcaagcag

SEQ ID NO: 196686 - DNA, 247 bp, Homo sapiens
cacactactggccagatctccccccacctccaaaccagaaactctatgagagcaggaccatgacctgccactcactaaaggaatgggcaggtggtaggcagcacagaattaaggaggaagcacaggaggaaaagaatccccaaggtccgccagctttgacagggaagggaaagtctagtctcctctcctctccagccacaggtacctggaacctcatcctctagaggaatcttccttggccagtagt

SEQ ID NO: 196687 - DNA, 474 bp, Homo sapiens
cacactactggccagatctccccccacctccaaaccagaaactctatgagagcaggaccatgacctgccactcactaaaggaatgggcaggtggtaggcagcacagaattaaggaggaagcacaggaggaaaagaatccccaaggtccgccagctttgacagggaagggaaagtctagtctcctctcctctccagccacaggtacctggaacctccctagtgtcactaatgggcgtggactggggagtgcaaacccagacgcctcactcactgggcacacacccttgacaccctgaatcccaccaattccgttcccacgcacttaactgggcaaccctctgcaagctagaggtgttctgaggaccagcaagcaaccgagcagccaaaatactggaagcagaacctgtgtctggcgttcatctccaggcccacaacggggcagatgaaacgcgccctgttggagggggccgcgcg

SEQ ID NO: 196688 - DNA, 1248 bp, Homo sapiens
caagcatttgcaatgcactgcacggtcgacatctacgaggatcccctacgccatgctcgcaagtccaccggcggcaaggctccgcgcaagcagctggccaccaaggcggctcggaagagcgctccggccaccggcggtgtcaagaagccccatcgctatcggcctggtacagtggctctccgcgagattcgccgctaccagaagtccaccgagctgctgatcagaaagctgccttttcagcgtctggtgcgtgagatcgcgcaggacttcaagaccgacttgcgcttccagagctccgcggtgatggcgctgcaagaggcatgcgaggcctacctggtggggctctttgaggacaccaacctgtgcgccatccacgccaagcgggtgactatcatgcccaaggacatccagctcgcacgtcgtatccgcggcgagagggcttgagtctcaaggactcactgattacatacccaaaggctcttttcagagccacccacatgcgcgctgaaaagatctgtttctctcaggaattcttcctggtacttgttttgcctgtagtagatagggcccatttccagacgttatacaatctgtttcgtaagactcagcctatccctttttgaatgctaattttgggagtcttaacatctaataatgtccggcatttttccgtaagcattgagtgtagccaaaagttccttcgtgtattgctctcccatctccgcagcccggttttgaccggatggtgcttctaattttctgctaacctgtactgtggtgtgtgtatatttcttgccaacacgccagaaataaaactaaggttgtactgaagttggaaaaattcaggttaatgtagctcatgctggctaaagtgaaacgttctctccccgccccccgttcctaagcagtgttaagttttctttgaattttttcaagccggattttgggcctgcttaaaccacttaaatgtagttaatgacagatggtttgaggtttaaaagtcttctggagaaagcccgccagagaacattccctttgaagccccatgtaaaaatacgtgtgggagagaaagtgttttctctgacttctgctgacagtggctaaaactctgaactgtcaggagtattcaaaataagactgccttgtaggtaagcctgtggtagtttttttgagcacaggataaaatacttgagtctttgcttaaatgttactttctcaatgaggctttgtatgactaaataaaatctg

SEQ ID NO: 196689 - DNA, 1360 bp, Homo sapiens
  misc_feature (3)..(3): n is a, c, g, or t
  misc_feature (7)..(7): n is a, c, g, or t
ggnacancaaaaatttgagtccttcgccaatccggttactgttgggtaggccttcagcatacttttgtccaatcagcttcagactctcactataaataagcggctagctttctctttctcctgaagtgaatctagctctgaaggcatggcgcgtacgaagcagactgctcgcaagtccaccggcggcaaggctccgcgcaagcagctggccaccaaggcggctcggaagagcgctccggccaccggcggtgtcaagaagccccatcgctatcggcctggtacagtggctctccgcgagattcgccgctaccagaagtccaccgagctgctgatcagaaagctgccttttcagcgtctggtgcgtgagatcgcgcaggacttcaagaccgacttgcgcttccagagctccgcggtgatggcgctgcaagaggcatgcgaggcctacctggtggggctctttgaggacaccaacctgtgcgccatccacgccaagcgggtgactatcatgcccaaggacatccagctcgcacgtcgtatccgcggcgagagggcttgagtctcaaggactcactgattacatacccaaaggctcttttcagagccacccacatgcgcgctgaaaagatctgtttctctcaggaattcttcctggtacttgttttgcctgtagtagatagggcccatttccagacgttatacaatctgtttcgtaagactcagcctatccctttttgaatgctaattttgggagtcttaacatctaataatgtccggcatttttccgtaagcattgagtgtagccaaaagttccttcgtgtattgctctcccatctccgcagcccggttttgaccggatggtgcttctaattttctgctaacctgtactgtggtgtgtgtatatttcttgccaacacgccagaaataaaactaaggttgtactgaagttggaaaaattcaggttaatgtagctcatgctggctaaagtgaaacgttctctccccgccccccgttcctaagcagtgttaagttttctttgaattttttcaagccggattttgggcctgcttaaaccacttaaatgtagttaatgacagatggtttgaggtttaaaagtcttctggagaaagcccgccagagaacattccctttgaagccccatgtaaaaatacgtgtgggagagaaagtgttttctctgacttctgctgacagtggctaaaactctgaactgtcaggagtattcaaaataagactgccttgtaggtaagcctgtggtagtttttttgagcacaggataaaatacttgagtctttgcttaaatgttactttctcaatgaggctttgtatgactaaataaaatctg

SEQ ID NO: 196690 - DNA, 1456 bp, Homo sapiens
  misc_feature (3)..(3): n is a, c, g, or t
  misc_feature (7)..(7): n is a, c, g, or t
ggnacancaaaaatttgagtccttcgccaatccggttactgttgggtaggccttcagcatacttttgtccaatcagcttcagactctcactataaataagcggctagctttctctttctcctgaagtgaatctagctctgaaggcatggcgcgtacgaagcagactgctcgcaagtccaccggcggcaaggctccgcgcaagcagctggccaccaaggcggctcggaagagcgctccggccaccggcggtgtcaagaagccccatcgctatcggcctggtacagtggctctccgcgagattcgccgctaccagaagtccaccgagctgctgatcagaaagctgccttttcagcgtctggtgcgtgagatcgcgcaggacttcaagaccgacttgcgcttccagagctccgcggtgatggcgctgcaagaggcatgcgaggcctacctggtggggctctttgaggacaccaacctgtgcgccatccacgccaagcgggtgactatcatgcccaaggacatccagctcgcacgtcgtatccgcggcgagagggcttgagtctcaaggactcactgattacatacccaaaggctcttttcagagccacccacatgcgcgctgaaaagatctgtttctctcaggaattcttcctggtacttgttttgcctgtagtagatagggcccatttccagacgttatacaatctgtttcgtaagactcagcctatccctttttgaatgctaattttgggagtcttaacatctaataatgtccggcatttttccgtaagcattgagtgtagccaaaagttccttcgtgtattgctctcccatctccgcagcccggttttgaccggatggtgcttctaattttctgctaacctgtactgtggtgtgtgtatatttcttgccaacacgccagaaataaaactaaggttgtactgaagttggaaaaattcaggttaatgtagctcatgctggctaaagtgaaacgttctctccccgccccccgttcctaagcagtgttaagttttctttgaattttttcaagccggattttgggcctgcttaaaccacttaaatgtagttaatgacagatggtttgaggtttaaaagtcttctggagaaagcccgccagagaacattccctttgaagccccatgtaaaaatacgtgtgggagagaaagtgttttctctgacttctgctgacagtggctaaaactctgaactgtcaggagtattcaaaataagactgccttgtaggtaagcctgtggtagtttttttgagcacaggataaaatacttgagtctttgcttaaatgttactttctcaatgaggctttgtatgactaaataaaatctgtataatccccacctatttttttcaccctagaatttgtcactatatgctgtaccagagtttgctgatgtattgcttgtgtgttctaaaatacaggct

SEQ ID NO: 196691 - DNA, 110 bp, Homo sapiens
agcattcaccggcagcaaaagagagctgaataggaacattaacataagactttattgaaagccagtgtgtaacaaagaaaattacaatgtggagagtaatttgcatctaa

SEQ ID NO: 196692 - DNA, 649 bp, Homo sapiens
ccatggggaagacttaggcctggaaagacctaagagaaagaggagaaactggtggatagaaatcagagaacagaggaccagatctaaccaacaggaagcaagtcccagatgtgagtgttatgtgtaccaaagcttctgctgtttactgtgtgatatgctcacacacagaggagatgtcatccggagacagtgatgctgatctgtttcatggtatcttacatggagcttatacctggcactgttggctaactgctcccagccctattcctggaagagttggtgtgaactccatgaacatgacatgtcaggggtggctgatcataaaggtgggaggggatgtcccagtgcccggaggcatatatacccactgatccttactccactcagacaggaaaccagtgaacattgacagggttgttcttgtgtccagttgcatgtgctatatttgtctgtacaacactctgctttctctcttttaatccgttgccaataaaacaggaaacagcaagaacatttgagattaaactgcccctagcattggtgatgacagagtggatcctgcatgtgcttccccaccagacacaaagccccaaataaaaagtacatcccttctcctcctcgctttgagacgggggcaggcgtggggaat

SEQ ID NO: 196693 - DNA, 923 bp, Homo sapiens
ggattacaggcacgtgccaccacgcctggctaagttttgtatttttagtagagattgggtttcactatgttgaccaggctggtctcgaactcctgacctcaagtgatccacccacctcagcctcccaaagtgctgtgattagaggcatgagccaccacacctgggctaatttttgtatttttagagactaggtttcactatgttgtctaggctggtcttgaactcctgagctcaagccatccgcctgcctcagcctcccaaagttctgggattacaggcgtgacccattgcgccctgcccaatcccatacttttgaaggtgtcgttccagcatggctcctcaggcacaggcccaccacagacagcagggcctatggaggcctgagcagagtttcctcatacttccctttttgctgcctcactctgggtccaccacagggtggcctttttcaggcttctcttcctggttcagttcatcgaccaaagacatggctccatttgctaactgagacccaaccaaaataaacattcatggagtggttgggccttttgttgtgaccccttaggtagaggaagggagagatatgcccaggttctgtttggtgtttctacctgtcaatagagataccacgttaatcattaacagccatgcctcccagttagtaagcaagacaactaactggaactagactttttacacaagttagagatgatcttcatcggatgcgtcaacaatgcctgaagcccagtgtcttagaaacaacacttgcccagggtcaggcgtggtggctcatgcctgtaatcccagctacttgggagattaaggcagagaatcacttgaacccgggagatggaagttgcagtgagccgagatcgcgccactgcactccagcctgggtgacagagcgagactccatctcaaaa

SEQ ID NO: 196694 - DNA, 596 bp, Homo sapiens
tgcccacgtcagcctcccaaagtgctgggattacaggcgtgagccactgtgcccagcctctttttttttttttttttaaaacatagttcaagtgattgattaccttgaaaagtaaatgcaattagggccatgtatacagttttattccatgcatacagcttgtaaaataggatttcttaggttactatagaattaaattattctgtaatttgttgcaggatagcgttgtgataagtctgtgagcccacaagagttacctagagacttttcagataaggtagacacatcagtaatacagtaggatttacctcaggagaatctgctaatccttattttcttttattattgagccacctacaggcttgcccatcagtggactcagtcactagtattggattgctgataaagagggattgaaatatggtggtctttgactcaccttagattttgcagtatactttaaaaaacttaatttggctagaatgtataatagccctaatgctatgtgagccgagaatgactaaacaaacaaaatttaggtgattgatttactgtcatacgttttgctaagtgaactttttctttgtgaggagggg

SEQ ID NO: 196695 - DNA, 476 bp, Homo sapiens
tggaagtaccatgttgttgctattttcatcctgagcaattataagttggtaaagcaagagttatgtgccttgaaactaatgccacctcagtctagctgctcactcagagcaagtgcagaggaaggcaagggaaccaatattctccatacacttgctatgttttacgcactgagtgaagatttttctcatttaattgcatgtaatttcattctaaagagcagacaaacaatttcattcgattagatatacttcctcaataaaggcttttgaatgaaagcaaatttcattttgctgatcaggctacactacgtgagtgtgtccttatagaaataaattaacctggaattaacattacgtatttttgttgttgttttcaaagacagagtctcatcctgtcacccagatttaacctttctcagccacatctgcaaaatggggatggtaaaaataggtaatgataggagctatttcacact

SEQ ID NO: 196696 - DNA, 166 bp, Homo sapiens
agagaggggtagacgaatttgagatgtattttggaagtagaacagataaaatcttgtgaattgcatatcggcataagaaaaagtgaggagccaatgatgattccaggtttcaggcttcagtaactggataaatggtggcaccatttattagtatgggaagatcagc

SEQ ID NO: 196697 - DNA, 543 bp, Homo sapiens
ataaaagttattcttatgccttatccgtggcttgtgaaatggttttatactgccctttatctataattattcctcttctctatcttcactattgttctcatagatcaatgggtcttaaatctgtctgcacattagaatcagctggggagcttttaacaattaccagtgcccagatctctccccagaacaaacgagaatctctaggggtgaggccaggcatcagtatttttaaaagcttcccgggggactctgatgtacctccaagggcgagagccactgtcaaagctgctcaaggagtgctatcccagcagagacgtcaccagagctataggtgctgaccaccagccagttaatggaactcccacctggggtggagctccacacagttacaaagatgatagaaaaatctctttagggagctgacaatcttatgtggaaaatataattattagagtaaatacagtaaactcaagtgacaggcatgctgacacagatgttagtttatttactgagtgataaataatttggggaaaatgaccttag

SEQ ID NO: 196698 - DNA, 303 bp, Homo sapiens
ccatacacactgtaggataataaaggtgtgtgctgtttaaagctgctaagttttgtggtaatttgttctgcagcaatagataacaattacacctacacagaagaaataaaaagaaacatgaccaatgaaaactcatttgtgtaaaaaaaaaaattcatatatatttctctcaccactcagaattttaaaagattcctcttcccttaactcaatataataaagctaactctttattattaagactataagaattttagaaacaggctggttgtggagactcggcgtgtgcagggtaccgagctc

SEQ ID NO: 196699 - DNA, 500 bp, Homo sapiens
gaatggagacaagcaagacacaatctaaatagtattttatccaatctgttgtgtataactggtcagagctccgtagaatgaaaggagatttcaagtagcacctcaaagctctgaagcacaaccaaaacacagcatcatttcagaccgaagcagtaaccaaacattcctactttgatatggttcaaggatgctatcatcaatattgaatcatctgctcacttatccaggaagaaggggggcttagttactactgtactatgattgtgctcaatcaacacgttacaaaaatcaagctgccataataataataataaaggctcctatacacaggaccaattatcttcagttcttcacctccaagcatccagtgtttacttccacatgtgctcaatgtttagctaagacatataagtgaaatatgtggtatttggttttctgttcctccattagttcatgttgccacaagggaagtgatttcattctattttatggctgcatag

SEQ ID NO: 196700 - DNA, 220 bp, Homo sapiens
taccctatatttgctttttaaagtatattaaagagccaccatatctagggttagctaggaaaaagcaatggcaccatcctgggagtccacccctctgaaagatttttgattagtctccatgttgcaaagtcctccagttattcatgtacattttatccttttagtagaagataagggtcttggcttttcacccacaagttgtacagaagagtgtaaagaa

SEQ ID NO: 196701 - DNA, 832 bp, Homo sapiens
atccttaattaaattaatccccccccccccctttcctgagtgctgagcgcgaacccgaggagatgaaccctttaactaaggtgaagctgatcaacgagctgaatgaacgagaggtccagcttggggtggccgataaggtgtcctggcactccgagtacaaggacagcgcctggatcttcctgggagggcttccttatgaactgactgaaggggacatcatctgtgtgttctcacagtaagtgtcctttcatttcctgcctcctgagtcgacagagtactttgtttctgtaatacattttgtggcatcacaaaaaccacttattttcactctaggctgaatggcatccctgcatggggagggctggagcttctgttctagatcagtcccaggacatggttctagaatgttctgtgggagatccaagaggtttgttaatttgggagggcatcttggggatcctagtctatttctgttgtttttcactgaggcttgttcagcctgggcctagactggaacagactggactccttgggctcttgcaaactaggggtaacccatggtcacagggcccttctggcccttacctgtgtggcgtcatacgattggggcaaagcacagaggaaattggggtaaaaaacagaaggtcgtagtttgctttctttgtttctcgatgagtgtaaggttagtgagcaaaggcaatctctgcctggaggctgagaatcacagcccgaagggaacaagaatgaataggagacctgtatattcttcattctgctgaggtgttagcagcagcatttcatgggagagggtgttggcagctcatactggtag

SEQ ID NO: 196702 - DNA, 1528 bp, Homo sapiens
gcgcatgcgctgcgctgcctttcccgggcgctgattcctgagtgctgagcgcgaacccgaggagatgaaccctttaactaaggtgaagctgatcaacgagctgaatgaacgagaggtccagcttggggtggccgataaggtgtcctggcactccgagtacaaggacagcgcctggatcttcctgggagggcttccttatgaactgactgaaggggacatcatctgtgtgttctcacaatatggggagattgttaacattaatctcgtgcgggacaagaaaactgggaaatccaaaggattctgtttcctctgctatgaagaccagaggagcacaattctggccgtcgacaattttaatgggatcaagatcaaaggaagaactatccgagtggatcatgtgtctaactatcgggctcctaaggactcagaagaaatagatgatgtgaccagacaactccaggagaagggctgtggggctcgtaccccctcaccaagtttgtctgagagctctgaagatgaaaaaccaacaaaaaagcacaaaaaagacaaaaaggaaaaaaagaaaaaaaagaaagaaaaagagaaagccgaccgggaggtacaggcagagcaaccatcctcttcgtcacccagacgcaagacagtaaaggaaaaggatgacactggccctaagaagcacagcagcaagaactcagagagagctcagaagtcagagcccagggaggggcagaagctccccaaatccaggacggcctactctggtggagcagaggacctagagagggagctgaagaaggagaaacccaagcacgagcacaagtcctcaagcaggagggaggcaagagaagaaaagaccaggattagggacagagggcggagctcagatgcacattctagctggtataatgggcgttctgaagggcgtagttatagaagtagaagtaggagccgagataaatcccataggcataaaagggcccgacgctcccgggagcgggagtcttcgaatcccagtgaccgttggcgtcactgaagacttcagctgcacagtagatttggaaataattatgttttttaaatgcagtcaaattcagttgggtggttactatttttgtatctaaaacttctggggctggattcttttaatcccttgactatttagagtcattgggagggctgcagtttcaacagctagatatcctggatattgtttgcaccatccattgtccctgtaccagagtatgtatcctgaactttggttcataaatatggctcttgaacccatagaccccagttgaagatggaattttcaggaaagggaaaatactagataattctagaattctagtcttcgtgttagatgtttatagcccagcatcttgggacctttccagttactaggtttggacagcttgatgtgaacgaatgggataggatttttaaaatcagccagctccatgcccaaaccttcctgtttgcagaactttttaatgtcttttctttttcattaaaacttttttgttcgata

SEQ ID NO: 196703 - DNA, 1745 bp, Homo sapiens
gcgcatgcgctgcgctgcctttcccgggcgctgattcctgagtgctgagcgcgaacccgaggagatgaagtaaggcgtcagcttccttttgaggaaggagcagcgggccactgggggtggtccaccgggactggtgtggtagagcgtctgcggggccgaggggcgggagcggcgcggggactggaacagctcgtcccctagttttgctcttcctcagctccggccggttcgcacttacttgtctgcttttctgcctaccctccccaccccccccgccaccgtgaagccctttaactaaggtgaagctgatcaacgagctgaatgaacgagaggtccagcttggggtggccgataaggtgtcctggcactccgagtacaaggacagcgcctggatcttcctgggagggcttccttatgaactgactgaaggggacatcatctgtgtgttctcacaatatggggagattgttaacattaatctcgtgcgggacaagaaaactgggaaatccaaaggattctgtttcctctgctatgaagaccagaggagcacaattctggccgtcgacaattttaatgggatcaagatcaaaggaagaactatccgagtggatcatgtgtctaactatcgggctcctaaggactcagaagaaatagatgatgtgaccagacaactccaggagaagggctgtggggctcgtaccccctcaccaagtttgtctgagagctctgaagatgaaaaaccaacaaaaaagcacaaaaaagacaaaaaggaaaaaaagaaaaaaaagaaagaaaaagagaaagccgaccgggaggtacaggcagagcaaccatcctcttcgtcacccagacgcaagacagtaaaggaaaaggatgacactggccctaagaagcacagcagcaagaactcagagagagctcagaagtcagagcccagggaggggcagaagctccccaaatccaggacggcctactctggtggagcagaggacctagagagggagctgaagaaggagaaacccaagcacgagcacaagtcctcaagcaggagggaggcaagagaagaaaagaccaggattagggacagagggcggagctcagatgcacattctagctggtataatgggcgttctgaagggcgtagttatagaagtagaagtaggagccgagataaatcccataggcataaaagggcccgacgctcccgggagcgggagtcttcgaatcccagtgaccgttggcgtcactgaagacttcagctgcacagtagatttggaaataattatgttttttaaatgcagtcaaattcagttgggtggttactatttttgtatctaaaacttctggggctggattcttttaatcccttgactatttagagtcattgggagggctgcagtttcaacagctagatatcctggatattgtttgcaccatccattgtccctgtaccagagtatgtatcctgaactttggttcataaatatggctcttgaacccatagaccccagttgaagatggaattttcaggaaagggaaaatactagataattctagaattctagtcttcgtgttagatgtttatagcccagcatcttgggacctttccagttactaggtttggacagcttgatgtgaacgaatgggataggatttttaaaatcagccagctccatgcccaaaccttcctgtttgcagaactttttaatgtcttttctttttcattaaaacttttttgttcgata

SEQ ID NO: 196704 - DNA, 1312 bp, Homo sapiens
acaccagttggacaggtctgctttagtgacagaatttaacaagaaggtaaaggatgtagttcaaatcatggttctctgtagcttgtgttcaaatagtttgacagtttggtatgagggctgtcttcactgaagcatcgcctgtcttgcttagatcaaaggaagaactatccgagtggatcatgtgtctaactatcgggctcctaaggactcagaagaaatagatgatgtgaccagacaactccaggagaagggctgtggggctcgtaccccctcaccaagtttgtctgagagctctgaagatgaaaaaccaacaaaaaagcacaaaaaagacaaaaaggaaaaaaagaaaaaaaagaaagaaaaagagaaagccgaccgggaggtacaggcagagcaaccatcctcttcgtcacccagacgcaagacagtaaaggaaaaggatgacactggccctaagaagcacagcagcaagaactcagagagagctcagaagtcagagcccagggaggggcagaagctccccaaatccaggacggcctactctggtggagcagaggacctagagagggagctgaagaaggagaaacccaagcacgagcacaagtcctcaagcaggagggaggcaagagaagaaaagaccaggattagggacagagggcggagctcagatgcacattctagctggtataatgggcgttctgaagggcgtagttatagaagtagaagtaggagccgagataaatcccataggcataaaagggcccgacgctcccgggagcgggagtcttcgaatcccagtgaccgttggcgtcactgaagacttcagctgcacagtagatttggaaataattatgttttttaaatgcagtcaaattcagttgggtggttactatttttgtatctaaaacttctggggctggattcttttaatcccttgactatttagagtcattgggagggctgcagtttcaacagctagatatcctggatattgtttgcaccatccattgtccctgtaccagagtatgtatcctgaactttggttcataaatatggctcttgaacccatagaccccagttgaagatggaattttcaggaaagggaaaatactagataattctagaattctagtcttcgtgttagatgtttatagcccagcatcttgggacctttccagttactaggtttggacagcttgatgtgaacgaatgggataggatttttaaaatcagccagctccatgcccaaaccttcctgtttgcagaactttttaatgtcttttctttttcattaaaacttttttgttcgata

SEQ ID NO: 196705 - DNA, 1843 bp, Homo sapiens
gcgcatgcgctgcgctgcctttcccgggcgctgattcctgagtgctgagcgcgaacccgaggagatgaaccctttaactaaggtgaagctgatcaacgagctgaatgaacgagaggtccagcttggggtggccgataaggtgtcctggcactccgagtacaaggacagcgcctggatcttcctgggagggcttccttatgaactgactgaaggggacatcatctgtgtgttctcacaatatggggagattgttaacattaatctcgtgcgggacaagaaaactgggaaatccaaaggattctgtttcctctgctatgaagaccagaggagcacaattctggccgtcgacaattttaatgggatcaagatcaaaggaagaactatccgagtggatcatgtgtctaactatcgggctcctaaggactcagaagaaatagatgatgtgaccagacaactccaggagaagggctgtggggctcgtaccccctcaccaagtttgtctgagagctctgaagatgaaaaaccaacaaaaaagcacaaaaaagacaaaaaggaaaaaaagaaaaaaaagaaagaaaaagagaaagccgaccgggaggtacaggcagagcaaccatcctcttcgtcacccagacgcaagacagtaaaggaaaaggatgacactggccctaagaagcacagcagcaagaactcagagagagctcagaagtcagagcccagggaggggcagaagctccccaaatccaggacggcctactctggtggagcagaggacctagagagggagctgaagaaggagaaacccaagcacgagcacaagtcctcaagcaggagggaggcaagagaagaaaagaccaggattagggacagagggcggagctcagatgcacattctagctggtataatgggcgttctgaagggcgtagttatagaagtagaagtaggagccgagataaatcccataggcataaaagggcccgacgctcccgggagcgggagtcttcgaatcccagtgaccgttggcgtcactgaagacttcagctgcacagtagatttggaaataattatgttttttaaatgcagtcaaattcagttgggtggttactatttttgtatctaaaacttctggggctggattcttttaatcccttgactatttagagtcattgggagggctgcagtttcaacagctagatatcctggatattgtttgcaccatccattgtccctgtaccagagtatgtatcctgaactttggttcataaatatggctcttgaacccatagaccccagttgaagatggaattttcaggaaagggaaaatactagataattctagaattctagtcttcgtgttagatgtttatagcccagcatcttgggacctttccagttactaggtttggacagcttgatgtgaacgaatgggataggatttttaaaatcagccagctccatgcccaaaccttcctgtttgcagaactttttaatgtcttttctttttcattaaaacttttttgttcgatatgcctctttccacattttttccttgcaatgtatttattatttatttgtatttaggtgaaattcacataacataaagttaaccattttaaagggaacaattcagtggcatttggtactgaacatccacagtgttgtgtaaccattgcctctgtctagttccaaaacatttttttatcatcccaaaatgaaaccctgtagccattaaacaagagctccccgtttcctccctcctccctgtccctagcaaccaccagtggacttcctgtttatgggtttgcctattctggatctttcataaaaatggaattacacaat

SEQ ID NO: 196706 - DNA, 497 bp, Homo sapiens
agcaggacaattgttcagaggcacatggagtttcacacctccagtataatgagacgcactggatccaccgatgtaaatttagagtttttcaatatgtgcaattatgccaccatccaaaatgccaaaatgctgccacattcacactcgtcatcagatctttaatggctgcccaaaaaagttatgagaaagaggagagtggctgatgggggaattggagactggagggagcaagttttacctttttggtttgaccatttaaattgaagtcatgcatacagggaaagttatgcatatagaaaaatgtacacttcatactgcgtgcattcaattaatttgcgccaaatgaatgcacccgtgtcccctgcacccagatggaaaatgccaccagcacccttaatagcccccacctggacccctgaattggagtgaattttgaaagaagagggaaagaaagtgacatgtcccaattagaacatatgggacaggcactttctata

SEQ ID NO: 196707 - DNA, 544 bp, Homo sapiens
gaattttcaaaaagactcactcccacaccatctaggcgggcctgactcatcgtgggtatccttttggatcctcagggatttcatggtttattcctggggctccacttgatgtttcttcaggctggctcgccactgtccgctcctaggattgtgggaatatcccatagagccctcagagtagacaggtgagagttcaatgctgacacacatccacagaggactccttctccgccaagatgaagggacttgtcaccagacaatggtggcttcactgtgacgtgagccgctgttcaccactggtgcctggtgacctggctgtcacatgcgcattcaccaagcaggctcaggcacctggctgtcagggctgtaagcctggcaaagctcaggaaaatggtacagccagagctggcctagtctccagaaaaaggctgcctgcagcaacccactgcagcatgctaatagtctcgaacatagagccttcatgagccatctccgtggtagggtctcacaggagaaggaggagtttcaagactgtgaggtgggc

SEQ ID NO: 196708 - DNA, 243 bp, Homo sapiens
actcctcccaagggttccacttaaaggcttccgtgattaaaaggcacagggttcaaaggtccatcccctctccaaagtggaaaacagaagtgtgctaaggctcttcttttccttgtgaatgtccccatagcccatagtggcagagagggacagaggtcactcatctcctgatctagggatcagagacatgtagacctttttttttttttttttttctcctgaggtgatcttcggaggtgatct

SEQ ID NO: 196709 - DNA, 408 bp, Homo sapiens
gcatcattcactgacagttcccttccatatcccctggtccctactgtttccagtgtggatcagctaatttgcaaccaccactatctgcatctgtgcctacctcagggttcgctccaaaatgcagaagactgctctgcctgtggcaggacagaagtgacattccctggagcagccctcaactcatggctgccaggagttagtgtataaattgccccaaagctctctataaagtggttttatttttgatgtctcatttgacctatacaacaattctggaaggaagaaagttatattaaacaaggccaacagtggagtgtaatccctgtattcttttttgttctctcatctatcccaagaatactgctcagaaaattatagatgctcaataaataattgatgaataaagga

SEQ ID NO: 196710 - DNA, 235 bp, Homo sapiens
gagcagaggccaggccagcttcactgagatcccagaggttctgactggggccgcccagagttgggcatccctggcttctagcatttgagatctcacccgggactggttggtgcaagtaggggatgaagctagggtggtagctggtcttgttccaggttgcaaggacagaatgatgttcctggcacataaactgctctcggcgaagatttgtttcatgaactgaatgaatggtgtg

SEQ ID NO: 196711 - DNA, 430 bp, Homo sapiens
caggaattaaaaaaaaaaaaacatttctgtgcattcactcaccaggtgtcgaaggctcaaactttcatcttaacaataatgattataattaaagcaacaatagatactggccaagaagaccttaatgttcccctcagctggactacattgtagacatttttcctgactgtagactctgacttaagagcatttatttactttagaaaacttgtcattgtaaattctttctttgttcctttgagacgtaaatcttttttaaggccttctgctagtttctaatacaagaatgtcttcctcaaggacctgggagctatctttttcagacacaatctcaggaagatagctcctatttcctagcccctgtgagagggtaagcctaatgtgggtgagtggtgccacataatatacaaagatgatctaaccatgcaga

SEQ ID NO: 196712 - DNA, 331 bp, Homo sapiens
tgttgcccaggctggagtgcagtggcacgatcttggctcactcaacctctgccttcctgggttcaagtgattcccccgcctcagcctccccagtagcggggactacaggcatgcaccaccatgcccagctaattccttctgtaattcttgagcaagtgtttgctctggaaacaagcctacaatttattgggtaagtaaaggaatccatcaatggttttctacataccagagagtaatagcttaatatacaccaacacaaagattgcaggtcattcagagctgaaagaatgttagttgtccagggagcatagaaaatgactgcaaagcttta

SEQ ID NO: 196713 - DNA, 237 bp, Homo sapiens
agtgctgggattataggcatgagccaccatgctcagcctccttcagttctcagtttaaacattacatcctctgagaagctccagtcgaggtcaggtctcctgttgtgtgttctcagagtgccctgcacagttccttggtagcacttatcacagcgctaaattgatgaggaactctatgggaaatgatctgtctcatgtctgtctcccctgctggatgaagctttgtgagaataggga

SEQ ID NO: 196714 - DNA, 678 bp, Homo sapiens
catcatggccatcaccaccaccctcctcctcctcttcatccttctccttctcatcatcaccatagttgcccgtgcacaactctagtatcaaacacaacttctttagtgttgcactggcaataatgtagtcaagttagtaacacagaaacaacttttgtggtgctaaacagaaaaggtcttctttgcaccaaataaaaaataaacagtaaaagcatccagatgggccaggggtttgttcatgtacttacagaacatctaggttctcatcgatattttctgttctggctcattgccttcctggtcagacttgggtttgggaaatgtctctattcagcttcatctcttgaggccatcgggaggcataagacttgggagagaaaatgccattggtccagggggtgtctccagatgatcttcccggaaagccatgaccaattctgaatgtctctctaggagtaaatacatgaattaacacagctgcataaatatttcacttatcgtatgcagcttcagcaggattaattatgctctaaaattagacgtgtaaagagcacagtgctgagcagtacctaattattcatcctctagaatggagtgtttatctcttgttacacagtagcttcagtggacgattatgagtctaatgagtgtcaaaagtataaaaaattttcctaatga

SEQ ID NO: 196715 - DNA, 645 bp, Homo sapiens
gcattccggctgctgttatgagattaattccttcagaggtttactaattaatggatgttgaattatcccaaatgcttccctgttacctaatgagaagcatcctttggtctacaggtggatgagttgcaactaagtcaggagtaattttttttttaacctggaagtctattcagtggataagattaaactagattttctttatttaggttggtaagtagaaccagccgatgatgcttctttgaaaagtgttcatttgggagtaaaacggtttactcagacacaggttggtggctctggtcactttgaagagtacagccagtagatttttggataaatggccaaatactacacaccttaggatttgtgggccataaggtctctgttgcaactcttcaaacctgtgtacctaaggcaaaaacagtcacaggcaataagtaaatgaatgtatatggctgtgtttcaagaaaactttaatgagaaaaacaagttaagggtcagatatgttccagggtcaacagtttccagattcttgatctagattgtccttgatggtttggaaaaagtatatagataatcaattactgatttatttatttatttatttatttatttatttattttgtgtgtgagagagagagagcaaag

SEQ ID NO: 196716 - DNA, 935 bp, Homo sapiens
  misc_feature (607)..(607): n is a, c, g, or t
  misc_feature (611)..(612): n is a, c, g, or t
  misc_feature (628)..(628): n is a, c, g, or t
  misc_feature (672)..(673): n is a, c, g, or t
  misc_feature (714)..(714): n is a, c, g, or t
  misc_feature (771)..(771): n is a, c, g, or t
  misc_feature (794)..(794): n is a, c, g, or t
  misc_feature (806)..(806): n is a, c, g, or t
gccttccctcagcttgaaacacctgctgcttcgcggcggtggctttgtgccacttttcccagggcttgggcatcattctggacccatgttcggtgaaccggttactctcagagctgctttcgggcgcagctcctgctgcagccaggcccgttttaagagaggcttccaggtccagccctcccgctgcagcctgcagggagcgagccggcctgtcccgatgacatagacactaggtttttacagcaattctctgatgaccttgatatggtagaacgctgtgtatttcaagagtaagctctcgtttgaggagactaacaattcctgttttcgccagatttcttcttgaatggcaacctaaatgccagtccaaagaggcccccaatagactgttcacccttcatgtcctcaactctggggaagttaagtaatcaagttgaagaaacacttccactacttaaaaaggtacctgcaaattactttcacatttgttcagctatcctaatgggattttcacttagtaaatctgctactcaggtatctgctatacatatggattcaaaagtggatgatcacttaatacgagggactgaaaaaagcaggttggaancagnnatcagttatttaaaanaccaagaaaataagattagaagacacaaatcaagaaactttaannggattgaagggactggcacaggatctctttctgggaaagcntggttcagtggtatatgtcaagaagtgatggactagaaatgacagatgtggatgagnattgtcgtatacaagaaacaaangcttgatagggngtgttgaaagagaacttaagcttttaggaacctgaaaatgagggagacatggctattggcatggggatccacttaccggttgttggtaataacaggagttaggggaaagtcaataaggattctggatac

SEQ ID NO: 196717 - DNA, 888 bp, Homo sapiens
ttatgggcatgagccaccgcacctggccttccctgcattttagagagaagtgggtgaagtgtattgaaaaggctgttttgaagtcagtggcttccaaatcaaacaatgatgctttctccttgtcttgatccattttaaactgctataacagaataccgcaaaaatggctaattcataaagaaaggaaatgtaattctggaggctatgaagtcccatatgaaggtgccagcatctggtgagggttttctctgtgttatcccatagcagaaagcaagagcgtgagagaaaggaatggggaagggggcagaacttgttatttaataagaaaatcactcccatgacaactaacccattcctggcataatggcattaatccattcatgagacagagccctcataacctaatcacatcttaaaggtcccatctctcaacaccgctgcattaaggactaagtttccaacacatgaactttgggtgacccattcaaaccccggcactcctcaatacctttcccactggatgcatctgcaaggattttcatcacctcaggctgtggcaccagacggtggagcctcagattctcaatcgggacaatacagacaaccatcatgccacagtggggcaagtatggcattgtggcagaaagaaagaaggaaagggagaaagggtgggggagggagagaaggaggcaggaaggacggaccaggcaggaaggaaggaaagagggaaggaaggaggaaggaaggaaaaagagaaggagatattttaaactacagtctatagtcctaattcattctcagtacatagaaatgttcctttctttggggccactgctggtagccatctacatcctgattgcgttctccagagaaacagaaccagtaggg

SEQ ID NO: 196718 - DNA, 161 bp, Homo sapiens
aggttttagtatttaaatgtaaaataacttttgaagtctttaagatcatcaccttgactgaacgagagctaataggttttattcattcctgcaaaaggaatagaatagaacttgtcatactgggtcagtaccagttatgggtcaactaagcaagtagacgt

SEQ ID NO: 196719 - DNA, 233 bp, Homo sapiens
ttttgcagtgtttctaaaatgtttgaggaagaatgctgattgtcctagatcagtcatctgtgatcagaggatagagcttaggttctacaaaccatgttggcaggaacaggatcagttaacatcaaagggatgctgagtgtgtagtcgccgaatagtcagtccacttgccttctccctagccatctatttgttaacaagttaataatttgttaattaataaatgtttttttccc

SEQ ID NO: 196720 - DNA, 495 bp, Homo sapiens
gaatagtcataaaaacaccacatatttgaggcagggagcaaatcaaagggcgtaaaagaaaaaacgtcaatacatgttaaattagtgttacccattgcacagtatttcattgcactggcctagtccacaagctcagaaactcagggtcatgtttagaaactataagctcagaaccagatgacactctggaatgctaccctctggctttacagaagaggaaattgagacccaagaaggcgaatggcttccctgtagttcatgagattccacagtgctgagagacattagtactctttctggtcaaagtaattaatttatgtatggctggtaccttgggacaagggcaatgacattaaatgattctgaaaacacaaaagcaaaaaaccagcttggcatatataaaatacctccaaattaaaacttaacaaatataatatcagtgtgcaaaatgaatggaaagcaagataatattacagtgcttcatgataagaaaag

SEQ ID NO: 196721 - DNA, 337 bp, Homo sapiens
catgcagccctagggtgcagctgctccaggaaggaggcaggacctcctgcggtccctcagctcagtaaatggcatgcatgcccctttcccagcatgctcctttcccaaagcttttcctcctttggttcctgggtgagattttctctttggtttgttggggaaactaaacctaaaagtagttgacaggctgggcgcagtggctcatggctgtaattacagcacttcgggaggctgaggcgggaggatcccttgaccccgggagttccaggatgcagtgagctatgactgccactgcactgcagcctgcctgggtgacagagaccctgtctcttaaatt

SEQ ID NO: 196722 - DNA, 755 bp, Homo sapiens
ataacagcctttctaacaggtgtgaggtgatatctcattgtggttctaatttgcattcacccgattagtgatattgagcattttttcatatacctgtaggccatttctgtatcttctatggaaaaatgtctatctatgtcctttgcccattaaaaaaaaaatttttttttttttttaactattgaggtctgacatgttttggatattaaccccttatcagacatatagtttgcaaatatattctcccattgcataggttgtctcttcactcagtttatgtttttaaatcttttaatttataggtttccactgcatctttttcatccctgggaatttatgtgttgaaaccagaagtagacttttaaatctaatattgtgccttacttgtacaaataggctctagcaataaataggctactaaaggcagtcacattttgtatgaggtcttctgtttcttcttcctggaccatatatcaaattcagaaactggaaaaaggccaagtttgaatttcaactcactacatttcattttaaggcttgaataagtaaataatgctaatggaacttggtgtaccactttgatgaaaatccaaaccaggcttattgtgtatcctttaggctgcatgggatgttacaatgtttatgtttggagactacaatttatactctacctgcttttaaaaatgttttgaaaatgatcacaacataaatatatataataaagacagaatctttttaaatcatgaaaggaagag

SEQ ID NO: 196723 - DNA, 110 bp, Homo sapiens
agtcagtctcaaaaaagaaagcaaaacaaaacaaaacaaaacagaacaaaaaaactctgtgttatcagagagggatatagtcttatttttttaaatggatcaccaatatt

SEQ ID NO: 196724 - DNA, 513 bp, Homo sapiens
gacaatggaagcaaaagatggggacatctttgcaaggaactcagtgatcaggtcttctgtaaaaaatacccaccagatgggtaagaagtagccactggctctaaaattagacaaagaaatgcacctgtttatttgggatgaaacacaatactataatgaaatgcctgagactgggtcatttatatgggaaagaggtttaattgactcacagttctgcatggctggagaggcctcaggaaacctacaatcttggcagaagttgaggcaggcatggcttacatggtggcaggtgagagagagagcgtgagagtgcaggaaaaactaccattcataaaaccattagatcttgtgaaaattcacttactatcacaagaatggcatgggggaaaccacccccacaatccaatgacttctcttcctccacacatgggtattacaattcaagatgagatttacgtgggtacacaaagcctaaccgtatcaactactttcatgtgaattattgcctcaggt

SEQ ID NO: 196725 - DNA, 496 bp, Homo sapiens
tgcctcacagcactcaatacagagcttcagaagattccagaacaccaccacacccaatcatttgcagggctcccaccttacgtaagtgtctcaactctctctctcagtctgtgtggccgttaaaactccgtctctggcagagagactgggtttgagtttcagttctgccacttactagctgtgggaccttgggttgtttctaaactgctctgagggctgcgtgtggcggctcatgcctgtaatcccagcacttcgggaggctgaggtgggcagatcacaaggtcaggagtttgagaccagcctggctaacactgtgaaaccctgtctctactaaaaatacaaaatttagccaggggtggtggtgggcacctgtaatcccagctacttgggaggctgaggcaggagaactgcttgaacccaggaggcagagattgcagtgaaccaagatcgcaccactgtattccagcctgggcaacagagcgagactccatcttgg

SEQ ID NO: 196726 - DNA, 373 bp, Homo sapiens
cagccagaggattggatgaggtcatcgacggagagaatgcagagagaatcctggggctcaccaacatgaagaatttgggacaagaaagaagatccagcagagaagactgaaagaaggcagctaatgaaataggagagaacctggagagcacagagtcttagaggccaagaaagtggtttaatataatccgtatcaaagcatttgtggtttatttttgttaactgacaaaaggattctaaaacatacctgaaaagtataattcacacctaggataatggatcattctgtcacattgttcctttttcacagctgatatgaacatgatattttcatgactttgtaaaataaaaatggaatctttctaattttttta

SEQ ID NO: 196727 - DNA, 413 bp, Homo sapiens
gcactggtggagggagccctgcggggcagtcctcaaggcctccggatgggtgtgagaggcaccggggctgaagcagcatctgggtttgaggaagccacagccccttggctctccactgcagtctcagagcagcctcaggctgagtaagtggctgaggccaatcctttaggaaacggcaccacgcctggctaatttttgtgtttatactagacctggccaacatggcgaaacctcgtctctactaaaaatacaaaaattagctgggcatgatggcgggcgcctgtaatcccagctacttgggaggctatggcagtaaaatcgcttgaacctgggaggcagaagttgcagtgagccaagaccacgcccttgcactccagcctgggcaacaagagcgaaagtcatctcaaaaaaaa

SEQ ID NO: 196728 - DNA, 245 bp, Homo sapiens
cacgggcacggaaaggtgtggctggcttccttcacctttctgaggctcactggaaacttggggtgatccatgctacttgcccagccccaacaccaccccttcttgctgtcatctcagtgaggcttttggcaacacagttccagaagggactggaaaatgcaagtctgctctgttctgggacacccaaactaaaaagggacttcactcatccctaccaccccacctctgcccaagacactctcccc

SEQ ID NO: 196729 - DNA, 364 bp, Homo sapiens
aatctttaaaaatattagaactattggctaaatttatcatattatgtatgcattctgagaactgtatgagtatctggatcatatctatcatcttctcaagtatttgttttataaaatacttagtaaaaatgaaactaaatcttgagcagttttaagtcatggttaatccttctccattgtaattcaaataatgtaaagtaagtctgaatttattaggacaaaacagtcatatgcaaatctcaatcttgttataagaaggaattttctagtttcacaaaagaaaccacaaaatttaattcttttctcgaaggctttaacattctgcatcacaatttcaataaataacggtcattctaaacaaaca

SEQ ID NO: 196730 - DNA, 289 bp, Homo sapiens
cttacaagaggtcttgcactgagcctcccagtgggcaaggggtttaaatcccatggcatctgactccactctttcatttacttttgcccaccaatttacaacaatctccatgccactttcgacattaaccccttccatacttccaaaatcgccaagttggctactaacacattttacacgtgaggaaactgaggttcagagtgatgaactgacttatcaacaccacacagccagtcagtagcagagccagattctgaactcatgcctgttttactccaaagcgacccag

SEQ ID NO: 196731 - DNA, 456 bp, Homo sapiens
gttggactcatgtcccaagtgcctgatagagcgcctggggtgaggtagccagccaaacagtaaatattgaacttcagagactcttaaacttgtagaaacagaaaaaaaagaaatatgtgtatgacttttttctgaataagaatatgcagttgttgcaaaaaaaaagaaaaaaaaaagagagaagatactgcagtatattaagaagaaaattgtggtcacctgtaatcctaccacccaaatgtagctataattgacttttttagaaaacaatatatttatatccaaaaaatgttattatatgtttgagtgcacatgcacacacatactataaaaagcagaatgtatttaggtgcatgtactgttttagaatatttttttctcttaatgcattgaggatatatttatatatatctcaaaaattgtatctataaaatacatgactcaagggacatcatt

SEQ ID NO: 196732 - DNA, 497 bp, Homo sapiens
actgtggtgctcaggtttatattcactctgttgagatggcttactggaatgggagcattggtgtggggctcagcgcagttaaaggagtcataattgcatctgttggtgggccatatcctttccaagagaaaccttgtgctgagttcatacctcttcctttgaagcatccagaaagaaggcagtctttcttgctaatctgttttgaagtatgctcaattaggttggattagggatgatttaaacaaagtaatttagacacagttcttctacagatacattatggtttaaatacctctaggacatcccgtgaaggtgttcagtagagagttaagtgtgcataaatgaaggtcagggagagagagctgggctagaaatacagatgacatctgcatggttattgaaactaggagtagacacgatggattatcctggaagtctaagtagcacttaaagggctggccagggaggaggatttcgtgaagcagtgaatggagaga

SEQ ID NO: 196733 - DNA, 464 bp, Homo sapiens
cagagaagtctaagatcaaggcaccggtagattcagtgtctggggaaggtttgatctctgcttcacatgtggcctcttgttgctgtgtcttcatgtgggagagggagtggaagggcaaaaaaggatggacaggctccttcaatcccttttataaaggcataatcttattcatgggggccccacactcatgacctaactaccttgttaaagccccacctgctgataactatagccttggagattaagtttcaacatatgaattttgggggaacatgttcagtccatagtaaaaactaagaaggtaaagaggatgaggagttggggagtgataaaaatggcttctgtgggccaagcgcagtggctcacaccagtaatcccagcatttgaagtgtctgaggcgggaggattgccagagctcaggagttggagaccagattgggcaacatagtgtgacccctcatggc

SEQ ID NO: 196734 - DNA, 216 bp, Homo sapiens
gcttagaaaggtgctgacaggcttggcttttcacccgagacgttttacatctttaaatatgtttgtaatttgagtggtctgcacactccagattttgttttgaaagggaaactttataaatcactgtattattattagaaataattaaactaaaaactaagatgtggttgcacacatgtttacaacgatgtgaaaaataccggctgtcagcaccag

SEQ ID NO: 196735 - DNA, 423 bp, Homo sapiens
tgactttcacatttgaacatttcaaacaaacagctttcaccagttgtttgtaaggacaaacgtggaaaaacattaaaagaaaaccgttaagtgtaaaaatgccaacattgaatttgaataaaagaagagtcaaccattctaaccagaggtgaaactttaaaatttttgctttcagctttcacaataaaacaggtaaaaattgcctatctgcaacattcggttttttaaaatttatccaactatgccctttttatgttgtacttacattcccttggaaggaataggtgggtatattcatcgaaccttgttattattaatattaaccattagtattgacagcctaatattgagtgaatccttttgatgagagaagcactactgatggtcattatcatggtgtaataatattaaaaatcatttgta

SEQ ID NO: 196736 - DNA, 458 bp, Homo sapiens
tctaacacagcaacactctaaagtagattccagtattatcctcattatttaaggaagaggaaactgaaacttaaggagcacacaaagttggcccaggggcacccagctgaaggtggcaacacggaggcctaaccccaaccctgtgtgattaaacacatgcccttcaactctgttcagctgctccaaactcctattgcctgaatggggctcacagaggtagtttgataacacattacagattatccttgaaaaacctgttctgctggcaagggatggggacaaacctgcctcacttgttttcctgagtccttgcagccctggcctagctggtggagcctgtttgtttttcttttgcctaatcttattcagacatagttgagctgcttaactactcagcctggctttcccagacaaccctttcatcaagggaatgtcccaataggtaaacatgagggcag

SEQ ID NO: 196737 - DNA, 425 bp, Homo sapiens
agagtttcttccacccttattctccagccccccagtgttattagttccttatgtatccttctagagctgctttatgcatatatagccgtaaatatgtttttcccccattaaaaaaaaacaaacaaacacataggctgggcatggtggctcgtgtctgtaatcccagcactttgggaggctgaggcaggcagatcacccaaggtcaggagtttgagatcagcctggccaacatagagaaactccgtctctactaaaaatacaaaaaattagccgggcatggtggttgcatgcctgtaattccagctactcgggaggctgaggcaggagaatcgcttgaactcgggaggcggaggttgcggtgagccgagatcatgccattgcactccagcctgggcaagaagagcaaaactcttgtctcaaaaaaa

SEQ ID NO: 196738 - DNA, 407 bp, Homo sapiens
atgaaaaatgactggactttggaataaaatagacttcaatatgagccccagttctaccgaacaacagctgtgtgatgcagagcaaacgactcaacccctattaatctagagatggcttaaaaattcgactttcaaggtgttgggaggtttagtattaatatatgcaaaacattttgcacatgctgggcacatagtgagtattcagtaagtgttattactatcgtcagtatcgtcaccatcagtgtcatcctcgtcatcattacttttggtaccaagcatatctattaccaatggagtccattttgactatacacagtgaatctcctttacaatgttatttgcaatggaatgaaattcagtctatggacctcactagatgaatcatataaagtagtatatgtgacagc

SEQ ID NO: 196739 - DNA, 411 bp, Homo sapiens
ttggcgtttgttggtatggggaaagcatttacttagaaatttgaaggctggctttagacaatggcctgaacttgcaggaacataaacatgctttaagatgttccgagttgcttgcggtgggatgggatgggaactttggtctctgccgcagaggcaggctagaagctaggcaggcaggaacctgtgcaggggcccctgaggatggaccatgccttggagagcagtcacaactcttgagcccaattaattagctaccttttaatctgcttttattttcctttgttatctctgggccttttcgtttagccttactttaccatttcagctttgttgcagctgtgctgtagggaattaaggaaaatttttaagtcaacttgagtttcatttgtgcaagagcaaaagtggccccct

SEQ ID NO: 196740 - DNA, 610 bp, Homo sapiens
tatattatagagcactgctgggaataccctcatgcattcagcttctcatctattacatttttctcaagagtgagatcactcagttaaaagttgaacatccttatgttttttgctccattctgatgttgctgtcaagaagggtatatcaatgtactaaaagcccataaaacactttccctttttcccacattgggaatctttctgctactttatccacactgtgcacatcttacaactctaaagtcagttagcatacatgaatgagagtaccatatattgtcttaaactctttagttttgaataaccagaaaataccattgaccttagaaatgattactatttatgagattcgaggccggctgcagtggttcacacctgtaatcccagcactttgggaggccaaggcaggtgaatcacttgggctcaggagttttagaccagccttggcaacatggtgaaaacccgtctctacaaaaattagccaggtgtggtagtgggcacctgtagtcccagctactcaggaggctaaagtgggatcccttgagacagggaggcggaagtttcagcgaaccgagatcgcaccactacactccagcctgggtgacagagt

SEQ ID NO: 196741 - DNA, 595 bp, Homo sapiens
ctattatttaaaagtggtctcccaaaacatgtaatgatttcccccaaaaatgtaatgatttcctctccttactttgaatgaaatgggctctaaatgctccactcccattctcctcacccaattatactggcaactatgtctatacaggtactctggcccgagctcccagttcctgaatattgagatcaaagatgtatatatgggaaagtagtagagcttggaggtttgctagagaacagtatagcattttctatagatagctttacagaaacacagccaacattcagcattttaaaagcagctgaggctggccacggtggctcatgcttataatcctagcactttgggaggctgaggtgggcggattgtctgagctcagaagattgagaccagcctgggcaacatggtgaaacttcatctctactaaaatgcaaaaaattagctgggcgtggtggtgtgtgcctgtagtcccagctactcaggaggctgagtcatgagaattgcttgaacccaggaggcggaggttgcagtgaaccaagatcacaccactgcactccagcctccagcctgggcaacagagtgagactcggcctcc

SEQ ID NO: 196742 - DNA, 316 bp, Homo sapiens
cacactcatttaatttaatctccatagtccaccccattttgtaaaagaaactgaaggtgaagtttggagagattaaggcacatattttaaaaagtatcagggcctggtgcagtggcttacgcctgtaatcccagcactttgggaggccaaggcaggtagatcaggtagatcactcaaggtcaggagttcaagaccagcctggccaacatggtgaaaccccatctctactaaaaatacaaaaattagcttgatgttgtggcacatgcttgtaattccagctatttggaagggtgaggcaagaggatggcttgaaccc

SEQ ID NO: 196743 - DNA, 427 bp, Homo sapiens
gctttctgcccagaaagtggaagcgcttcccttaaggcaagagcctgtatgttcccttcagctaagctctggcataaagtcactttctttttaccatccttgtgtttgtcatttaaatttgcaagcaacaaggggcatgacgtgtattcctaggactgagcccttagcctgtggggtctgatgctttctccatttactgtcacaattggattgcactgtaggacacccagctggtacccaagatttggtctgtgtggggaaaaaacccatgtatctggtaacagaagtgttctgtgttgagtgttgagagtatactataagacagttgtttttcctattataacattttgtctttcaacttttttcttcatgtcttctgagacataaaagttgtgaattttgaggaaataaattgatttatttttca

SEQ ID NO: 196744 - DNA, 453 bp, Homo sapiens
attccacttctaattctaattttcttgctgtttccaccaaatctcccccaaggtcttgaaccccccaaagttattcatgacaggggtatcaacttcctccaaactcctgttaatattgatattttgacctcctcctgtgaatcacagatgttcttaatggcatctagagtaatgaatcttttccagaagactttcaatttactttgcccagatccatcaaaggaatcactatccatggcagctatagccttatgaaatgtgtttcttaaataataagatttgaaagtcaaaatgactccttgatccatgggctccaaaatgaacgttgtgttcctaagcatgaaaaacattaatctccttgtacatcttcattagagcccttagatgaccaggtgcattgtcaatgagcagtaatattgtgaaaggaatctttttttattttcttctgagtag

SEQ ID NO: 196745 - DNA, 621 bp, Homo sapiens
ggttgagtgtccgggtagctgtgcgttgttgtttaccacgatgcagaacactagggaaggaacaggctctggcgagcggcatcagagtgttgcctccagtgctttaagctagagatgcctgtcaaacatccaggtagaaaagtcacacaagtgattggtcgcacaagttcaggagagaggaaataaatattaaggcaccattggttattgatactgtgtagataaatctacgggagggaggatcctccagggcacagctttcacagtggcttgtgtctccgtgggtcatgaagtcaatacagtgggcaccagcaattttcaaaaaacgaaatagaattgaaaacaatatctcggtagtaagggctgttgtaaaatgtttccttttatgccaactgataggggaattttgccctatgaaacattttttaaaaattaaatttatgtgaaaagagagctgtgtcctagatcacagtatgaaacttctttttttaaactgcagatcacagtttaaaagccactgatgtagaaggagatgtagttccaaaagagatcagagactgagttgattccggggccatttcaacgtgcagaggcttgggatgggtctgggaccagcaaagg

SEQ ID NO: 196746 - DNA, 318 bp, Homo sapiens
  misc_feature (318)..(318): n is a, c, g, or t
acacagcccctgcctcaggacagagtgcctgggttcaatgccacctcccagctttgtgatctgaaacaagtcactcaacctctctgggtctcatggcctcagctgtgaaggggacatgatattactaccacagttccacaggctgttctttttttttttttttttttttttttttaaaaattttttttttttggatttttaaaaaaaaatggggtttaccgggtttaaccaggaaggttctaaattaaaattccggacccttttaaagttggggaccggaccccaattcaaaacacggggcaaacattttcccggggn

SEQ ID NO: 196747 - DNA, 460 bp, Homo sapiens
gatctgcgcgcctcggcctcccaaagtgctgggattacaggcgtgagacaccatgcccggccctcagtctcttttaagcaaggatcaggggagtaatcagatggcccatatagcgctcctgctattgaaggagcgcagatgtcgctcagatagcgacaggaagagaagtcagtttccccctgcaggtaggatcagtacttttcctaagtggctgcacttctttgaggtgcaagcatacagtgctgtctttctgagagccctggcatgacaccaaggggaggcccccttctgatgtaaacactgagcttgctgggttgcataaggcctctcaggggtgatataaaccgagggggtaaaggtgaccgtgttgctcccaggaactgttttcagaagatgcacaggtgcagcaggaggattcctgccagaagcaggaacagagagggcagggagaaaaaggagg

SEQ ID NO: 196748 - DNA, 480 bp, Homo sapiens
cctcccctacaaccctggtgactactgttctaagaatttgactattccaagtaattcatataaatgcaatcatacaatatttgttggccttttatacctggcttatttcactcagcataaagtcctcaaggttcatccatgttatgacatgtatcacaatttatttttaaggttgaataatattccattgtaggtacatactacattttgtttattcatccatcaatggacatttgggttgtttctaccttttgactactgtgaataatgttgctatgaatatgaatatgacagtacaaatatctgttggagtccttttttttttgagagagagtctcactctggttgcccaggctggagtggagtgatgccattacagttcaccgcagtcttgacttcctgggctcaggtgattctctcacctcagcctcctgagtatttgggactatgggcacacgccaccatgccaggctaactttt

SEQ ID NO: 196749 - DNA, 778 bp, Homo sapiens
tattcaaaaagagacccttttgtatgcttctcctttctcagccataattataatgtgaaccttctgagtacagtgttattctaagtttctcggggcaagggagcagttcccatttaagaccctcttttgttgtgtctttattaatagactcaaactttgtgtcccggattttctttttctttttccattttcttttttaattgaaaagagattataaagacttcagatattcatttgctctgcaaatggagaggagaaataggaaaataacgaaataggctttcactagtgccactctgtctttgataatgctcgtgtttgagaaagacttgatgatgtgggtggaagtgtgatggcaacttaaatttacttagagagttggttttcagtggatgatagtcttcctcacctcctcatctctcccaatccatctcatatagaggtggagctatttctccagctgttagtagtagttgaagcattaactgctgttgatatagaaagagtcttttattcttttttttggtatttgggtatgatgcagttctttttacttcactttagagtaggtaccagcgtgggatgtttcctgtgcagtcctttttaaccaaatggttttttctggcatagtactggcagtgttgcttggctaattcctaatgtagtcaagttagttctgtcagatgtattcggaatttagttggaattgtttagcattaaattacggaagcatctgaaagttggttttacgaagttctttttaaaaattttctaaact

SEQ ID NO: 196750 - DNA, 720 bp, Homo sapiens
tattcaaaaagagacccttttgtatgcttctcctttctcagccataattataatgtgaaccttctgagtacagtgttattctaagtttctcggggcaagggagcagttcccatttaagaccctcttttgttgtgtctttattaatagactcaaactttgtgtcccggattttctttttctttttccattttcttttttaattgaaaagagattataaagacttcagatattcatttgctctgcaaatggagaggagaaataggaaaataacgaaataggctttcactagtgccactctgtctttgataatgctcgtgtttgagaaagacttgatgatgtgggtggaagtgtgatggcaacttaaaccaaataataatttgaaaacaaaaatggaggaaaaccttcatagaagagtaaattagtaagttattggtatgaccttgatttctattctctatgataggaaagactttagtatttacatttttatcttatggtttctaatttttctcatatactttgaagcatttacttgtcatgttcagcctgttcatacataatttgaaaaagtttcccgccccgaaaatctacattttaactgttgtggtgttcattttcctttacgggcccaaagttttaaataggattgaaaattctaattgtcacattagttggtaacatttagttttaatatatgaaaaaggaaatgtttttctgctg

SEQ ID NO: 196751 - DNA, 450 bp, Homo sapiens
atccccacacatttgctggagcccacaatggcccaggccctcgagcattattttgaactgaaatacagtagacttgaaaatttcaagaaagactacttctggattctatttggataacttttcccgttgctttgatcttacagtcttttaaatagaaaactaacacgtggtccttgaagaaaagttggaaaacggtcagatagaagaaaaatcaataatccaaggccatcaccaaagcagaattgcattttgcatttacatatttccttcaaacttttattcaagtatcttttgaattgttgtaattatgtgtgtctggaattttacttttttttcctgaaacttaatcctctaacgtaaatcatttttatgttacgtagtcatttgtaaacttcacttttagtgtttgtaaatggtccattttgtgaatatagtttacttgactattct

SEQ ID NO: 196752 - DNA, 111 bp, Homo sapiens
taataggtgaggggaacaatgccttaggaaaaaagaacttccctagatcacacagtaagcccatgatcagctggaaggagatgaattctttttagtccttgccgtagacat

SEQ ID NO: 196753 - DNA, 172 bp, Homo sapiens
gaggcagagagatggggtcagggcactgtctcttgcaggcctttgtgagggctcagacttggacaatgcttgagctggggagacatgggaggttctgaggccagataacatggcctgaattatattttaaaagagtcacattggctctagggtgcaaagatagacgtgagag

SEQ ID NO: 196754 - DNA, 433 bp, Homo sapiens
aggcaggtaaggggggactactgtactttctgtatgttatcttcaattcttagtgttggctgtagaatatttttttcagaggccaaaatcttattccctcagggtaacataaagacagagatcggctggtcatgatggctcatgcctgtaatcccagcactttgggagggccaaggcggacagatcacgaggtcaggagatcgagaccaacctggctaacacggtgaaaccctgtctctactaaaaaatacaaaaaattagctgggcatggtggcaggtgcctgtagtcctagctactctggaggctgaggcaggagaatggcatgaaccctggaggcggagcttgcagtgagccgagatcgcgccactgcactccagcctgggtgacagagcgagactccatctcagaaaaaaaaaaaaaaaaagatcagca

SEQ ID NO: 196755 - DNA, 864 bp, Homo sapiens
gattcttaggtttatattcatgtctttgcctagttttggcatcagggtaatactaacttaaaatgaaatggaaagtgtttcctcctcttctgtatctggtgtagaattggtgttaattccttttaaagtattttgttgacttctccacctgggcttggagatttctttttttcttttttctttttgagttttataaactgtgaatttattttacttgataactaaagaactattcaaattatctattttatattagatgggttgtgatagtttgaggaagtggcccatttagtctaaaaatgtgtagaggtgttcatagtactctattttgctgtctgcagagtctgccatgagatctctgttgcattccagatactggtaatctgtgtcgtctctgtttttctttgccttttttcccccttctgcttgctttgggtttattttgctcttgagatgggagcttaaattattggtttgagattttttctcttttctaatgtatgcatttagtgctataaatttcccttcagcattgccttagctatgttccatatatttggatatattgtagtttcatttttcattcagttcaatgtatttttttattttccttgagacttcctgtttggctcttaggtagtgtaaatttctgtttattcctgtatctgctgtacatttaagtcattgctaattatttaccatcctaaataatattgtcagaaataacatcctttaatcaggcacggtggttcatgcctataaccctagccctttgggagaccaaggcaggaggatcccttgagcctaggacttcaagacctgcctaggcaacataacgagatcttgtctctacaaaaaaagaaa

SEQ ID NO: 196756 - DNA, 1219 bp, Homo sapiens
  misc_feature (865)..(865): n is a, c, g, or t
gcggtgcgagcgggtgcgcgcgcagcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagcctactgcgttgtgcctggggtgtgtcccgaaaggtatagccggttccctggagtctgagattggcatggagctcatgnctgggtgggcagaatcttacctcctggagggatcgggactcacacgcaaccagagggcatacaggatagggcgcaagagggcgtccccggagccgaaggcgaaagtgccgcaggattgaggctcgacgagagacgttccaaggagtaaggaaaacaaaaatgtggcgccacccggggagggcaaatgaggaacccagaggcggggcgaacaatcaaaacaacgcaaagaaaagacggtcgagggcacacagtcaacaagaacgaaacacactcagagacgaaagtatgagaacaaaagaacaagagcgaacacacacgcacggcgtgtcgcggcgacagagcaactaacacggg

SEQ ID NO: 196757 - DNA, 1185 bp, Homo sapiens
  misc_feature (861)..(861): n is a, c, g, or t
gcggtgcgagcgggtgcgcgcgcagcgggccggcagtggcggcggagatggaggagggaggccgggacaaggcgccggtgcagccccagcagtctccagcggcggcccccggcggcacggacgagaagccgagcggcaaggagcggcgggatgccggggacaaggacaaagaacaggagctgtctgaagaggataaacagcttcaagatgaactggagatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatatgcaaaggtctgcctttatctcaccagttgtgtgaattacgtgcctgagcctgagaactcagcctactgcgttgtgcctggggtgtgtccgaagttaagccgcttcctgaagctctgagattggaattgatgccaangactgggtggcgcaagaacttacacactggagagctgggacaacaaacagagggcaacacgacaagcacgcagaggctagtccagagacaagagaaaaattcaagacataatagagccggagccaactagccaagaacgacaaagcaacccacccgcgccccggagcgagaaagagccacagccagcgcctaacacccaaagaaagcgggagcggacacgagacaccaaacacgcccacaggtcagacacgaagcaggaccaatgtcaacaaccagagactacctgagccactggggctacgtagctctgcgaaacgaaaagac

SEQ ID NO: 196758 - DNA, 200 bp, Homo sapiens
gtcagggatcaaagcaggcaagccatttgcccagaaccacacagctgttgccagagttgggatccaaatgcaggactgtccttggccataccgccttctggatgtccctacagtggctctgcccagtcaagagcccctgttgcccggggagacccctcttcacatcctcatgacaatgacaatcccacgagttaaacatt

SEQ ID NO: 196759 - DNA, 1026 bp, Homo sapiens
acaaaaccctcactttgctactgaggaaagttattcaatggccagagacaccctgcggcttttgaaaagaggtttcaggctgacaaatatccatatatacatatatatttatatttaagcctaaaacgactctttgatccctcccctaagacctccttcccgtccgcctaggcctcggtatcccccaccaggtatgagaaggaggagtcttcattcttcccaggcggggagaccacgccttccctgcctcctccctccgcggggggtcgcgttggaggtcacccccgccccctaggcgctgggttgggagtgacgcggggtgggctggagaggtttcctgccgtctgggaagcgtaaacggaccgcccacctgtcgggcctcggccgcccgcacctgcttgtgagaagcctgcggctggggcaccgcccccggtccccgcccgggtccgcgcattgggagcacactggccctttaagagcgcggcggccgcggcgcgcggggaggagggctgggagcgcccggagccgcgctgaactcgccggggacgtcgggcgcccgctccttggctggctcgcttgctctctcgctcgctctctcgggtcggctccctgcgcctcctcccgggactgcttggggacccgggcccggtcgggcgcggcggcgagcagaatccccgtgcaggaggcgcgcgctccgggcagcgcccggccccgggcatggacagagggagctgggcgcgcagggagcgccgcgggaccgggcggccggagcgctgagccagacaaaggctccggagttgcgcttgctctcgggagccgggccccaggcgctgggcgccgaggctgcggaacctcgccgggggcagctccggtcggccccctttcccgccggctggttccgagctcccggacctgccctgcccgcttctcctcgggcttgggaatttgccgaggcgacctaggcggctccggcggggaccgggagcccgaggtccgcggcgcgcctgccgggccaggagccaggga

SEQ ID NO: 196760 - DNA, 575 bp, Homo sapiens
gttctccagcatcactttcactgatgtcataaaaccctgcatcttttgcaggatttgcagtttccttttgcaactgatttgctttccgttcaccttgtgttgtgactgtggtatattcaggagcgtgagatccataaagacatggaggggacattagcaggtgagctgtttgagcaggaatcactttagaagtggccagctcatttggggtattttgaagacaatgacttttcttccttggggtacttgggtaacaggtagtggtgaagtggatactgaagaagcattttaagatgtgtctttgttctgggagatgctgctgagtagtcgagaccaatctcactcctgagacaggcagggtatgattgagacacggtgtcagggtgctgtgggctctcggttttcctcccgtacatctgcttaggtcctttgttatttctcctctgcctcctgggttccgatggtttgggggtgccagcccccacctgtgggcctcttctcttcctggtgatgtcacttgtgtcctttgtaccatccccacctctggattgcacccgggtatggccactgtctct

SEQ ID NO: 196761 - DNA, 387 bp, Homo sapiens
accattattacaacagcaaaaatatcaaaaaggaaataacctaagaccagtttaaacagggaaataagcgaggcgcggtggctctcgcctgcaaccccagcactctgggaggctgaggttgaaggatccctcgcgcccaggagctgaagaccagcttgggcaacatagcaagaccccatctctgcaaaaactttttttcattaactaggcatgatggcacgcacctatagtctcagctactgggagagctgaggtgggagggtcactcaagctcagggggttgaggctgcggttagttatgatcatgccactacactccagcctgggtgacagagtgagaatctgtctcaaaaaatacacaaacagccaggcatggtggctcccacc

SEQ ID NO: 196762 - DNA, 1032 bp, Homo sapiens
agcggggatgactggccgcaggcggccgggcgggctgtaacccgccgctgaactagcgcttctgtgtccagaggcttcggcctggccgccgtcgcctgtaagctacgaggaggagatttacgacttggccgggcgcagcaaaggccagactctgcgcgaacaggcgctgcgcaccaaccggcaggcacctggcgggcaccatcgcacggtggcgcagaagcccctcaatggccagcgccagctgcagccgcggccgcgcagtcgtcccacctgagcttgggcgaatgtggattgggaaagtcgacattaatcaactcattattcctcatagatttgtattctccagagtatccaggtccttctcacagaattaaaaagactgtacagctggcagcctgttatcgattacattgatagtaaatttgaggactacctaaatgcagaatcatgcgtgaacagacatcagatgcctgataacagggtgcagtgttgttcatacttcattgctccttcaggacatggacttaaaccattggatattgagtttatgaagcgtttgcatgaaaaagtgagtatcaccccacttattgccaaagcagacacactcacaccagaggaatgccaacagtttaaaaaacagttgaaaatggtgaacattgttattttacaattctaagaaatatgttgataaggtaacttttccggtcacacacaacagactgattttcctgtggaagacctcacaggagttctcttgaaccaggagactattttgagctgaaatacctggagccctctcaagctatttgggcctttcaatttgaaacccaggtttggatgattctaagctctatggcagagactgtaatcattttctcttcaccctcaggttggggactcaccctcagggttgggagtgactgctgtctctccagcccccaccaattacaccatgttctggttgttaaaatccagtgtatgcatgaaatgtaataaaagtatcttcgcagcactaagtagagagttccttgt

SEQ ID NO: 196763 - DNA, 980 bp, Homo sapiens
agcggggatgactggccgcaggcggccgggcgggctgtaacccgccgctgaactagcgcttctgtgtccagaggcttcggcctggccgccgtcgcctgtaagctacgaggaggagatttacgacttggccgggcgcagcaaaggccagactctgcgcgaacaggcgctgcgcaccaaccggcaggcacctggcgggcaccatcgcacggtggcgcagaagcccctcaatggccagcgccagctgcagccgcggccgcgcagtcgtcccacctgagcttgggcgaatgtggattgggaaagtcgacattaatcaactcattattcctcatagatttgtattctccagagtatccaggtccttctcacagaattaaaaagactgtacagctggcagcctgttatcgattacattgatagtaaatttgaggactacctaaatgcagaatcatgcgtgaacagacatcagatgcctgataacagggtgcagtgttgttcatacttcattgctccttcaggacatggacttaaaccattggatattgagtttatgaagcgtttgcatgaaaaagtgagtatcaccccacttattgccaaagcagacacactcacaccagaggaatgccaacagtttaaaaaacaggtaacttttccggtcacacacaacagactgattttcctgtggaagacctcacaggagttctcttgaaccaggagactattttgagctgaaatacctggagccctctcaagctatttgggcctttcaatttgaaacccaggtttggatgattctaagctctatggcagagactgtaatcattttctcttcaccctcaggttggggactcaccctcagggttgggagtgactgctgtctctccagcccccaccaattacaccatgttctggttgttaaaatccagtgtatgcatgaaatgtaataaaagtatcttcgcagcactaagtagagagttccttgt

SEQ ID NO: 196764 - DNA, 437 bp, Homo sapiens
gattccctgcctattctcaataaaaaactcaaacttaggaaagccagtgaggtttgtattcgccttacatcaggggtgggttggatttaccatttctttgactccttcaatcttttaggtaacttttccggtcacacacaacagactgattttcctgtggaagacctcacaggagttctcttgaaccaggagactattttgagctgaaatacctggagccctctcaagctatttgggcctttcaatttgaaacccaggtttggatgattctaagctctatggcagagactgtaatcattttctcttcaccctcaggttggggactcaccctcagggttgggagtgactgctgtctctccagcccccaccaattacaccatgttctggttgttaaaatccagtgtatgcatgaaatgtaataaaagtatcttcgcagc

SEQ ID NO: 196765 - DNA, 1033 bp, Homo sapiens
agcggggatgactggccgcaggcggccgggcgggctgtaacccgccgctgaactagcgcttctgtgtccagaggcttcggcctggccgccgtcgcctgtaagctacgaggaggagatttacgacttggccgggcgcagcaaaggccagactctgcgcgaacaggcgctgcgcaccaaccggcaggcacctggcgggcaccatcgcacggtggcgcagaagcccctcaatggccagcgccagctgcagccgcggccgcgcagtcgtcccacctgagcttgggcgaatgtggattgggaaagtcgacattaatcaactcattattcctcatagatttgtattctccagagtatccaggtccttctcacagaattaaaaagactgtacagctggcagcctgttatcgattacattgatagtaaatttgaggactacctaaatgcagaatcatgcgtgaacagacatcagatgcctgataacagggtgcagtgttgttcatacttcattgctccttcaggacatggacttaaaccattggatattgagtttatgaagcgtttgcatgaaaaagtgagtatcaccccacttattgccaaagcagacacactcacaccagaggaatgccaacagtttaaaaaacagagacaaggtcttgctgtgttgcccaactggcctcaaactcctgagctcaaagtgatcttcccacgtcatgctcctcccatatcacgtcactataggcacacaccactgcccctgttttattttgaacagttctttaatttttaggatattgtttcaagttactgtccttattggcaattttcccaccagtgacccccgtaccttgttcccagttccctctgccatgcccaggcaactttcagttgctgagctgaggctttaaaacttacatactgcttaaaaataggcaacggagaaattgattttcatctctcttttgtagtttacccttctactctcaagtaatattcgtatttgtgatacattatttaaaaataaaagtaaagaacctta

SEQ ID NO: 196766 - DNA, 1466 bp, Homo sapiens
gccacagtgctccggatcctccaatcttcgctcctccaatctccgctcctccacccagttcaggaacccgcgaccgctcgcagcgctctcttgaccactatgagcctcctgtccagccgcgcggccgtgtccccggtccttcgagctccttgtgcgcgctgttggtgctgctgctgctgctgacgcagccaggcccatcgccagcgctggtcctgccgctgctgtgttgagagagctgcgttgcgtttgtttacagaccacgcaaggagttcatcccaaaatgatcagtaatctgcaagtgttcgccataggcccacagtgctccaaggtggaagtggtagcctccctgaagaacgggaaggaaatttgtcttgatccagaagccccttttctaaagaaagtcatccagaaaattttggacggtggaaacaaggaaaactgattaagagaaatgagcacgcatggaaaagtttcccagtcttcagcagagaagttttctggaggtctctgaacccagggaagacaagaaggaaagatttgtgtgttgtttatttgtttttccagtagttagctttcttcctggattcctcactttgaagagtgtgaggaaaacctatgtttggcgcttaagctttcagctcagctaatgaagtgtttagcatagtacctctgctatttgctgttattttatctgctatgctattgaagttttggcaattgactatagtgtgagccaggaatcactggctgttaatctttcaaagtgtcttgaattgtaggtgactattatatttccaagaaatattccttaagatattaactgagaaggctgtggatttaatgtggaaatgatgtttcataagaattctgttgatggaaatacactgttatcttcacttttataagaaataggaaatattttaatgtttcttggggaatatgttagagaatttccttactcttgattgtgggatactatttaattatttcactttagaaagctgagtgtttcacaccttatctatgtagaatatatttccttattcagaatttctaaaagtttaagttctatgagggctaatatcttatcttcctataattttagacattctttatctttttagtatggcaaactgccatcatttacttttaaactttgattttatatgctatttattaagtattttattaggagtaccataattctggtagctaaatatatattttagatagatgaagaagctagaaaacaggcaaattcctgactgctagtttatatagaaatgtattcttttagtttttaaagtaaaggcaaacttaacaatgacttgtactctgaaagttttggaaacgtattcaaacaatttgaatataaatttatcatttagttataaaaatatatagcgacatcctcgaggccctagcatttctccttggataggggaccagagagagcttggaatgtc

SEQ ID NO: 196767 - DNA, 1207 bp, Homo sapiens
  misc_feature (1)..(1): n is a, c, g, or t
  misc_feature (5)..(5): n is a, c, g, or t
  misc_feature (1028)..(1028): n is a, c, g, or t
ngacnacaaagatggaatggagacttctgcttctggccaagttggagtaatagggactagatttgtcctccaccttaaacaactaagaaactggaaaaagtattttaaactctagcttcaacattggatatagtgcagtacagtacattgatccctgagagagagaaaatagaagagatgagccctatgattgctccagtttgctgcctgagtttgtcaactgcagagcagggaaggaggacccaggcagagcctggtagtaagtttgaagaagtcagggtggctagacatcacaggacagactagagaataggttgctgcacagagagaatgccttggatatctgtgttcaatcttcagctaagtacttattagtacatgtatttgaggaaattatgcaaagcagggcaaagaacttcccaaaaggaataatctctgtagctcacacagagcttgcaacacttggtgtttccatcagctagtgtgaaaatcccttttaatagagggagcattggttagaacaggagtcccaaacccccagcactggtccatggcctgttaggaatgggaccgcacagcaggaggtgagcagccagcgagaaagcattaccgcctgagctcagcctcctgtcagatcaacgatggcattagattagcattggagcacaaaccctattgtgaactgtacatgccagggatctaggttgcatgctccttatgagactctaactagtgcctgatgatctgaggtggaacagtttcatactgaaaccacccaattcccaacccctaccaccccacccccaccttgtctgtggaaaaattgtctttcatgcaaccagtccctggtgccaaatctgtgggagatcactggcttagaatcttcaaaagagtattgcccccaatgtaaactatggactttgtgtgataatgacatgtcaatgtaagttcatcaactgtaacaaatgtgccattctggagagagatgttgatagtctaggaggctatgcatgtgtggaggcaggggntatatgggaactttctgtacttcctgctcaattttgctgtgaatctgaaactactctaaaaaataaggtctattttcttaaaggtcattttgcctccatagtgggaaagaaaatagcagttgactaatagctgctcttatcctgcctaaaaaaaattaaaaagccagcttggaaagatg

SEQ ID NO: 196768 - DNA, 682 bp, Homo sapiens
ggaagtgacatccctggaagttaatgtcacagattttggagtatctgcttagtgttggagaaaggcgaacttttctgtttcgtttgcccaactgccttgacttgagcacagaaggccattttgcatgaatgcttttatctaaattctgtctttcccattactttccttgttttccacccccatctccattttactttaaaaaaaaatcagaatagaatttgtataattattatggacttgtgtgtggggggtatctttttcttaaggatgtgttagaattactattatttaaaaaattcttcttgtctttatttttctattgccatctgttcatttaaatattctcagattgtttatggttttggttttccctccatatattttctggcatttggctctccttttctgacacaataggtcaggctttcaaaaatctggtccctatgtaatttgactttttcagtagtcaacataccgcccatgccttccgaagtctttcatctcttaggtctttgagcagatgttaactgtttaaatattttgttgttttggtgtaaagaaaattgaaatataagacgtcagtgatagcatgctttgcttacaccagagcagattgctgcttacaagttgaatatgcaaacatctttaaaacatggaacattcccttatgcattttaaccat

SEQ ID NO: 196769 - DNA, 431 bp, Homo sapiens
tcaaatgtttaaccactgtggcagggcatggtggctcatgcctataatcccagcactttgggaagctgaggtggtaggatcacttgagcccaggagtatgacaccagcctgggcaacatagggagaccccatctctgctgaggtgtgggaggatcacttgagcccaggagtatgagaccagcctgggcaacatagggagaccctatctctacaaaaaaaataaaaaattagctgagcatatggtggcttgcttgagcccaggaggtcgaggtgagctctgatgatgccaatgcactccagctgagaccctctctcaaaaatgcatatatatggccgggcgtggtggctcatgcctcatgcctctaatctcagcactttgggagaccagggtaggtggatcacttgagatcaggagtatgagaccagcctgg

SEQ ID NO: 196770 - DNA, 350 bp, Homo sapiens
aaatggaaataaactgatgttgcctattgacatttacttttttttaaattcatttgataaaatattttgaattaccattattaaatgccataatctgccatggctattttcttttgtctgaagaataatttaaaaactatgagaagtaaaataaatctattaatccaggcaactatgagaagtaaaataactattcatccagttattctttaaaagatctttaacaacagcagatgaacttctgatcaaaactcaggcacacagctgctttatcgaagggtgttgctagttcctgattcaccctaagccatctccatgccatagtgtactcctaccccagttcttcactc

SEQ ID NO: 196771 - DNA, 434 bp, Homo sapiens
aacatctacgaaaaatgcacagctaacatcacatttagtgatgaaggattgaatatttcccctaagaccagaaaaaaaacaaagatgttcactcctgtcattcctattcaacattatactggagatgctagccaggggaattaggcaaggaaaacaagtaaaaggtatccaggctggggaaaaaaaaataagtcaaactgtccttgacataatcctgaatgagaaaaccctaaggaatatacccacacactcacatgcacacatacacatggacacacacacacaatattaaaactaataattctactcaacaaagtcacaggataccaaatcaacatgcacaaagtcaatttgtatttctatacacttgcaaaaaatcataaagtgatattataaaaaataattcacaatagtaccaaaaattaaatacttgg

SEQ ID NO: 196772 - DNA, 217 bp, Homo sapiens
ttaatgtttttatgtaccatttaaattttgttttatgtgatggaaaaaagttgatcagtacaccttttgcgtaacacccacatatttaaggataactctttaatcaactttgtcttttatccttttttagtaatcgaagcttttataattgtttatgttcctctgattcttctagtttcactcactgctcttaaaatagctgaacattagatatctg

SEQ ID NO: 196773 - DNA, 259 bp, Homo sapiens
tgtcttgtaaaactcatggctcttctgtaatactgcattcactatactctccttatgttcatactgagatgacatccaaaaatgtatttttaaagttcaatgatctcttttcttttgaatttctaaaggtacataaaattctgtttcagcagacaggatattaactagtcatgccacgcaaatgcaactggagaaagcagtagtgtgtaggtaaaaaatatagagagaagcgaatattttctttagatacttgaaaatg

SEQ ID NO: 196774 - DNA, 1093 bp, Homo sapiens
agatgaggcttccagtggctcgcaagcctcttagcgagagactgggccgcgacactaagaaacatctagtggtgccgggggatacaatcactacggacacaggattcatgcggggccatggaacgtatatgggagaagagaagctcattgcatctgttgctggctctgtggagagagtaaacaagttgatctgtgtgaaagctttgaaaaccagatacatggtgaagtaggagacatcgtagtgggacgaatcacagaggttcaacagaagaggtggaaggtggagaccaactccaggctggattcggtcttgctgctctcgtccatgaaccttcctggaggagagctgaggagaagatctgcagaagatgagcttgcaatgagaggtttcttacaggaaggggaccttatcagtgctgaggtccaggcagtgttctctgacggagctgtctctttgcacacgaggagcctgaaatatggaaaactaggtcagggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcctttcttgggttgccagctgagtcccgga

SEQ ID NO: 196775 - DNA, 917 bp, Homo sapiens
taaactcttcttcaaacatgaaagcttgatttttgaggaaaattattcacattatttacagattcaaagatgtttatgtcctgtactctagaaataaggagaaagggggtggggaggttgactggggtagtgagtgttaaaggagaggtcatggataatggactggttatagttacaggatgccctatgttcattgggctggttatgttaactgcacttgaaacatttaccttatcagtgctgaggtccaggcagtgttctctgacggagctgtctctttgcacacgaggagcctgaaatatggaaaactaggtcagggggttttggtccaggtttccccctccctggtgaaacggcagaagacccactttcatgatttgccatgtggtgcctcagtgattctcggtaacaacggcttcatctggatttacccaacacctgagcacaaagaagaggaagcagggggcttcattgcaaacctggagcctgtctctcttgctgatcgagaggtgatatcccggcttcggaactgcatcatctcgctggtaactcagaggatgatgctgtatgataccagcatcctgtactgctatgaagcatcccttccacatcagatcaaagacatcttaaagccagaaataatggaggagattgtgatggaaacacgccagaggcttttggaacaggagggataaggaggtgctccagaagcacgggactgtggaccttgcaggagtgaagactgtgatgtgtggtccccatatgtggctcagcaaagactcgagagatcatccctttgtctgcattgacggccctgtgacggcctccagcccacaggcctgctttctcctgtcctaacaccaagcctgggtggcagatgaacagtgcctttcttgggttgccagctgagtcccgga

SEQ ID NO: 196776 - DNA, 328 bp, Homo sapiens
aaggtccagttgtttggacagaagggctacagggtgcggtcccagctcttgtgtaacaattctgaccgcactaaccatgcctaggaaggaaaggagttgttttgtagaagggattggattttgggagattagtccgacatgatcagcagggagagcacgtgtttttatgagaattatgccaagatagataacagatgaagaggaaatttgggcttgactgaagtaataggagctgtctgtgaagacttgcagctaatttgctgagcctgatgggtgtcagggacagtccaagtgaaagcaaagagaggctgggatgaagggtgcaaag

SEQ ID NO: 196777 - DNA, 639 bp, Homo sapiens
aaggatataattgtttagtaatatttgagtactatagaatgtcttccagagagcataggttttgggttgccataactgatactgagttgttttttgtttttctgtctgaagtggccagagattcaaatgcctcttgagcctcctcctcgcatgtgcaagtaggactgtggtcctggcccacaggagcctcttcagctttcctccagctgtggcacaggacatgtgttcggttcactcgatcacattattaagtaacataggtattatttaaaaggagaagagtgagggcggagtcctattttatggcatttaagtttggaaccacttatgtcaaaactcatttctgtgtttatatgtacttcctaatttatttataataagcatgttgaattatgaaggagaatgttatttcaaaattctattggaggctacttagaggctgtggtgacactgaatgagagctctgaaggaaatcatagtgaaacaggaaaagttcccttgtccccgtcgcagggcatgcgacaagggggagtggcttgcttcttcagtgccccactgctcaaacctctaggggagaacacagatgggcaggctgtggggctctgaccccacggcagtgtctaggggtaaatgtttaca

SEQ ID NO: 196778 - DNA, 645 bp, Homo sapiens
cctccagtcctggcaaccactgattagttatttgtctctagagttttacctttttcaaaatgtcataaaaacaggatcatgcagtatgcagcttttggatctgctttcttctacttagcaggatgcatttgatagtcacctatgtatcaatagtttgttccttttcaatgctgaatggcattccattgaatgaacgcaccacagtttatttcatactgaaaagaccttaaaattatgcaagttttgggtaattatgaaaaatgttgctataaatattcaccaacaatcttcatgcaaacatatattttcatttctcctgagtaactagctaggattgggattgctaggttgtatgcagactgtatatataacttcataaaatactgcaaactctttttaaacatagttttagcagtttgcatccccatcagccatgtctaatagttggtttgtatcttcagcagcatttgatattatccattttgttttgattttgtttagtcattctgataggtgtataataggcatttctttgaggttttaatttttgccctcatgactaataatgttgaataatatttcttgtgcttaattgctgtccttatattgtctttggtgaaatatctttttcaaatattgtaccca

SEQ ID NO: 196779 - DNA, 508 bp, Homo sapiens
cctaccacgcacagatgcctgtccaaacgctatacatgtgtcacctctaaggtctccacacagttcaagactggaccgtgcctgccacagttcccttctatagaggagggagctctggggggtctaggcacctgcccccagctggggagggtgtatccaggatctctcattcccctggcactctctgtccaagctttctgggagctcagagctcgagtcagcaggtggaacccggggcgcgggcagggtgcaggggcagaggagccggcccagaaaaggaggcggcagggcctgcatgccagggcagcgagagggacgggatagctgagacccagctgagaccccggctgctgtcaggaggggcaggaggtgggcgtggacttggcagcggaggaccctttgtccgcccggggaggcgagggccttgaatgacgcttccccaggaccccgggagacccggagcctctctgcctggggtgggggccccagcctggtgccctgcggccgc

SEQ ID NO: 196780 - DNA, 502 bp, Homo sapiens
cctttctagaagtctgtgggagggaaccactccctacagggagtctggccatctcccttccacccgaggcctcacctctgttgagatgacccgtggcacagcccctgtcttcccaggcaggggctggtccaacataggcctttctgcaacccaggggctgaggctggtcaggggtacagcctcctctctggtcctggctgcccaacccccacaaccatccaacttcccctgcacaaggcattttgatctctgcgtccaagtagctcaattggtcaggaccgggctgcggtgaggccaaagtcaggggttaccatagcaactcaccacgctttgtggctgcttgttgatatccacaggggcagggggcatgccctctcactcaccaagtatctggcaactggcacagtatctggcccacagtagatacttaataaatggttgttgcctaaatgaatgcatgaccgacccattgtagctagttagagccagtgattactgagca

SEQ ID NO: 196781 - DNA, 329 bp, Homo sapiens
tcgcaattttaatacttcaattaattgtgcacgtcactgccagacttttcttaaacttgatttccaaggccctgatatagttcaatctaatctactttttaaactatccagcaaatacataccctcttctgtgttctcacttttcccctacaaatcataaatatttcttcatatgtacttttttttgtgctgttgcttaaccttcaaaccacagtcctccttcaagggtcagctcaaacttgccaaaccagagatccttccgttcaccaaatgtagtattaaatatatagttataaagtatacggacaaaaaatttaaacatgaacaat

SEQ ID NO: 196782 - DNA, 403 bp, Homo sapiens
gacgagagaaactctgtctcaaaaaaaaaaaaagttggagaggggactctaggaagcctgaaagacccactcccctgctgtcctggcctagggtacatttcccttttctcatatgaagcaacatcatatcatggttaagaacatggccacattggccgggtgcagtggctcacgcctttaatcccagcactttgggaggccaaggcaggcggatcacaaggtcaagagattgaaaccatcctggccaaaatggtgaaaccctgtctctactaaaaatacaaaaattacctgggcgtggtggtgcatgcctgtagtcccagctactcgggaggctgaggcaggagaatcgcttgaacccgggaggcagaggttgcagtgagccaagatggcgccattgcactcc

SEQ ID NO: 196783 - DNA, 291 bp, Homo sapiens
ttaagaaaaaaggagataaataacataggcttggttggaatcccagctacactattaacaagcttcaccaccataggagcaattggcttaaattgtgagccaatgctgcttgctgcttgtgtgaaaggcaatcataactaccaccagaggttttataaggatcaaatataatatggaactggacagtgtctcatgcttgtaatcccagcactttgcaaggctgagctaggcagatcacttgagcccaagagtttaagaccagcctgggcaacatggcaaaacactgtccct

SEQ ID NO: 196784 - DNA, 100 bp, Homo sapiens
gtctaaggaaaatatatttacttttaggaatttataatgtggaaaacaaaacccccaaaagagaggtactctaacaatgaagatggtcggcctgtgcaca

SEQ ID NO: 196785 - DNA, 543 bp, Homo sapiens
ttttaatagagacaaggtttcaccatgttggccaggctggtctggaacacctgacctcaagtgacctgtcctccttggcctcccaaagtgctgggattacaggtgtgagccactgtgtcattatggcattaattacctcttgatatactatagtaattaatgccataaggaaaattacagctgatatgaggatgatggtatattaaatttgtgcttttaggtagtcttgggaaggcctctttgaggtggtgtttgagtaaagatctgcatgatgcaagatagcatcagtacagatatccaggggacatttctgtttgtctgttatataatagacaaaaacagctagatagattttcatatttggatggaattcgagttgggctgacttaaaatgtaggctctataaggagtgatgaagatgtctgtgtgactaccattcaggagatatctggcatctatattaaacagaaaacagtaatttcaaatatgagctctaaatagaaattcgcaagggcacatgttccaaaccgtaggattattata

SEQ ID NO: 196786 - DNA, 155 bp, Homo sapiens
gtgagaggaatccagtgattacacttctgagttatgaagtgttcttacctttctgtatatggtaatggtgcttcaaggtaggcatttcttttacattcataaatgaactttactttgccctatttaaaggtcagtattagaactggcctattcgt

SEQ ID NO: 196787 - DNA, 553 bp, Homo sapiens
aaatgtggacaaaagccttgattgtggttttcagggaagaggcacacaagacagggtaagcaggtttaggattagctagttcggataatttcaggggttctggggttgaggggctgttcctggttgtctagtacctggcccgggtgattagggcagtgtagtattggccctcagtgtcatagaggaggtgctggggtattggctttggattggttggtttgcctatgaaaggagtactcaaaggtgagtttactatctctaatgaaaaagctaatcctggcaggggcagtccctccagtgtcagcaaggaccctgatgtcaaaacatcaaaactatagaaagtaaaaagacatgcttaatacagaagttaataaaggttaaagcagaaatatatgaaagagagagcagaaaaacaatggaggaaatcaatgaaaccaaaagcagttctttgaaaagataaaaaaattgactaactttagctagactgaccaagaaaaaaaagaagactcaagttctgaaatcagaaaagagggaatattaccaccaaccatac

SEQ ID NO: 196788 - DNA, 130 bp, Homo sapiens
tttttttacagcaatagatgaacggatgagttaccttagccaagcctcgcaacttccgcatgagtcaatgtgataattactccactttatagatgaggcagctgccactctcagagctgtgataatctgg

SEQ ID NO: 196789 - DNA, 357 bp, Homo sapiens
ctagttcctttgcactagcaccaactttcttgaacatgcagccagaatctgctcatttttcttcaatttaacttttgcatcctaacttctaatctctttattggcgttctctcttcaagctcatgaataaactcctaattgccaaatccaagagttctttcagtaacgctttattttatgcactattaggctcacttcacacttcttcttctattcctaattctcatgtttcactaatcgtgcactaccggagtgcagggtgaaaaaattaatcaagctgatcagtttttgtgtaaccaattctatagatcttttgtgataatttattatattgtatctatgcttaaaagtatgttt

SEQ ID NO: 196790 - DNA, 478 bp, Homo sapiens
atttactattttttaaaccgtcactttacttttagttggcaatattttgatgagcgcttatgctagtaatgttgtcatgtattgtattcttttagtataactacagtctcactgcataataaacaaagttatttgccatgtaattacgtagcaaaataatccacactccattgtgccttcaaagcatgacacttgaagtttatttatcttctttcttcttttgacgtatgcaatagtaatgagaaaagtaatgcaagagtcatggtaaggtaatatgcatggcactccaaatgctgtcaagttttaactgtcactgtgattcatagtgaactgagcaatggtgggaatcaatgagaatgtcacctatgatctccatcacaactcagctctgccattgtcacacaaaagcagccataaacagtgcataaatgatgagcatggctatgttccaataaagctttatttgtaaacacttaaa

SEQ ID NO: 196791 - DNA, 394 bp, Homo sapiens
cacatgtaagcttaataatgaggttcatattaaaggcagacagatgttcaattaaacatcagacttcacgctgacacgctgagagtgaggatctccatgcataattctccgtcccagccccagatcccgggagttttgatcacacagctgggaagtcgtcatccaagcctcggatgtgtttgtggggcatcgtctatagccggggctcctcccctctctctgtccacacacacaggtctccaggcatgtttacctctaaatacacaccctgccaaggactgtggcctggaaagtcataggcacttgacttctaccaaaaaagaaataacggaacggcatgagaatggtcacacctgagcaggcagctaacagcaacaggttcactacacacaac

SEQ ID NO: 196792 - DNA, 278 bp, Homo sapiens
ctccctaaagaattagaacatttgaggctatacactgttctgttgaaatgcagttatatattacccagatctgtaagcacttgccaaccgacctgtccaagtcactcacttcctacgagttctcagttttctttttctcccctttttaaattccagatccatgtatgaataacatgccaggtgtgtttggaggagacattcctaatattttgaaaaatctcattcaggctgggtacggtggctcacgcctgtaattccagcactttgggaggccaagg

SEQ ID NO: 196793 - DNA, 416 bp, Homo sapiens
ctatgcaaccaccgttaaacattcaaaacgcatcctcttcacattgagaaacagcctcgtgagagggaaaaaaaaaaaacgcatcctcttatccagtgacccagatcctgacactagctttctgttaggaaggccttctggaaaataatttggttcagaatgcggggaatatgggttcaagcgcgccccacccccctatacaagcactcttcgacagacccggttctcgaccttcctccgcggtcggggagggccgaggcaggcggatcacctgaggtcaggagttcgagaccagcctgtccaacatggagaaaccccgtctctactaaaaatagaaaattagccaggtgttgtggcacatgcctgtaatcccagctacttgggaggctgcggcaggagaattgcttgaacccggg

SEQ ID NO: 196794 - DNA, 187 bp, Homo sapiens
ctaaatgtctctcgtctgttttcaccctagggatgcgaacattcttgaactgatattctgcttcttttcctttccatacactgcagtgattatagttgttttgagattcttcatcaaaatatatttttgagatttatttttatgcaaattaaaagcttaagagtttatgttatcattagtataatta

SEQ ID NO: 196795 - DNA, 1004 bp, Homo sapiens
tattcatagaagaaaagtaccattcagtacaaaggtatcaagcagtctgaagaacattacttttgataaatgtcacagttccccatgaagaatagccctgagctttccttcattaaatatcattatatgaaatgtataatttaaaaatactgaagtaagagataagaagggtgaaaacatattctttataaaaccttaacacatgcttttagtctttgataaatcataaaaaggagttaaataatatgatggataacgttaatttaatccacatacactgatctatgcaaacaaagagtttctatcttctgtctaaatctgcatgggagatttagaaaaacatttatcatatcaaagtctaataggaaattgtagacagttcctactgtggctggcagaattacatgtagccatatagtagaacaagaaatgaataaatacataagcgcactcttgggttaaggaatcttagaaagtagtgatgatgctaacactgcatattttgagaacgggatggagccgacatagtatgccaagtaatactagtctcattaattgcaacaggaaacagtgcatatgtattaacttaaaaaactagaacagacaagaaaatcaaccttaaagaaatccattaaaataaaacattgttgataagttgaaaaatactgcaatgtttagatctggggatgattttttgaaaagagcagtgaaataaacatttggttaagataaccaagaaagaaacaaaaactacagaaaattaggaatgaaaaagacactcagcatagatacagatgacattttaaaattattgcacttaaaattttatatgagagactatgttctatgcaaatctaaagtacaggtgaaagaaacttgaataaactcgtaaagacagatggaatgtgaagctactacttgcaaaagagccagaaaatttcactaatcaaagttttcagatctccaaagaacaaatgatttctgtgctatttcaactttaagag

SEQ ID NO: 196796 - DNA, 119 bp, Homo sapiens
ataaaaaacagaatacttttttaaatgaagggaatatttttgaaaatggttaaaatacaaaatcaagaaatgatccccaaagaatgtggggaagggatgagacagagatgatgtatgag

SEQ ID NO: 196797 - DNA, 557 bp, Homo sapiens
gaaaagttgctccagctgacttcgcaaaatattgaaatcaagctagtgagtgatgtaacagctgattcaaaggtattagaagccttgaaattaaagggcaaatgaattaacagggatgcaggaggctttttctgaaggacttttccccactctctgcactggaagacacgagaactacactaaaataatgttccaggcaaagccttctgttaacaacatgcctctctgtgaggtgtgtgatgaggatctctgggccagcatagcccttccttgaaaggaagttggacaccaacagcttcaagaacggcaaggagcacagcaggttcctactccagcttgcgatgtgatcattgcctgaagcttcttctcttgttaattagagaacctgattcttctaaagtgtctccactctcctttataacatacagacacatgctttccctccttctcccccaaatcctgatactctcatattcttcttaccattcccttcctttccatggcccaggagcatttcccatttgaaatttctgagtttctcagactgaatgaagact

SEQ ID NO: 196798 - DNA, 350 bp, Homo sapiens
aataacagtaatatccccatctcaaattctaactttcaactccagttttgctccctacgtcacaccttggatatgaattcacatgatctacatcagtgcgatggctaggaaagtatatatttttgaagcaaatggagtaactagttaatgtcagtcactctgttgttttattagtgattcacattcttccatgatcccatagtttatattcggcttttcaactctttcacttttctcctgccaagcattttatgtctcaccctatccttaacatacacacacacacacacacacacacacacacccctacctgttttacagatactatccagttttatcatagaattgtg

SEQ ID NO: 196799 - DNA, 627 bp, Homo sapiens
ccatgcctggcctaggttgtatatacaattcttacatgaggttacatatacagatttacaagtctaaggcaattaatcattcattttgagcaactaacacttaagcactattatcaaaggaacttacaacatacagtgaaaataattttagcaggatttgatatcaactaacaggcatatgtagcaactgaccaaattcaaagactcagttggagctatcaaccaatctgaaagatcagttccagaaaacatgcaaatggcttgctaagcagaataatttttaaaatatactcctgttggcatagtgcttgcatcttataatttccctaggacttgttgagcaccaattattcaccaggctcacttcttggaagtgtcacacctttaattcattttttgatctcccaaaaattgttcacagtaggtttcaacatatgcttgatgaatttaatctgattacttgtagagctctacacattttaattcagtgactttctaaggtcactgctctagctcaaatcagagcggacattctgtgaactgaaccctactataagccaggcaccatgcagcagtgtgatgatggatggggatgtggtaacccaaggcagatgtggtaagagggac

SEQ ID NO: 196800 - DNA, 469 bp, Homo sapiens
gtttgcttctttgttttagtttgtttaagtttctaagtacttattactaatgaaaccccaaagtttttgtcaagtatagacatctcctttcaggctgttcagaaagcctgtggtgtcctaccaacttcaccctcctgggaagctcttctgaaccctagagtcctgtgcataaccatttgggaaaatcccttcatctctctcctgggttaaggtccccttgccttcttcctcatttcacccctatgttttgatagagcacatcccccagtagctttctgagaaaaggtgcatttggggccgtgatacttgaatacctggaaaagtcttttctacccttgcagttgattgataggttggctgggtataggttttaggttagaaatcattttcctttagaattttgaaaacactgctccattgctttaaaaaatgttgcaactgagaaacataaagccagcttgatttctgt

SEQ ID NO: 196801 - DNA, 516 bp, Homo sapiens
tcacactaagcactcacattattgactcctagaccgagtacgcctcattctaagctgtaatcggaggacaatcagtatgctacccttttaccatcattggacaaggtagcatccgtactatactacacaacaatcctaatcctaataccaactatctccctaattgaaatggtcgcccggattggcgaccatttcaatccaatggctaactctttgaaatgtatttaaaattagatagtcatcttttctgcaaaatgaaggactgcacacagtctctgtgtgtctaactctccgaactaggacgtgagaattctcatgagggttctggttgatggccacaaaatggaaaaggcagaagagcttcggtaagtagatatgtaccatcatgtttgtgagtgccctgtttctagaactcttttaaactataaatgattctgtgagctattaagcctctctctaagaatctagcagattcatcctaagcatgtgttgaaatgtcgccattccggggtctct

SEQ ID NO: 196802 - DNA, 301 bp, Homo sapiens
agtagctgggattacaggcatgcaccaccacgcccggctaattttgtattttcagtagggacagggtttctccatgttggtcaggctggtctcgaactcccgacctcaggtgatccgcccgcctcggcctcccaaagtgctgggattacaggcgtgagcacctggccaagatggtaaattttgttatgtgtatattaccataattttttaaaaaggctccatgaaattatctatgtacataggtatctagcctatatcccacagtcattcactccaatactttattctctaccccattctg

SEQ ID NO: 196803 - DNA, 659 bp, Homo sapiens
taagactcagcgagagcaaacagggcttggatcagtagcaggatgcaggtgagaaggaaggcaggctggcagcatccctgaggcagtggtgagctggcacacagctcagagtggagtgtgaggtggagagacctggagcgcaggcttcccgagaggagccctctgttgtcactgtcttttcaactgtaagcacgagtgcctgtgcagacacactgagacctccataatcatcatttaattgttgcacctgccctttaaaacgctgagaccaaggaaagaaaacacaacaaaatagctaacagacattggtgtgtgaggttctgcagaggggcactctttgagtgtttatgaataaagtatcagcgaagtacactccaggtgggaaccccagtcagggtcaggtgaaatttgttccataatcttgttatttcacaatcagggaaaatgttgtcttagaaccctgaagtgagacgttgcaatcacaaaagagaaaagagtagaaggagagttgccaggatgaggacagtgatgaaatctgaggttataggtaggcaatggtttagattttagatccacgctacccaacctgtggacttaagaattattgcaagagacctccacatccctatggatactaaacattgagtataaactaagca

SEQ ID NO: 196804 - DNA, 283 bp, Homo sapiens
gttgtgcagcacagaaatattttattcaacaaactctgcagactcctgaactttaggggtgggctgccttctgcctggtgctctgcacagatcctggagctctcgtggtcatttatgtgcagtgaagctgctccactcacctacagcttgtccttttccagagaatccctatcatcctcccctcatcccaaggaatgcaacaaaggaaaattaatagtgaatgcttttgccggagacctgtggatacttaatttttatagatactcaataaatatttatttat

SEQ ID NO: 196805 - DNA, 548 bp, Homo sapiens
caggtagttacgtttcttctctagcattacttatatgatatgtctccatacccattcaatcccctcatttatgattggtgcattttgtcaggtttaagaagtcttttctctcccataagaacgtgaagaaaacatattctcctatgttttatagaccataggttggcaaacttttttctgtaaaggactaaatagtaaacattttaagctttgtggaccacagatagtctctgctacatattcatcttaaaaaaaaaaaaagaataacctttagaagaaacgcaactaagttgcgtttcttctaactgtgtggttttttattatgccttgcaagtttttgttgagggctggtcatgctcaaccagtaaatggactttctgtgtgaagttttatgttggtctggttaggggttgtgccatgtgtgctgtttgttaaccggaggtgtcagaggcttaaacctcctctagtgtcttagtttttgtctccctgttgtctttacggtatcctagagatttctcgaataagctctgagatgagcagttctttca

SEQ ID NO: 196806 - DNA, 483 bp, Homo sapiens
tctcacagcatccacaggaccccccaaaacccctgcccaatcctgggtctgagtccctcctctgaatacacaaggcctgaagacacagcgttcagaggaaggagctcagacctccccgatcaaatggtatcttctttgaaagaatatggcgccacatttggggttgtcaactgcggccaggtcagtacgtcttcactttgatcaattgcggccagatcaatacgtctgcactctgattcccacgtgtctatgcctccctgctcctcaatgcagggccctggatgaaaggagtgagtgctgagttttgtctaaatccaatccttgcaagagtcactgaaagtagcattataaattgtttgcaagaggcctttgacactgaaaacttggccatgtgactgttgtccaaaaatcctgctttcacatctatgagttgcttatttctaaacttttttggtgagaataaagttatctaatactcaatga

SEQ ID NO: 196807 - DNA, 654 bp, Homo sapiens
ggataggaaatctgtttgagctactctgcgtcagcactttgagcttgctggtatatgtatatattgatggctggtgtagatatattgccatctaatgctcagaacacacttgtattgcaagaaaatatttttttgcttgtttttttgagacatagtcttgctctgttgcccaggctggagtgcagtggtgatcttggctcactacaacctccgtctcccgagttcaagtgattctggagcctcccaagtagctgggactacaggtgcatgccaccatgcccagctaatttttgtatttttagcagagatggggtttcactatattggccaggctggtctcaaactcctgacctcgtgatccacccaccttggcctcccaaagtgcagagattacaggcatgagccactgcacctggcctcaagaaaaattatatatcacgtggaataggatagtagtctctgcactgattttcgttgataatggctgttcttcttatcaccattttgctatttctttgtctgggctattacagggttattacagaaatttccagaaagacccctgcctgtcgaatgtttacttcaagcttgagctcctggtatattatgaggaaattatatgataccccaggagaggtcttcctttcccatgcc

SEQ ID NO: 196808 - DNA, 395 bp, Homo sapiens
ctaaaatgttagaatcagagaagaccttaaaaatcatgttcagttttctcattttccaagtgaggaggccaagacccataggtgaagtaattgagatctcggcaaaaaactcttaattcagaaagcccccttttttgaccttcagtaggacttttcacctttgggttctaatgcgaactctgaattctgagataacaaaaaaagtttcacacacagtgctgatgtatagtaaatgtcttttggtggtgcctgaaaatataaaatgataaaaattggccctggcctgctggctcacacctgtaatcccggcaatttgggaggccaaggcaggtggattgtttgagctcaggaattcaagactaacctgggcaacatggtgaaaccctgcctctaca

SEQ ID NO: 196809 - DNA, 917 bp, Homo sapiens
gtacagacatgttcttagtcatttgcaggttactgctatgttcagatattgctctcttgaagttaaaacttgttcatgtagtaaagtgttactctattaaacttgatttctgtaaccattcaagtgttgttttatcaccacaagagtcatgattagaatttttcccctttttttcctttctttcaatgctcctttatgattttaccctagaagagtttccttaatagattccttgctctagtactggttaaggcatatttaccaaacttaacacctagcaagcttgtccaacctgccttattttgctgttgttcttctgttttgttttgttttaggctttcagcagcctgaagccatggtttttagtttctgtctctagtgataaaacggaaagagggatgaggaaggggctttactggcccatccagaaacagaaactaagaacccatgactgtattctctcccttgaacaactgtaactagagcaaacctctttgccaatttaactggcatactaaaataatgaaattgtgagaatttcctttgagattagtaactgtaccatccatatacaaaacactatattgctttgctgaaacctgaaagtgagcaaactgatagaaatgcatataacaggccgggcgtagtggctcacgcctgtaatcccagcactttgggagaccgaggtgggcggttcaggaggtcaggagatcaagaccattctggctaacacggtgaaaccccgtctctgctaaaaatagaaaaaattagccgagtgtggtggcgggtgcctgtagtcccagctgctggggaggctgaggcaggagaatggcatgaacccaggaggtggagcttgcagtgagccgagatcgcgccactgcactccagcctgggcacagagcgagactccgtctcaa

SEQ ID NO: 196810 - DNA, 681 bp, Homo sapiens
ccacatgtatttgctaccatttctaggttaggaacaaaaggaggtaaatagtgcatctagatcttctctgtaacataaataatgaagtcataattaaggagtattagctctttaatacaataaaacatttttaatgtttgtaagaactacaagcctaaatctactcgggtgccttctcaataaaatttaccaaattccacatttctacttcttttcttagaaaaccctttcatctactcctgactgtcctgcttcaggtcttttccaagctccattaattacttgcactttttcccttctcttgctttacaaatttggcgtctagagctgccaaagccatatcctaatttcttcagagattctggatttggtgaaaacattgcaatctagctccattgttttattattcaaactttcttggcaaggatcttatggatggatacgtccgattaatctctgaaacatgaagccctctttcaaagtagttttgcatcttttgttcaaaccaccagttattttgacaaatttccttagtcttctctctgtttgatggtaacaaccctctggcatattctttaggaaggagttgttaggacagtagtccctgagttctcgtaggattaaaacttttttttcgataactttgatacttgaaagacagatgggctggatttaaaattc

SEQ ID NO: 196811 - DNA, 208 bp, Homo sapiens
agaattaatcaatagtttgcaattattatggagagtgggacagtagttagacaatagccaagacccatctagctagcaacaaagtctttctttctctctcttcacatggtaccaaaaaactgaattctgctttatggtttttttggcgatacctttcttttacccgctggggtagggtttttcttccaatcccaatctttataaatat

SEQ ID NO: 196812 - DNA, 453 bp, Homo sapiens
atatataaaggactgggatgaatttgataattgtttgagatttcaggcttcatgatacaatttattggctatggatagccttgtaaaaaaagatgtccaagttctttttctgcatggtgcatttgacttctttttgatttagagaagtaatttttaaaaatcaaataatttggccggacgcagtggctcacacctgtaatcccagcagtttgggaggccgaagcgggcggatcacgaggtcaggagatggagaccaccctggccaacatggtgaaaccccgtctccactaaaaatacaaaaattagctgggcgtggtggtgcacgtctgtagtcccagctgcttggcaggctgaggcaggagaatcgcttgaacccgggaggcggaggttgcagtgagccgagattgcaccattgctctccagcctgggcaacagagcgagactccatctcaa

SEQ ID NO: 196813 - DNA, 201 bp, Homo sapiens
gatggcccatgcctgtaatcccagcactttgagaggacaaggagggtggatcatgggaggtcaggtgtttataggtatggcgtttccttttgaggaaacgttgccagagacgaggagagggtaagactacaaagtgatagcatgagattaaagtgatgaaactgttttatattcagatggtggtgttggttatgcaaatca

SEQ ID NO: 196814 - DNA, 405 bp, Homo sapiens
ttataataagaggacacagaattaaaagctgaaaactagatatttttctagcttgagttacaatgttactttgagattataaatgtcattacagtcacgcctagtactcgcccaaatctgattgcggaagcttaaggagactaaacacccttgcccttttgctgtggtggagacttttgactagttctagccaatggacggagatgtgtacaacgtcaagcttagctgtgaaaagcccacacacatttctccagtttttcttccctcacttgattgaataggagcccacttgtttccaatagtccaggtaatagttacagcatcctattgacctggaataacaagttgctgtacagaggacagttgccttgtggggtgggggtggtcttgacaatcagtggacat

SEQ ID NO: 196815 - DNA, 423 bp, Homo sapiens
atggcagccaaatttcaagatgagttttgaaggggacagacatgtaagccatagcaatcacattttcataaacactgtctttccatatagcaaggaagcatagcaaagtaagaacttaaaggcttattttccttgctgctgaatttaatatcatgtgttataattcagagacatgtaaggtacagtttaaaaacagccaataagttttttagagacccactgagtacctagcactgtggtaggtcttatgcgggattcaaaagcttaaaataaaaacaaaccatttaagcatcagacttggactctgttcattaaaatgcaaagagagctgagtttaagagcttggtaacttgggttttaagaggaataaagcactgcagatattatcatgcaaatttgaacttgaatttggtcctagaaata

SEQ ID NO: 196816 - DNA, 270 bp, Homo sapiens
gcagacacaatggtaagaatggtgtctgtcctgctgtctctgctgctgcttctgggtcctgctgtcctccaggagacccgagatggtcattactctctgacctatctctacactgggctgtccaggtctggcaaaggcacccacaggctgcagggcactgtcttcctcaatggccatgccttcttccactacaacctgagggggccgacagtgccctccaagacagagacgactgaacttttggggtggagactagcagcagcagcagga

SEQ ID NO: 196817 - DNA, 713 bp, Homo sapiens
gcagacacaatggtaagaatggtgtctgtcctgctgtctctgctgctgcttctgggtcctgctgtcctccaggagacccgagatggtcattactctctgacctatctctacactgggctgtccaggtctggcaaaggcacccacaggctgcagggcactgtcttcctcaatggccatgccttcttccactacaacagtgaagacaggaaggctgagcccctgggaccatggagacatgcggaaggagtagaggactgggagaagcagagccaagttcagaaggccagggaggacatctttatggagaccctgaacaacatcatggagtattacaacgacggtaacggatgtgtggcaggttcctgaggtggtggctgctggcggaggagagctggcactccacccccgtggggcgcctcctgtttcccgtgctcctgggattccgccttgtgctgctggctgccagtgggcctggagtctatggcgatgagcagagtgaattcgtgtgtcacacccagcagccgggctgcaaggctgcctgcttcgatgccttccacccgctctccccgctgcgtttctgggtcttccaggtcatcttggtggctgtacctagcgtcctctacatgggtttcactctgtatcacgtgatctggcactgggaagaatcatgaaaggggacggaggaagaggacaccctgatccagggaggggag

SEQ ID NO: 196818 - DNA, 499 bp, Homo sapiens
ccaaggattggatccggagtaccaggggcagagagggggagcagaggaaagaaaggagatgtgaggagtttccacctaaagcacttcactcctcgtgttcttccccgacagagatagctgtgtggttcttccttacgcgtgggtgcaggtgtgcgcgcttggggtgagcccatggttgtgctcgagtatacgggcgcctgtgcacctccagggcaatggtaaagcctggcagagctctttttggaacaaaatgaaggagctccatatccacggaggccacccgtatgggcctttgccaagtagggcagaagaagcccttgttagccagcttccctttgcaacttcctactcttcctttgggtacagactggtgtctgggctagctaggatcacagctgagagcgaaggtgctctcagtgtccgaagaccacgtgctggtgaacccacaatgagaagcgaaagggtttcaggactctagcagaaaggaagagcaagattt

SEQ ID NO: 196819 - DNA, 405 bp, Homo sapiens
catccagatttgttttaggagctataattgaacacatcagaaaggattgttttgttactcttatgcattattccattaatggaaaaacccattttttgtatcctgaacttcaaaaggtggttggagagcaatgaaaagggtaatttcaaaaataaagtagaaaagatattccaacaaattatccactctttcctacccagtcttcttgcaggaatgcttcagtgtttgaaagggtgaagaaaagaggattcctggctgggcgtggtggctcatgcctgtaatcccagcactttgggaggccaaggcgggtggatcaccaggtcagaagatcaagatcatcctggccaacatggtgaaaccacgtctctaccaaaaaaaaacaaaaaaaatagccgggcgtggtga

SEQ ID NO: 196820 - DNA, 474 bp, Homo sapiens
tgactctctttgggggtagttctggatttgggagggctgcactctcttttgagaaccccttcttagtccatggtgaagtcataaaaggctctttggttttggttgagtcacttagtaggtactttcagtttaaaacaagaaaaaggtaaatgtatatgtttttctcttgttaatctgtgttttcttgtagtgctctcagccacgaaccttgagataggtgaggaaaatatattatttttcctcccttacattgagcaagatgctgtctgttctctgcaactcctaattgttctctcttcacctccattgtctgccacgaaaaaaaaaatgctacattgttcacacattaaaatggatcactcaaaagtgtctgaaaaaagcaagaggaaaacatatcctaattccaaatgtcaaaaattaagtggctcctccttgagactacctttttgaccccaagaaacaataagagagtgc

SEQ ID NO: 196821 - DNA, 515 bp, Homo sapiens
gtgagacgactgaatagaacggtagaaaaaaggaaataattagccaatattacatagaaacccctttaatttgatcttgatatacacacacacacacacacacacaaaagcaataaagccgccagttttgctgataaggataagttcctgttttctcctctgaagacatttaatattcaatcaaggacagccacagagccaagcagatcatagcgtaactccaaagatatggcatgtcatcaccctgctgccctttgaaccaaatggggttttgcagtctctctcctttcttcctgaaaaccattcaacgtgtccccagaatctgagctcctcagcctgaaacactaatgtgtgtgaaaaggattggtttggcctatctttcccgtgcaaactggtatgaattttaaaacaaaaacataagaacaaaggaaatagtttttgaatttaatcagtctgaagttagcctttgaccatttgatacattccacaataaaaaggaagtttaaggggaaggc

SEQ ID NO: 196822 - DNA, 484 bp, Homo sapiens
gcctgtaatcccagcactttgggagactgaggtgggtggatcacttaaggtcaggagttcgagaccagcctgaccaacatggtgaaactgcatctgtactaaaaatacaaaaattagctgggcttggtggtgggtgcttgtaaccccagctactcaggaggctgaggcaggggaatcatttgaacctgggaggcagaggttgcagtgagctgagatcgctgcactgcaccccagcctgggcaacagagtgagactccatctcaaaaaaaaattgccaagaaagacattactattctctattccagtaaaaagccaacactaaaattactactctacaaagcgtgcacacgcacacacacacacacactcccacatcctaaaagacaataatattttcatttataataaagtaatttttcaacttttgaaataaaattaatacaattatattttgcctttatgctcatttatctggggacagatg

SEQ ID NO: 196823 - DNA, 747 bp, Homo sapiens
aattatgcttgaagaaggttaatcttataatggcatgcagagcggagctgggcaaggccagaggctaaatatggagccagaaagatactgcagaaagtgagcaaaaaggatgagtggatggcctggggtggaatccgtgaaaaagggcagattgtcagtctcaggaaatcaacaggactgagttctaacttcagctgggctactatgccctggggaatcagaagattctccctaacattggagtccaaagaagaggagccaccatctccttaactacaaaacaactgagagaagaaatgtctccctttagtgccagtgaagagttttgcttctctagaacaactgtttatttttgatcttatgaaacgcgtgacacttgtaactgatttgccttctttttgcttgctgctagaaatctcagaaccaaattcgaggtcatttctgaatgtgctggactacacagcatgaattctgtgtcctctcacctcattcatagatacatttttttattcctacccatcttttcctttccccagattttcctattgctcttttatcatcttgagtaaagaaggttaaactatgaataaaaagtacaatctcaatgacgagtcagggaaaagtaagttttggacttccatttagagccatttataggtcagcaatcttttgtctctgtgtcttctttctgccctgaacaaccaaggcatcctagtcagtctctcttcatctgcataccactttaaa

SEQ ID NO: 196824 - DNA, 595 bp, Homo sapiens
cttcaataataaaaagagggacaggggttacaaagaaatgagtggggccagtctcactgccaacttttagtatcccaatatcttcaataactttggatttattatttagggaatttgagagacgtgagttttagctgggttctgatgagaatgcagccagtggaactcggagggcaggaccagggccggtgcatagaagacgctcagaggaagattctgccttcaatatgagggagaacttactaattaagaggtgtgcagaaatgggatgggcagcatggggagagaggaacttatgccaaagcggggtgattcctgatcaggtatgttttaaaagtgttggagagaggtcaaacaaggtgacctgggagatggatgcaaccccgggaacttaggattccttgcacacagtggagcttcctgggtaagtatacatgtcttatccttagaactcactgtccagtctctcttaaggatccttctccccttgaggccatggatcctgtgatagttatctaccgctacatcacaaattcccccagagcatagtggcttaaaacagtaaccatttggtatcttaccatattttgtgggt

SEQ ID NO: 196825 - DNA, 418 bp, Homo sapiens
agcaaccagcaatatagcaaacagaagaaaaaacatacggctaggtgcgaggctcgcgtgttaatcggccgagggacattagagggtgatgtccaatagatagagatgcacatctgaagctaaggaggagcactgagctggggtgtatgtttggaggccgtcagcctgtagagatggtactttactcatgagaacagagccaggaattcgagaccagcctgaccaacatggtaaaacctcatctctactaaaaatacaaaaattagctgggcgtggtggcacatgcctataatcccagctacttgggaggctgaggaacaagaattgcttgaacctaggaggcagaggctgcggtgaaccaagatcgtaccactgcactccagcctgcgagacggacagaggctgtctcaaaaaaaaa

SEQ ID NO: 196826 - DNA, 255 bp, Homo sapiens
agcaaccagcaatatagcaaacagaagaaaaaacatacggctaggtgcgaggctcgcgtgttaatcggccgagggacattagagggtgatgtccaatagatagagatgcacatctgaagctaaggaggagcactgagctggggtgtatgtttggaggccgtcagcctgtagagatggtactttactcatgagaacagagttacaaaacaatggtcgaaccgaggggttcacaagatcagctgggacctatccact

SEQ ID NO: 196827 - DNA, 256 bp, Homo sapiens
tctgagacaggatctcactctgtcgcccaggctggagtgcagtggtgcgatctcagctcactgcaacctctgcctcccaggttcaagcggttctcttgcctcagcctcccaagtagctgggattacaggtgtatgccaccacgcccagctaatttttgtgttttcagtagagatggggtttcaccatgttggccaggctgtttttccttttttcagaaattggttccaaaatttatatggacatacaaaggaccta

SEQ ID NO: 196828 - DNA, 363 bp, Homo sapiens
agtctccatgcaggctaagagagaaaaggactggcccagcactatagggcctgagtaactgggtgaatcatgaatttactgagacagagaactgtgggagaggtctgatttggggggaacagccagcattcaggttttacaggttacacgggaaatgccgattgagaggtgggcaggcaggcggacacaagcatgtggcaatggtggcccaggtctgggctggagaggaggagttgggagtctcaggctagatcacggggtgacctagggccatggggtggggccagatgggtcacccaaggagggaagattgagaggaggccagagcctgagagtgctccgatgcttgcaggggaggaagat

SEQ ID NO: 196829 - DNA, 756 bp, Homo sapiens
aaaatggtacagtcacttcaaaaagtttggcagtttcttaaaaatatgtttaccagatgaccaagcaattttgctctaaggtattaatccaagaaaaaagaaaacgcatgtctacacaaagatttataagcaattgttcacagcagcttcaattttaacaacccagaactgtaaagaacttaaatatcaatcagctggtaaatgtatacacaggttgtgatagatacatacacagattatttttcttcaataaaaaggaactactgctaaacgcatgaatgaattttagtatttccaataggctaagtgaaagaagccaaatacataagactacaaactctatcattccacttatatgcatctagaaacagcaaaacttagaaagcaaatcagtgcttgccaggtcccaggggataggcggaagaggattaactgcaaaaaggcaaaaggaaactttctggagagatggaaatgtcctttatgatgtttgctgtggtggttacatgagcatatacacttgtcaaatctcatcaaattgtatatttataagtgatgaatttcactgtatgtcaattttacctcaaagctgacaaaaacatattctcgcacaagtttgaagtaccttcaaaatgctccactattactcattaagaggataaagatgctttctctgagaactggatgaagcaactgagtttatccatcaaatatctgccaaatggtttctgtttccattttatacagccatatattagg

SEQ ID NO: 196830 - DNA, 310 bp, Homo sapiens
agattctctgaaaggtaagttttgaaatatggtcagttcgtgtttagctgaacagaagatgggtggactgcagctggcaaactcagaaagcactgctgggtagcaggtgatcaaaaaaaaaacaaaaaaaaaggcaagtccctgggcaaatggtgtagccaaaggtgatcattataactagagacttgttacataattacttgttaactcctgacaaacagatacacagctacaaaatgccatggttaccctagccattgaagctaatgtagctggtgcaagagtcaaggtgtctccccttacatcgatt

SEQ ID NO: 196831 - DNA, 531 bp, Homo sapiens
tttatttttacaaaacggaagtcattctgtacatactgttttgtaatcaaaatttttctttttgatatatcatgaacattttgcccatcatgaaatatccttttaaattgtatgcaattccactgtaaacatgtgggtttatttgacatctttattgttgggcattttatcttgagtgcttagaatggaaactaattaacccaggataggaaggtgctctatcttttattctgaagatgttattaacatagatttccatggatggtgtaatgggcctctagagggtggggccaggtgtggcgatggcccaggagattctcaggggagcctcttccctcaggagccccaggaggcacctttctctgtctccgtggcatttagatccgtggagtatgttcacctgagtgtgacctacaagcttaaggtattaatccatgttcctcccacatggattaatatccgatgtgaaattagtagggaaaaaaagacgtgctccgtggccactgagcccttcccagcgggaggatgcag

SEQ ID NO: 196832 - DNA, 1066 bp, Homo sapiens
tcctatcagattgagttacctgaggtacttgattgtgaggggccatggggatagggttgaaaccctaagacccatccatgtgttgctccttcaccagttatgcaaattttcaacttatttaatgtgatctgaagaggtgagtcttccatctctgggttgcagttagatagggcatgatggtgtacaagtaggtgtcattttgaagagattccatacatattcccataaactcagaacgttttggaaattcccttttgagactgcttttctgagccccacacttactcaacaggcaccaaatcatcctcatgcacctactatgctgcgtgtcaaccggaacatacaaataatttccaccccctcctcacccataagaagctggcagaaaggcaagatccagcctccaaagtagaattcctctttgtttttgaggggtgttgcaggcttgaggaaccccttgtttgcccatctggcttccggtaaccaggctgtcagcagaaatgaaacccacccttggaatgaagactggccactttgttcaagccactgaggacactgtactgtggccccctgacagtgcctgtctgtagggacagctagatcctgctggtcccttcacagtcccagcagtggctgattcacaatggtgactggtagatctgttggggtcgagttgttgagctgatggtaactagctcctttattaaagtaatttccaagggagaaactgcaagagacggcctaagctgcggcagcttccaaggatgagcttttctggacctcaggtttggggggaacccgagaccatttgaatgccagagatgtgatgtgtttggtaatgtcgtgtctcacaagctccttttgtatttcccatgggcagatcaggtcggatcttgactttttccagaacctggcttggctggtttgggttgtgtatgaatgagctggctcgctgggtgtgtgaggggaggtgaagctgggactagacaagccagggctcgttagcaagtttctgctgtgtcaggaatcccagagagaggtttcccaagccctatcctgtcttgcc

SEQ ID NO: 196833 - DNA, 404 bp, Homo sapiens
gtttcaggtcctagtccaacaagaaatacaaattaaccatagcttaaacaagatagaacattctctctctctctctctttccccactcccctcccccatacaggaaatccagagagaggccgtgaacagtgttacttggaccactgagagctagagctatggaaggggtgctacctaaaagagggggcccgccacagctagaaccaggctgctggtatgttcctttagcagaatcttggtgtaagtaaggtaacagggaagcctgggtaaagttgtccactggggtcaactcctagggcacagacaagggcagggagtagatttgggggtgtgtgtgcaaatggagattatccagcataaaagggaaagatgatgaggcaatgttcaatctatataagtagcag

SEQ ID NO: 196834 - DNA, 455 bp, Homo sapiens
catggaaattcggtgctgtgacatactcctcaactttaacctttcttccttgtgcaggatgggatttttttccccagtgcctttgagatgtcctggagaacaggaagcaaaacttccccccagttcttgccctgctgcatcccactcccatgcacagcctggggtagcatattcatgacccagtgaggctgtgtgtcatgacaagctggctagccttttattaatacccaagattattcactcccctttttatttgaaagagccaaataattttaaataccacctataagactgcagctgtccccagaaatggaattctgattgaattcctactgctcctttaagagtcaacttaaatgtcacctttaaataataactgctgacatttacccagagcttactctaagccaggcactttgctaagggcttctcatggatttctcatttcatcttca

SEQ ID NO: 196835 - DNA, 348 bp, Homo sapiens
actgggccaaatgtgaggcttttctagcagtcaagttgtttgggatggcccaagtagaaggcttgggaggtagcgagttcctcttctgtggagatgaggacttgggagggatgtggaggaaactgaattccagatgtgggagggagcctgacaatctgtgattccagtttattgctcatggtctcaactctccccctctacagaggtgacttccgccctggcctgagtttcaatcccacagttccttttttccccccttaaatgagacatatcttgctctgtcacccatgtcagaatgcagtggcacaatcatggctcactacagccttgacctcccccgatcgcctg

SEQ ID NO: 196836 - DNA, 580 bp, Homo sapiens
cagtgtagtcgttatctccctaggatcctcatcttctctatcctctttgccacactagtgcttctttgggttacagagtcaccactacagtcttgtagctagacatgccccttgtgacagagagggggaaagtcccttatggtgataactgtttcagattcattatagttctctacaatggggaggctggcctgtttacccagtaattaaaaataagatttttacgggaaggcacatcctaatcttcgaatttttatctgtcagacatagctcttctataaatatttttaacaggatgttaacagttattaactttttttctgagatgtctcactttgttatctcactttgttgcccagaatggagcaccagtggcaagatcttggctcactgcaaccttctccttcttggttcaagcgatcctcgtgcctcagccacctgagtacctgggattacaggcacctgctaccatgcctggctaatttttgtatttttagtagagatggggttttgccatgttgcccaggctcgtctcgcactcctgacctcaagtgatccctgacctcaagtgatctctcca

SEQ ID NO: 196837 - DNA, 427 bp, Homo sapiens
tatgtaagctgtagccaaagaaacagatcacaggccacactaaaattgtgaacttcatggcaattgctccagtcccacctgctccagatacctaaatcatgaaggcttactagcaaacctgtttctggatatctgctattggataacaaactacggggaaacctagtgacttattaccgtggattattgcccctcgtgtttctttcacaaatggtggaaaacagcaagtggaaaaggctagttcaccaaagcgaaagattataatatgacaatctgaaaggcagcagaaagcagatggaggtcaccagtgtcggtctcaacacttcagctgcactggatgggatcctgttgcatcccccagtgtcacaggaatgtggcaaagaatgttgaaacaatgaacaacaaatatataaaacatttaagtata

SEQ ID NO: 196838 - DNA, 442 bp, Homo sapiens
tccattttttgtggggtttattttttaaataacttgaagaaggactaacagagaaaaagaaaattgagatccacttcgaagataaatgctatctttggcagttcttagcagtatctctctgacctcctagaatggttaccaagtttcctctagccccaaaactgatgctgctgctcagggggcccaggccctgggggaactgctgtggggatcgggggctattcttaaaccagcccttgcttgcccctcactaagttccagatgccctgggagcagccagcagcagaaacacaacccaaaggacacagtttcaaagggcagggaatttggcaaccagccatatgcacagacagaccagcatccccctcctttgcctggtcctgttattatataagtcaaggtaggtttaaggcctccaggaagtcaccactgaagataaatc

SEQ ID NO: 196839 - DNA, 431 bp, Homo sapiens
ttgtatgggtaaactccaatctgatctgaaaaaaatactaataaatatctcaaaagtctgtgagctccatgtgatggagggaaaacaaagcagggaaggggaggttgtaatataaaatagagtggtcagggaaagtctcaatgaaacgctgacatttgatcaaagactcaaaagaggtgaaggaggaacatgaaatatttatctcagggaagagaatttcaggtgtagagaacaggaaataaaagacattgaagttggaaagtatctagcatatttgaaaggtaacaaggaggttactatagttggagcagagtgaagcataaaagacaaaaattgatgagttttattaaacttacatggtaaaacacacacacacaccacagaaaaaaacaaaaacaaaaacaccataactaggccaaaagataaataac

SEQ ID NO: 196840 - DNA, 215 bp, Homo sapiens
ttttctgattatgtttaaccccaaaatttggttgtataccatagcagtttctattttacctggatgttaaaagaaaaaccattggaatctaaagagagatgaataacctcttgagcttagatggagaactaaccagtggcaaatatgtatctagtggggtaaatacatctcaagagattcaaaacgttacaaaacaaggtgtttttaaaaacact

SEQ ID NO: 196841 - DNA, 360 bp, Homo sapiens
ctcaagcttgggcccagaggttgtccagtcccagctaacacactgggagcctcctgttctcacttcaccctaacgggctcctttctccaccctgtgctccttgtccttacctcctcttctgcatctgtggtgagagacagagaggttccacaccccttccccatttggagcctgaggcagccccacctcctgggcccatctgtcccctccagaccctaagacacaagcttcacctccacgattttctcacagcaaacctgctgtcctctcctactgtcctcccccagggagtctttgatccagcttgggccttgagccaaaaagtcattaaaagaaagtacagccaaggagaggaaaaaa

SEQ ID NO: 196842 - DNA, 398 bp, Homo sapiens
ctgtgttacccaggctggcctctaactcctgggttcaagccgccctcccacctcagcctcctaagtagctagggctacaggaatgcaccactgcacccagcttcaatgtggtttgaatttttattactctttttttaatgaatcttttctgatggttaatagccatttgtatttttttctccgtaaattaatactttaagctctttctcatatacgtaaatttttaaaacatgcatactgattgtttatagccatgaacatgcataatgaagggtgggagagaaactctaacctcaattgagaggctgctgctggcaaggatggcaggcgggtgggacagggcagacagcagagacctttagggattatcgatgagggggtaccctttttcttcttta

SEQ ID NO: 196843 - DNA, 417 bp, Homo sapiens
caaaaccacgccaacaatatcagggaactgagatatttccaaacaggatgggtaggtttgcctaggttgtatagcctggggcctaatggcaggagcgcatttgttgacaaagtcaacataaaaaggataaagtaggccgggcgagatggctcacgcctgtaattccattactttgggaggccgaggcgggtggatcatgaggtcaggagatcgagaccatcctgtctaacacagtgaaaccccgtcactactaaaaattaaaaaaaaaatagctgggcatggtggcgggcacctgcactcccagttacttgggaggctgaggcaggagaatggcgtgaatccgggaggcggagcttgcagtgagctgagatcgcgccactgcactccagcctcgacaacagagtgagactccttctc

SEQ ID NO: 196844 - DNA, 601 bp, Homo sapiens
caagaaggaaactaaactgtcaatactgatgttaccaaataatttgaaggatacgtgatttctaatttttgttctttccacttttttaaatgcatggctttcataatcagggaagaggaattaaaaaaaaagcagaggaggccctgagagaagaccaaagtagggggtgagagatgccatcaattcacacgtaaaagctgcagcctctctcaactacgcctgaaccttgttagataagatactttaaaaaggacatttttttttccctaaggagaatgtctacctgaattatagccaagaacaaatttgttatagggaaagaatgcctgataatctgaagaaaacgttttaacctcataaatgtcacacggttaggttgaatttgtagtaaaatgaataggtaaagacttaactgttgaagactttactttctaccctattaacacactgtccatcatagagacaggaggtggggaactgcctgtccttactgtggaaggaggatgaggaagatggtcacatcagatcttcctgttcccaagctcacttcaatctgctaggccagtggcactgaaaccacagtgagttgccatgtcttgga

SEQ ID NO: 196845 - DNA, 534 bp, Homo sapiens
tgagatctgactcaccattccaagcagagggagatatgctggtttctgaaagttgccaagataataatgtgaatatcaaatccaaattcatgaatttgtcccaaaaaggcaccccaaaggaaggcccaggtatattgcaaccatttgaaagctatggcaccccaagtcaagggagtaaaaatatggactatagccaagattcaaaaagcccaggaaaagggaatggggcatctccttcaaatagtaactattcctacagtgttctcaaggaatctgatgcagaaaaccaagttccatgcaacactaataatattggcaacttgggtgaagaagaacccaagtttcatgctcatgaagaaaatagaggacactcagaagtgaattttgactcttcaacagttgtcaaagaaccaggtttgaaagataacatgaatgcagagagaaagagcaaagtaggaaatacctatatcctgaaagcctccttagagccagagaatattaagtcaacacctggggttgccaacaatggctctc

SEQ ID NO: 196846 - DNA, 622 bp, Homo sapiens
tcctttgagctgaatttagaaaaaaatataagaatattgctgagctcttgaaacctgctaaatgcgaatcatcagacacttaaatatgacttgtgctgaaggcccccaagtggagcacaatataattgaaatcaactgtaacaattaacaaaaagagaattcaataaatagtccaacaaaaagtccttgtgagtatcctgccaccgccaaggagggtgtttatatcatcgaacgcaaaatctcattaagccagctagagtctgtactttgaatttccctttttgtggaggtcttctgttcagtgacagcagggtttttccaagacatttttccctgtctttttctcctttaagtatgcatctctaggcagtttaccagtcaattcagtgaaaaatgggaaaaagcagttgtttcaccagattgactgactgattgttaaaacagttggtcccatgacccctctatatgtagacacggacatttgtgtgaacctgaacatggcctcttttatttaaaataaagcaacaggatgtggttttgggtttgactcaaaataacattgtcaagatgggaagagaaaaaatatatatatgcacatatgcattcatctattggattgact

SEQ ID NO: 196847 - DNA, 342 bp, Homo sapiens
cttgtggtgattaagaaggtagattctagacgggactacttgacctcaaatcctggctgcatcatttatgagctgtatgaccttgagcaagtccatcctcttctctggacattgtttatttgtaaaatgggctaatgcaagaacgacgttgaggacctgtagtgcagagctgcaaagtgttcaggttgttccctgcccttgatggcctgatgactagtgtctccttgcctcaaagacaatcatcagttgttttctttgaaggaggtttgagggacctgaagtttccttgaaacacttaaggtctccatttcctcctactttaaagagaatatgtggccatta

SEQ ID NO: 196848 - DNA, 121 bp, Homo sapiens
caggattcttacatagtcaaaaagctccttatagagaagctcggaactttcaatacagctttgccttttttgccattttaattttccatttaatttaaatgtattctctcatttgatcttc

SEQ ID NO: 196849 - DNA, 894 bp, Homo sapiens
actcaagtcccagggtggccgctttcagctcggactgaattacctgcgctcttttcggctggcgggctggcgggcggtgctggtgatgttaactttttatctccagtcatttcaccctctccctggtttggtaactgaagccttctgaaatgaaccagtgtcaggctccagtgaggactccatccccaattcaggaagcacagaggtggagcataatccccccaatttgtttatgtgcggctgacttctctcaagatggtgtgcctgtttgggaaagcttttgtttgcaagacaatgtgaaagaaatccttaaagctcacagactgctgggtggatatgacattctggcccttggttcccccaagaaaacagcaacttgcagatagcaagtcaaacttgtcagcagaatccagggatgttcctcgaggcctgacaagttaagagcaatcatgggaaggcattcagaggaccgcagcagaggatcaggtcaagggaaacctacctcctaaaggaaagatcgagaagaaccatgcgccccaccacccacctgggctgctcagctgggcacagaagcagccaaggatattttcattcggatgctcacatatgactgagttgccacatgaggatgatccgtggcgattttccaccttgaggcaaagcaggacaatgcgtgtaaagaggtttgcagccccgggaccgggttttcagctggtttttctaccccaaagtccaatgcgtgcaggctgtcatcagcaccacagacagcaccagaacccatcataatgtcccagaaggttttattgctaaattagtgtcagagctccagggaacacattcagatatagtcacactgagtcagagctcgagggaagagctgtaagctgggaacca

SEQ ID NO: 196850 - DNA, 350 bp, Homo sapiens
tggtgagacagttttggaatgtaatgatacaagtttatatccttattcagtaagcctcaacccttgaatttatacttccctgtagtataaattcaagctcataagcccatgactttggaatacttctcatggattacctaattttcatttcttatttttttacacatttgtttattcaacaaacatttttgcttactacctctacagtagaatacagtaaatggacacgaagcaaatacctagtgctgcagatagctagtgccagggtgtgtgttggatgctagaagagtaagataattaaagtagaagagattgctttgtgaaaagaccattgcaggacagtgtgatga

SEQ ID NO: 196851 - DNA, 437 bp, Homo sapiens
gcaacatggatggaacaggagactattctcctaaacgaatcaacacaagaacagaaaaccaaacactgcatgttcttacttacaagtgggagctaaatgctaagaacccatgaacacaaagaagggaacaaaagacaccggggcctacttgagggtggactgtgggaggagggtgaggactgaaaaatacgtgctgcagttattacctgggtgaccgaagaatctgcacaccagacccccgcaacacgcattttacccatgtgacaaatcagcacaggaacctcctaaaaagttggaaaggaaaaaaattcttcaccactgtcttgggcatctgtgatatgaaatgtaaacaagcacaaaaatggctgatgagcccacagagtgcagcccggatgggaccacctgtgagactctcagacctgtccagttccacagtc

SEQ ID NO: 196852 - DNA, 569 bp, Homo sapiens
gcacacctcatatctgacagatgactagtatttagaatatataaggaatatttgaaactcgacagtaaaaacatcaaaccatccaattagaaaatgagcaaaaaacatgaggcatctcaacaaagaagatatacacatggcaggtaagcacgtgaaaagacgttcaacatcatttctcaataggggaatataaattaaagtcacagtgagatatcgctatatcctattggaatggttagaaatttttaaaaagtgacaacaccaaatgtggagaaccagattattcactgattgctgatgggaatataaaatggtacagccactctggaaacacagtctggcagtttcttaaaaatgaaatgtgcacctgccatatgaccaaacaattgtactcctgggcatttgtccaagagaaattaaatcttatgtttgcataaaaacctgtacctgaatgtttttaacagttttattcataatcaccgaaaactggaacccacccagatgttcttcatcaggtatattgttaaacaaattgtagtatatccatgctatggactatattactcaac

SEQ ID NO: 196853 - DNA, 409 bp, Homo sapiens
ggcatcaagcaaacctacctcaccatcccaagtagctgggactacagtcaggcaccaccacacctagctaattattttaaaaaattttagagaccagagggtgggaggtggggtgccctcactatgttgctcaggctggtctcgaactcctggcctcaagcaatcctcccaccttaccctcccaagtagctgggattacaggcacaagcaagggttgactaattttttaactcctaaaaatatactcagtcctatgatagcatagagtttaatatattaaggaccttaaaatcttgttgaatattcaagcatcaatctataagcttggtcagttcagggctagcatagtatgttgctattacaatgggatgtattcatacatatagataggaatgaggcctattacaga

SEQ ID NO: 196854 - DNA, 474 bp, Homo sapiens
tgtggcacccaccactgtgttatgacatgcagacaagggtcctcactaagtgcctgtggcctgacagattgtggctctgaggtcagtgcagtcgtggccatttagagatggttactgaaagttaataattggtggttcctgcctaaaaatcccaccacatactacaatccctttgaattttcaagaaatatttgatccattagggatatcagaagcctttggtgagccagacatggtggctcatgcctgtaatcccaacactttgggaggccaagagggaaggatcacttgagcccaggagtccaagaccagcctgggcaacatagtgagatcctatatctacaaaaaataaaatgaaataaaaatattaggctgggcacagtggcttacacctgtaatcctagctctttgggaggccaagatgggcggatcacgaggtcaggagattgagaccatcctggctggctaacatgg

SEQ ID NO: 196855 - DNA, 515 bp, Homo sapiens
ctgctctctcaccctgctctctcactacttgggatagcagctcactgcaacctcgaactcctgggctcaagggatctttccatctcagcctcccaagtagctgggagtacaggcacacatcaccacacccacctaatttttttatagagagggtctcaccatcttgcttgggcgggtctcaaactcctgggctcaagcaatcctcctgcctcagtctcccaaagtgttgggattacagacgtaagtcaccacacccagctaatttttgtatttttagtaggtttagctcttgccaggctgaggtgggaggatcacttgagttcggagttcaagaccaggctgggcaacatggcaaaaccccacttctacaaaacaaacaaacaaaaaaacacacacacaaaaacaagcgtttcttcagcccaagaatcatttccagtattaagataaatatttgccaggcgcggtggctcacgcctgtaatcccaggactttgggaagctgaggcaggcggatca

SEQ ID NO: 196856 - DNA, 421 bp, Homo sapiens
tagttaggctaaaaaatgacttgacagggtaaaccagccaaaaacatacctgaaatgcagcctaagagactgctctggactctttattaaggctacaaactaaacttaagccgagttttcactgttttctttgcaaaaagcagaagtgtgtatgtggaagctcgggggagagcaggaaattcccgatgataatcttttatttttctccttatttggataagtctttgtgtttgtgcggggatttagggggagtgctagggagtgggaaaggagaggtagaatgggaagaatttgaacaacttttcgctgtcttaaagcatttagaacactgttaatctcaccccttgtaacttaataaactaaatgtattccctcttttacattcatggcattaaaaagtatttgaggttcaactgtgaaa

SEQ ID NO: 196857 - DNA, 681 bp, Homo sapiens
ctaatcttgaacacttcagcaaatgaaactatcaaacagttgctccagctagaaagccaggagtcctccctggtctggtccttcccttttcctcttccctttcactctcccacagctatttttaaaatgaactaaaaagtccattcaagaaagaaatgtgaagtttcaagttcactcacttttcctcatctccacaaacatgcccttagcccagagcacactcatctcctgtctggatagactacaagtagcctcctaccacttctgctgctcctctccagtccactctccatgtaaccagagaacatctttcacaaatgtcaatcagggaacttcactctctggcttaaaacccttcaacaacttcccatttcacttaaaactcaaactccttaccacagtctacaagacctgcacaatcttatttctactcacgctctaaccccaacattctagccaacaccgcctcctctcaactgctaggaacaaggtgctttacaccttagagccttaaacacacatcattcttttctgatgtctcaaatgccttattctgttccttagagctttcagatttctgcttataatgtcatctcaggcaaacctaccctcatccctagccacaatccaagtgggtcctttctgtaacacctctgaagcacttcatatataatcccagca

SEQ ID NO: 196858 - DNA, 530 bp, Homo sapiens
gggtgcatttgttgggatagtgcgtttgttttgatatgaggagtttattcctcatgtgaacataggtctagcagcaggaaggcagaaggcactgtgataccagtctcgggctgtagagtgatgggagagcaagaaaaataggccagagaaatagcacaaggggccttgccatctgtattgagcgatttggtgtttttaatgcttaggggatgggccgtgaggttgatagaaaattgtccttgttggctgggcacggtgggtcacgcctgtaatcccagcactttgggaggccaaggcgggcggatcacgaggtcaggagatcgagaccatcctggctaacacggttgaaaccccgtctctactaaaaatacaaaaaatttagccaggcatggtggcaggcgcctgtagtctcagctactcgggaggctgaggcaggagaatggcgtaaaactgggaggcggagcttgcagtgagctgagatgtcactactgcattccagcctaggcaacagagagagactccatctcaaa

SEQ ID NO: 196859 - DNA, 303 bp, Homo sapiens
cctctcacttctgcctaggttgctaggctcagactagacagtttaagtcggcataaggcataaatgctaaaatgttaataatggattagtgatactggcacttttttttatcctactagaataacttactaacctaaagaaatgtccgatatatttacaggatttgagtgaagattcttttaatccaagtgtcccttcttttccagggtgccgatttatttcatacattctttatattaatccatgaaattagcacaatatgtttacccacaatggtgccgtcaccccaaacctcttaccttt

SEQ ID NO: 196860 - DNA, 638 bp, Homo sapiens
cgtacatgcggtctgttgttgactgaaacatcattaaagcagcacataactgtatgttcatttacacttaaataaacacggacagggtaattcattagagaagacccaaattgtaataactttgtttcttgatccaatgccttttaggtataaaaccactgtgaaaaatcatataaacaggttttgactaacaattcataataaatgacattgctagatacctcaacgcaatgttttcagagctgttcaagagctcagttttcctagttctctctcactggaattttaacttatcgggcagttggccactcttcttacccagcattatttatattctgttaaaacaaaatatactgttgcataattttgaaagcaaaacatcaaatacaaaatggctctatttgtgatgtgaaagcatctgatacaatttcgtctagtatatgaggaatgttccttagtaaagacccaggaaaagtacaatgttcaatgaaagcatacgttcaatttcaaacgtcacatgttcgtcaactccaaagtatctgtgctaatgagggaagcagcagcaaaggcactccccacgtgtctgccatactcactcttaacaagggtgtcgcgttttgcaactactttcaaacaca

SEQ ID NO: 196861 - DNA, 654 bp, Homo sapiens
cctggcctgtagcttcaggagatgaccctaaacctccagaagagggatggggatttgtacttgcagcagtaagtccattgtgctcaccccagtgccaccacccccgaccccactgcccagcaggggcacaggaaaggtcaccctggagaggaactgtcccaagaaaggccaacttgcccacagccattcccacacagcagcagggcctacagaggcttcctcctggggcttccgcagagctccatgttctgggcttctcctccatcctcccctactgccgactctcctcaagctcttgccccagaggccaggcccagggtccacactcaggcaggataaggcaggtcagacctcttcttggatccactcttgaagatgagatgctgctcccagtatcctctccaccgagtcctctagagttctgctaaatgtaactgcagggcagcagagtggaaacagcacgggctttagagcgcagctgagcaggctcagacctcactttgcctttgactggatgggtggtcttgggcaagtcacctaatctccctgagccccagttactcatctgtaaaatgggtgttaatactacacaccttgctgagagactgtgaaggttaaatgaaataacgtgtacagatatgttcttgtgggtat

SEQ ID NO: 196862 - DNA, 350 bp, Homo sapiens
tgctgggattacaggcgtgagccaccgcacctagccaggccagttcagggatcctcttccaggacctccaaagggctgtcctccaggccacaactggggatggttccgactcttggtgaattcctcctgtattgcactgctgcgtctgtctgactctagagtgttttggggtgcgcgggaatatgtctgattcttctccgtgtgactcaccctcagtccttggagggagtcttctggttccctcttcttcttgtcttctctaaggcctcccaactcctttggccaccttccctcctgtttctaagactctcaatgttctcatctccctcatctaaaaaatgacactcctt

SEQ ID NO: 196863 - DNA, 680 bp, Homo sapiens
agcaatgactgtgaaacaaaatggggggaaaaaacccaagaattaattgcaataaaagaacttgtcccagataactctaaggatgaagtttttcaaattatcaaaaaccataatttccatattatttaaatggctcaataatgagtgcaatggtgagcatttattaagcacttactatgtgcctgctactttgctaaatggctcaaaaacactatcatttaatgttaacaattatatgaggtggttttctccaaattacaagtcagaaaaatgaggctaaaaaacacgaccaattgtcagactgggtgtggtggctcacatctgtaatcccagcactttaggaggccaaggcaggcagatcacgaggtcaggagatcgagaccagcctggccaacatggtgaaaccccacctctactaaaaatacaaagattagctgggcgtggtggcgcatgcctgtaatcccagctactcgggaggctgaggcaggagaattgcctgaaccagggagtcagagattgcagtgagccgagatagcaccattgcactccagcctggtgacagagcaagactccatctcaaagaaagaaagaaaaaaaccaacatgaccaatgtctaataaaattgtggagctaagattcaatcctgcctttctacctctaaagttgctcatttaacaact

SEQ ID NO: 196864 - DNA, 838 bp, Homo sapiens
cagaggtcggttcatgcacaagagcccctcaccccagtgtcctgatgaaaagggcattcctcgggtgggattcgggggcacaggctctagaattgctccttcggggcccggaagcactgtctttatggcgtgccttttgcggtgtgtcctctgccgcccaggaggcagcacacagaggctcgggcccagccccagtgaagaacagcagagcctctgcacttacaagggacagagtgaggaggccccagggattccagtcccttctctgccccgaggtgtgctgtgtcccctccatgcggagtaaggcacggggcccaatggctctgggaggccatttgtctccctgtcttccttgtcctcccacaccacagcccacctgtgccccattgtttccatcctagcacctgagaccaagcaccccagcatagccacccagggatggcggggatcagggccagccctcatattcaccctggttcccagtccccaactttcagccccacggcggcccctggggaagcccaggatctctgcatctctctgtacctgatcgtgcagaggtcaggcctggtgaggaggaggcatctcccctcatgccccgcaaaggcagcagcttaagtctgtccctttaaagggaaggggccaagtattcctgggctgatcacaagatctgatagaagggaccctgcatcaggcaggcatcaaccatccagagctgttggctgcctgtgtgtcaggcgccaacgccaaagcctccatgaacctcgtaggtgatggaagcccaggttctctcttttgttccttgtgtcctcgggcagattgctcagccactcatgcc

SEQ ID NO: 196865 - DNA, 173 bp, Homo sapiens
ttactaaaataaaaaggtaacaagatactcagcctggtgaggcttacaaatgagagaaatgaagcatacttgtaaaataccagaccttcaggggaaagaaaatgcaaaaaaagacaaatttttaaaggctgtaaaaattaaaacattctaacttacttgaggtagataaaaat

SEQ ID NO: 196866 - DNA, 153 bp, Homo sapiens
agggactgttctagaccctggagatacaaagataaataaggcagagtctttatccttcaaggaacctccacactagtggtcagatagacacaattatgcactaggacaatagaaggtcaatttgttttatctctgcctcacttaggccccttg

SEQ ID NO: 196867 - DNA, 165 bp, Homo sapiens
taattgtgtctatctgaccactagtgtggaggttccttgaaggataaagactctgccttctttatccttcaaggaacctccacactagtggtcagatagacacaattatgcactaggacaatagaaggtcaatttgttttatctctgcctcacttaggccccttg

SEQ ID NO: 196868 - DNA, 290 bp, Homo sapiens
gctgacagtcactcatcccctggagaggggtactgagcataatcactgttggtattttatttactaccagttcttcatcattaccgagactcattccatttggaaaataaacattgcctcatctgttcatggtatatttttacacttgcctttcactcacatgttgcatattaactgaaaagatcagcatgatcttggagcctaatgtgatctggatcttattaccatgtatgtttttatcgtcaggtgctgctttggactctggcccattcctcccacctgtcttcatc

SEQ ID NO: 196869 - DNA, 312 bp, Homo sapiens
aaaacccccttctcttcaccgggaaagtgttactgcaagattgtcctgtcattttgctacacacagcctcggcccatcagccagtaattatgcttcccataattagtatgtcatcacctctcatgtttttgcatggtctccaggctgaaagatgcagcatgtaataattttaagaaatctacatctacatcttgatgaccagaaatggggatcctcaaggaaactttcaaagttcttatccaaactagtctccctcccaattccacatcttaaaatcaatttgtatcgccttgtataaattacacaaaacca

SEQ ID NO: 196870 - DNA, 221 bp, Homo sapiens
ggaaatctccgtcctgcatcccttgagaaatcagatctggcagccccgtggctgtgtgctccctcgaggcaagggctgcctggaactgcctgaagccagagccgccttcccttagcaagagtgtggcgcctccaggcccacctggctcacccactgcctctttgtcacctgcctggcctgctaggacaagagcctgcaacccctgcctttttctatctctt

SEQ ID NO: 196871 - DNA, 279 bp, Homo sapiens
cattggtcagagagaattaggctacccgccgcagtactgagtcatctatttccccctctattgatccccatctccaaatatctcatcaacaaccgactaatcagcacccaacaagtgactaatcaaactaagcctcaaaacaaatgataaccatacacaacactaaaggacatttggggtgtgtgtttcctgtttggggctattataaataaagctgctatggacgttagtgagcagtattgtgtgtgaacctgcgctttcatttctctgggacaaatg

SEQ ID NO: 196872 - DNA, 415 bp, Homo sapiens
ggtactttctgaggctctccagagggactcctcctgggtggcagtaagcccagcctcattcctcagctctggctcctggcacgcctctctgacacacccaggaagctgagctggaggcccctggggtagccagaaggcccatctgaattccacatggtgggctcatccccctgaaacagtagaacagacaaaccaccagtgcccactgtcagcatccctgtccctcagactccctggacttttaagtgcctctggaccccacctctcattcgggacagaatttgggagttgggtgtgtgtcaccctaagagccatgggcacagtgatacgcaaccaagacccctacaatgggatgtctacaaatctcagcgctcacggcacaattcctaagagtcaaattacaacaggttgggga

SEQ ID NO: 196873 - DNA, 382 bp, Homo sapiens
gacagttaggtagacctgaaggccaggctcttcaggggcctgcaagttatgtgcttgatgggctggggtggagggagtgcctgaagcacaggcacgacttggcttcagctgatcaccgtcaccagagcatgtagaccccatccctgagacttctatgagaagcctgaagttggtatttttatgtgaaatcgttcactttgccagccacaaatcacatccttgcaaaacagctcaaaaaacacatccacaggtcagatttggcccttgggccaccagtttgagaccctggtctgcgcgagggttgcagcaggagagccctagtctagggagcaggaagccgggatcccaggaacttcctggaggatgtggggcagagggcaga

SEQ ID NO: 196874 - DNA, 534 bp, Homo sapiens
aaatatgtttttccactttgtttacaacttcagctctgtttgggagacacagacagactgggaaagcatgagggttcccagtacaagttcacctgatgaaggtttctaacaggaatccctctgctggaaacagttaatttttttaactgaaaatgatgtgggaagaggaaagcaataagggaagaccatatccacccagaggcttccaatttcctgggtaattgaagaaggttcatatatttctactccagtaagagaactcaggtctatttctttaaaaaaaaaaaaaagaagaagaagaaagaaagaaagaaaatagagccatcaataaccattagagtgcattttaattatttggatcttacacaaaattaggggaaattccagtttagtgggaggtttcctgttactacgattgggatctcacattaaataagctatattagttctgcatgcttttcccaagatattatatttctccttctaaatgcggtccctgctcttatttgagatttaatacttccctccttctta

SEQ ID NO: 196875 - DNA, 476 bp, Homo sapiens
atgtataggcaaaccagaatcagaatatggaagtgctgttcatatatcttttttttcttagttctgtcctcaaagggcttagaagcaatgaaatactagttagtagtaatgagcacccccagtgcccatattttaatttctgaataaccagggctctctggagaaatgactaattccaggtctgaaacaggaacttgatagggcgagcctgacacattatcttgtgccagaaataagaacactattaaaatctaatggaataattataccgcagtttaaaacagatgaactaatggagttgtgtcaaaaggacagagaagccagttggaagggactcttaattggccgaaggcgggacggctggagagttggctgcaattgatttaaacacatgaatatataaaacgtcagagtctgttatattgtaataatactcagaaaagagaaagcttccccaacagttgtcagaactaaaa

SEQ ID NO: 196876 - DNA, 140 bp, Homo sapiens
aacccccaaatccacgatgttcagaagcacgtgactgttttccacaaatgccctttattttttccctttgataatttcagaattctgattacattcaaaatgatgtagaaattattcaagagtttatggttttaataaaa

SEQ ID NO: 196877 - DNA, 221 bp, Homo sapiens
acccatagcgatagctaattttgcatctggggaaggggctcaagtttttgggacacttcccacgactgccagtctctccttggcatacgaacgccctgtacttcagccagggctccgtggcgctggtctctacagtttctaggaaaccatgctcctttgtgcaaagtgctcacactgaaagccttgagaaacattattttctctgtaggccaggattgatg

SEQ ID NO: 196878 - DNA, 751 bp, Homo sapiens
gcttggccaaggctcaaaccaaagtatgttttaactactctggatattgcacacttccacgggaaggctggaggggaactggtgtaaaaatcaccccgtgaatgtctgatttggccccagctgccacagggacctgaccttctatctctacttcctgaccttctagctctacttcctggtaccacgttccaaacagttccttaaaatgagctctgggaacaaaggtggtagatttgttattagaacatggttccaatgacacaaaacactgtcgctaccaacccaccaacatcatgctccccctccctaggcctagcaggaaccagccaagctccccagtagaaagtacaacgtgcacctgactcccagcaaacggacccaactgaagtctaatttttaatttttatcaaatctggacatatcctctggggttccttctactcagcatttcaatgtatagctaagtctttcaacatatagctaagtgtgaagttctgatttctttaaatgttagccctgactgtataaatgtcagtagacatgaccttcccttgggaccacatgaggaggtccccacattgcttcactgacaagagtgctagcaggaagccaccccatctcacaacagatgggctattgggctatggccaggatggcatggacaacttgaacaagagtgttttcctagatggattttccacctgtattttattccaccctataaggtaggaaatacgtacacgattgtggt

SEQ ID NO: 196879 - DNA, 387 bp, Homo sapiens
tcaaattgcaggattacaggctaggcttgggttctcaagtcacatgtcataaagatgtgaaggccatgatttggagaaatacagtttataacatatactctaataataatctttctggggccccaaaatatcatggtaactatttcataaggttgataagggaataacatgtgacatgcagagactggcacacagaaagtagtacccaataagtgattgtgttaatgctggttattactccttataaaaaaaaaaaaagaggcgtgatggctcacacctataatcccggcactttgggaggctgaggggagtggatcacctgaggtcaggagttagagaccagcctggccaacatggcaaaaccctgtctgtactaaaaatacaaaa

SEQ ID NO: 196880 - DNA, 604 bp, Homo sapiens
aaaaactctgagaacctctggatgagcctctttagtcacagtaatcaaataggatggaattcagtgtatttagggtcattctctagcaaacaggtctttaaaaagggaaagcctgctagggaccgtggttcacacctgtaatcccagcactttgggaagctgaggaaggcagatcgcttgatcctaggagtttgagaccagcctgggcaacatagcagggccctgtctctacaaaaaatccaaaaattgaccaggtatggtggcatcgtgtacctgtggtcccagctacatgggaggctgagttaggaggatcacctgagcctggggaggtcaagactgcagtgaaccgtgattgcaccactgcactccagcctgggtgacagagtgagaccttgtctcaaaacaaaacaaaaaaaattgtgggccagggggcaagtaaagaactgtaacagaaagaaataagaaatctgaaaagattatagaagtaaagcaatattaaaataacatagtttttgtccatagagttgttttatttcaaaatggtttgtgaaaaccaaaacacatattaaaacagtgatattaactggttgatttttcttctttt

SEQ ID NO: 196881 - DNA, 350 bp, Homo sapiens
ttgtctctcctctcctctacccctcacaactttgtaggaattacagaaggctttgaatgtgtgtgtgtttgagtcgctgagatatgctgtcacctgactaaactcctaaaggtaggaatctttccaagattcctcactctgtccacgtggtacctggcacagggctgacacttcctagagtggctacttctacttgaagggaactgagaagggctacatttggcccaagagctagctagacagccacatgaacagtctcttgcccttccttctggaattctgagtctcatctgccccttatcgaccatgtgcaagccactgccctcttccaagcctcagtttcctcaact

SEQ ID NO: 196882 - DNA, 1062 bp, Homo sapiens
ggcctcggatgctgccccacttcagtacctggctccttactctggctgttccatgggagagtattttagagacacatgggcaaacatgctttgatcatctatgacgacttatccaaacagtgtatgcttatccgtcgagatgtctctggttgctcgtgtccgccgacccctggtcgtgaggcctatcctggtgatgtgttctacctacactcccggttgctggagagagcagccaaaatgaacgatgcttttggtggtggctccttgactgctttgccagtcatagaaacacaggctggtgatgtgtctgcttacattccaacaaatgtcatttccatcactgacggacagatcttcttggaaacagaattgttctacaaaggtatccgccctgcaattaacgttggtctgtctgtatctcgtgtcggatccgctgcccaaaccagggctatgaagcaggtagcaggtaccatgaagctggaattggctcagtatcgtgaggttgctgcttttgcccagttcggttctgacctcgatgctgccactcaacaacttttgagtcgtggcgtgcgtctaactgagttgctgaagcaaggacagtattctcccatggctattgaagaacaagtggctgttatctatgcgggtgtaaggggatatcttgataaactggagcccagcaagattacaaagtttgagaatgctttcttgtctcatgtcgtcagccagcaccaagccttgttgggcactatcagggctgatggaaagatctcagaacaatcagatgcaaagctgaaagagattgtaacaaatttcttggctggatttgaagcttaaactcctgtggattcacatcaaataccagttcagttttgtcattgttctagtaaattagttccatttgtaaaagggttactctcatactccttatgtcagaaatcacatgaaaaaagcgtcctaatgccaaaaaaaaaaaaccgggccatttgcggggcgggaaagggtctgaaggcgccaggcatgtgttccgccccttttgacacgggaatccggccctagggc

SEQ ID NO: 196883 - DNA, 665 bp, Homo sapiens
agcggaacaaccaaagccttttaggctgttacttaggaaggatctgagggtttcgatcagaggaatgataatatctgatttatattgtaacaatttaatataagagaggagtgcagttatttaaatttgttttgttacattgatagtcatataatcagctcttagttgctttaagctgacaggagaagggatgcttctaaaataaccataacctagcatttacttgtatttggtttagaagaatgtgattacgttcttgagtttttatttagattctcatcaaagaactgacctgtatatagtgtgtgaggtactctcaaagtatatgtagagtagatgctaatcactgtcactagaactcttccttccacctccaaaaatacaagtgataaagtaatgtggcttatataatcagttgtttttagtccactatatttaaagtcatttagatcatatcttattttccgccattgccgaaaacacaaactagctaaattgtcttcctttataagtgtgttccacatttattctcacttcctagcctttgctagttcagtctttctccctggaatgtcttcgtctgcacgtctctacccagctttcatctttctgtgcctagcctggcttctgactctgttatgacacttgcccttgcttgttagctc

SEQ ID NO: 196884 - DNA, 531 bp, Homo sapiens
aggattgggaaaaatacatgcacctgtcttttaaggatattcctatatcttagaagaaatgggtccacttgtgtctctgatttcttgcacatgagtctggttttcatgggtccaaactgatattccacctagtccaagaggactgactagttttgttagtgcctgtcagattaggtgctaattctagccttaattacaattaggaattacggtaattccaattaggcattgtgctaagcagcttgccatagatggaaacatttaatgcctatcagccatctttgaaatgaaatcactcattataaataaggaagtggggttccaacacatcaaacaatatttcataacaggacttcatattcaaagcacctgattccaatagtggttctgttacttatgaactgtgtcaccttggacaaatcacttaatatccctgtcctcctaacacatctgacaatggacataatcatagtacctactgcaaagagttattatgaggattaaatgatttaatataaggatttaaatatg

SEQ ID NO: 196885 - DNA, 899 bp, Homo sapiens
gttttgccattgaatttaatggcaaaaaatgcaattgcttttgcaccaacctaatagtttcctttacttgtgatattttaaacattgttcttgttatttcttgaatatgtaaatgagtataactgaaaatatacaaggatgtatagaaacaaaaaatggatttagaataaatatcttaattaattgcacaggcaccaacaagaatttacacattcaacatttattctagcattaagattggcagaagacagcttcatcatctttctgttttttgagatggagtctccctctgttgccaggctggagtgcagtggcatgatctcggcttactgcaacctctgcttcctgggttcaagcgattctcctgcctcagcctcctgagtagctgggattacaggcacatgccaccaagcccagcgaatttttgtatttttggtagagacagggtttcatcatgttggccaggctggtttcaaactcctgagctcgtgattcgcccgcctcagccttccaaagtgctgggattacatgtgtgagccaccacacccggcccatcatctgtctttaaaactattttttttaaatactgttttcacattttttaaatttttacatttttcaccttttcttcagattttcacagagcatatattgtatcataagactggtatcagaaaggattattttttcctctcaacctttttaccttcaaggaactgaaataactagactttatatattttcctttttactgtgcaatttttgctacatagtactaaatgcattcattattgttcaaatgaatataagctatatttaagagcaatttctaaatatgttatttcaagcagagattaattttaaataagaaaacctgacctaggttttctattttcttt

SEQ ID NO: 196886 - DNA, 901 bp, Homo sapiens
cgccgcccaagatgccgaaaggaaagaaggccaagggaaagaaggtggctccggccccagctgtcgtgaagaagcaggaggctaagaaagtggtgaatcccctgtttgagaaaaggcctaagaattttggcattggacaggacatccagcccaaaagagacctcacccgctttgtgaaatggccccgctatatcaggttgcagcggcagagagccatcctctataagcggctgaaagtgcctcctgcgattaaccagttcacccaggccctggaccgccaaacagctactcagctgcttaagctggcccacaagtacagaccagagacaaagcaagagaagaagcagagactgttggcccgggccgagaagaaggctgctggcaaaggggacgtcccaacgaagagaccacctgtccttcgagcaggagttaacaccgtcaccaccttggtggagaacaagaaagctcagctggtggtgattgcacacgacgtggatcccatcgagctggttgtcttcttgcctgccctgtgtcgtaaaatgggggtcccttactgcattatcaagggaaaggcaagactgggacgtctagtccacaggaagacctgcaccactgtcgccttcacacaggtgaactcggaagacaaaggcgctttggctaagctggtggaagctatcaggaccaattacaatgacagatacgatgagatccgccgtcactggggtggcaatgtcctggggtcctaagtctgtggctcgtatcgccaagctcgaaaaaggcaaaggctaaagaacttgccacttaaactgggttaaatgtacactgttgaagtttcctgtacattaaaattattgacataataccaaattttccttcaaaaaaaaatggcaagcccaggtca

SEQ ID NO: 196887 - DNA, 461 bp, Homo sapiens
tcatcataaaagatttcacacaaactattgtaaaattctgtcattcaccatgtctaaattattagaattattacctaaaagaattcaaggacatgaatctagactgaaatgataaaaacttagatgttaaactttttgtctctgaaaatgtgcctacttgagtgcagttttgcttgagtgaaaaaaacctaatgaccctttagattttatagtagtgctattttttactttatgtcagaatccctttgaataaggtaattctaaagcagtgattctcagctagggtaataatttgtttaaaagcaaacaacacgttataccacttttcttatttgcttttagtaatatttattgttgaattttcatataacactactaaaggaagacctgggatatttttaaatactctttttggaaatttttatttgaattaaattagttatatttcagtgggctttgga

SEQ ID NO: 196888 - DNA, 686 bp, Homo sapiens
tgcagtgtttgtctttatgtgtttagcatatttcactcagcataatgtcctccaggctctgatgggcacttggcttgtttccatgtcttggctattgtgaatagtgccgcaatgaacatgggcaaattgccgtgttgagttaaggaagctcttttccagtctgagtttgcaaatagcttttcatatatgagcgttgaatattatcaaatgcttttctgcattcactgagatgactttatgtatttaaaaaaatctgatggcctatattttctatttctaaactactcgtgtattcctggtataaataactcagtgtgttactctcgtttttatcatagctggattcgttttcactatattttgtttgagattctgcctcgtgatcatgtatgtgattgctctgtaacttttcattcacattttgtccttgtcctgtcctggtatcaaagttatattggctttcatagaatgagggaaatgtttatccctctaaaaatatttagtagagtggtctaagatgagagtgtaagtgagtaaactttctcaatcaaatattttgtgatatgtttcaggaatttcattacatgtttgggtcaatttttaaagcatttctttttattatttaaaacttttagcattggtgaccatccatgtgctgcttttattgccagcttaacttgttttta

SEQ ID NO: 196889 - DNA, 413 bp, Homo sapiens
tgcagcatctcccgccatgacctccagcctgtagaggagaggcgccacaggacctttacaggcacgccgctgttcccctcacccatgcatttcttaatgccttggtgaggagaatgcctctgggtcttccttggtgggagctaaaggaacaaaggtaaataatgctatgggacccactgagaattggggctgtggaagagtggccactgaagtaatagacagatgcagctattgccagatactcagtgccagagcagggagggagagggaagaaatacggacctcaccttcctctcacttccaggctccatcgggtgcccacattgctaaacctaactagaagtgtgcacacaggggagccagggatgcattctagaagggacaagccccaagtggcgtaagacaggatggaa

SEQ ID NO: 196890 - DNA, 423 bp, Homo sapiens
gtcctatcatattcatttgtataatcaaacctatgtgcatatagattacacttaactgaatttttttttaaggactgttacaaagaaaaattgtcaggtcccaccttagactgaatctgaaactctgcgggggggtggagcccagcaatctacttgtaacaagctgcttaaatttgagaattattgcctgtaatcccagctctttgggaggactaagtgagtggatcacctgaggtcaggagtttgagaccagcctggccaacatggtgaaaccctgttctctattaaaaatacaaaaattagccgggcatggtggcaggcacctgtaatcccagctactcaggaggctgatgcacgagaattgcttgaacccagaggtggaggttacagtgagccgagatccagcactgagccacccagcct

SEQ ID NO: 196891 - DNA, 207 bp, Homo sapiens
accgtcaaaagcctttgtggttgggtactatcattatcatcttttaggaaacaagttgatatagattagttggtttacctgaagtcctggagttaggtggcagagttgagatttaaatccagatgtttaagactccatagtctatgctgttaactttaatgctacatttgtaatttagcaaaggaataaaatttggtggtcacataa

SEQ ID NO: 196892 - DNA, 405 bp, Homo sapiens
ggaatgttttctacagagcattgaacacatttaagaatctgaaaggataagatttagaaaggaaggaacaatgttgtctccaaattatgaaagttaaaatgagtctgtctatggatgatgccaggtaattatccttctaccttataaaagttgtcaacagacaattagctatgtaagtaattttcccctcattcctttcttgttgaacagtttctgaaagagaagcactctattgtcatttccttaatgcacatttattttctaagcgtctgctttcaggcttcttctatgtgttcctaagaaattgctctcatagtgattatcaccacctccttattactaagtccagtggaaccttcttgttctggtcttacttgatgtctctctatagttgaatgctccata

SEQ ID NO: 196893 - DNA, 512 bp, Homo sapiens
ccagaggagtttaggatgggccccaggtcatgtagctggagagtggcagagccaaggtgtgaatcccgcacctggctctggagccctgttctcagccaccgtgctgggcagcccacacctggcatcctctctgttaggagcaggggcctgcccccacgccctctctgacattgctattcttgctaaaatgaagagacagagctgaggggagagctaaaaagaatgaatctggactggcatcagaaacatgctgcttcccaccagcgagttttgtgcttcactcttgggcccagggcctgcagggtgtgctgtgacctcatctgaagaagcacccacacgggcaggccctgaggggctgcagcagagccacctcgatgcctctcgagccccacccggccctacttatgccttccatctgcaccaacaccgatgagaagcttgcacctccccagtcttccctggttttgctcgtagctggctggctggatccctgcatggattgcccttggaca

SEQ ID NO: 196894 - DNA, 109 bp, Homo sapiens
ggatacaaatttcagttagataggaggaataagtttaagagatctattgcaaaacatggtagccaaggttaataacaatgtattgtattgaaaattgctaagatagtag

SEQ ID NO: 196895 - DNA, 470 bp, Homo sapiens
caagcatttgttgattctgtgagtcaggatgcagacaggatgaaacagggatggcttgtctctgctatctttatgtgtgccacagctgggaaggagctgaaagccagggactgcaacagttgtaactggagagtctacttccaagatggtttcttcattcacatttctgacaccttgatgggaatgactaggtgcgtgggacttgtcagctggagaggctacaggtagccttcccagcatgacagcctcagggtatttaaagttcttacataagtggttcagtgtctagtaggctgcatggcctcatatgatctagccttgaagttgcctggcatcccttctctgttggaagcagtcataaacccacccatatccaaggaaaaggggacataggtttcaccttgtgatgggaagtcaaaaaaatttgcagccatgttctaaaaccaacataaactagcaagaagaatgat

SEQ ID NO: 196896 - DNA, 408 bp, Homo sapiens
ctagcccacagaggggtgccatcgattaatcagctgcatgaatgtgcaaagtcatgattcggaagagctgaattcaagctgtggctctccaaaatacttacttagcactgtggaacctgggctaagttgacgagcctttctaattctcttgaagttggtggggttaagacaagttccctacctaacagagttcttatgaggtccatgagacaatggactgaaagggcagttgtgaactcacctgtgggctgctagttagcagattcacttcacaaatgtctgttgagcttttgtccttccaagcatgcttctcaggtctggtgatactgtagtgagcaaaacatttacaaatccctgtctttgtggggcttagtcctaagaggaagaacatacagtaaactaataaat

SEQ ID NO: 196897 - DNA, 303 bp, Homo sapiens
aaaaagccccaggtacagtcttaactttgattgatgggagtaagaccccttcttttatgggacttctttggctcaacaaataaaaaatgtagtcacagtcctagatcccacattgggccagtctagtcttccgttcattcatgcgtgcattcaagcttttatttactatctatgatagaggagtcatgtgggacagtaagtgagaatcaagggaagaaaggggtgattaacacaaatcagtgattgcagccataagacaactcaaagttcccagtccggctcagatgtgtcaatagcggtatc

SEQ ID NO: 196898 - DNA, 401 bp, Homo sapiens
aaaaaaaaaaaaaaaaaacagaacaagaaagaactcagggattggcagagtgagaatacattatgagtaaagacaggaactgacaggatgcatccatgggaaagtgaattaaccatcctgggtaaagttagggaagattgacattaggaaagagtcaaagagaagacaggaaaagaaagatggagtgcgaagaccctgaatatcagtctattaactgtgaactatattctgcaagcactggggactaattttatgtattaccatttatataacaattagccatcaacaatatatgtgattccctaacgttcttgaagcagctcaaccttataccttaagtttctacagggcaacaatcagagtaaaaaatattctgtgtatacaacatggatctgtaggca

SEQ ID NO: 196899 - DNA, 737 bp, Homo sapiens
cttaaatctccttaatcaatctccactagcttccaacttttcttctgcagcttcctcacccctctctgcctttacagaattgaagagttagggccttgcttctagattaggttttggcataagggaatgttgtgactggtctgattgtctacccagaccactcaaactttctccatatcagcaataaggctgtttattttcttatcattcatgtgtccactggagtagcacttttaatttccttcaaaaacttttcctttgctttcatgatttggttgtttgctgcgagagatctagcttgcgacccatttcagcttctgacgtgccttcctaactaagcttcaacatttccagtttttgatataaagtgagagatgtgtaactcttcctttcacttgaacacttagaagctattatagggttattaattggcctatcatatggtttgaatatgttttccctccaaatctcatgttgaaatgtggtctccagtgttgatggtggggcctagtgagaggtgtctggatcatgggggtgtacccctcatgaatggcttggtgccatccccttggtgataagtgagctcttgctctgagttcacacgagtaaaactccctgagccctccctagaagtccagcagatggtggcaccaggcttgtacagcctgaagaactgtgagccaattaaacatcttttctttataaattacccagcctcaggtatttctttatagcaa

SEQ ID NO: 196900 - DNA, 341 bp, Homo sapiens
ccctgctgtacccggcagcagctctgagccagtcctgagctccttctcctaagaacacccttcatgtggcctccatacccagctcaactggggtagtactgccccgtctagggtgctttttaagatacagaagagctggctggctggacatggtggctcatgcctgtaaacccaacacgttaggaggctaaggtgggaggatcacttgaggccaggagtttgagaccagcctgggcaacatagtgacatcctgtctctacaaaaattaaaaaattagccagggctgagagcaatggctgaagcctgtaataccaacattttgggaggccaaggtggacaga

SEQ ID NO: 196901 - DNA, 119 bp, Homo sapiens
agttccagccctgagtccccatggttttctccctaggctaagatagagaggaagaacatgaaatatgcagaaagcattctcttaagcaaacgtgtataatttgcctaaattgtaattat

SEQ ID NO: 196902 - DNA, 258 bp, Homo sapiens
tgctgctgaggctctggggcaggaatgagtgtagaatgttagggaactgaaagaagaccagagtggctggagtattgggagtgagtagtaagggatgtagtggaaaaagtggtaaggggccttgaagactttgataaaggtgtttgttttaatccaggagaaataggcagccatgggagggttttaagcagtggatgcaagactctggtaaggatttgtgtttttaaaagatcactttggctattgtgtggagaacag

SEQ ID NO: 196903 - DNA, 391 bp, Homo sapiens
gactggttttggattagccataaattttgattatccaaatctgtcttctgcccctttctaatctacatagaaaaaaaagctcaaatagcctatatgtggcaaatatatctactcataagaattttgcttaaatttgccttaaaaattctggaacaataatttaaaactgaattagtaacacaaatatggatgctctaccttaaaggctgtcagaaattcaataattaattctcctaattaaggtgataatgagaaatcaggttcattatagttgaattccgaaatgcctgaccccaacataagcatcctgtacactgagcaatgaaaaaggagagtccttttcacatgatagtgatttttaaccaagaagaacattacaagcacctgttga

SEQ ID NO: 196904 - DNA, 458 bp, Homo sapiens
agtcatcttgggtatctgagagtcttcctcatccagtgaagttcctccgtacagcgtttagaggcctttcctcttgctttgcccttctttggcatctgcatgtggattatttacttgctcatttgttcctggtgtctttgcattacctactctttctccagccaggaataataaacaccttattgacagattgacttctgattctctgtgtcctccttgtcaggttgatatcctgccatcccagaaggcactgtgtagatgtttgctaaatagatggttgaatagaagaggacttaatttttgctaaccgaccagattgatttaatttgttggtgttccaatccagccactttgaatatcaaggctttcttgcttaatatccttttaggcaacattataactgttcatgtttctatataaagatttctaaattggagggtttctcatccgaaaatagt

SEQ ID NO: 196905 - DNA, 934 bp, Homo sapiens
agggcctcttgagtcatcactggtcttaagaagaagagtgaatcagtcaacattattttgactgcaagtaacagaaactcacaccaaactggcttaactagaaaaagagatttatgggttatataactctaagattgtagagagggctggcctcaggtctggttggatccagggactccaacaatattaggaatccttccccatttctcacctccacttttctttacagcagctttattcacaggtgcaaagcaaagatacctcctagcagccctaggctcacatccaccagcttagccacctcagcagaaagagtgctgttttttccagttgtcccagaagtgtttcagagctgagtctcattggactattcacatgccagtcttggggcctggggtaggggtggaaagggcagactggccaagcccgaggctcatgcccaaccctagagagggtgagtggtgccagctcaacttgaaacggatggaggttggggaggtgctttcctgaactgggtgggtgtggctgccagcaggaggcagggataccaggtgggcagcgccaccaaacactcattgccaagaggctgcagctgtgacccggctcctctcttggacccaccttgcaggctgggcccacagagcaattcttccagttcctaatgaacagaagccccagagtgctgacagtttaggaagtaagtgtacgtattttcccagttggcacaagtgactttgtaggccaaaaatgctcaaatattgatttcctaaggttcatctaaaaacatgctattaagagctttggtcttaggccaggcttggtggctcatgcctgtgatcccagcactttgggaggctgaggcaggcggatcacctgaggtcgggagtttgagaccagccaggccaatatggtgaaaccccatctttactaaaaa

SEQ ID NO: 196906 - DNA, 338 bp, Homo sapiens
aactgtgagtcagttaaacctctttcctttataaattacccagtctcaggtatgtctttattagcagcttgagaatggactaacgcacaaagcataggagttaataatcataaccttggatttggcaatggcttctaagataagacatcaaaagcatgactaagacagaaaaataaataaaccagacttccgcaaaataaaaaaaaaaaacttttctgcatccaaggacatcaagaaagtaaaacaataacctacaaaatggggaaaaatatttgcacaaagtatttctgataagggtttgatatttagactatataaagagctcctaatgcttagtt

SEQ ID NO: 196907 - DNA, 396 bp, Homo sapiens
atggtatctgaaagattaattcataagcagaatggagatctgctgcaagcagccaaatgtgatagcgaaggaacagggccgcctgctaagggatgccccttcaggcataggcagtattttcctgtcagcatctgagcttgaggatggtagtgaggaaatgggccaggacgcgctcagctccagtcccagagagctcctctctaactcagagcaactgaactgagacagaggaggaaaacagagcatcagaagcctgcaggtgggtacttatatgtcttctttaagaaatgtcaactttttaatgggattgtcttcttcttgttgagttgtttgagttccttgtggattcttgatactaattctttttcaggagcataatttgcaagtattttatcc

SEQ ID NO: 196908 - DNA, 458 bp, Homo sapiens
cggatctttaagaaacaatcagtcttgcggcaggcgcggtggtgctcagcacagttctaaggcagacttttttatcctcattttacagtcaaggtagtggaggcagagagggaaactggcttctccaagaacaataactaaggtggtgggtggatccaggttgccaacccagacaacctgttgagctgcctctaaccctacactgagttaaatgtttgctcagtgaatggatgcgagaaccctgtaaacccaatgtaaggaattcttactgctgtggcaaatatctaactgtggtctcctaacagaagatgctctcctctggagccagccagccagcctggcagatggaatttctggatacccttccaaggagcagcagctgtggctttctctcccacctgcaccattctccccattacctgccacataaacacacttttttcctaatgaccaagggt

SEQ ID NO: 196909 - DNA, 441 bp, Homo sapiens
tcattagttgatgggcacgtaggttggttcctaagtgaattgtgaattgtgctgctgtaaatatatctgtacaagtgtctttttcatatgtcttctttatccaaagaaacctttatacaaaggtttactttgtataaccattatatagttgtcccttgatatccttgggggactggttctaggaccctcctggatgccaaaattcatagattcccaagtgtcttaaataaaatggggtgatattttcatataacctatgcatgttatctcatatacttttaatcatctctgggttacttttaaaaatgtaaatgctatgtaaataggtgttatactgtattggtttttcatttgtattatttttgtattcttttttattgtttgtttgctttttcccaaatattttctatctatggtttgttgaatctgaggatgtggaac

SEQ ID NO: 196910 - DNA, 465 bp, Homo sapiens
aagccggctcctcttgcactcacttcctttgtgtctctctctctctttctctctctctccccctcaccaatctctttcttccctccttgtccgattctctgctgtagcttccagtggagaaaaataattattcttcaatgggttagcacggggcgcacgcacacacgcgcgcgcacacacaccccgccgaggtacccaatcaatgcacaaatcttcggggtccctttaacctctgcggatgactccgggagttaattatgaagcctatttcggcgcggcataaatatgcattaagccccccagccccggggccggcgtgcccggcccaccccgccctccgcgccccccgacggccgcggtcagccggcattccggagcagcgcgtcggagctgcaacttcgcgcctaagcgcccgcacctcgcagcccggcgggcgggagacaaaagctgcggcgccgccgccgg

SEQ ID NO: 196911 - DNA, 255 bp, Homo sapiens
ttgttctgtcgcccaggctggagtgcagtggctcaatcttggctcactgcaagctctgcctcccgggttcatgccattctcctgcttcagcctcccgcgaaatatgtagtttataaaagcataacaaactcaactgcttagtgtttttcatgttttcagcaaggaatcttttataatctggtttctcctgggtagagaaacttttaagtttagcaattcttttagtctcactaggtgcttcttcttatctccaaa

SEQ ID NO: 196912 - DNA, 473 bp, Homo sapiens
agttacatttcaagtgctaaattgccatatgaaggtagtggttactgaattaaacagtgcagatctaggggcttggttaaattcaggtttaattctcttggcaagaagtgccaaaatacgtggtgctcacttcttcctattgcatcatcttatgaggcacatacatgtctggctgtcctacttttagtgttcctaataggtttaaagtgttgttaccctcactcattcattgtagttcacccatcagcctttgacttacttggtctagcagcctttgctgatcattgcctggatccactagaaggaaagaaagcctttcattataacttgtggagaataatttatttctattttatttaagcttttctctactaattagtatctaaaagggatggcagtcaggaccacagcatcaaagaaagaaaggctgcagagaaaaccatgtttgaaatggtggcattaaccaggttatg

SEQ ID NO: 196913 - DNA, 380 bp, Homo sapiens
gttcaagcgattctcctgcctcagcctcccgagcagctgggactacaggcacctgccaccacatccagctaattcttctacacttagtagagacggggtttcaccattttagccaggatggtttcaatctcttgacctcgtgatctgctcgcctcggcctcccaaagtgctgggattacaggtgtgaaccaccacgctgggcccagttggagaactcttagacatgggtactcaatacgcacggccatgtgtcattctactcccggggggacttcgggaactctcagtccacaccttgatcagttccagtgtcccagggcaaagcttcgcagtgcatcatctttgtccaaggagcctcaattcctgtgggatgtcgacgc

SEQ ID NO: 196914 - DNA, 460 bp, Homo sapiens
gtcatagagcttccagcctgtttgatgtggtgcttactagctttaatatccacaaagaacacaagcatgttgttgtcctgtcttcttcctggccaactcagtggtcaggggaacttgataatggcttgtttcctcactgccttcagtgaggaagccttatttaattgtctgtctctccccagagcctagaagaatacttggcacatagtgggtatacagtaaataattattaaatatttgaaatctgagatgaaagttaatgaatgtaggtatgggaattgtacaagggataggaagtaccttggagaacttctgtaagctccaggcatatactcaaagatgggaagagtaggaatcagcattttcaaaagtcattggggatgcccatttttttctgtactgtaggaagaagggtttgcctgatcttacaccatggttagagcttgagctctgaacaagt

SEQ ID NO: 196915 - DNA, 180 bp, Homo sapiens
tctttattttctttattcatgtggcctgctggccagaatttctttaaccaggtaattaaatgcttctcctcatagtctctctgctctctcccttctgtcctccagccctgatgtgaaaaatcaataacctcattatcagtatctgcagatgggagctgagctctcagtgcaacatctctg

SEQ ID NO: 196916 - DNA, 271 bp, Homo sapiens
aagggtaggtcagtactgagctgctactagggaaagaggggaagtgggtggaacaaaagtaagtcaaacatgaaaacccctggttttcataatttaagtgatcatgagactttcactcaaagtcagtagtttgaccatatacttgctgttacctatttacagaaccattataatgaaacaacttctacgcattcgatagacaacacttaaatgttttctgaactaaactccaaaatctaatagcaccagctctgttccaaatcactattaa

SEQ ID NO: 196917 - DNA, 521 bp, Homo sapiens
attcagatgatacctctttcaaaatgccctccctgtttgctctctctttatttactatgtgttataaactgaatgtttgtgtcccccttaaattcatatgttgaaaccctatctccatccagcgtgcccatatttgtagtaaggaagtaattaaggttatatgaggtcataagggtgaggccctgatccaacaggattagtatcctgagatagagagcttgttcttgctcttgctctctctctccctctctccccactgccccacgttctgaagaaaggccacgtgacatagtgataaggcagccatctgcaacccagaaagaaagccgttcccagaaagtgaattggctggaactttgatcttgagaaaataaatttctgttgttaaaatatccactctgtggtatttcgatatggcagcctaagcagactatgacactatcttaagtagaactttgttgttgttgttttgagatggagtcttgctctgttacccaggctagagtgcagtggggcaatct

SEQ ID NO: 196918 - DNA, 400 bp, Homo sapiens
aatccaaacatctataaatctgtggaagctcgtttcctatgaggtagacctcctatagtgctttcagagatcatgatgcaacttgggcaagataccctgaaaccataatgttttcatctactctgttttaagtatttttgcagtataaagattcctactgccaaaacccatctgtcagtttgtaagtttgtggtcacgcccttaaacatgtctttctggctttattccttaccctctgccggtctagtataaggtctctgcatactccacaactttctctgcatatatttttctgtttaaaaagcacttcacatctggccaggtgcggtgggtcacgcttgtaatcccagcactttgggaagtgggtggatcacttgaggtcaggagttcgagaccagcc

SEQ ID NO: 196919 - DNA, 842 bp, Homo sapiens
ttgtagagacagggtttcaccatgttggccaggctggtcttgagctcctgacctcaggtgatccgcctgcctcagcctcccaaagtactgggattactggcgtgcgcccatgcccagcctacattttttcataataagtccttgaaatccagtgtgtaatttacacttaaacacatatcaagtcagactgaccatgttttcagtgcacataaccagatgtgacaagtgactgcagtattgaacagcgcagttgtacacccgtgcttactctacataccctctcttgcagacactttttccctctctctttcccctctctctacctacacatactctacgtgtgtgtgtatatacatacatacatgcctacatgtacgtacatacatacacatacatacatgtatgtatatacacatacttatgtaatttttttgtgtatgtgtgttcacataattgtatttctgaactatttcagggtaagttgcatagtaatgaccctttacctctgaatgcaccagtgtgtgtttgctaagaatagggacattcttttacatatccatagtatagttatctacttcagtaaacttaacattgatacaatcctcttatctaatctattactctgttttattaacatattatccagtttattctaatttatattcatattccaattttgtcatccaataatctgttttatagcacttccccgcctccagtacaggatctagtctgggtcagttgtcatgtctctttagcctcctttaatctggaacatttccccagcctttattttactttcgtgatattgaataaacatagttctcaccacatatgctttg

SEQ ID NO: 196920 - DNA, 302 bp, Homo sapiens
ctacaagatggaatgcagacattcctcaacattctgaaagtataaattgatgagaagtgggatatggaagacaggaaaacagaggaaacagcagaggcgcttatactcgtcttacaaagcagggtgttgctagagaatggcgttattgatatggaccagaacagttcaaatacattataggcaatgtcaaagtaatcaatagaagaactaaaaatatttatatatcaaacattgggatgaagagagaggagagagggatagaataaaggtgatttttcctcatttttcttgttggtgagcca

SEQ ID NO: 196921 - DNA, 420 bp, Homo sapiens
ctgatggtttcactgctgaattcacctaaatatttaaacaaacactagtaccaattctccttaaactattccagaaaattaaggagggaatacttccaaactcattgtataaagccagcattactttgatttcaaaaccagacaaggacacagcagaaacaacaaagaaaactataagccaatattcctgatgaacgtagatgcaaaaattctcagcaagatactagcaaactgaattcaacagtaggttaagaagataattcactataatcaagtaggattcatcccagagatgcaaggatgactcaacatatgcaaatcaataaatgtgaaacaccgaaagacaaagaccatgtgatcatttcaatagatggagaaaaacatttggcaaaattcaatatcttttcatgataaaaaaaa

SEQ ID NO: 196922 - DNA, 420 bp, Homo sapiens
taagccttttcatttgccatcaaccagctgaaaaccagtcttttaaccctccatttaaaccactctccccaagtcagcaaatgaaatctaaagatggacaagagctctttattggccaggcatggtggctcacgcctgtaatcccaacaccttgggaggctgaggtgggtggatcacttgaggccaggagtttgagaccagcctagccaacatggcaaaaccccacctctaccaaaaaagcaaaacgaaaacgaaacattcaacgggcatggtggcagacacccgtaatcctagctactcgggaggctgaggcacaagaatcctaagaacccaggaagtagaagttgcaatgaaccacgatcatgccactgtacaacagagcaagactgtctcaaaaaaataataaaataatatttttaa

SEQ ID NO: 196923 - DNA, 637 bp, Homo sapiens
gctctttttagcttagctattcagcaggcatttataaagcgcccactgtatgcaaagcccagggcttgggggatccccccactcctgtcacctgcaagaagcctccctatcaatcataagagagattgtccctgaagtcccaggcgactctgccgagctggagaggtggtgaaggctgtcccagaaggaactggtcatggctttgcccgtggtgccctctcctctccctgtcccatatttgccattgccgagactgcactgtctgtccaccagcctggctttccttgcagggcgtgtgtcctgcctgctttctggctgaaggcttgagcctggccctgtcctctggcctgggctcaacttctgggacccaaggccccataagccagagtccacataggccatggccttctggtgtccctcccaaggcccctgcctctcctggctctttgctcaggccaggattgactgctcctccttcccttcagttctggggcagtaccctcacagcctctctgtgggcacccccttgggccaacactggtgggggtatggaacatcacatacactgtggtcaacagtagaggaacactctgccccagtgtgcagaacccagcccagctggggtcttctgattcag

SEQ ID NO: 196924 - DNA, 236 bp, Homo sapiens
ctgggtgttagatatatttattgctgctgggggatcattgtttctagaccctctcagcagatagagcaaggaaatatatgtgtgtttactaacatctatttttctatctttatattatgctaaatataaatttatgctgatgtctccaactctaatccagcatcacatgagttctagccgttgattttctacaacattccactccagcagtgagaaacctagctctagctctgcca

SEQ ID NO: 196925 - DNA, 364 bp, Homo sapiens
cttggctaagatgtaacttggctcttctctgaaatgatcagttctcctaaatcttctccactcgtgattgttcgtcactagaatttgtacacctcgggtttggaagttggtgagcttccttcttattccacatatttttctgctatgcttctctctagttgcctcatcattttcaggtcatcgctttggtataagactcacagcctcctccactctagatcctgctttcaacctgcaagtcactctgttctctctgtttattgatctcatgatctccaaaaacattcactttaaaccatcctctcctatgtccatgccttggattgtatcaacattgtccagaaccacttcacatctgaattat

SEQ ID NO: 196926 - DNA, 393 bp, Homo sapiens
ggcatcagccactgcgcctggccaaattcaacaaatatttatcgaaaacctatgacacttcccctacaaaaaaagacaaaacaaaacaaaaacaaaagctatgatgtgatgtgactgggcatggtgtctcacccctgtaatcctagcactttggaaggtcgaagcggcaggatggcttcaacccaggagttcgagaccagactgagcaagagagggagactgtctgtattaacaacaaacaaacaaacaaaaaactaaactaaaagaaactgtggtgtataatataaaattctggctgagcagattaagatgagcaaactacatggttgaataggggagatgaaccatgcacacaactataatacacagcaagaaggaataaacgacacatgg

SEQ ID NO: 196927 - DNA, 284 bp, Homo sapiens
cttcctcttgtacgatcaaaaaacagacagctggagtttatattttcccctcaacactcaaaaatgagcagctttgtagataagggtagtcctgatcagaaatcctactgcatttgcacaaagctatagaattagcctatcccttcctggtgcttccttctcttccttattaataaatatcgtttttgacttttttttttttttttttcagaatagagcacttttgtctacattaaaaactcattcaggctatacattctcctcaatgattttctttttctttc

SEQ ID NO: 196928 - DNA, 316 bp, Homo sapiens
ttacaggcgtgagccaccgcacctggcctaagggaagacttttaaaaaggggtgggaattgaggaattgagaaattgctagatgggaagtataaagtagtggaaagggcatttagggtaagaatagacacttaaagttgggtcagtcaagatatgctcaggacagtggtgggaatgagggtttatatgtaggagtatttgagagaatatggattactggaaaaattatgtaagccaaaattatggtcgagcctcgaatggtacactaaagttgtatgtgtgactacatagttggtaacattgtttaattgtcatat

SEQ ID NO: 196929 - DNA, 453 bp, Homo sapiens
caggattgccattcccacacaaatttgtagcagatgcattatccgaggtgaaattatagttccagtagaatttttcagacctcaaggcaagtgcaaaggaaatttctgtgtttctaaatccatttcactgtataattgaagagcttcagtctttgattggaggtgattaacttccaatgtaataatactctaaaaggcaaatgccaagagaagaatctaatagaattttataaatgcctttcaaactagtgaatatgctcaattaaaatcctatgcctgtggattgatatcagtatttggcagtaactacctctgtgaaaagacattaaaaaatcaaatatgtaaaatctcattacagatcagcattaatggattatcatttgcaatcagttttgatgatagagaacacttagctttgaacctcaattaagtgaaatgttatccacccctgaa

SEQ ID NO: 196930 - DNA, 502 bp, Homo sapiens
aactcccttaaacaccggctgagagccggcactaggctaggatggtgaggtgtgattgcgggtgagacaggccaccccttcttcgactgggtacagaagttataattggttgaatagtcccaggttgtccatcgggcccttcacaatgcaaaatataaccacttggatatacttcaggggctttaccaactctacctatgttaaattgagtgggttgaattcgccacgtggacagccagtgctgcagagaaatgatcgaaatgtccactcctgtatctaccaaacctttaaatttctttccctgaatggttgtttcacaggtcgcagagcagcctggcaattgggattagcattgtcgaaagctaataactgcagcactatatcctgagcagccaaatctgcgatcatctttcgaagagactcctgaaaccgagctataaaattaatgtatggttctcttggtccctgttttatagcactaaaggaaaggtattgttctcca

SEQ ID NO: 196931 - DNA, 342 bp, Homo sapiens
gcaggtatatgacaatccctgttgagacaaataactgccaaagctgtccctcaagtctgccatcctcatgctgattcctcacatctactcatttgaccacttggttctgtccctccattcctgtcaatatctctcattctacaaatatttcctccagcttctacttcatgccttgcactgtgtttgtgaaacaaactatagtgtgctcaccataaccaaagctgatatccaaaacagattcacactcagagtgttaattacttaataactacatcacatgtgggtactgaggcaggcataatgcagtgttaaaatggcaaaaatagacactggggactactt

SEQ ID NO: 196932 - DNA, 610 bp, Homo sapiens
ttatctgcacacctgcccttcataaagctctaatttaaatagaagattaactagttgcataaaccatacactgttgctgttatatttctcaaaaatgtagaaatacacatgcttgtgaattagtttcctattgctattgtaacaagtaaccaccaatttactgctttaaagccacacaaacttactatcttacagttctggaggtgagaagtccaaaatgcatcttatgcctcaagaggtaagcagggctgcgtggctccttctgcaggctctggggggagtctgctccctgcctctctcagctggttggaggcttcctgtattgcttggctgtggccccacatcactccaaacttcgctctgccatcacatctctgactatgaccttcctgtctcccttttgtaagaaggacccacccaactaaacctgggataaccctcccatctcaagaccattaatgtaatcacaccggctaaattccttttgccatgtaaagaaatatacaaattccagggattaggacgtggacatctcaggcgggaccattattctgcatgctacactccccaaagaatcactgacagatgattttcaagtacaatagtgatg

SEQ ID NO: 196933 - DNA, 694 bp, Homo sapiens
  misc_feature (662)..(662): n is a, c, g, or t
  misc_feature (673)..(673): n is a, c, g, or t
ggagatttcacatcgaaattcaaagtttcgtgaaacttagaattgcattggaaaccttcttggcatcaccaatattttactcatgggaaattgggtactgcagagcagaggagtggaatgtagtataaaatattagtaaagagcaagcactttgaattcaaataggtctgatttggttactgatgttgccacttcttacctgtgtgaccttgagcaacttaacttacctcttgtgttagttatctattgtcacataacaaattaacgaatttagtggcttaaaaaaacatacatttattatctcacagtttctgtgggtcaaagagttggggcatttttactggtcttccgcctagtgcctcagaaagctgcaactcacgtttaaatcaagcctgggttctcatgagaggctcagctgggaaacactccatttccaagctccctcaggttgttggcaaaattaattttctcatgcctgtagtatttatggcaacttgcatctacaaagccaccagtagagaaattgagtatgttagcaagatggagcattatgtgataaattgtaatcatgggaatgattcatcacctttgacatgttctgttggttaaaaataagtcacaggtctcactccactgaagaagaagggattataccagatacnggcccaggaancagggaagggacataagggcc

SEQ ID NO: 196934 - DNA, 775 bp, Homo sapiens
gtttttcaaaaagtcttttgaggtctgatggatgaagtaggcctaatttttaccattgtccctaatgaggaaaggaaaatggaaggctcacttgacttttttgccccagtttttccccagttactttttgcccttccctacctccttgaattggtagttatgatggtgaaagttctctcccagaatgtgtctcacagatctctttcacctctaacatcttagaggttaaaatctccttcccagttcagggcttcttcatctcctcacagctatactctacatctccacctccagatatttccctgggtttcaggccctcatttttttctaaccagaaataagcaacaagcaagatgggctttggggttgttctaccatcacttcagctgaatatgtcctaaacccctaactcatcaacttcttccacggactgcttcctttttcctggcttccctatttcttttaataatgtgattattcgtctcatgatctaggtttgacattctagtcattgtaactcctttctttttcttgaatctaataaaaaattaggtgaaaagatctaattagcggaagtctaaaattagttgaaaaatcccactgacttggcttctgaggtgctttagcatcagcctgtcatggatggcacccttggccattgccttgccacaatccctgtcacctccctggacttgcctttttgccaccatcaccccaggtggcctgctttcaaactgttcatggctccctcttatacatagcatgaggccaaact

SEQ ID NO: 196935 - DNA, 721 bp, Homo sapiens
cgtgtggatcatagcgtttacatgtggattaacatttgctaatccaaaactgaatctgtggcacatgatgagggcacaggctaaaagctagccttcatgaaagctgctgatggaaatctagctttggttaccacgacatcaacacacttactgcctttagcacgttccagaaatcctcctgggacggtgcggtggctcatatttgtaatcccagtactttgggagaccggggcgggcggatcacttgaggtcaggagttcgggaccaacctgggcaacatagggagaccgcccccgtctctacacaccactgacccccgtacccccaaaacttagccgctccagtagtcccagctacttgggaggctggggtgggaggatcacttgagaccagaagtcgaggctggggtgagctatgatcaggccactgcactccagcctgtttccaataagtgagtaaataaaccctcctgatgaagaagtagtgaaaaaaaatagtttagaacattaggatagcactacctttcccccttaagctcattatagtaaggaacagcctatttagcaatttcaacttaactgcatgtaaaacagtaatatccttggtatgttgcttccaaaactgtatttgaaacttaaatgaatttggactatttctaagcatcagaataaaggtatgtgggaagggaaaacgttgagaggtaataaaacgaaacatttgc

SEQ ID NO: 196936 - DNA, 401 bp, Homo sapiens
aatttgataaaaatatttccatgaaattttttgtgtagtgttctaaaacttgaaattagactacattagttgatagtattattagaatcttccaaatccttactaatttttatatgttcatctattgtttattttgagccgatgattaaaatcttcaactatgagtgaaagtctatttctctgtttagttctgtctgtttttacttcatgcattttgacactctgttatcagttgtataaacattgagaattataatgcattgctaatgagcttaaccttttatcattccatctctgatatttcagcttattttgaatcctactttctctggtattagccagctacatcagttttacttcctttcattttcaaccaattttatgactccatctcaaaaaaa

SEQ ID NO: 196937 - DNA, 272 bp, Homo sapiens
acttaataagaatcttaagaagtagatactgttatctatattttacagatgataaaacaaaggtttagaaagaatacattacttacccaaggtcatacatttagtgaatgataaattcacttaatttaccctaaccctgatttattattattattattattattattattattattattattttgagatggagtttcactcttgttgcagtgagttgagatcatgccactgcaatctaacctgggtgacggagcaaaactttgactcaaaac

SEQ ID NO: 196938 - DNA, 1319 bp, Homo sapiens
ttcctagtttgagtttttgtcattgttcagtattgaattttgtgaaatgcttttctgtgttgaaataatcatgttctgctttgttctgttcgtgtaatctattccatgactagattttctgatgttgagccatccttggattttcagaataaaccttagccagtcatcatttatgttattttttttttccattggtcagctgtgatgttaggataggtttgctcaatagttcaggaaattaaaatgatgaagctgagacagatttatgaatagtactgattttaatttcaaataatagatgaatggcttattagctggcttaaaatgaagatggcctatgtaagatatatcactaattttatttgagaagtcttcttaaagcacttatttttgagtagataagacaatcacatttcataattcaaattgtataaaggaatgtatacagtgatacccctcttccattcctatctcgacacctccagaaaccaatattaccagtttttttgtcctggagattttgcatatataagcaaatatatttattttctttgtccctctttaaaaaaaaaaagaacatgaattgcagtatacacgctattctgcatcctgcagtttttcttgatcttgaggaatgtatgagacaaggttcagtcagagaagtggagctactatgtgtgttaagacatatggcattcatcaaatgaattggcctttactcagttggagttgctgaagaaatgaaggtccagaagggaaaggtggagaatgagaggagtcactaaccaggctttctgaaggattagtgtggtgaacaagtcagagcttgttagggaaatctgggaaacagtcacatccagctgctgaggtgagattgcagaaaggatagtatgctttcaggaagagcgggatgtgaaatggaggagagtggggacaacctaaagctttccacatacctttgtgagtgtccatcactatcctaatcctgaaatcttcattgagtcacgtctgttgcattgttcctgccttctaaaatcttgtgcaaattcctcttggccaaatcttactcagagccatacaaggaaggggattctggaaaacagttccaagcttaactttactaacccagcacagttcagcaccaagagcatgctgtattgatatgtaaaggcagctttatccccctgcccttcttcatggggttaccttaatatatttatatctaggatttagtgtacattcgggttaataatctctatgggacggtcctcttccgaactaacatttttgtcgcgaatgagatagagtatttttggcct

SEQ ID NO: 196939 - DNA, 183 bp, Homo sapiens
ggatggatgagggttggaggggcataaaatgacagggctgagggttgtttatggaatgtttgtgtgttgtcttggtgctgtgttgacactattgagtgtctttatttttttatttatttatttatttttagagacagggtctctctctgtccctcaggctggaggtcagtgtcactatcatag

SEQ ID NO: 196940 - DNA, 412 bp, Homo sapiens
aactgatcctaagcagctgttgtcagtaggtctgttgctgatgcttccgaggaaacatttcaggaccatttatcaagggaactggtagcagtaatatggatgggcttgactcaaacaagaaaatatactgcagacaacaaggaacatagctcataagtgagatgagccctagtacagcaataaccatttcagtgtatttgctatactttccttagggcagaagagaaggaaagatactaaattggaggagggaagaatgtgtgccccacacactagtcctctggagcttatctggctccatagattttttttttttttttttttggggacttagagtctcactctgtcacccgggtgggaatacaggggccggatctgggctcacggcaccctccgcctcccaggttcaagc

SEQ ID NO: 196941 - DNA, 841 bp, Homo sapiens
atccaggagagacaaggggtggttttgaagcagggtgctagagagggaagactttccagacttaaagtagcccctgccagtgtctcctgaaagacctttggctccaggtaccctcacaggtctaatctttttgtggtttttgcatccctcttgtcttctgaataacttcaagtcacttgtcaagttctcctgccctttagttggaaaaaataaccccacaggaattattagctgtttgctttacagttcacaaagttgaatcgaggtgttttaggtggctcaggccctgatacttcatcatttaaataattggccagagctgcttagtggtggtaggagagcaatgacccccttgagaatattttagtgttttcttaggagaaatgccagctacatctacagggtaggaacagtgctttccttgtaggtgttacgctcctaatacaacattttctcttgtactttatgcaggaattggctccttgacttcatttgctttgccccggtctggtggggctccatctttgtgtctctcgcatctataaatgggttggaacagggattacagggtcaccctatagttctcccatggtttagcggtggggaaacttgctgaagtcactcagagaacccaactatttcctcctctgcctggaacaaccatgtagtggttttacttggagagttttgtatgatttggcctgctagcctgtgatgccagggggaataaaaaaccctaggcatatattgaatcattaagtgcttcttaagtttattcactcaccaaatatttattggatgcaggggcccagaagctgagcatgtggttctacctgcttgc

SEQ ID NO: 196942 - DNA, 152 bp, Homo sapiens
tttgaggaaagcaaatggcctgttgcatgctgcctcctcctacttcataaagtgactgacagctgtcaacaggcttcattcagcagctttgtattaatgttgtctggatcctctgtaacaggtttttattatcaggatataaagaatagata

SEQ ID NO: 196943 - DNA, 560 bp, Homo sapiens
tgtttaatatgcttatatagtaggtctaggcaccaaggagattttaatcgtatcctccaggccattcattttcctgtccagaatgtgttcaagctgtatctcagtggggttgggtaccatgtttcaggaaaatacgcaattgtaaatattattataaacacaacttggtaaatgcagtgggccttacccttgcaaaagtgacatagaaaaagagtgcccatgtttgaaatgtggtagttacacttgccttcttaacatgcttgtcactggaattggtagttaaataatagcttgcttatgccctgttccctttcccaaatagataagattagatacactgccttgacttccttgattttagaatagcttggctacctctctggaagtcatttcaggtatattcatagaagtggagtcagcccagttcagcaccacgtgcttaagttagtgcattgttaacctgacatgttatttttctgtttacagcaaggatacattcatttatacactgaacactttcctgtcctattggctgtgtacctgaggacttgctcacttct

SEQ ID NO: 196944 - DNA, 347 bp, Homo sapiens
gggacagggctgtctccgtcttgcgggtacctgccccttcaccaggggccttgggaggggccatcagaaatggcgtgacctgtgcagcctgtcctgggttctgtaagccagtgtaggtgctgtccctgtgaggcccgtgtgcctcccctcactgctccgagctctctggctgaggagctggggcaggagccccgggagggtctgagaagactcagagagaggtggactctttgtagctggtactaggtttgctttacagatggggaaactgaggcacagagaggttgaggcattagtagtactacatggctggctggagagccggacagtcagtgtcccagcccggg

SEQ ID NO: 196945 - DNA, 822 bp, Homo sapiens
gttgctttgttgtatggtaagtttttccaaagtacttacagcatctaccctcccaccaacagtgtacaagagttgcagttgttcgtcttaacccaaacttggtgtgtggtggatttaagctgtatgatcctgatgacaaatgttgttgactgtcttttcctgtacttagtggtcatttgtatattttcttttgtgaaatgtccgtttgaatcttttgcccaattttaattgatttgtttattaagtgacaactcaatagtaagacttcttcagatatcctggatacaaattctttgtcagatttatgtgttgcagatttttttgctagtctgtggcttgtcttttcatattcttggtggtttttgaagaacagaaatgtatggaagcccatttatcaacttttttcttttatggttcatgcttttttatgtgctagctaagaaatttttgcctaccacaaaattacgaagtttttaaaaaatggtttttcaaagaaattttgtacttttagcccttacatttaactcagtgataaattttgagttaatttgtgtatatgaaatgagaaagtaaataaatgttcatcctctcactccatggatatcaattattcccacatcatttgttgaagaagactgttatttccctattgaagtatcttgatgactttgtctaaaatcatttgaccacatatgcatagcactgtttgtatggttatgtgaataaaagaaatgaatttatataatgcctttgaaggaaactcaagatcatgtaatacttctcaagtattataataaacatttattttcataccctactgaa

SEQ ID NO: 196946 - DNA, 455 bp, Homo sapiens
ccctgttttctagggtgaggatggagagttttatcttgagctttaaattttccaaagaaatagttattcattttagatccattctattgttttatggtattcaagaaaaagataagtactaacaattcttttcctttgagaaggggtaataataatcttgaaattgtaacggagtttttcatatctttaaggtgaagttattggttgatttgttttaaattttaaatatagtgtcaaaactttgagtaaagccgttttttaggagagtgaccagatttaagtaatcatggactaagagaacctagagtctatagacagaaactcaagaactgtggttccgaatcagaataactttctactctgtttttttttcaatgtttggaaaaatatggattaattagatatgttgataaagaatgatgaagataaggtgccatagccaaattccatatggt

SEQ ID NO: 196947 - DNA, 510 bp, Homo sapiens
agaaatgaggtagctgtactgttattaatgtacccttcttcaaactacgtcctatggaaaattacatttttttttcacagatgcttagattttttgcaatagctaaaagcaaaaacctagaaagaatgaggcaatttaatccttgctgatgatgaggaaaaacattatgttaatatacacgagcattagggagtaatagtctttacatatatatatttttccttctatgagcccaagatcattcttaaattattcctcatagcaaaaatttagaactacttacataatttcagtctaggtctgctttataaaatgtagtagtcactggatctttgtccttatgatattgtggcattgttccgtaggtgtgacagtgttatggaaaaatatttgtgctaactgtttggacaggattcacaaagtgttaaactgaattctgaattacaatggcttgtgttgcgagaaagctccaggaattctctgctttttggtttctcacctctttttatt

SEQ ID NO: 196948 - DNA, 459 bp, Homo sapiens
cacacacacacacacacacacacacacacggcaggcacattacagaggaaactagcagatattaggatatgaggggggaaaatgcagatacactcagaggccaagtgcacgcacccaaataggttaggtgcatgcacagatgaaaaggcgggggcggatcacctgaggtagggagtttgagaccagcctggccaacatggggaaaccctgtctctactaaaaacacaaaaattagctgggcatggtggcacactcctgttgtcccagctacccaggaggctgaggcaggagaattgcttgaacccggaaggtggaggtttcagtgagtcaagattgcaccactgcaccccagcctgggcaacatgccaagactccatctcaaaaaaaaaaataaataaaataaaataaagcagggttagaagggataagaaaatggtgtggatactcggcgtgtgcaga

SEQ ID NO: 196949 - DNA, 362 bp, Homo sapiens
cagctaggtgtggccatccagctaagttttcatcagtgaattgtgagaggaaataatgcacgaaattttgatttcagccgggctcagtggctcacgcctatgatcccaacactttgggaggctgaagctggcaggtggatcacttgagctcaagacttcaagatcagtctgtccaacatggtgaaaccccatctctactacaaatacaaaaattagccaggcgtggtggcacacgcctgtaatcccagctactggggaggctgaggcaggagattcacttgaacccgggaggtggaggtggcagtgagccgagatcactctactgcactccagcctgggcaacaaagtgagactccatctca

SEQ ID NO: 196950 - DNA, 754 bp, Homo sapiens
accctgtgagataacaattattcaggtgagcccaatgtaatcacaaggtatttaaaaggggaaggagatggcaaaagaaaagagtcagagagaaagatgagatggcaaaagcagggttagagagatgctatgttgccagctttgaagatggaggatagagaccatgaaccatgaatgcaggcaagaagctagaaaagtgaagaaaacaaattctcccctagagcctccagaaaggaactcaaccctattgacacttgaattttagcccagtgaagcctttgttaggcttctgaactacagaactataccataataaacttttattgttttaagcaaaaaaaaaaaaaaaaaaaaaattagctgggcatggttgcacatgcctataaacctagctactcaggaagccgaggcacaagaacacttgcactcaggaggcagagattgcagtgaactgagatcacgccgttgcactccagcctgggtgacaaagtaagactgtcttaaaaaaaaaaaaaaaaaaaaaaactgggggaaggtttagaatatggttaacagagccaagagtgaaaaaaatgacaactctcagaaagcactgctgaacagggcctccatcacttctgggtatgaattaaaagatcatttctgtaatatccaacttcctagattctcaattattgccaaaaaaaaggatttaggaaataatatacacttttcccacaactatattgatacagataacacaggcccaagatga

SEQ ID NO: 196951 - DNA, 792 bp, Homo sapiens
ggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactggaaggaaggaaggaaggaagggtgggagggagggaaggagggagggaggaaggaaggaaggagaaagagaaagagagagagaaagggagaaagaaagggtaagaaagaaagaaagaaagaaaggaaaagaaagaaagagatagaaaactgattaagatatacatttatgattttttaaccttttggattataagttaaacttggctgaaggttttggaaaaaacctgggaagttacctaggctgggtattctagagataatggattctccgcggcggctgcagccatgggtgctgggcctgcgggggcgcggggggtgcgcgaggacctgcggggcggggcgggagagaaggctgcgggaccggcctagacactgagccgcgggggatccccaacggctctgcgaggccctgcgagcgcagggaggcgccacgaggagccgggagcggggcacttcaggggggcccgctcgccgccggcggcgaagaacctggggcccatattggggcgcgggac

SEQ ID NO: 196952 - DNA, 108 bp, Homo sapiens
tccagagtttcacggcagcacgagaacttgctctcaagaagttttctctctactgaaatgtagcataaactctgcagcaggccctaggctatttgaaaagtattgtct

SEQ ID NO: 196953 - DNA, 691 bp, Homo sapiens
agatgatttagggtatctgatggaagaaattctaagcagtaaagcatacaagacatgacttgggtgctgttaaaggcattcagttttaaaagggaaacagagcttaaaagttgtcagggtaggacgtggtgaaattgtgcactttttgagcttgtccagagagataataatcagcagtccatagcgccaacaagaccatttacgggaagaggaaaaatggcatagattcaggaaggagcagaggggtgggtaccagtagcatactggactccagacaccaaaaggtgagagttgtgtggagcctgagctcttcatttcaaaagtagatctttttcttttcaagtgatattttgtcactatgcaaatatccagttatctatcaactcttaacataatagttttagtatgattatctttgcctgaattatttcattaggagttgaaaatggtcatatttctaattctgttattagttctatttccattatttggcattcttctgaaaagacaggtttcccctcatgaactggtactgttgatttctctgaaatacagttcctactgaaaagagagggtagatttttaaaaatacttttgggttaattattcattctctaagtaagcagttggtgtaataatcacctcaaatggtgggaaatgagtatgaaagcctggtccctagtcaatgata

SEQ ID NO: 196954 - DNA, 520 bp, Homo sapiens
atagatagcccagaaatacactctcacgtatttgtcaaacgatcttcaacgagccagccaagactactcaatggggaaaagataagtctcttcaacaaacagtgttgggaaaactggacatccacgtacaaaagaatgaagctagattctaattaacaccatacacaagaattaactcaatatggattaaagtcctgaatgtaagacctaaaactaaaactccaggaagaaaacataaattaaagtttcatgaaattggaattggcaatcatttcttggctatgacaccaaaagcacaggtaacaagagcaaaattagacaaatgagatgacatatgtcaaattcatctaatcaaaaacttatgcacaccaacaactaagcgaaaagggagccagaatgggagaaaatggtcataagtcatatgtctgataacagtttaacattcaaaatacataaggaactcctacaacataaaaacaaaaacacaaaaatcaaaaataagcaaaggatgtgcacagac

SEQ ID NO: 196955 - DNA, 423 bp, Homo sapiens
aatttgaccatttcaagaaacaatgacaccaacagcacaccaccagtgcttgctgagtctccactgccatccacgtgccacagtctgcatctgcagctgccacagcagggatgctcccaaagtgtggcctctgagcagttcctccacaccctaggcagcagggtctccacatctgaatactgagatgcaagttctcctggcaaacaacttgcttttcatttcctttttcactgtcataaaaagggtatatggatttttttaaataacatgtgtaattaggatatgttattcacaaatttcattttaggattgtaaaggtggcaaatacacatgaaatagccagatggattcctggaatagtggaagcttagtgaaaatgctattttttttttttttttttttttgagatggagtctcgctctg

SEQ ID NO: 196956 - DNA, 376 bp, Homo sapiens
acgccttgctaatttaaaaaattgtagagacggggttttgccatgttgcccaggctagtcttgaactgttggcctcaagcaatcctcctgcctcagcctcctaaagtgctggtattacaggtgtgaaccgctgtatccagcctctttttcaactaacatcttatctgaggtataatatccgtatgcaaaaatacaaaaattccaaatatctaactcaagaatttttacaaagtgagcacacctgtgtaactagaacactggtcaagaaagagaacattcccagcaacccagagtatctcttgtgttcctttccgatggctttccaaaaataaccattgttctcacttctaacatcacagattattttgcctgtttt

SEQ ID NO: 196957 - DNA, 775 bp, Homo sapiens
ggagcggaggcacgctggccgccgcaggcacaggcgcagagtccactgcgcgggggcgggaccggggagctagctgcagactccacgttttgcaaagatcggttttgcctcagagtcaacaaactcttcagattggttccggtgtgtcctatgtttacaagtcagtggaaattaagcacaacacatataaattgaaaagtcaaataaggaaatgaattacctcccttgacggctctaattttacttggctaaagccaatttttaggttggcttgggcagaaaagtgaaaagagaatgctccactttaaccgatgtcatcatctgaaaaagataacacagaaatgtttttctagtatacatgttaaaacggataaacatgcacagcgatttctttcaagaacctttgcacttgcggaattgaggaagtcatggtattcaacccactctcttgttggagacaaaaatattatcctgatgggacctcctggtgctgggaaaacaacagtaggcagaataataggtcagaaactaggttgttgtgtcatagatgtggatgatgatatccttgaaaaaacctggaatatgagtgtgtctgaaaaattacaggatgttggtaatgagcaatttttagaagaggaaggaaaagctgtgttaaacttctctgcatctggaagtgtgatttcccttactgggtccaatccaatgcatgatgctagcatgtggcatctgaagaaaaatggaataattgtatacctggatgtacctctactagatc

SEQ ID NO: 196958 - DNA, 765 bp, Homo sapiens
ttagcggctcgtggacactgctcccccatttcctttcatttcccccgtcttctcagtgagatttccttgactccacgttttgcaaagatcggttttgcctcagagtcaacaaactcttcagattggttccggtgtgtcctatgtttacaagtcagtggaaattaagcacaacacatataaattgaaaagtcaaataaggaaatgaattacctcccttgacggctctaattttacttggctaaagccaatttttaggttggcttgggcagaaaagtgaaaagagaatgctccactttaaccgatgtcatcatctgaaaaagataacacagaaatgtttttctagtatacatgttaaaacggataaacatgcacagcgatttctttcaagaacctttgcacttgcggaattgaggaagtcatggtattcaacccactctcttgttggagacaaaaatattatcctgatgggacctcctggtgctgggaaaacaacagtaggcagaataataggtcagaaactaggttgttgtgtcatagatgtggatgatgatatccttgaaaaaacctggaatatgagtgtgtctgaaaaattacaggatgttggtaatgagcaatttttagaagaggaaggaaaagctgtgttaaacttctctgcatctggaagtgtgatttcccttactgggtccaatccaatgcatgatgctagcatgtggcatctgaagaaaaatggaataattgtatacctggatgtacctctactagatc

SEQ ID NO: 196959 - DNA, 313 bp, Homo sapiens
ggcgtgagccccttgactggcccactattgaagtcacagtaccaaattcaagatttagctagcattcctcctgagtcagtgagaaattggatcagttacatgttgctcagccaggtctgagaatcctggggccttggcacaatagctttcaaaatactacattgactcagcaagaactctgaccatgaacagacttcctctcctggttctaaaagtctgatctggagaaatcagaataaatgtagtccttcccagagaaggtcttgtcaatcaatgactatcactgtactactgcagtgagacgccaatcatt

SEQ ID NO: 196960 - DNA, 484 bp, Homo sapiens
agccaagattgcaccactgcactcctacctggatgacagagcaagactccgtctcaaaaaaaaaaaaaaaaaaaaaaaaaaaaactggagacttcatcagcctctgaaggaatgatacctgaaattgatcttgtaatgcagaaagtggctatatgttatccagaagagtaacagataccccaaatacacttgctaacacaagaaatcctgtgaaggtgcttagacatacccttccatagattttagatgggttatctgcctatgttccagacacaagccgatatgttgtggtttgcccagtacagtctctgtggtttactgagaggaagtggttcttgtgggtgaaggtctgatcttttcagagattgttggtggcatatgcactgtcagcctatttcctgttttattggctgtttagcaagaccttcttagggcaagtgctgctgaagaggtatttaaatattttgtattggcaggatagatg

SEQ ID NO: 196961 - DNA, 545 bp, Homo sapiens
tctttcccaagttccctcaactcacattttatgtcctcctgttgccctgccatctcttttctgagttcttaccattcctgctttgtaatcttctcttgtagaactatttacaagctttactcaagtctaaaaaatagatggtgaaatgctgggtcacaattttcatctgttctgtagcaacacttcactaatgactgttctttgtgtttgggaagttttgctgccatatcagcttcttttttattttgcgtaacagaataaactgaattttcctgaagcagctatttacatagattcctgggagtgggaaaggaaggaaataacaggcttcacagtccaaagactctctactcctttgacgctttaaataataaagggagtgtgtgctcttctgctgccctgcgaccagtgccctgtgcattgccttctcctgtatcccctaatctaactcatctctttatttcactcaacctcagagccgccaccaaaatgcagatttttgtaaaaacccttatggggaagaccatcaccctccagattgaacc

SEQ ID NO: 196962 - DNA, 546 bp, Homo sapiens
gggcattcagattcttctagagaatgagttgttttgcttttggcagaaaggacagctgcagtgagctgagataaagagcatggagctctgactttgatgcgtttcaagcactgggtgcaagaaaaaattaagcaatgttcatttttcctctttgtgctttgcctttgtttttgttttctttcgtaattttggaaagggttgtcacaaaaacagtgctgggtatgtgaaaatcttctcagtgctattggcagctgatgactcttgtgtaggtgtctttgagagggaggatctaacaaacacctttaaagtgatccctgatgaaccatctgggtcttaatactctccaaataactgttcgttattctcttttataagccattgtctgtcaaagatccagatgttttaccatttgttgaacttgtttttcaggtttatcaaataatcagagataataatagcatcaggctcttactatgacaccagcatagctggaagagaagtcatgaaatcattggaaacactagccttactgtatcttcactttca

SEQ ID NO: 196963 - DNA, 234 bp, Homo sapiens
atctgctttcagtccctgctgtttagtttagacttttctagagttttctagagttatgactggatcatacagtatgtctcctttttgtggctggcttttttgtgcatgtcagagttgggggcaggcatcctgatatgtttgagattcaaccatactgtttgctatggtttgaatgtgtccgccagagttcatgtgttggaaacttaacccccagtgcatcagagctgggtgttg

SEQ ID NO: 196964 - DNA, 381 bp, Homo sapiens
tatccaggagtgggcagggcctacacagccctggccttgtctgggatgctggggaggacaagctctggggcctgaggagccgagaggttcacctactgagaaagtgggtgaaccaggcgtggtggctcatgcccataatcccagcactttgggaggctaaggcaggcagatcacttgaggtcaggagtttgagaccagcctggccaacatggcaaaaccccacttctactaaaaatacaaaaattagctgggcgtggtgatgggcacctgtaatcccagctactcaggaagctaaggcaggagaatcgcttgaacccaggaggtggaggttgcagtgagccaagatcacaccactgggctacagagtgactccatctcaaa

SEQ ID NO: 196965 - DNA, 532 bp, Homo sapiens
gggcagcttcctgagagtgggagacttctcaaagtgagactgaaagaaggctcaggaaggtggtgttcaggagcctgtgacatgaggggcttctttctaacctatatcaatgctgctaaagttttacacttgagtgtaaaatactcccagggtacaggacttgaccatagtggagagaactggagattaatgctggacttgaagctggctgctcttcctatgaactgacaggttgtctccactgcagcatgaatgccttctagttctgcctgccacaccttggcataggcaggcaagttcatagaataatggaacacagacaaagctagatgtggaatatacatcagaagacaaattatctcaccaacaaaagaagaattcagaatcttagtattttgtggccttaaaggaataatgaaaactgggttttctcaaagtttaaaggaaagatatatggttaaagaaaataagaaatataggagatagaaagtgagctgattaatctgcgtgaagaaggagaaaaaccattagg

SEQ ID NO: 196966 - DNA, 171 bp, Homo sapiens
atgagattgacatttactgggttgggatgagcatgggaaaacagatttatgatggaaaacaaggagttcagtttgccatattaaaatgaagatatctattacaaatctaaaaatattgatgttgaataagcagctgttttctggactttagagaagactaggttggagata

SEQ ID NO: 196967 - DNA, 421 bp, Homo sapiens
caaacgagagaattttaggttctctttgtagctgtggctgggctgggacaaggacgatggacaaagttatgggggtgctaaaaacctcagtaatgaagataaatgatattctaatctaatattttaaaaaatcgaggctaggtgtggtggctcatgcctgtgattccagcattttgggaggccaaggtggacggatcaccagagttcaggagtttgagaccagcctggccaaaatggtgaaatgccatctctactaaaaacacaaaaattagctgggtgtgtggtagtgtgtgcctgtagtcccagctactctggatgctgaggcacgagaattgcttgaacctgggagtaggaggctgcagtaagctgagatcatgccactgcactccagcctgggttaacagagcaagactctgtctca

SEQ ID NO: 196968 - DNA, 409 bp, Homo sapiens
tcatatcttcccatcatcactggtctgggttagcagtccctaggcctgggtattttaggctcacagaaatgcagaggcatagctggtggcaactctggacgactgctccctccaaaagcataggttccagaggtcacagcaatgagatttcctgttggcagctgctaaaacccctgggtggtcaaaatttggagtactggaaggtagtggtggctggttttcattctaagaagcctggaaggagtaggagtggtctcaggggatcctgagcaggtgtcagaaggcaagcgtcccaaacaaaggctgaaaagttttcctaaaatatctgtccactccaagtctcacttctctctataatagggacaatgctagatgtcacattcctccaaatatcaataagcatttgaaa

SEQ ID NO: 196969 - DNA, 465 bp, Homo sapiens
tataggtcaaagtgaaaacagggttgcacaaaaatgtgaaggtacttaatgccactgacctgtacacttcatttatttatttatttagaaatgctcccagccaaactggacactttaaatcagttaaagaaggccaggcgcagtggctcaagcctgtaatcccagcactttgggaagctgaggcgggtgcatagcctgaactcaggagttcaagaccaacctgggcaacatgaggaaacctcgtctctactaaaaatacaaaaaattagccaggcatggttgtgtatgcctgtgggcccagctactcaggaggctggggtgggaggatcacttgaacctgggaggcagaggttgcaatgagccaagatggtgccactgcactccagcctgagtgacagagtgagattccatctcaaaaaataataataataattaacaaataaataataaaatggttaaaattgt

SEQ ID NO: 196970 - DNA, 420 bp, Homo sapiens
cccagaagctgcacctgtgggaaaggctatatttaatatttgtagtctcatatatcagccaaaagctgaacggagagattaacaacattcctaggtggcattattctaataagtttatttttttaattgaaaagtaatttaaatagcagatgtagaatctaatgagagcctcctctctgctgggtggtagcattcaaaatggttcagaccagctacaagtgccaatgctgtttaaaaagtctcaggtgaccaaaggcatgggttggcctcctgaagctggaaccaggtagagccacgggccaaacactctctcctctgaaccagtggagctagtggtgtcaaatactgtaattgctggtggggagagcagtcattttgatctaacgctgggacgtcggctcagttggtgggggtggtcca

SEQ ID NO: 196971 - DNA, 626 bp, Homo sapiens
gggggaggaaaagggagtggtatacttaaggggatcctaaccagcaaggtcggtcgcctgtcttaggctagactctgtcgattgatctgtaactaccattatccacaggccatgacccttttcctcttttttattttctttgtgtccccatctaacttcagggtttctgtattcattaagtcacctctttttctctttggcatctcctaccctattttgttttcagttcctactcccatcttgctcatcactccaggcgcttccttatccctctctgaccacaccgagtgtccatcccactgctaggagtgttatcacaggtggtttctaggtgccctggtgagggttcccaactcagactcaaaatgccagaagctgtgttctggctctcttgctcagtttggagtgcagtggcaccatcttgactcactgcagcctccaacttccagggctcaagccaccctccacctcagtctcttgagtagcacgggactacaggctcgtgtcaccacatccagctagtttttgtattttttgtagagacggatttttgccatatcgctcaggctggtcttgaactcctgagcttaagcaattcgcccatcttggcctcccaaaatgcaggg

SEQ ID NO: 196972 - DNA, 416 bp, Homo sapiens
ttaaatcattgataagagcaacttaataaaccttggtttcttgttgaaattctttttttattgtgccttgttttgtgtcttttctttatgagtaggtttattcgagggtgatgggaaagaatattttatctcagtgtgtctttatttatgccataggccttctcagcttggtgtgaggaagctttttttaaaattatggtaattttttagaaatagattgcatagaggtgtgtgtgtgtgagagagagagagagagattatagttaaaataaaaaatgtgattgtctgctgaactaattttcaggtagaaattaaaatggctgacttttaaaaaatttgtgtacaagttaacggagtaagaaaaccagactaaggtgcctaactttggcttttccattgactttatttagataatt

SEQ ID NO: 196973 - DNA, 394 bp, Homo sapiens
gcagaaactcaaaaaatcattagtggctactatgagcattatgagtgactatacatcaataaattgtaaaatctagaagaaatggataaattcctagacatacacagcctgccaagattgaaccatgaaggaatccaaaatctgaaaatctgaacagaccaataacaagtaatgagatagaagccataataaaaagtctcccagtaaagaaaatcctgagacccaatagcctcactgctgaattctaccaaacatttgaagaagaactgataccaaatcctactcaaactatttcaaaaaaatagaggaaaagagaatactttcaaattaattctaagaggccaatttatgaggcttctcttaccctgataccaaacccagacaaagacacatc

SEQ ID NO: 196974 - DNA, 623 bp, Homo sapiens
ctatccagaccactaaaactttctgtcagcaataagactgtttcatttcttatcattcatgtgttcactagcatagcatttttttatttcttttaagaacttttcctttgcattcacagcttggctaactgttcagcactagaggcctggctctcagcctgtcttggcttttgacatgccgtctttactgagcgtagtcatttccagcttttgatttaaagtgagagatgtgtggctctttctttcacttgaacattgagaggtccttgtagggttattaattggcctaatttcaatatcgttgtgtctcagagaatacggaggcccaaggaaagagatggggaaatagctggtcggtggagcagtcagaacacacacaacgtttattaagtgtgccatcttatatgagtgtggttcatggcacgccagatcaattacaatggtaacatcaaagatcaagaattaccaaaatgtgacgcagacacaaagtgagcacgtgctgttaaaaaaatggcactgatagatttgctcaacacagggttgccacaaaccttcaatttgtaaaaaatgtaatgtctacaaagtgcaataaaacaaggtatgcctgtaccggtgaaaggtgt

SEQ ID NO: 196975 - DNA, 541 bp, Homo sapiens
ctgtgaaattgagtaggattctctactcaaagacttctctgggaagtgtccagaattgaccacacaggtgctgacggtagaaagaacacagacccaaaaccctgatctagttgcattaactccattagccccgagttcctctgtaaaatgaagactgtggaggcaccaactagaggatttctgtgaccttctcaaactctaaaatttttggcactggactgttccactttgaagggtcaagaaagaaatctggaggttgcagaaatcagggtcaggcgcacacacacacacacacacacacacacacacacacagaaacagaagttccacaaagagagttcatcctgttatatatgatgtgctctgagactgtcttttctattgtatttctcttcatttatctaaaaactatcagggcccacaagttgatttcagaatccactctagagtggtgatgggcactttggaaaacagattagaaattggtccagaactccaaagatgtagcagattcagttagcctgctcaaggcatggttgcg

SEQ ID NO: 196976 - DNA, 224 bp, Homo sapiens
cctgtccacactgaacccatcttatctgacgtcccttctgttctaatagtagaggaactatcccttctatcctaggacagttattccattccatgctctgggctctattacctgcagtcttgctaggaatattatattaatgattattccttttatttttggacattcaacatctctccctctcaattatacatttcccattactttttaaacttgccagagtt

SEQ ID NO: 196977 - DNA, 609 bp, Homo sapiens
taatggctcagcattccaaaggcagtccaaatcctgacgtgttttgtgtagcttagaaagacacaggttctagggtatttgttttaaggtggggttgtactctccccattgcaatatttgcttccgttattgagaaattagggttaaaccagtgaaaccgatgcttcaaatgggaagatgatggggaaggagaattcagagcagtagcagagtttcttccattaacaacaggcagaatttaggagccgcaacctggcttttcttctcttacagttatctactagtttatagattatgcaaggtatccataaagtctggaatcacaagaaaatatacataatctcatcaatgacagtttatatcccaggaagtaggtcagattacaaatgaagaggtcttcaagatagaaaaatttcctgctcctccaagacctatccactgccctccatctgtagctgacccaccaggtcattttgtgatgtgaaggaagcctcccctgacctgctccaacccctctaaaaggaactcattgtcgtatctagaacttgaccctgtagagattcattaggatatgatcagtcattcatactctcatattgattattttaa

SEQ ID NO: 196978 - DNA, 315 bp, Homo sapiens
cttcttggcttttcttcctctcggaaataaacagacattagtcacatgcagaattaaacgctgctgcagaattttgtggtgtggcatgagacgctcagagctgatggaagtctagaaaggttaagccgttgtccgacctgaatcaagcaattcttttcaaacattcagtaaaatgcagccaagtaggcataatctaaaatggactatgtggaggtcctgtgggcaagactggggaggaattcctgggcagtcttcatccattttctttttcctattatggtaagctaactcaaagcttaagtcaatccatgaatc

SEQ ID NO: 196979 - DNA, 314 bp, Homo sapiens
caaaaagacatagtggatccttaaacacatattatcacataagagaaaccagtctaaaaatattggatactgtatgattccaattacatgacattcttgaattggaaaactgcagaggcagtaagaagattagtggttttcaagggttaaggggcatggaggaagggatgaacagatagagcccagagagtgataaaggtggtaaaattatgctgtaggatactgagtagaccgtgcatgtaattgtggatacatgacattattgtgaaaacctatagaacaataccatacaaagagcaaaccctaatgtaaac

SEQ ID NO: 196980 - DNA, 577 bp, Homo sapiens
ttttcgacggaagcatggcatcttgttatgtgaggctgaaggagaacctcaaccacaatcaagtggagagtcaatggctcccccagttgacaatcatccatttgctggtgatgtttgtcttccccaggggaaatcaggtttaaccaaccttcaaccaaatcatactgctgtgtaccagtgtgaagcctcaaatgtccatgggaactatccttaccaatgccaatattgatgttgtggatgtccgtccattgatacaaaccaaagatggagaaaattacgctacagtggttgggtacagtgctttcttacattgcgagttctttgcttcacctgaggcagtcgtgtcctggcagaaggtggaagaagtgaaacccctggagggcaggcggtatcatatctatgaaaatggcacattgcagatcaacagaaccaccgaagaagatgctgggtcttactcatgttgggtagaaaatgctataggaaaaactgcagtcacagccaatttggatattagaaatgctacaaaacttagagtttctcctaagaatcctcgtatccccaaattgcatatgcttga

SEQ ID NO: 196981 - DNA, 282 bp, Homo sapiens
tatctggcactagaacttatgccaagtatttgggtaacattgggcctctgggacttcctcagtgaaacttttaaaggaaggcattgaataaccttttaattttttgaatcttcacatggaacattttgtatgtcccaaatgctcctcaaacagggcaagtcacaaattcttgttttagcggccaatggttctcttaatatttggtctcgtgccatgtgactaaaatagtgggttggtcaatctagtgatggaaaaacgtaagttttaatttcttttaacttc

SEQ ID NO: 196982 - DNA, 392 bp, Homo sapiens
cagccagcccaacgcaagcggactacagggcgccaggccatcaccccaagtgggagatgaggacaccctgggctgccacccatgcagctctcgacatttcctctccacccactgctgccagcaggaccttttcctgctttctccactccaggcccacaccaccttaaacccagcagccctcagtggaaagaacactgggctggaacataagtgccctaattaaggccatgactgcacaccgagtggtcatgaggtcttgtgcacaacctgagaaggtggtcacttacctttttccaggtctcacttacaggtgtgtgcccgtgtgggtcagtggctctgctggagggaaccgcatgaccccactgaaggctcacattacctcccatggccgc

SEQ ID NO: 196983 - DNA, 230 bp, Homo sapiens
gagaatatttgtcatcagaaaggcaaactgattgtattgatgttcacaaagctcagtttccctccctggaggagtattgtccttccctgccccattgctatcgggactggacaagagatttacccagctaataaaacgtaaatggagatgaggcatgttacttctgggtagaagctatagagccagctcgtagctgatcctgttcccttttccctcaactacaatatcag

SEQ ID NO: 196984 - DNA, 390 bp, Homo sapiens
tcccagctactcaagaggctgaggcaggagaatcgcttgaacccagaaggtggaggttgcagtgagccgaagtcacaccactgcaccccagcctgagcaagagtgaaacttcgtctcaaaaaaaaaggttactttccttacagagttaaagtagaggggacttctttcatgctgcttcaggttgactggggccctttggattaattgctgcaaatctcctgttttgtttttgtttttgtttttttctttttgaaaattggcccatctctaagtatagtatgattatctagcaggagtgactccattctgttttggtcttgtctggtggcacttagtgcaggagcttagtccaaaacagtagcctcccatatattttatttagcaatataa

SEQ ID NO: 196985 - DNA, 630 bp, Homo sapiens
catcagttgaataattttttatattcttgctaatctagtcaaaatgaaaccgtttgatgctcaatgaatggctgcatacaaatatttaagacttgagagggtacaacacacccaggagacgactgtgatcactatcaagagaatagtatcaaaagaccaaagtacactccttaacaagagcccatacagaccaatctaaatcaaacaaaccaaacttctggaacttgaggcagttcaataatagctgagtctaactgatcatagcccctgttttggttttgatggcaatcaagggaccctatcttgttgcaaaatagtctgactcaaagaggtatccatcttggtagtgagcctggcaacacatgtcatagcaatctggagacacagtagaagaaacacagattggaaactttgaaaagccaagcttgccacccaccacttaggatgcctccaaaccaactgttagctgcttccgtaagcatattatattatgcattcctttccctttctcttatgggaaaggaacacataatatgtttattgccgtcccattgagggtggcaatttaatgtcgtccctctgtaaatgttcaaatggcccatcaggtagtggaaatgcaccacctaaagt

SEQ ID NO: 196986 - DNA, 218 bp, Homo sapiens
tattttaaaacttttttccaactagaaaaactgtcaaaaaccttgtgtaaatattagcctgaatccaatcccttattaataataatgaaaaatattctgaagaaaaagaattgggttatacagtgaagtactcagtgttggttctttcattatggcgactgtaatctgatttttaattggtgattgtcttttgccaccagtggttctcttcttttttc

SEQ ID NO: 196987 - DNA, 241 bp, Homo sapiens
ggctaagaagggtatccttgaaatacgaataactgctacatgaaatgctaatacttttaaaactgaaaaagctgtgaatgtgtatagggaaaaacaaagcttttgaccaaagttcaaggccaagctttgctcctaattgggctgtcatcaatttagcctgggtgggaagcattcaaatggagacagggggatgaggtgagtacacacaacagggaaaaatgttgcactgagtattggcttt

SEQ ID NO: 196988 - DNA, 427 bp, Homo sapiens
tcagatatccaacctccttcgaggggccatgtgcttcaggggaaggctggaccccagctccaggggttgggtcataatcgattcctcttttaattgattcctcttataattgattcctcttataaatggtttattcttgggcacagaacacagctctagccagtgaggtgtaagagttgagggcttgagggaaagatttctccttcccaagagaaatacaaatgaacagatggtcttgtctttttctggatgttgtcatttgtgagcataaaggcaaacaaagctaactaccaagaatagcaaaagagaagggttaaagaacatagatgaggtttttgagtcactgaattaaccaacaggcaccacctaccatcccctacccctagaccacttatgtgattataataaatgcttttaatattttaaa

SEQ ID NO: 196989 - DNA, 388 bp, Homo sapiens
aaaaagaaaaaaaaaaaaagaagagtggttggcacatagtaaacactcacatacatattagtcattgttcctctgtttccaaaggtaggaagaaagttcccaggaggtgtgcttagaatgtgggtaggcagataccactcgggtatttcctgagcacctatgccatggcacacaagtgctggggccacagttagggctcaggacaggcacggcccccacgctcttggagctgacattctagaaggcaggtggatcctagatacaacagatacatgacgtaatgttatgtagtgagaagtgctagagattgagggaggctactgttttattagaagtgaccaaggcaggcctctaaagaggttgcctttgagtcaaggcctgaaagata

SEQ ID NO: 196990 - DNA, 424 bp, Homo sapiens
ctgtggatgctgaggaagggctggtgacatgaagaggggtggcgtgacctgtggatgctgaggaagggctagtgacaggaagaggggtggtgtcacctgtggatactgaggaaaggctggtgacaggaagagaggtggcgtcacctgtggacactgaggaagcgtcggtgacaggaagaggggtggtgtcacctgtggatgctgaggaaaggctggtgacaggaagaggggtggcgtgtcctgtggatgctgaggaagtgtcggtgacaagaagaggggtggcgtgacctgtggatgctgaggaagggctggtgacaggaagaggggtggcctgacctgtggatgctgaggaagtgtcggtgacaggaagagaggtgtgctgtcagcccttacaaagggaggtacggagctcggaaatcgtaat

SEQ ID NO: 196991 - DNA, 227 bp, Homo sapiens
caaacctcacatcctccaggagaaacacaccagttgcttttaggctccctggggagtgttctgttgccacctcatcaaatcagtgaaggtggaaaaaagagtttggtgccagctaaggtgacactgaagtgtgcagcaggaaatctgaatccaacaccacatctaatgagcctattattacaggctattggcaaagcaagggaaatcgaatgctaatgaaaagcagg

SEQ ID NO: 196992 - DNA, 281 bp, Homo sapiens
ggttcaagcgattctcctgcctcagcctcctgagtagctagggttacaggcacatgccaacatgtccagctaatttttgtatttttagtagaggtgaggttttgccatgttggctaggctggtctcaaactcctgacctcaagtgatccacctgccttggcctcccaaagtgctgggattacaggcgtgagccaccgtgccctgcccacaatggttttcaacagctaaaaaaatggtggggcgggggtgactgagggagcatttacattttgtctgtatac

SEQ ID NO: 196993 - DNA, 241 bp, Homo sapiens
tatggggttgttgagagtgtgatgagagatagagactaaacaaaatattgaacaaaagagatatgaaacaacttgatattagaattataatctgtgataaaggccttaaagaaaaataagatatttctaagagaataatgaagacctactttaaaatggcctaggagtaacccaggcatccaccgacgaatgaatgaataaacaaaattggtgtacccatatgattaggatgtttctcagc

SEQ ID NO: 196994 - DNA, 421 bp, Homo sapiens
ttttcattttttgactatccttgcctcagcttgtgttcaatactcagagactctctaaacacagtaaggaaaacacacactggcagcctcaacttaatcacagtatcttaccttagtcatcctagtgggaaaagataggcgtgccggtttgttccaaaagaaaacacccaagctctaactggtccagcttaaagtagagggtagggtaactaggactgaaactttccctggaaccgtagagaaaagaaggcatggttcccaaaggaagggatgccaggaagaaaattcacatatgtccatataaacatacatatccttgacccggcagttccatttctatgatgaaaatgtggcactattattgtgtaccagacactgttttactttacatggtcaaactataatagggccgagctcgatc

SEQ ID NO: 196995 - DNA, 252 bp, Homo sapiens
ttgtgagttggaagggatgtatctaagggaattattctaaagaagatgaaagaaagcatggagagagtggacaggcagtgtttgaggaggtaaagactggtgactttccagaatggactcatccttgagatcaggaagtccccaaggaatcacacatgagaagcaaacattcattcctagtctcatttgaatgaagctgcagaacatgaacaaaaagaacaatcattaaacgaatgtttcaacgtaagccaa

SEQ ID NO: 196996 - DNA, 480 bp, Homo sapiens
tcatcactgtgctcatatagacgccatttacttattcaaccaatttttactgagctcctacaaataagatagggctcataccctccaggatctaactactggagcaatgaccttcaaacttttcagattattaaccccgatcagtaaaacaacttttgagcacacaaccacagtataggcatatttattagtcaccaaatatacatgtttactattgtaacaacatattaggcacattaaaaaatattcatgtaattgagatgagagttctatcctattcttccaacatccaattttggaaaccactagactagaggatttataggatgtggtggaaggtgctaaggagaaaggtgaacatggcacctctgagacttagagagaagagaggaatcaaatgtgggaagggctgtgagaggaagtttcaaaggaggggcatttgacctgagtctttggagatgagcaggcgatgatcaggca

SEQ ID NO: 196997 - DNA, 517 bp, Homo sapiens
tggccaacatggcgaaaccctgtctctacaaaaatacaaaaatttcccgggtgtcatggtgggtgcctgtaacaccagctactcgggaggctgagacaagagaatcgcttgaacccaggaggcagaggttgcagtgagccgatattgcaccactgcactctaacctgggcaacagagcaaggctctgtctcaaaaacaaaagagacacggttttgctcttttggccatgctggagtacagtggtgtaatcataactcactgcagcctcaacccccccaggctcacgtgatcttctcacctcagcctcacgaggagagggattacaggcatgcaccacaacaccagctaatgtttaaaaaaatttttttgtaaagatgggctgggcacggtggctcatggctgtaatctccacactttaggaggcctacacaggtggatcacctgaggtcaggaatttgagaccagcctggacaacctggtgaaaccctgtctctaccaaaaatacaaaaattagcca

SEQ ID NO: 196998 - DNA, 268 bp, Homo sapiens
aatttcaatggcttggtccagatgtagcttgtttcattcattttattcacttattgtctcattttaagtgatttgttttcagctctgggaattttcatttcttcttgtagtatttcttcttttttctcttttccaagaacttggagtaaacagatgtcattcctgcatctaagctctagtcaccaaactgttctttgatctttttgtaaaatctctctctttttttttttaattgttgtttctgagagaattatttaggtcactctta

SEQ ID NO: 196999 - DNA, 492 bp, Homo sapiens
taatgtaatatatgttaactccttaaatattaatgcaaagaagaagtatattatgtgttaaattacatcttaataacatagtgcttgaaatatatttttaaaactgcagtagtttttttttaatatataccttgtttagtattgtttttgagtactcaaacagcactcagtaaccagagttttacagctaaagacactctcagtattctaaatgcctatgattcatttcataaataagaaaatgcttatagacatttagagctttttcaaccatcatgttgaagattttataatgtttttgaattcaaaaccactaaaaatgaataaaaaaaaattatggaattggtgaattcaggtggaaagattaaaaattatatatattgtatttgcacttgactgcttgtttgatgaggttctcacttgaaaaagataattgtttagacgtaagctagcagtcatctctgttataccagattcagatagtatttagtg

SEQ ID NO: 197000 - DNA, 616 bp, Homo sapiens
gatggtcgtcctggactcacttaactctaaaatccatcttaatagtagattcactggatgtcagagtaggaagggctttatagggccttttcatccacagtgtcagatctaaatgccttcggaagccagcaagaaccgtcaatgagcgaaggcagaagcatccagccggcgctgtccagtcccgcactctaactgctggctgcatgcagcggccgaagacttggaacatggctagtgcaagctgtgaagcgctgtgagtataaaacagaaagtttctcaaagatgcagtaactgcggggatggacggtggggaccagagctatctgcaaagcaggtgtctttgtgagaagcatcagaattcaaactttaaagaaagaaacgaagactgcagaccaaattccactcgtaggtctccagattgtggctaatgatttcacacaagaacaggaagtgccccaaatggcccagctggagaatggaaagtttcaagtacaatccgaggtctctcaactcagaatagtccatcatttctactcagggaggcctgtttaaccaagccacaagcttcagcggtagctggaaggcaaactgtaaccttcagcgagggttcacctct

SEQ ID NO: 197001 - DNA, 603 bp, Homo sapiens
agatacagctaaaataattttaaattgataggaaagttcatttctaaggaatatttaacaagcaatgacttggctatcaacagaaaacaaatgtaaagcaaagctaaagattaatgtacatgagttaaaacttaagacaactatgagaaaatttctacacaaagaaattccctggtctaatctttcatacaagtttgaaatcgggaaacatccagagaccatcctcaagggtaccataaagcacatttgcaaaaatgccagaactccatatataggaaatggttttggcttaaagactagggaattactgggtgagtcattctaactgtggctcccagtaaccagactatcttaaaagggaataaagtcaaaagtaaaactaataaaatcaagattaaaaaatttatgattagcaatggtaaaagtaaataatgcagacatttgtgtaacacattagtttacaaggcactttcatttttcaaactaggaaaactaaactgagaaagttaggtggtatgtggaatcaggtcaccaagctgcaataagcaaagtaaaggaatttaactggctgttccaataccaagtctacagactcttccatta

SEQ ID NO: 197002 - DNA, 299 bp, Homo sapiens
tgcccgccgcagtactgatcattctatttccccctctattgatccccacctccaaatacctcatcaacatccgacgtaatcagccacccaatcaatgtgtctatctctaaactaacctctaataacaaatgatagccatacacaacactaaagggcgaacctgatctcttatactagtatccttaatcatttttattgccacaactaatttctctcggctcctggctctctcatttgccctgccgctcaactatctattagcctagccatggccatcaccttatgagcgggtgcagtga

SEQ ID NO: 197003 - DNA, 514 bp, Homo sapiens
aaatatcacacttcccaaatcttataactgattatgacatttcattgaatttttaaatttcagtattttatattctagaagctctgtgaaaaatataagtagtaaagaagattacctacaaattatagatatttgtaagagatagtgaaggataggaaaagttgtacgtctttgtgtatgtaattccccaaagaagacaatctatccttgactgtaggtaccctgctgtgctttcaaatgctagatcttacccattctatctacctatatttttgtatccattattcaacaaataaataatagaaataatgtctttgtaaaagtatggcgttgggtagggttgtgatgttgacatgcaggaattaaaatatttatacacccaaaccaagaatttttttataagcctagggaagaaataccttctgtttctcagtcaaaccagcctaatatgtaggcaaattcctgtatttctgaaatgttcagaagaaaaacttaataaagttcttacattgtg

SEQ ID NO: 197004 - DNA, 139 bp, Homo sapiens
cctggtggtggccctggatcgggggacagttcagattctgggtgtattttgaaagtatagctaaaagatttcctgatggattagatgtagagtaaaaaaaaaaaaaaaactcaatgtggtacatatgtatgtttgcttg

SEQ ID NO: 197005 - DNA, 497 bp, Homo sapiens
tgccttaccaacacttttccacatattgtgggaaagattatctcagatgactgcatgcatattgcttgggtaggacaatttcctactaattgccaggaacaaccaaaccctagtggtaatcatcaaagcttaggccaatcctgttacaagtacacaatgaatacgcatctaaaagacttggcgtagtgcctggtcttgacaacatgtaattaaccctagctataattctggatggcacagagtttcagtgagaagcaatttaaggaaaaacacatgctcctttaaacaattttagattttatcagtcaatgattttagaaagttaccatcatcctttataacatttaagaacatgtcaatggaaaagtcactggattcagagttgaggaactagattctggtcttgattctgctactacctatctgtgtgatgttaagtaagtaatgtcacttctatgcaccctggttttccaatttctaaagtaagggtgttgggg

SEQ ID NO: 197006 - DNA, 481 bp, Homo sapiens
gaagaaataggtttaagtggaaaaaataaaaaaattttattttggatgttaggtttgagtctaatatattagggctttgcagatcatactgcatagatggtcagcagccataacatctgcttagaagttatttcttattaggattatgtcattacattaatttttaatcatccattcttttacttttccaagctgaatgctctagttgcacctaaaattcttcagtcacaattaagatgcctataaaatctctactagccaccatctttaaaggaaacataattctgaattttacaatacaataaacttgattattcagacactgatgattttttcatctggttgtccttgacctttgcttttattaacacctcctgctctgtgcttgtaatgccagctactctgtaggctgactcaggaggatcatttgaggccaggaatttgagaccagccttggtaacataataagaccctgcctatt

SEQ ID NO: 197007 - DNA, 221 bp, Homo sapiens
gtattgtgcgaatatttttgggcatgtgtgctatgtatcttgtatgcctattataagttaatgcatcgtgtgtatatactgagtttgtgtgtattttatgtgtagaaacaatggtaaagtagcctttgtgtatcttatatgcatatgcattttgtccatgtagttttttatgtattttgcatctgagtttcaggttgtatattcgcacgtggatgtatgtt

SEQ ID NO: 197008 - DNA, 274 bp, Homo sapiens
gttcagtagctgtagtttcaaaaaagaaaaataaagtctaaccttagcctaagaattcagggatttaggttgagcacaccaaaagcacagtttgaggaagcacccagataggactgagatgctgctagtggaggcaggtgcctgtcctggctgaattgtcagaattgtggaggaggaggaggaagaagagaaacaagctctcttggagtatcctaaggatcaaagagttaaagaaaaaacaaactctagctaatgaatcaagaagttgaatgag

SEQ ID NO: 197009 - DNA, 455 bp, Homo sapiens
gagcatctggtgagtggtgagctctgaatatgtgtaagctgtcattgctgtttgaagtgtagtaaatttccagaatgctagtcactcacattcaaatagaagtacaaaatactttttcagaggcagagagatgaactgtttgtagcatttcatgtcctcataggtaactgagaattaaacagacttagtgcgtggtaccagattgtgagtcttctgttctggctgtctgaagtcttatgaaagaggggtgctgcagaagcctcactggcattctcctaacataatcattgtagtgtgtatttgcttcctagggctatacaaactgggtggcctagaacaacagacatttcttctccttcagttctggaggttagaagtccaaaatcaaggtgacagcagggccaggttccctctgagactcttagcagagtcctcccttgcctcttcctagcttc

SEQ ID NO: 197010 - DNA, 439 bp, Homo sapiens
gagttctcatctcagttattaagtttttcagctgcactcacgtccaatgggacaactcttcattttgtaaggtttttagcatccttgctcaggcttagtaaatttcagtagtgcacctcactccaggcccattaatgtgacagtgaggttcttctgagggtaactgatttgataccatctccactgagaaccactgcattgtgaaaacaccgattagcactgtattccaggaaagggttatttttggtttctttaaatcttaggcatcttggtaaaacggaacatctccacaagactaagggaagactgaggaatagagtttttgaactttatgcaacttcgtttacatcaagattcaaaatgacctaaactgtttcatgtggatgcttgaatcttttctagtacactggtggtgggcaagagggtgttggaaacaggg

SEQ ID NO: 197011 - DNA, 482 bp, Homo sapiens
gaaaacatgagaaaatttttgtaggtttgagttagatgatgatttctatataggacaataaaaatatggaacatacaaaaataaatttaatgcacttaattataatacaaatgatttactcactttaaactttgataaattagattttgttaaattcaaaagcttgtgttcttcaaagcacacagttaaggaaatggaaaggcgagtaatggactaaaaaaaatacctgtaaaacagctttggttaagaatagaagaaaaatcctaataagaaaattggtgaaagaatggtgtggaaagttcactacagaaaaaatatgaatggcaaataatcctgatttgggggagagtgttcaataccaatgctaattttttaaatgtcctgtgtttaattttttggagtttgtgatttgcaacatgcccctactgcatggagggagaggagatggtaaaatgaacagaagtaataattgtaaacataaa

SEQ ID NO: 197012 - DNA, 248 bp, Homo sapiens
tttcaaatcttcgtatgtttaaacatattcttagggaatcacttgatttttgttttttcgtgttgcatatttacctgccatttaactaggtagaaaataatatgtgatgatactttttaaatatatatttttaaattttcttatgatttagaatatgttattggattttgttttattacaaaatcagtggatgcttgatgtgacaattcaaacaacacagaggctattaaagtttatactctctgctt

SEQ ID NO: 197013 - DNA, 619 bp, Homo sapiens
caggctggtctggaactcctgacctcaggtgatccacccgccttggcttctcaaagtgttgagactacaggcgtgagccaccatgcctggcccaaaatgtttcttaacccatggttcagaattatattcaatcgacatgaaaatgatagaatggaagagttatatcaactcacctgcagtgttttattttgcatacatgtgcatgcagagattcctacacttgacaggattaaaagggaactgcatgccaggaatggttctgggtgctgggtagacattgttatataaagcagacatggtttgtacccttaaaagagatgacacctcagctgaagcgtggtaggattgattttttgcactggcacattgataacagaacttataccaaagaaggcatattaggaaaagttttgtttctcagtgtttcttattcttaaccctcaaaatcaaattcatcatgcttgcatgtcagcagctcagctaggtcagtgctgtcatgatttaatctcaggatgtttttgtttatatactgtagaatgtatacttaaacttttattctcttttcccacttttgttttaatcttttgactgtcttttcttccacttccccacagcagcc

SEQ ID NO: 197014 - DNA, 990 bp, Homo sapiens
cggccgctgtggtcaaggggcttgcggcccggccgcctcgtacgggcgtacacacgcgtgcagagcattgcgctgccccccggcgtagtgaactcgtacaatggcctgggagcccgccggccgcacccccgctccgcgaaccctcttgaagctgttcagaagccgcttgccgcggggcccactaggcggggcgggggttgggacccagcgggagccggggcagcctggctccacggcctgtactcggtttacaccgcgggcgggcgcggagggaggctgcgtttcctccgctatcagtcccgtcgcttcgggcacctccgggccccggcggctggctaatgttttgtttgaaagatcggtggaactttttaagagagtatttaaaaaaaaaaaaggaaaaaaaattcaccgggcaaccggggaagtattgtggccttggagtttgctaaatccaaatatgaaaatcaaaagctttagtattcctcatcttctcttctggaagatttgcgttagagtttttgttgggccttcaaaaagctgtgttcagagttaggagaatatatccaataaaagatggtttcgtctaccaattggggaagtttcaccctctccctatctgaagaaaaaaatcaaaaacaaatgtccccggatctttcgatgcaagtcctggaggcagggagatcactgcctgcctggcccacgctgctgggacggctcgtcctccctgctttttgtttttcaaacctcctgcttctcccaccttgggaaggagaaatgtgaaacccggcagcggccgacctaggcggtcttgtggcccggagccggcccggcccgaaaaccatagacctggttgtactgtagcttgttgtttgggggaccaaattttctagagagaactagagcacttttgttgtgtttttttgttttgtttttgttttttgccttgtcgattcccgaataaattttgtgttccttcttttaacacggact

SEQ ID NO: 197015 - DNA, 1606 bp, Homo sapiens
gcggccgccgcaccgccgcctgccccaccgcaccacggggccgccgcgccgccgccgggccagctcagccctgccagcccagccaccgccgcgcccccggcgcccgcgcccaccagtgcgccgggcctgcagttcgcttgtgcccggcagcccgagctcgccatgatgcattgctcttactgggaccacgacagcaagaccggcgcgctgcattcgcgcctcgatctctgagagcccaccgcatgccggtgcagacggatgcgaggatgcagggacgcgcgacgccggccccggtcgcagccgacgacgccgccgccagcctgacctcacaccctctgggcccgcctctggagccagcgcccagggtccctctgtgctttttcgctttcctaagctcctgtcgctcctctttgtcccctcagtttatgtcctcctgtgctcacctccctgacctctgtgaccttgcactcccctggcctgaagctgcctctctgcgcgctttctactgggctcgtctctttccggagccccagcgtctcctgcccaaattcaccgcggaaagggcccggggcggaggtgcgaccgggcgtcggcagcgcagacctcttggccttctctcacaggtcggtgcgctcgctctccgcgttccccgcccgactgccgtgcagtccatggctagacgcgccggacaggactgatggcgggaccgcgctgcccgagaaagggacggaccaatacgtgtgtttgctccgcgaaccctcttgaagctgttcagaagccgcttgccgcggggcccactaggcggggcgggggttgggacccagcgggagccggggcagcctggctccacggcctgtactcggtttacaccgcgggcgggcgcggagggaggctgcgtttcctccgctatcagtcccgtcgcttcgggcacctccgggccccggcggctggctaatgttttgtttgaaagatcggtggaactttttaagagagtatttaaaaaaaaaaaaggaaaaaaaattcaccgggcaaccggggaagtattgtggccttggagtttgctaaatccaaatatgaaaatcaaaagctttagtattcctcatcttctcttctggaagatttgcgttagagtttttgttgggccttcaaaaagctgtgttcagagttaggagaatatatccaataaaagatggtttcgtctaccaattggggaagtttcaccctctccctatctgaagaaaaaaatcaaaaacaaatgtccccggatctttcgatgcaagtcctggaggcagggagatcactgcctgcctggcccacgctgctgggacggctcgtcctccctgctttttgtttttcaaacctcctgcttctcccaccttgggaaggagaaatgtgaaacccggcagcggccgacctaggcggtcttgtggcccggagccggcccggcccgaaaaccatagacctggttgtactgtagcttgttgtttgggggaccaaattttctagagagaactagagcacttttgttgtgtttttttgttttgtttttgttttttgccttgtcgattcccgaataaattttgtgttccttcttttaacacggact

SEQ ID NO: 197016 - DNA, 1509 bp, Homo sapiens
gcggccgccgcaccgccgcctgccccaccgcaccacggggccgccgcgccgccgccgggccagctcagccctgccagcccagccaccgccgcgcccccggcaccggcgcgctgcattcgcgcctcgatctctgagagcccaccgcatgccggtgcagacggatgcgaggatgcagggacgcgcgacgccggccccggtcgcagccgacgacgccgccgccagcctgacctcacaccctctgggcccgcctctggagccagcgcccagggtccctctgtgctttttcgctttcctaagctcctgtcgctcctctttgtcccctcagtttatgtcctcctgtgctcacctccctgacctctgtgaccttgcactcccctggcctgaagctgcctctctgcgcgctttctactgggctcgtctctttccggagccccagcgtctcctgcccaaattcaccgcggaaagggcccggggcggaggtgcgaccgggcgtcggcagcgcagacctcttggccttctctcacaggtcggtgcgctcgctctccgcgttccccgcccgactgccgtgcagtccatggctagacgcgccggacaggactgatggcgggaccgcgctgcccgagaaagggacggaccaatacgtgtgtttgctccgcgaaccctcttgaagctgttcagaagccgcttgccgcggggcccactaggcggggcgggggttgggacccagcgggagccggggcagcctggctccacggcctgtactcggtttacaccgcgggcgggcgcggagggaggctgcgtttcctccgctatcagtcccgtcgcttcgggcacctccgggccccggcggctggctaatgttttgtttgaaagatcggtggaactttttaagagagtatttaaaaaaaaaaaaggaaaaaaaattcaccgggcaaccggggaagtattgtggccttggagtttgctaaatccaaatatgaaaatcaaaagctttagtattcctcatcttctcttctggaagatttgcgttagagtttttgttgggccttcaaaaagctgtgttcagagttaggagaatatatccaataaaagatggtttcgtctaccaattggggaagtttcaccctctccctatctgaagaaaaaaatcaaaaacaaatgtccccggatctttcgatgcaagtcctggaggcagggagatcactgcctgcctggcccacgctgctgggacggctcgtcctccctgctttttgtttttcaaacctcctgcttctcccaccttgggaaggagaaatgtgaaacccggcagcggccgacctaggcggtcttgtggcccggagccggcccggcccgaaaaccatagacctggttgtactgtagcttgttgtttgggggaccaaattttctagagagaactagagcacttttgttgtgtttttttgttttgtttttgttttttgccttgtcgattcccgaataaattttgtgttccttcttttaacacggact

SEQ ID NO: 197017 - DNA, 614 bp, Homo sapiens
tcaaaaccatcatcaataccaagatcaaacgggtaagaatccttcaaaaaacaggaaaaatctcctaaaacaccaaaaggacctagttctgtagaagacattaaagcaaaaatgcaagcaagtatagaaaaaggtggttctcttcccaaagtggaagccaagttcatcaattatatgaagaattgcttccggatgactgaccaggaggctattcaagatctctggcagttgaggaagtctctttaagaaaatagtttaaacaatttgttaaaatttttctgtcttacttcatttctgtagcagttgatatctggctgtcctttttataatgcagagtgggaactttccctaccatgtttgataaatgttgtccaggctccattgccaataatgtgttgtccaaaatgcctgtttagtttttaaagacggaactccaccctttgcttggtcttaagtatgtatggaatgttatgataggacatagtagtagtggtggtcagacatggaaatggtggggagacaaaaatatgcatgtgaaataaaactcagtattttaataaatttaaaaaaaagagaaattaatagcctgaaacacacttaccagtaaaagtgga

SEQ ID NO: 197018 - DNA, 636 bp, Homo sapiens
taagagatagggtctttctatgttgcccaggctggattcaaactcctgggctcaagtgatcctttcatctctgtatctgggactacaggtgcaccaccacaccaggctcattgcaagagatatggagaaatatttccctaggacctgagtattgttagataagactgcaggttttttagattacaaattgctccatgtcaacactgagaaccagatgacaagtgacagaggtacccatgtgtccttaaaaaattcttttgtgggtatagatgtaatatatggggccactaccaactcagtactactttacacaaaatgattgatatggaattgtttggataatatgatgtctaactccagaaggtagagactttggttaagaatttcaagggagagatttctttccttttaattttttccaccaagatccaaagcctccacagatatgcctcttcatcattcttgccaggcaggttttagttttcctaatttactcaatgaatgtggtgtctttcggaaatctctactttgtgtaagaattgtcaagctaattaagcctgtgtgcttggttagcacccctatctttattgaagcacttatcacaatagctaagatatggaatcaatctaaatgtcc

SEQ ID NO: 197019 - DNA, 168 bp, Homo sapiens
ggatcctggctgttttataaaacatcaagaaataacagtctttctacttttatatttctttatttttcagcagtaaaatcttttttaaagtagcaaattagtattttttttttttttttttttttgaaactgagtctcactgtgtcacccaggctggagtgcagtggc

SEQ ID NO: 197020 - DNA, 864 bp, Homo sapiens
cggaagtatccgatcaccttgcgaggagtccgccggctgtccgagcctgatgtcactgcaacttcgattcctccgacgcccctactcttacttcccagtcttcaggcaacttctccgcttcggcctcccctaggccttggccccagagaggggacgcactccacaggtggattcgcacgtgtgggccctcggcagcactttctcgtgcaaattaacaggtggccctcattgtggaagcaccgcccagcctttcccggggaggtcaccagggcgaggccgctcaaggtctgcaggcgcccggcgttagcgggatcctccccgcgcactggtccgaggaggccaggagagggcgaaccagtccccgaccagcggcccttccgggggtgggctctgaccccaccgagcggttagagggtccaggagctccaaagggtagggcagaattgggtagatgagggtgcatttttctgggaggagtctaaggcgtcgctgactctcaaaggcccgcatccggagaaagggaaagagccccgtcccgggaggaaggacgagaggctggcccgcgggaaggagccctggcagtccctcctggcctaggtctacctctttgatctcaccgtccccgtggcggcgagtgccaccaaagatgagagaggccagcaggtatcgggagagagctgaggggtcggcgccggcgggaccccagattggagccgccgtcgtcggacgggcagaccctgctgtaatagctcccggccggccacggtaggcaggtggggccaccgcgagtcctagtgaaaaacaccttcctcttgatctctcaaaggaacccgagccctgggaagggacatcaaggcgctcccg

SEQ ID NO: 197021 - DNA, 295 bp, Homo sapiens
gagagactattgatttgttcagtgccaagtttcctgtgatctaaaaatggaggaactaagtggtgccaccctttgtttgcaggccaacagaagtaaaccaaagagaaatgagaagggggaagaattgaataagttgatgatagtgaagtaaatacccaccatttcttgctttgtttagcatggaaaacagctcacttgttcctttaaacctttataggcctcgttggcaacaaagcacatttcattgagggatgcctctgctggcagcaatggttatgctttcaaaataaaagac

SEQ ID NO: 197022 - DNA, 221 bp, Homo sapiens
gctatcatcactgtgatactgatggaggtcagaggggatggacagcttgtggactgagagccacagaaggctgtcctttaacacaagctccttcattctgccaagcagacctccgtagggagttgctaggccatccaaggttcagctgtactgacatggaactggaaacagatgttccatggaactatggcagtggctgaaggtgagtaggaatggaaaaa

SEQ ID NO: 197023 - DNA, 385 bp, Homo sapiens
tccccgcacagagagagagggcgcttcctccgcaggcttccctgcctgctgggggccagggaggagaccagcttgttggaagcggagacgtctaaggagtttccaaataggaaaaccagcggctgcaggcctcaggacgtggccgggcgagccgcagcctcatcccgcgagcgggcgttcctgagctgcctgcaccgtagtaccttcatatgctttaaaaatgtaaagcggccgggagcggtgcctcacacgcctgtaaccccggcacgctgggaggctgaggcaggaggattgcctgagaccaggagttggagggcagtctgggcgacagagggagaccccccgtctcgacaaataaaataaaataaagatataaagatctgga

SEQ ID NO: 197024 - DNA, 869 bp, Homo sapiens
tgagccactgtgcccggcccaaagctcaaaatcttaagttgtgcacgccaacatcaaatcacagatttctgtgaggacgtacacatgcattattcatgtaccctgagcatcttcagactatagctgcccccaccccaacacacatgttgatgaattctagagtgatgctggcctacttcaacactctgctactttaatttctatcataggggttgaggcacagcatagtcttttagcctttgtccctgcttttaaagaaatcaccattgttggtatattgtatgttggcataaggagaagagatgacttggggagatataacataggtaacttgcaaagattcattcctcacagagagtgaaagagggagagggggcaggtagagcatccaacagaataaatgtaagattttaagtgtgtcactttctccactcatctttgaatagaaagatgactgtagtatctcttcaatttcatttgcaaagtacttattcaaattcccctgaagtcactttttaatagcaagaccaatttagatccttttggattatcgatgaaattctagatctagtagtatagcaaacgtgatttccatatgtcaaatagagcaaaagcataagggataaatttgctatcctgtatttgcatacctcataatatcatatactatccctaacagatattatctccttatagctattatttcagtataaactactttaaaagactccttcattagacttttctgcagttacctacttgcctattatcagtgaaatgcagctgaggtatattttaggatcactattcttctggctgtctgagattgtacctgagaatgcattaagatacattttcacattcattta

SEQ ID NO: 197025 - DNA, 360 bp, Homo sapiens
tggtgttgtaaaggaagctgtactgtgaactacaaaagttagatcgatttatgagaagccatgacaaaatttgcggataatgcataagaattgttttcaaaatgaagactagcacaagtgagctaatgaaaaatgatacttggctattccactgcacttgactataatattttgataattagaccaaggaaaatgacctcatcttacataggtacagagccacaaccttctaggttatttgacacattcctagctgtcaggtgtaagaagggacaaaaacatatgtactttagtataagttctaactagttggaccctgtttttaaatagcatccagtacagctcctacaactccaactt

SEQ ID NO: 197026 - DNA, 297 bp, Homo sapiens
gatacgaatcgagctcgtaccggaaggtagctgttactgcatcattgataaatgtcttgggtgtgacataggtactgtggttatgtacgagaacacgcttcttcttaggagacgtatgttgaagaatttaggggtgaagtctcattacatgtgcgatttactttcaaatggctcaggcaagaatatactgcaagagtgacggtgataaaggagagggaggagggccagggcgtgtgtgaatgagcaagacctggcaaatgtggcaaacagtaacagctggtgaactggggaaggtat

SEQ ID NO: 197027 - DNA, 460 bp, Homo sapiens
acttcatattgaaagcatgtaatggtttttgtctcagttactgaaccccaacattttggtttggagtactctcttcagaagtgttcaaggttcaaattgaggtcttctgttgtcatggaataactttctcaacaatggtaagtagtggagataagagttaatggggaatatcctattcacttttctctgagccctctgaaacagattttctaaacccttccatgtgatcccgaccatgttatgggtttgctaactttgcagtacattggattgaaacatcgtaattctttccatgacaacagtgtctgatgttacagatgtacaaccagtgaggtcaatagttgacagatggacgttgaagccatgcaattacacctcccaaaccattataaagaatgtaacagaagaaaggtggaacccagtctaaaacacaccaaacaataaaaggcactaaaataat

SEQ ID NO: 197028 - DNA, 249 bp, Homo sapiens
tcaaactcctaacctcaggtgacccacccttctcagcccccaaagtgctgggattacaggcacgagccaccgtgcccagcctctgtcataatttcatctctctcatcaatagcagaaatatttgaggcttctgcttctttgagaatttccagttagctgcacgagccagagcctagataatgagtggaaacgtaaaatattagtgaagtgtacttcaagttgaatggattaatcctgtagactaaccag

SEQ ID NO: 197029 - DNA, 296 bp, Homo sapiens
ttaattaggagaggaaactttcatctgttgctttcaaaaagcttatacactgaagagagcacacagctgttctgtcacctcacattcacacacttccgcctcttaggtttgagctcatgttctgctttcagtcttgttgtgatgggcagagagaaagtcgttaaagtatactgtccttaccacattctcgaaacacaccatacaccctgtacttcaggcagagtcacagtgtggggccagaagcttctgtaggtaagtaggactgagagagaaagtcctggttacctaattccttt

SEQ ID NO: 197030 - DNA, 239 bp, Homo sapiens
catgaccagaggtgtaggttttttcacccagcccgcgtctgctgcttggtgtgtggtgaaaaaacctacacctctggtcatggaagtcttcttctgcgttgatattactgtggtggtatgagagcagaggaaaaacacagtttgagagagcttttcccgaaacacaaacagaaattgccagccccgctgtacagaagagcagtatgtacagaatgctatgtgtccatcaaaagaagagt

SEQ ID NO: 197031 - DNA, 505 bp, Homo sapiens
tgacgctctacccccctgacatcctggatgccatgctgaaggagaagaagctggcacaggaccagaacggggctctcatgattcccatccaggatctggaggacatgccggccccgcagtacccttatatcccccccatgaccgagttcttcttcgacggcaccagcgacataaccatcttccccccgcccatcagtgtagagcctgtcgaggtagacttcggtgcctgcccagggcctgaggcccccaaccctgtacccctgtgcctgatgaaccacaccaagggcaagatcatggtggtctggacgcgaaggtctgactgccccttctgggtgactccagagagctgcgacgtgcccccactcaagtccatggccatgcgcctgcacttccagccgcctcaccccaactgcctttacacggtggagctcgaagccttcgccatctataaggtgtgtgcacgcaatgagagggaggaatgcggggtctctgctaggagcctgag

SEQ ID NO: 197032 - DNA, 357 bp, Homo sapiens
cctggcctagtgtatggtactttttaaaagatactattgtttgcctatcaaacaggcaaaaagtatgacagtaccaagtgttggggagaacatggcaaaacagcactttgacacggtggtttcaggcatggaaatggctacagttgctgtcttcaaatttgggagtatctaacaaaatggagaaatatgtcacataccctgtgtctctgcagttctgtttctgggtaaattcttacctgtatgtacaaggagacatgtatcattccctaccacgtcgtcgtcattagcagaagctcgtaagccatgtaaatgcctgtcagtcaagaaatagatgggtaaaatgcagtctctttacat

SEQ ID NO: 197033 - DNA, 544 bp, Homo sapiens
gatatttggttgcttggttcatatgcatagaaacagttgtcataactgtaaaaagcagtacttagcaagtatttctaagtgattggaatagctttcctttaatgttacaatactgcctattgatttggaaattagatcacgctctatgatgtttcgattttactcaaaggcatcatgagtactctgctcattctttcattctttatagttttctagttgagttaggaactattttatcagaaatcattttagcattataataaggattttttttttttgagacagagtcttgctctgttgcccaggctggagtgcagtggcacgatctcagcttactgcaacctccgcctcctgggttcaagtgattcttctgcctcagcctcccgagtagctgggactataggcatgcgccaccatgcccagctaatttttgtatttttagtagagatggggtttcaccatattggccatgctggtctcgaactcctgacctcatgatccacccaccttgtcctcccaaagtgctgcaattacaggtgtgagc

SEQ ID NO: 197034 - DNA, 509 bp, Homo sapiens
gagtccaagactcatccagattgactctgtccccctgctcctcctgcgtagccactcaggcagcaaataatttcatttccaaaatttcatttctaatccacctcctcctttccctctctgtgagcactgtgttctgcgccttaacatttcttgtctggaaaatttcaatagcctttcttaactacccaacgcttatatttcacttgcgtcccctcaacgtgcccttccactggaagttccagcaatcctgaggccctcagacctcccctcaccttcgggactggcacgggcctctcccttggtctcttttccactcggaactcctatgcttcctttgaaacctatgttagagagtcaggcatggtggcatgcacctgtagttgcagccactcaggaggctgagggaggaggatcgcttgagtgcaggaattcagggctgcagtgagctatgaccatgcctctgaatagccactgcactgcagcctgtgcaacgcagtgagaccccacct

SEQ ID NO: 197035 - DNA, 214 bp, Homo sapiens
tgattcctgactcagacaatacaaagtggagtctgggaatctgcacttataacgggcatctcaggtgttatatgcaggagcattttgagaaacacgggcactgtgggaacctagaagggactaccaacctagcctggaggatagaggccatcagagaaggcttcctggtggaggtgatgccttgagagatcttaaaggaagtgtaagagtttgc

SEQ ID NO: 197036 - DNA, 415 bp, Homo sapiens
caatctctctctcctttctaaggacaacagtcattagataaggccccccaccaatcctaaatccaggaccatctcatcttgagatacttaattacatttaccaagataaagtcacatttacatgtcccaaggcctaggacttggacatattttggggttggggggacacttcaacccactatatctccctgggtcctcttgagatgacactaatagtctttgatatttttcttgctttttgtgtaacatgatgttctgattcatcttgtagatttcctgcccttgacctggaattagtcatttctccaggaatctctggtttcttttagtggaaaattgtatttagagatcacaataaaggtgctaagaatgtattacttttgtaatcaataaaaacaattttcactaaataaaa

SEQ ID NO: 197037 - DNA, 625 bp, Homo sapiens
actctgtagttccttacccttctctaaattcttcgtagcacttgtcgccagctgaaattgttatttttctgttagtttattttctcttcctttccatagtattttaagctccgtaagaacagggacctggtctgtctttataccactgtacaccaagagcgcaaatggctgtgtgctcaataaaaacttgtcaaatgaccacaactacccaggtaatttactttaaggtcaccaagtacacataagatcaagtcaccaccaataaatcagtaagtccaatgaaacagtaaacacaaaataaattattactctgttcctgggtaaaatgatcttaaattgtaccagctttcagcttggaaggtttgataaaagtttgatttggaagacaggtaatttttatatatttttatggagaatttttatgaaagacaaacactacaacaaaaacaatgtcatgaaaggagcaaaaccactgctgtggattaccaggaaacatgagtaagaggcttgggctttgcccagtgtaggtaccttatcttatttctgggagtttttctacctaaaaagcatcacacgatgatgcctttttgaagcttccagcaaagatcatagctatgttgtgttt

SEQ ID NO: 197038 - DNA, 361 bp, Homo sapiens
gagctgtactgtattaaatgttctcttgttttcttcagataccaactcacccactgaatgattcctatttttgtatcccagccttttatttggaaaaattcctaaatctgttatgatccttgccagacaattcaactaaaatcagataagcagatgagcaacgcctcctgcgaacagtcaccttgttcctcaagggctgtgtctctgtgtggtcatgcctgacgtcgccgaatgtgccacaccttttctctgtactatggcagtgagacagctgagaagcatgctttatagagagtgtatgtgtcagatcatttgctgctcatatcaaactccacatggaagggcagtaacagctgacttc

SEQ ID NO: 197039 - DNA, 671 bp, Homo sapiens
tcattgtaaaattcagtttactatatcgattttatgctgctatgtccacaatcaataactattttatatttgtataattatcctttttaagctatatcctatttccctgacatcactctagttgctcacagatcaagatttttaatctggttctccaagaatttcacccactgacccactcctcacatttatattaatgaagtaacactgattctagaataatcctgcagaaaactggtaaacctctgtagaagtaaatcaattagctcaatttagccattacaccacatatacatatttcaaaagaacatactgtacttaataaatatatacaattttttctcaattaaaaaactgtgcaaaaaataagtaaatgaaatttccaaagattgaaaactaaatcatagagagtcatcaaaacactggttatgagtttctatggtttcaaataaaaagggaacattatatttaagttacaaatatgtatttaagtttaaaaattaaataaaaaaattacaatctagttgcaaaagtgtttgaaaacagtctgtaaaggataatggaagggaaactaaaagcaaagctacggaaggatacaatgctctacaggtctacagaagtaaagttattcttacttaggaataacttaggccacatgtacaagtcattgt

SEQ ID NO: 197040 - DNA, 161 bp, Homo sapiens
ttaacagttagtgtcacaatgattgttattagatactcactcatccttttcatcattcattcattcattctgtgagccttaactgattattgtactaagggctgtggggccacccgaatgcacaagacacaaagagatgttcacacaaatacagtgtatat

SEQ ID NO: 197041 - DNA, 361 bp, Homo sapiens
cagaggactttgcagtgcctgatcagggcagaaaaaggaggcatgcacctgggggaggatcacatacgagtgaaacctgtccccgctgaagcactaggtttggagaaatctactgggcatttacacacctttcccacttctgcttatgacttgtagccaaactcaagagtaccacccacttccaggaatagtgtaccaaggtaacagaaacattctagattcatacaattggggttagattaggatcatctgaaaatgaaggttgtgtatgtcaattgccttctaacaggatgggtggagagatgtacttaatgaatgatttgggggaagggctagaagtgaagcacatggcctctctgcc

SEQ ID NO: 197042 - DNA, 620 bp, Homo sapiens
gaccctacaggttctgctgattctcccactgagtggcagggcccaagccatcattaggggaggatttattttgaaagtgtcatcttaaactgcaaggatgtctgtcagatatcacaattaaacatgccaaaggagaaatcatattgtcaaaatgcccacttaacccactgaaacgtctcaaactcaccccttgctgaccttctataaccccattgtttaagttttttttttctttttttaaacaagagaaaatagacagatacatgttggtatatgctaactgtccatattcacatagagacacagtgtgctctctgatcccaatatacagagaaaggaggaaaaaactagaattgtatgcactactacacagggacttagcaccctccagattccagtagcgtgaagggagcaggttttttcttttttcccacagagcttgggggtgttgattccatatagttcagacaggaagggataaaaatgaattttgaacagaaaggggtagagactcttttcctgttctattctgctcaaggtattttctccaaaataagttgagaatcatggtgtagagaaaagagacctcaagaacagggtgactgaggacaagattaaaa

SEQ ID NO: 197043 - DNA, 459 bp, Homo sapiens
ggtcggtgaaggaacccagatcgtcaacctgcggctgcccctgtccccagggtccccaccaggcagtcatgaccccccaccgagccctctccctttcgcctcgcctcccagccccacgccccactccctcgggttcgcgctcctcagtcaagatgaaagagcccgcgagcagcagataggtctaggttcgaatcccacctctgccccttaatggctggaggccttctcccagcgccggcctgtaaaatgggcccatcacgcaccgactttggctggaggaggcgttcaggaaatgtcagcttcctgccctcatccgccctcatctcacgtttccctctgcttcccccctccttttagttttgttttaaatccctccctcctgcgccctttctcttctcggctccgcaatcttagccaaaccgcagcgtttagcaatcctgcgcccacccggcgccctgg

SEQ ID NO: 197044 - DNA, 432 bp, Homo sapiens
ataccgcaacatataaatctgctgagccacctcaaatatctacctaaagaataaaggtttgccaccaaatacaaagttccatttcctatgagcttataatgcactctagaactctataattgtttgtaatctaagcagtatgacaaatggctctctaataatttttaatccaagtaagataatgaaaatttgtaataattagtgcactatgagtactccccaaaacttccagatagatttttcaattctagagtaactctgtaagaatttcagcttccacatactaacaacaggctacataaaacagcttgggcttagagacgtctgacttccacagcctatctccttgaaataaaggagaagatgtggaaatatttctcattagccacatcaacctttacagtagaggaagctatatgtgtcaattcacag

SEQ ID NO: 197045 - DNA, 594 bp, Homo sapiens
aatgaagtcaaattatttttcccgtcattggggggaataagaaataaataatcaaatgttggaaaaggaagtgaattacaacacttatgatgatgaaaatatgtttgataaaacttttaaaaacattatgatgtaatggttgggtgtggtggttcatgcctaaaatcccagcactttgggaggccgagatgggaggatcatttgaggtcaggagtttgagaccagcctggccaacatggtgaaacccagtctctactaaaaatacaaaaattagctgggcgtggtggcatgcacctgtaatcccaaacactcaggaggctgaggcaggagaattgcttgaacccgggaggtggaggttgcagtgaactgagattgcaccactgcactccaggttgggcgacagagctgaacccagtctcaaaacaaacaaacaaacaaacaaacaatatgatgtattaatatagctaaataacatgctggcagtttgccaaacatgatgttctctttcacacttggtcccctctatgcatgttgtttccttggcctggttccctttcctcttttctgctgatatatagcttttcatgttagaag

SEQ ID NO: 197046 - DNA, 358 bp, Homo sapiens
ctaagcaaaatagaaatatatcgaagtccaaaaagaaaaaaaaagacgttataaactacgttttaaaagtctggtaggtaatttttgaatcgttctctttttcatgatctgtacctgcattaaccaatgatagccactagccacatgaagctatttaaactttaattaacattaagtaaaatttaaaatccagttactcaggccgggtgcggtggctcacacctgtaatcccagcactttgggaggctgaggcaggagaatcgcttgaacctgggaggcggaggttgcggtgagccgagattgcgccattgcactccagcctgggcaacagaacgaaactctgtctctaaataaataa

SEQ ID NO: 197047 - DNA, 3683 bp, Homo sapiens
  misc_feature (771)..(771): n is a, c, g, or t
  misc_feature (1836)..(1836): n is a, c, g, or t
  misc_feature (1853)..(1853): n is a, c, g, or t
  misc_feature (2230)..(2230): n is a, c, g, or t
  misc_feature (2261)..(2261): n is a, c, g, or t
  misc_feature (2334)..(2334): n is a, c, g, or t
  misc_feature (2466)..(2466): n is a, c, g, or t
  misc_feature (2746)..(2746): n is a, c, g, or t
  misc_feature (3011)..(3011): n is a, c, g, or t
  misc_feature (3433)..(3433): n is a, c, g, or t
  misc_feature (3458)..(3458): n is a, c, g, or t
  misc_feature (3618)..(3618): n is a, c, g, or t
  misc_feature (3683)..(3683): n is a, c, g, or t
gtcagcatactgaagacatatatgtgttatttctaagcacatttcctatttatgtgataatggagatcgccctttaaccatcacttggacgtgaaggaggattcttcttcctccattagtaaatattccttgacttgataatactgaaaatatgtgaggtgaatgagctttaatcctgtggtttggtttggtttttggttgtttgcagtcttggactgttcacctgcactgtcttgtgcctttgagtatgattaactgccttgacgccttacagtgcattacacaactctacttcttccatttcttgactaatctctcatgctgtttgactgcccattggaatctttaagttagctacttaggaaagactttaggaaggagaatgctaagagaactggcagagaagtcaggagcctgggctctgtccaggccctggcgtaagtcctttcacctcttcctttgactcctttacaaaatgaagttgaactcattcgagctttaaaaagatgacgccaagaggcaagacagagggcagtagatgtgaaagtaacatgaaagagaaaggaacatctgaaaaaaaaaaaaaggtagaaaaagattttgacaaatagtactaaaaacaaagaatatagaatagagagacccaattatactgataattacaattatcagtattgtaaaaactacagcaaaaaagctaaaaacatattcagcttttattgtccataaaaagtgatcacaccatgtctaactgtaattcgtttgtcaaanacactagaggccaaggactaaattgcggattaagagtttcttccttttatttcctgcatatccagaaacctggggtcatagatactcttccatggtgtgttgtttggcacaacttgcaagtattttggcagatggttagaaaaaaagactttaagaaatatgcaatagtactcaggactctaaatataataaataaagctaagataccagtatcctgccattcattacaatcaacatttattgaacagcagttatatgccaggtagcagggatacctagaacttgcccctcccactagcactccagaagagttcctgctttcccagcctaaagcaacagcaagtcttacatgagctaggcttactgtgatagctgtcctgacggcgagtggcaaacatggcccagtgccttcctcatggatgaacatgactctacactgggactccccggtagacctttttgtgatgatgagaaagtcctgtgttggtgatgttcagtatggtaactagtgactgtatgtgctgttgagaacttgaaatatggctactgtgactgagggacagaacatttaattttatttaactttggttgagtttaattcaaataactacatattactaatggctactgattggacagcagctttctagacccattgttaaaaataattataagcaatgagtacctcttatgagatagaattaataatcccatttattgagggcccatgacagattaagaattatgtttgacatatattatccctaatcctcacaagaatggttcatttgacaaataagataactgaagttctgagagataaattgctttgttatgtcctcgcaaggaattgtgagagctggaatttgaacctaattggtcagactccagagctgggtgatttctagtaatctgccaaatctgtgtatgtactgtccggatgctgtgtcttctgagtacatcttctccttgctttatggattagttagcaatgtctttatcttggtcacataggacagttacagggtccatcttatctcttctgaatatggacgtatcactgcnctggaaccattcatttntcttactgaggcctatgtccttcaaaaaatattaagagttgagggtccaacccagcttcttgagtagtaagctaatcacctacaagtatatttccccagtagatgctgagagaagcatcaaagtacatgggtagttctgtggacatcagtggcactcagtaaactcttggcatttgagtgtttaactgtcacagttgaggatatctgtgaactctcccaaggcctgagtcactgaatgagcccagccagtacttgggcgtctgtggctccattctgctttgctgttttctgctttccatggaacatacagtaactctcttgaagggtctgaaagcctcaattacaacgtttcagtgattctgaactgatttttcttnggaaagtatatatgcagatggtacttgcagnatcaccagggggtagtaacgtggaggagtggtaaaggtctactggacaatcaggtggctaccacccaaccacncatggtgatgtgatatgaagccacttttctttattccttcagatttaaggtttccccttcaggaagcaggttacttaacaagtacttgatttcaccataacatgcattatgacattatctttttttcttttntctttttttttttgagacggaatcttgccctgtcgcaggctggagtgcaatggcacgatctcggctcactgcaacctccttctcccaggttcaagcaattctcctgcctcagcctcctgagtagctgggattacaggtgcatgccgccacacctggctaattttttgtatctttggtggagatggggtttcaccatgttggccaggctggtctcgaactcctgacttcgttatccacccacctcaacctcccaaagtgctgggattacacgcatgagccnccgttcctggccgatattttattttcttaaaaggtcattatcagatgccacaagagtatttctataaactatgacccaagtatagcctaatgttaatagcttaaaataggttttatttaccttttttgccctttaaaagcaaggaattattttttaatggaaagaacatagactttgatgatcagttcacatccttgctttaccccttgaaaaatgtgcacctggaaagacagcttaacattcctgagtcacatttgtccaaatnatacaaacaatggcaacaagacttcagcactaatgtctgatgttttttgtatgattaatctgtgccaggttccattctagtttctttacacacattataccatctaattctcacaacaactttgcatagcaggcattgtcatttccactttacaagcaggaatctgaggaccagagttaaaagtaactggtccaagattgcctagttaataaatggtggaatttgcagtcagacccaagctggtttgggccaatacacttgaccttcttatgatacgtcagccttgtgaaatagggcagatactattaataatatccaccttgtgtgatcattatgaaggttagatataatgtatgtggaactcttgccaccaaagtggttccacaagaggccctaaacaaatgagtaatcattattatttnaaaatgtccgtaagtgaaaccgatntgccaagaccagtaaaaatgagagcttcttaaggaaaagagtaggaggcatacctttgtttcattttgtttgttggtttctgtgcttgctttttgttcttttctgttaggcacaggttttatttagaataaattaaatttttttttctttgatgagtgcngaaataatagttggaaacattgaatggaacagctaatgtaccatagtaatacttcttggattacn

SEQ ID NO: 197048 - DNA, 336 bp, Homo sapiens
tacagcactcagcatctccgtgtgggagaaaggaaagtcataaaactggagtgagatcatgaaaggtttgcgaaatgttcaggggccacctcaggtaaccatcaaaagttatgtatctaatatgccacctcatccaaatgtgttttgggcaatactttcttcatagcatgatttcaggtaagaaataaacattgtggatgaagccacaggacatgtaggaagttttgagataaaaatatttgcatctccggtcttgtcatgacggacagtaacatatagtggtaagaactgaaaacctgcagtaaacaaagctcggtttctgatttttccctgagt

SEQ ID NO: 197049 - DNA, 521 bp, Homo sapiens
atgcacatctcacatgactactgtgtaagaccttgtcagaagttagaaacaccaattcaatgtctgtgaaaccatcaatacttattttgatgcaactttgttaaaaatgtaaagtctaagacagtagatttgtacacgatgtttggaaacaccaatcataaatgaagacttgaggtcaaacagacttatggtcaccatacttgcagcagaatttgctggggggttgatatatgttcatcaagtaaacagaaacatcaaaccagagtagttctctagttagtaaaatgagaataaacaggttattaattaatctatttcagaggatggtcaggtggcctagagaatgctgtcctggggaaatgacatttatactgctacatgagatatgattagaagttaggtagaagaacatcattccaggcagaggaagtgggcacaaaaaggtccttagtaaaggagctttttgagttcaaagaactgaaagatgatgtgtgttgcaaatgtgacttgtgaggctagca

SEQ ID NO: 197050 - DNA, 426 bp, Homo sapiens
caaagtaacttgtgaatgaaagaagtaatttactagaacaacgcttgttgatgataattgacatttaggtataacgtcatatatgaatgattgtatttatgtatttatttgtcaaaattgtacatactgtttcgccaaaagtaattgtctgtaaaagtgcactctccaggtttgtagtactatttagggttacatgggttgccaatcaagctgctaatcagaatactatttttttgtatcaatgttataaaactaaaaatgacagacactgaagatatcattacactttcttcaccttcctcttgaaatgtaaactgttgactgaaagcgcaatgcttatgtacaggcccatctgtcatgaggaagattatggttccataaagctgatttttttaaaccattgggacaaataaacagaaggagaac

SEQ ID NO: 197051 - DNA, 397 bp, Homo sapiens
  misc_feature (14)..(14): n is a, c, g, or t
atcccccgcttggngctttcgagttgctattacaacatgtaatttactgagttacaaacagcagggtcagggctgggcaggtgcacacacttatccatcctgaggaactgccaggacaagacaaaggcatatctactcctcgcttgctctgatgccagtggcagtgatccaggttgtggcaggtggcttctgtttctatgcacatcagtaatctaaaactcagtcccatcgtcctctgtggcctgtgttagaggtgaggggaccaggtgcttccatgaaaaaacttctcatctccaaccagccatgctcccagagaatttcacagtctctgtggggtcaaatcaaagggcgctcaaaggcagtttaagctctccatcaggcgagtacatagctggac

SEQ ID NO: 197052 - DNA, 488 bp, Homo sapiens
tgaaaaacccagttaacatcatacctaatggtaaaagaattattctttccccataaaatcatgaacaaggcaggaatgttttctctcaccacttttattcaatatcatactggaggtctttgccaatgtgatatggtaagaataagaaataaaaggcacaaaatttgaaaaggaaaaaaaaatggctttattcacaaatgacatgactatttacacagaaaatccttaagaatctaccaaaaaaagctactagaattactagtgagtttaggaaagttgcaaaatacaatgccaatatataaaacccaattgtgtttctataatgaacaattagaaattgaaattttaaaaataccagttcaaaggcatcaaaaacacatggaggcactgatgagacaaattaaagacgaccaaaaaccatgttcacgaatcaaaagaatcaatatctttcctgacatgacctaaaaaaagaaatcaggctgggcgcg

SEQ ID NO: 197053 - DNA, 379 bp, Homo sapiens
tctttctttgttttgaccatcacaatctggaatgacatggacaaaagggaaaatacttcatgtccacgttaactcgtcaattcttctcctggagaacaggccttcaatgtgctctacacgttgagtaatgagagcctgcactgcccaccttccgtctctctacaccttccttacttgcgtggttgacactgcttttctcccgaccaactgttaaaaatgagaattgcaaacatttaaaatgtctataatataaatgttattcacatgatatttgctagttttctttgaatgttctgtatagggttatactagtttcttgaaggaaatgtaaataaaggataggtagatacatggttgaatttctccacaaaaatccagc

SEQ ID NO: 197054 - DNA, 714 bp, Homo sapiens
ttggtagtaacgtgcaggttgaactggtggatggaaggattatgtctgtgctccccatctccactgtccctttcctgttcccactccattaggccttgacaaaggtcaaggacttcccgcagtccaataataatctcctaacatctctccttgcttctactctctccctaaatagggtggtggcagcagaatagaaaggatcagatacaacagataacactgaaggaaaaaatctacgacttcagaaagtaaatatttctaaaagaaatagagaagttatgaagcacagattttattgcagcggactggcagtttttactcttagggttggccagctagtaaatttattgcatacctgcgtgtgtctgtggctttcgaactctgaaattgtgcattgactccatgaacaagttaatactgtgagactgccaccctgtggacaaaatatcaggactaaaaccatcaagaattaaagtttcattcatttgcgatttactgttttagaactggctttggttcttccacgttggtgcatgcagtgatgctcattaaatagaaagcttgaaattaattttttctctgaattttttctgaggcttttaaataaagggaatctaaaatggaaccagtagttttaaaaagctgcaatgattcaagagtggtttttagatggtacttctttgctctagaaatttcatatggaagggttggttt

SEQ ID NO: 197055 - DNA, 550 bp, Homo sapiens
tagccggttcattagtctgtttacctgagtagatttcaggcacctaattgccacaattggaataggttccttgtagataatgaaaacgtttgcagttctaggcaaaaggtaacttagtagtgcttagtcagagccttatgctttcataccatattgtttatgaatgattgatcacttacaatagatctcttatggcttatgtcctgacatccaaaattttcctactgtatgaacttagttgaaaatctcaatttaaattgtggcagattaaggaggggaagacatagaaaactcattgaaaacatagaaaaagcgtttgttatggcagggtaaggtcctgccttgtcacagaatttggaagcagtacatcttcacactgtaaagctagttttcacactttggatcctaagagatggctgctttcatatgttgctgatgtctgcattcctcccaccctcctacagagtcaccccgctctgtttcttttaattgcttgtatacctagagtagtcagctgtccttgtctgcgtaggactgtcagagaaaagtc

SEQ ID NO: 197056 - DNA, 726 bp, Homo sapiens
gtaatattcaacaaccaggatccctacggattgtctcaggtgcttgtaaaacacagcagactatgtctttttgcagagacagactttggcagcagtatcaaatctgaatcacctcctctggctgcctctcttctggccatattgtctggtatggctctttgacaatccctgcttccttgtgatggtcccatattggagagagaagatctgctttgagatgctccctcaattcttcctcatttctctttactgcccagctgttctctggggtgcacatttactatattcttcctctttctaatgcagatgactcttttgaaccccattattatgcctccattttatcatctagatccaggtcatttttcccaggatttgaatcattgccctgtcaacgactctgtcccatccatctcccattacagtgctattccaggtgacataacagggtcaagtccacgcacactccagagtaaaaaatccaaacatctaaaggctgaatctataataacctggatggtttcatctcaaaatgtgctgatgagctaactcatagaaaacaagaattctgactatattgctgcctcactgcccatgggtgcgtcttttcttttcatggatctcattggtcaggcatttaggagaatatggagactagtgggctgattcacctaactcatactgctcttccacccttcccatcttaattgttcctaaagaaatatc

SEQ ID NO: 197057 - DNA, 240 bp, Homo sapiens
tccctgaatatatatacctgagaactccctgtactatctttacaacttcctgtgaatctgtaattatttcaaaattaaaaattagtaaaaaaaaacaaaataattcaataaaacaaacatggcactgagatagtaaactcgtaaaccctttttgttatggttaaattattggttatattcaggaaaattgttaaaaacttggaaatagggcaaatgaatagctgcatattcgcaccattc

SEQ ID NO: 197058 - DNA, 364 bp, Homo sapiens
gatgtttataaaagttaattttttaaatctaaactgtttagtttataggcctttgaagaagagtttttgagatagatgctagacccataataatctatttgggacaaatggaagaacaaattttgtgaattttacttgttcataaaaaacttgaaaatatagtagttagtcaaaggtaataccagagtaggaaaaaaactagctgcagaaatccaaattgcaaatatacattgaggcttaaggataaatcacagtactttgtcctagtttgatttgtgaacaaaagaagggttcacactgggagtagaatttatgtttttgtacttaggtgtttaagtgattaaaagctttttgtttgatatat

SEQ ID NO: 197059 - DNA, 452 bp, Homo sapiens
tttacacacttcagaatttgctatgcatgagtctctctgactgcggatagttgtattgtggctattctgtgcacacaccttgttctatttcaatttttttccatgacttattattcaaaacagtgtgatacagtgaaaatcagatccgctatggtccctgcccccaggttgcttagagtctctgaggggttatggaaaagtaattaggaaattgggaatcagagtggtttgtgttctgatgaggaaggaacaggtccttatgagaacacagaaaagaggtacctgttttattctcctctgcatctctagcacctggtacagtacctggcatatagtaggtgtctcactaaatctttgttgaatgaatgaataaactcagaggtgggttgattgcatggtcacttttggggagatcttacatctgagctaagttagtgatatccactggaagt

SEQ ID NO: 197060 - DNA, 164 bp, Homo sapiens
caaaactgcagagaagggggaccactgtatagcattctccgcaaagaacagtacatttttagagaaatgatgacataaaggaaacggactctagggatatcaacttgtgggaaggcaaataaatggtagataaagaatagttggtagtttgttgtgtgcatttc

SEQ ID NO: 197061 - DNA, 689 bp, Homo sapiens
cgtgggtacataaagaacactagccagattcgattcggctcgtaccatactggtcatacagtgacagcatagattatcccagggctcaatcagttgttccagctaacttcctgctaaacagagctggtcaccaggagccaggctgacacctttgaaccccttcttcccctctgcctcctttctcagaaaatataaagtgcaaaatggtccagaggtggacagtgtggggagggaggggacattgagtcttgatgacctgcaaatttacaccagtttctgcataatcctatatgggctttatctgatcttagaggcacccatccctttgcaataaaagattgcatctgtttttatttcccctttctgttggaagctgataagccaagaatgtactctccccacctgctctcagctttgattcccattaacacaggggcattcccaggaaagggttgggctccccaaggtgtttgctggagaacctgctgtcactctgcagagatgtacaagtatttactgaaagaagaacttctccaggaatattgtgtaagcagattacaccggatctccctgcccttgggcaaatatatatggtgaagctcaaagaggggaatccaatgcacagaaacctccatgcttaaaaaatatcttgtggccggcacggtggctcacgcctgtaatgccagcac

SEQ ID NO: 197062 - DNA, 506 bp, Homo sapiens
agctgctgtaaacatttgcgtataggtccacctgtgaccacagttttaacttcacgtgatcagatgcccaggaaatgaattgatgtggcatatgagcaatcatatttaatttctggttagaatgtaataataaggatctaatttactcttattattgaaaagaacttaaaaatactggacaacatatgtgaagcaattgttttaagatattagacatcaagcaatggaggacagtgatcattgagagaggagaagcaaggaggatgagccctaggattgcctcagtttcccacctgatcaaaagcttccaggccacaacacagaaaaggaaaacacattttagatataaaggaaaatagactaacattaaaatgacgaatacaagctatatcatgaaaatactattcaaaagaagctggtgtggctatatgacatcagacaaagaagacttctgaaccaacactattactttgcataaataaagtcatttcctaatgaaaaagaag

SEQ ID NO: 197063 - DNA, 203 bp, Homo sapiens
aaaacaataaacaccggtgactacacgggtagggaatggtggagacagatggggacagcggctgaaaaactacctattgggtactgtgctcactatgtgggtgatgggaccatttgtaccccaaaccccagtgtcacacaatatacttatgtaacaagcttgtacatatatctgcataattgaaagttgaaattatttttaaa

SEQ ID NO: 197064 - DNA, 783 bp, Homo sapiens
  misc_feature (680)..(680): n is a, c, g, or t
gttggagtcctgacccatggtacctcagaaagtgactgtatttgaagataggtctttaaagaggtcattgtaaattaattaataaggtcattagggtggactctaatccgatatgactggtatccttataagaaaaggaaattagcacacagacacacaatcagagggagaagacagccagtcatctacaagccgaggagacagacctcagaagaaaccaaccctgcctgcaccttgatcttggacttctagtcgccagaactgtgagaaaacaaatctcatgtttaagccagaacctagcacgtggtacttgttaaggcatccctagaaaactaatacactcactgaatgaggcaggtagctgtttcttttattttttgagacagagtctcactttgtctccaaggccagagtgcagtggagcgatcacagctcactgcagcccctgccttccgggctcaagccatcctcccacctcagctacttgggaggctgaggtgggaggattgcttgggcttgggaggtgaaggctgcagtgagccttgacagtgccactacactccagcctgacgacagagtgagaccctgtctcaaaaaaagagttgctgtaattcccagcaacaaagtaggagactcaaactaaataattttctatagtcctagaacttcttagtttacanaacatttttacttctgttattctccattgatcttcatacccatgtaaggttaggcaaatgtttccccgctgtgggtgcatatcccgaatcctggaaaccctgt

SEQ ID NO: 197065 - DNA, 708 bp, Homo sapiens
gtcaaggatctcctgggtggtttttaagaataacaactagtatttgttgagcaccatgcttggtgttagctttatgtaatcttcacaacaaccccatagtatcagtcccatgttataggagtggaatctgagactcagaaaggttgtttcagttatctgttgtataacatatcacccccaactcactggcttaaaacaacaatgatttattatttctcatgattctctgagttggctgggaggctcttcttgcttcgtgtgatctttcgtggggtcactcttgttacttaattcagctgtcagcctgtctgggtgtaggctatccaagatgacctcactgacatgagtagggtcttggtttgcctccacgaggcctctctcagcacatagtctgtcatcattaggtggtctagcttaagctgctttacatgacaactagcttccaatagagtgaaagtggaagctgccaggattttgggctaggcccagaactggcacagcatcacttaccccttattccagtattcaaaacaagtctcaaggccagtcactttcaacaggagggggaacagatatcaccttcctcctccccctctttttttggtatattcgacatacaattcatgtaccatacaatttacccatttaaagttgtacaatccaatggttttcagtatatcaacagagtttttcaaccatcaccactat

SEQ ID NO: 197066 - DNA, 695 bp, Homo sapiens
gtccaaccctagccaatatgggaaagacacagcagtagagactagctgtgtaagagataggaaccccttccccttccttgtcggtgtgctctcgccattgctccatccgcaagatgcacccttctatagaaggaaatttgccttgctgagaaaactgtttgccagagtgctgattcttctttgcggcacccaaaatttatttccaacaagcctgaccaacatggtgaaaccccctctctactaaaaaatacaaatttagccgggcgtggtggcatgcgcctgtaatcccagctactctggaggctgaggcaggagaatcgcttgaaccctggaggcggaggttgcagtgaaccgtgattttgccactgcactcagcctgggcaacagagtgagaccctctcccccaaaaaacaaaaacccacaggaaagggtgctccttttccctccatctgacaggaagaccaacgtttggaaaggccacgtgcccctcaccaaggtgacagggcctgcatgtggcagagcagggctgggcatccagagccctgtccccagctcctgagctcttctgctgcctcactgtaggctccggcccgtccaggtacctgtgccttcacctcagctcacattttcccccttttctgtccagatacaggcctggcgagctatgatcgatttgggttacccgaaaaccaatc

SEQ ID NO: 197067 - DNA, 439 bp, Homo sapiens
ttgaatgcagattagttagcacctggaccatgtggtggaggatctggaatgctagaaaacttatcatttatccattaatacgttttgactggaagagtttcatgaggagtttcagggagattgatctggtgtcataatgtagatagatttttttttttttttttttgagacggagtcttgctctgtcacccaggctggagtgcagtggcgcaatctcggctcactgcaagctccgcctcccgggttcacgccattctcctgcctcagcctccccagcagctgggactacaggcgcctgccaccacgcccagctaatttttgtatttttattagagatggggtttctctgtgttagccaggatggtctcgatctcctgaccttgtgatctgcctgcctcggcctcccaaagtgctgggattactggcatgagtccagcca

SEQ ID NO: 197068 - DNA, 273 bp, Homo sapiens
atgtcaactccagtgataaagaaagaaaaagtctgagatattagcaagccattacagcaatatatttgaaaacagtatatactgagtctactgcaaaagactcatcattagatatgattacttctattttcattagtaaacacttcagtggatggagaaaaagcattcaatgaaattcaacattcattaaagtttaaaagaactctcaagaaaccaaaaatggaaaataatttactaagccttataaaactaatcagtccaaaaggtacggca

SEQ ID NO: 197069 - DNA, 402 bp, Homo sapiens
tgaggtacatgctgtcagcttgatgctggagtttggcctctcaaatctctaacctgttaaatgaagttaattaggattaattttttttaatgtatgtttactactgaaaataagtgctcggccagacgcagaggctcacgcctgtaatcccagcactttgggaggccgaggctggcagatcacctgaagtcaggagtttgagaccagcctggccaacatggcgaaacactgtctctattaaaaatacaaaaattagctgggtgtggtgatacatgcctgtaatcccagctactcggagcctgaggcaggagaactgcttgaacccaggaggcggaggttgcattgagccaagattgtgccattgcactccagcccaggcgacagagtgagactcatgtctca

SEQ ID NO: 197070 - DNA, 481 bp, Homo sapiens
cagcaataagaacaaatggtaaatgaacaaacccaagtatgacaattaaatttattcaatatgttgtatttacaaatataaatgcaaatctgtattagtattttaatcctcatagtcattatgaaccttatctcaaaggatttgatctgcaaacgtcaaaatttcaggtttgggtttatttatgagtcttccaatgatcttactttcaatgtttttatacttagttctgaaaattaaattaaccaaataactaaaaagatgattttaaattttattttatgaaatgacagatggtttctggttaactgtgttttattttttgttgcatatttgttaaaaagagaatggttagatctggaaaatgctgttaaacattccttcttttagttttatgttcagacatttattattcagcagtgagtatgatggctttttaaataaccaaatcagttggaaattaaagctgcttttaaaaatgtct

SEQ ID NO: 197071 - DNA, 639 bp, Homo sapiens
ccccctgccgttagttctgagtgacgctgttcattcttcccacccaaatattctcccaaatgtccgcagccctagagagctcgacctccaatccttgcttgctcacactcagccccttcagcacttcaggaaggcagggatttgaacaactgaactcaaggcatttggcaggggccagttttgctaagaaaagaaaagaaaatgcctcttttattgttgcaatgccccagacaaaggcagagaacagttcatgtcaccctcaggaatacctaaggatactgagcacatgtctaaatgggatgagaggtgggcgtcgggagttctaccgcctgccccctttattccctgagaaggggcgttgccttgtcttcaggatctgtgtttctggatgtccacagcagactgcatgacctccttcttaggcagatgtggcaggtgtggctacaccagtcaagacgggggagagagctccctcctctggaagcttcagttctgagcccaggtgtttgtcctgcactcaggatatgctggtttctagcaaacaggaatcacagagagacacttaccttccggttgatgtgagcggtcatgagtgcatgtcggtgcatcttcacaatgcagagaaccagaccagtccac

SEQ ID NO: 197072 - DNA, 203 bp, Homo sapiens
ccagagtattcgacactctaggggcactgatttagatttcagagaagaaataattgccaatcttttcttagcaacagaaggggaccaacttttctggggctttccaggggctggggacggccatagtgtgggaggatgtctagaggtgggagggatccataatgaagaagctcgcccaggaagggtccatgttgccagatgct

SEQ ID NO: 197073 - DNA, 381 bp, Homo sapiens
ctagcataagcaagttcattgtcagttttcaattgtttagggacccccctatatgggcaaatgacaacaatgtcaccaggcatgaccagctatttcccctgtttggcatgtggcatgcagcatatgggagtaggagtctatagtcacatggacatagctgagtttgccaaaggtggctatattggtaacatccatctgtcagatttcatctggagccaaacctcgtggggtgcatccttctacacgggcaacaccagggacatactggcaagtggggcaggcttgcacaatagcttaagcttggctgcaaggcagatgaaacatacgagtaagtgcagagttgttttgatgcagtaatgcatgagaagcttgggcttgttg

SEQ ID NO: 197074 - DNA, 635 bp, Homo sapiens
  misc_feature (248)..(248): n is a, c, g, or t
  misc_feature (288)..(288): n is a, c, g, or t
  misc_feature (321)..(321): n is a, c, g, or t
  misc_feature (341)..(341): n is a, c, g, or t
  misc_feature (343)..(343): n is a, c, g, or t
  misc_feature (348)..(348): n is a, c, g, or t
  misc_feature (414)..(414): n is a, c, g, or t
caccgttgaaatgacaacaaaggactgaaaacactgcataaacttagttgatagagcagtggcagggtttgagaggattgcctctgattttgaaagaaattctattctagctgagatggcatcaaacagcatcacatgctatagaaaaatcgtttgagggccgggtgtggtgactcatgcctataatcccagcacttgagaggcccaagcgggcagatcacctgaggtcaggagttcaagaccagccntggtgaaacctatcccagttacttggggaggctgaggccngagagtcgcttgaaccgggaggcgaaggatgcnggtgagctgagattgagccncngcgcntcagtctgggttggcagagtgagactcggtctcaagggggaaaaaaaaaatctctagcttagattnggctttatctttcttagaaatgctccattttagggtctattaatatgctggttaactgataatatagaaataatgactgatatgtgtatcctaaagttagagattcagcatgttaatagtgtgtttgctaatgaacctcagtaaactattaggaaaatgaacttctagacatttttttgcttcctgtagttgcgtggatgatcgcagcaaatcaggaaagg

SEQ ID NO: 197075 - DNA, 388 bp, Homo sapiens
tgctgacataggtgtgagccaccaggcctggccccattagtggtctttttcttattgtggttttctcgtgttatacactcatgtaaaatgaaaagtttttgatggtaccctatatgatttaatatcacaaccttgctttacactgcccctggcatctttgttgaggaattatttataattatgtccttttgacgcttcaataattaaacttgtgctgtattttggtattccagaataccaaatttggaaacactggaaaataattaagaatttattaagtttttttgcttttcataactgttgggtattatctaacaattatctggaaatcagttcagaaagacagattttaggccaggagccatggctcatgcctataatcccagtg

SEQ ID NO: 197076 - DNA, 296 bp, Homo sapiens
aattcatttattcattcaacaaatattcattgaacacactacatggcacagtagggaacaaaacagacaatcccctaccctggtggagcttacatgctaatgaaggagacagacattaacaaaaaaaagataaatacatagccacaaacttgttaagtgatattaagaaaatacagggtgtggccgggtgcagtggcttacacctgtaatcccagcagtttgggaggccgaagcgggcggatcacctgagatcaggagtttaagaccaggctagccaacatggtaaaatcttgtct

SEQ ID NO: 197077 - DNA, 570 bp, Homo sapiens
tatgtactaccagtagaaaatctacttatgttatttatgtgaactgtacttaataaatgacataaatatatgtttagaaacaacaacactccattttcaaggctgagtggctgtttactgagatctgggaagagcctcagtaactgcctgtaaaataaagaacaatttttattaactcttttccttagtaagaaagatgtaaaccttgatgcaatactcattaactagaatccttccatcacaaaatttttgttcacatatgtttaaggactttttgtttgtttgtttggagatacgagtttcactctgtcacccaggctggtgtggtggtggcatctcagttcactgcaacctccgcctcccaggttcaagcgattctgctgccccctgcggcccccagtagctgagattacaggcatgtactaccacgccaggctaatttttgtataaaatttccaaaaacttaaaacaacaatggctacatttattgaacctctagtctgtcaatccttaaggatttaaattaattacttggtagaatatatcgggtatgttttgttgataacataa

SEQ ID NO: 197078 - DNA, 1231 bp, Homo sapiens
gaaattcattaaagtaggaaaagctctcattcaagagcacagggaaatgaaaacctttaaggatttgaatgactgcaccaaataatataatatcaatgtttctaaaacataaaataatggagttctaagaacttaaaactcattagaattaggacatcataatgtctcatctgattaaacagtaggtacagtggacattaaataaatatgcctagagaggctataaattacatttgtattaaagtgaaccatacatttgtgtatatgtatgctaatgcaaaaaacaaaactttcatgttttaattgaataatgataaaatagagtatactattagtctaaagagaaaacctcaataaatctaacaaattagaataaacacaaacagtattctctgaacctagtttggtaaatctagaaattaataataaaatgaaaaaaatccacttgaaaaaattttagtatctcttttaaacaatatacaaaaaagtgtaatgcaattttggatttgatttctgtaatgaaataattgtaactgcaagttagaaaccatcaggtatagctaaagtagtggacagaaggaagttcgtagtctcattaattaagcaagaacagcatcaaaaatacaatagtgaaaacagaagaatttaaaagtaaaattaaaaataaaatggaaaacagaaatggaatgtttcttacaagaaaaataaaatgaattaaacttaaccctatcaaagaaaaaagagaggaaacacctatataataaattcaagtcaggatacatctgtaaagaggtaacgctataccaaacacaatcccattcataaaaacgagtgatacaggaggatttgctgctctaccagatattgaggctttatgtaaagtgctgtgtagctaagtagcatggagctggggggtgggatgatttagtaaattagtgaaacagagtagaaagttaaagaaaaaaacatgaggccaggcgtggtggctcatgcctgtaatcccagcactttgggaggccaaggtgggtggatcacaaggtcaggagatggagacccgtctctactgaaaatacaaaaaaatcagccaggcgtgatggcaggtgtctgtagtcccagctacttgggaagctgaggcaggagaatggcgtgaacccaggaggcagagcttgcattgagccgagattgcaccactgcactccagcctgggcgacagagcaagaccccatctcaa

SEQ ID NO: 197079 - DNA, 418 bp, Homo sapiens
gaggattcatgctgggggacaaggggtgtcctgtataccctgagttgttgagttgtcatggaagggctgctttgaggatgcctttgctgggaaggttcttcccagtactccctaaattcccatcttttcatccttcaggtctcgcggtaaattctgccttcccagagatgccttccttgagtaatgtgggtttcccttactcccattcatgtgaacaccctttatagctctatgtcccctaataattattttatttatttgcttgtctacttattttctaagaaaattttcctcccattcaactgtaaactatggagggcaggggacatatctctgatttatctttgtatttctagaacctggtgtagcatctggcaagagtagaagctcaaaaattatttctcgaatggataaatga

SEQ ID NO: 197080 - DNA, 381 bp, Homo sapiens
tttagtaacatctacacctgcagtagcctttaaatctggttaataaagatgcctattgccacttaattgttttatctactgcacagcaagctgaacccatggctcaaatctgaattatccatgaaacaaaataccagaaactataaatgaagtattaccacacatcctttgatataaccattattaaaaccttaaagataaaatttattagcacatatttattgagtgcccacaatgttccagatactgtgtatacaacagtgattaccaccatttgaattgtgtctcccaaaattcatatgttgaagtcctaactgccagtacctcagaatatgactgcatttggagacagagcatttaaagaggtagttaagttaaaat

SEQ ID NO: 197081 - DNA, 272 bp, Homo sapiens
atattggatcaggggaggatactggaagaagagctccatgggatttgcttggtgctcgtgagattttgactgacaagagatcttagggctactatattacccaaattcaggggactctgttcactttgccagcagcctgggattaattctgtagtgctaatgccattctgagaagcctttcaatgaatctgagctcagggttcttagtccccctgttactgaagcttctccccagacagtgtcgtttttgttttttccttcctttctaagct

SEQ ID NO: 197082 - DNA, 258 bp, Homo sapiens
  misc_feature (48)..(48): n is a, c, g, or t
gaccgagatcggcaagggggtcggccaagggggtcggcaagggggtanggccaaagggggttcggccaaggtcaggtcactggataaagccaacagagtagagagattctgatttctcagttcaccttgagttcagtaatattctcaaaatcatagtaacagaaaaccacagaattaattcagctctataggctcatggtctgagtagtgaatcttcttagatccaaacattggcacctctgcctaccagctgggcaa

SEQ ID NO: 197083 - DNA, 3691 bp, Homo sapiens
cgtgtgggcagcggaggagccaccctcaacgccctgctggtggctgctgaacacctgagtgcccgggcaggcttcactgtggtcacatccgatgtcctgcactcggcctggatcctcattctgcacatgggtcgagacttcccctttgatgactgtggcagggctttcacctgcctccccgtggagaaccccgaggcccccgtggaagccttggtctgcaacctggactgcctgctggacatcatgacctatcggctgggcccgggctccccgccaggcgtgtgggtctgcagcaccgacatgctgctgtctgttcctgcaaatcctggtatcagctgggacagcttccggggagccagagtgatcgccctcccagggagcccggcctacgctcagaatcatggcgtctacctaactgacccccagggccttgttttggacatttactaccagggcactgaggcagagattcagcggtgtgtcaggcctgatgggcgggtgccactggtctctggggttgtcttcttctctgtggagactgccgagcgcctcctagccacccacgtgagcccgcccctggatgcctgcacctacctaggcttggactccggagcccggcctgtccagctgtctctgttttttgacattctccactgcatggctgagaacgtgaccagggaggacttcctggtggggaggcccccagagttggggcaaggcgatgcagatgtagcgggttatctgcagagcgcccgggcccagctgtggagggagcttcgcgatcagccccttaccatggcctatgtctccagcggcagctacagctacatgacctcctcagccagtgagttcctgctcagcctcacactccccggggctcctggggcccagattgtgcactcccaggtggaggagcagcagcttctggcggccgggagctctgtggtcagctgcctgctggagggccctgtccagctgggtcctgggagcgtcctgcagcactgccacctgcagggccccattcacataggcgctggctgcttggtgactggcctggatacagcccactccaaggccctgcatggccgggagctgcgtgaccttgtcctgcagggacaccacacgcggctacacggctccccgggccacgccttcaccctcgttggccgtctggacagctgggagagacagggggcaggcacatatctcaacgtgccctggagtgaattcttcaagaggacaggtgttcgagcctgggacctgtgggaccccgagacgctgcccgcagagtactgccttcccagcgcccgcctctttcctgtgctccacccctcgagggagctgggaccccaggacctgctgtggatgctggaccaccaggaggatgggggcgaggccctgcgagcctggcgggcctcctggcgcctgtcctgggagcagctgcagccgtgcctggatcgggctgccacgctggcctctcgccgggacctgttcttccgccaggccctgcataaggcgcggcacgtgctggaggcccggcaggacctcagcctgcgcccgctgatctgggctgctgtccgcgagggctgccccgggcccctgctggccacgctggaccaggttgcagctggggcaggagaccctggtgtggcggcacgggcactggcctgtgtggcggacgtcctgggctgcatggcagagggccgtgggggcttgcggagcgggccagctgccaaccctgagtggatgcggcccttctcatacctggagtgtggagacctggcagcgggcgtggaggcgcttgcccaggagagggacaagtggctaagcaggccagccttgctggtgcgagcggcccgccactatgagggggctggtcagatcctgatccgccaggctgtgatgtcagcccagcactttgtctccacagagcaggtggaactgccgggacctgggcagtgggtggtggctgagtgcccggcccgtgtggatttctctgggggctggagtgacacgccaccccttgcctatgagcttggcggggctgtgctgggcctggctgtgcgagtggacggccgccggcccatcggagccagggcacgccgcatcccggagcctgagctgtggctggcggtggggcctcggcaggatgagatgactgtgaagatagtgtgccggtgcctggctgacctgcgggactactgccagcctcatgccccagggccctgctgaaggcggccttcatctgtgcagggatcgtgcatgtccactcggaactccagctgagtgagcagctgctccgcaccttcgggggcggctttgagctgcacacctggtctgagctgccccacggctctggcctgggcaccagcagcatcctggcaggcactgccctggctgccttgcagcgagccgcaggccgggtggtgggcacggaagccctgatccacgcagtgctgcacctggagcaggtgctcaccactggaggtggctggcaggaccaagtaggtggcctaatgcctggcatcaaggtggggcgctcccgggctcagctgccactgaaggtggaggtagaagaggtcacggtgcctgagggctttgtccagaagctcaatgaccacctgctcttggtgtacactggcaagacccgcctggctcggaacctgctgcaggatgtgctgaggagctggtatgcccgacttcctgctgtggtgcagaatgcccacagcctggtacggcaaactgaggagtgtgctgaaggcttccgccaaggaagcctgcctctgctgggccagtgcctgacctcgtactgggagcagaagaagctcatggctccaggctgtgagcccctgactgtgcggcgtatgatggatgtcctggccccccacgtgcatggccagagcctggctggggcaggcggtggaggctttctctatctgttgaccaaggagccacagcaaaaggaggccttggaggcggtgctggccaagaccgagggccttgggaattacagcatccacctggttgaagtggacactcagggcctgagcctgaagctgctggggaccgaggcctcaacctgttgccctttcccatgaagctggcttctctctgcaacaggagaaaacctggagctacagtgtcccccaccttccttgccccatgggaacctccacctcctactccccacccacctctgcgaatctgctcccaaaggaagctgaccagagcaagatctgggcaagcagagagtgcctgggacaggactgtgacctggtggacaggggcctagatgtagcctctgttcctcctggacataggaaggtcccaagcttagtatcccacgtggcctttacaaatcctatggctggccttctcattccacaagggccctggaaagggttgacagccagccttggcatatggctgggagtcccttagcaaggccaaccctgaagaggccctttgaggcattccctatggcttagagttgtagacttacactcaaccctcatgtgagcgtgggagtgagggtggcggtcccttgccaagttggtagcagtgacccagtgattcactgccatcccaggccttaactagcaaaactacggagcgtgccaagtgacctggtgcctgtgggaagtgggttctcaggactggcattcttggaataaattcactctgtccttgc

SEQ ID NO: 197084 - DNA, 2625 bp, Homo sapiens
cgtgtgggcagcggaggagccaccctcaacgccctgctggtggctgctgaacacctgagtgcccgggcaggcttcactgtggtcacatccgatgtcctgcactcggcctggatcctcattctgcacatgggtcgagacttcccctttgatgactgtggcagggctttcacctgcctccccgtggagaaccccgaggcccccgtggaagccttggtctgcaacctggactgcctgctggacatcatgacctatcggctgggcccgggctccccgccaggcgtgtgggtctgcagcaccgacatgctgctgtctgttcctgcaaatcctggtatcagctgggacagcttccggggagccagagtgatcgccctcccagggagcccggcctacgctcagaatcatggcgtctacctaactgacccccagggccttgttttggacatttactaccagggcactgaggcagagattcagcggtgtgtcaggcctgatgggcgggtgccactggtctctggggttgtcttcttctctgtggagactgccgagcgcctcctagccacccacgtgagcccgcccctggatgcctgcacctacctaggcttggactccggagcccggcctgtccagctgtctctgttttttgacattctccactgcatggctgagaacgtgaccagggaggacttcctggtggggaggcccccagagttggggcaaggcgatgcagatgtagcgggttatctgcagagcgcccgggcccagctgtggagggagcttcgcgatcagccccttaccatggcctatgtctccagcggcagctacagctacatgacctcctcagccagtgagttcctgctcagcctcacactccccggggctcctggggcccagattgtgcactcccaggtggaggagcagcagcttctggcggccgggagctctgtggtcagctgcctgctggagggccctgtccagctgggtcctgggagcgtcctgcagcactgccacctgcagggccccattcacataggcgctggctgcttggtgactggcctggatacagcccactccaaggccctgcatggccgggagctgcgtgaccttgtcctgcagggacaccacacgcggctacacggctccccgggccacgccttcaccctcgttggccgtctggacagctgggagagacagggggcaggcacatatctcaacgtgccctggagtgaattcttcaagaggacaggtgttcgagcctgggacctgtgggaccccgagacgctgcccgcagagtactgccttcccagcgcccgcctctttcctgtgctccacccctcgagggagctgggaccccaggacctgctgtggatgctggaccaccaggaggatgggggcgaggccctgcgagcctggcgggcctcctggcgcctgtcctgggagcagctgcagccgtgcctggatcgggctgccacgctggcctctcgccgggacctgttcttccgccaggccctgcataaggcgcggcacgtgctggaggcccggcaggacctcagcctgcgcccgctgatctgggctgctgtccgcgagggctgccccgggcccctgctggccacgctggaccaggttgcagctggggcaggagaccctggtgtggcggcacgggcactggcctgtgtggcggacgtcctgggctgcatggcagagggccgtgggggcttgcggagcgggccagctgccaaccctgagtggatgcggcccttctcatacctggagtgtggagacctggcagcgggcgtggaggcgcttgcccaggagagggacaagtggctaagcaggccagccttgctggtgcgagcggcccgccactatgagggggctggtcagatcctgatccgccaggctgtgatgtcagcccagcactttgtctccacagagcaggtggaactgccgggacctgggcagtgggtggtggctgagtgcccggcccgtgtggatttctctgggggctggagtgacacgccaccccttgcctatgagcttggcggggctgtgctgggcctggctgtgcgagtggacggccgccggcccatcggagccagggcacgccgcatcccggagcctgagctgtggctggcggtggggcctcggcaggatgagatgactgtgaagatagtgtgccggtgcctggctgacctgcgggactactgccagcctcatgccccagggccctgctgaaggcggccttcatctgtgcagggatcgtgcatgtccactcggaactccagctgagtgagcagctgctccgcaccttcgggggcggctttgagctgcacacctggtctgagctgccccacggctctggcctgggcaccagcagcatcctggcaggcactgccctggctgccttgcagcgagccgcaggccgggtggtgggcacggaagccctgatccacgcagtgctgcacctggagcaggtgctcaccactgtagagacggggttcccgtgttagcaggatggtctcgatctcctgacctcgtgatccgccgctcggcttccaaaagtgctgcgatttcaggcggtggcccccggccagactgtgtgtgctctcatgctgttggaccggggtg

SEQ ID NO: 197085 - DNA, 363 bp, Homo sapiens
ggctagctactgccagctatcttgggccaggcatccgctggggggcactggctgtctttgaagcctgcagggggagggaagggaagacgtgatgtaaccttggttcataacagctgtctgcgacttcattttccaggaaaggagaggctgtttgaccccatgggacacagccttctgcaactcctccctgggaatcgtggggctgctggtggagggctctggctgatctgctctggtggttctgagggctctggtggagggctgctgcttttgcgggttgggtagagccagtcctggttatctatcttggcaggctttgctcgtgtcctgtgatgctgcacaaagtatgaattacggagcttg

SEQ ID NO: 197086 - DNA, 144 bp, Homo sapiens
cccccttccctctcttctctttctctctctgtcacacacacacacaccacacacacctccccacctctcgcaaaactggcttctacctactctgtgagtgctgcagacttctgtgatcgttgtttttctgttgcttcttctaga

SEQ ID NO: 197087 - DNA, 551 bp, Homo sapiens
gatcatcctttaaattgtttttccagaacctggcctccttttatgtcatgtgatttcctccaaagcttcagtatgtgggtatttgtcttctaacttgccaactatgctaagcagctgcagctctgacctcccccagatttttataaaatcacatcataagcctccatctctctttaatatgataatataaagaatcagtagactgtggatattatgtttatttcctcaggtgttgatatatcgatgggcacacacaggaacatgcataaacattcaatggatattcatactgaaaccatattataatcctaggctttaaggaagaaagtttagcactttctggtgttctggtatatatatcatggggacattttacaggtgactaatagcagctaatctcttattaactatatagataggtggttaaaatttaaagcattttagaagagtaacataggccttctgacttcctaaatgcatggtgggcatggccaaaatgcacaggcaatgtccaaattctccagttaaacttgacatatgttcataatgtc

SEQ ID NO: 197088 - DNA, 572 bp, Homo sapiens
cgaaaaggaaaagatgtgcttattattacaactagcaagttcagcatttatgacctgtcattataaaacagatcaccatgctgtctgacccacccttgaaaatcgtgaagtgcaaacacactaattatgttcctactgaaattcaggttcttaacttcaggcttcagcttaacctgctttagagcacgcatactttttgccacgataatactcataggactagaaacaactaggagatgttattttattttttaaatcagactgaacttcaggcagatttccttatattgtaaattagtggcttatttatatgacctttatagggcatctaatgatagtgggtttttttttctttttttttttgagatggagtttcgctcttgttgcccaggctggagtgcaatggtgcgatctcagctcaccgcaacctccacctcccaggttcaagcagttctcctgcctcagcctccagagtagttgggattacaggcatatgccaccatgcctggctaattttgtatttttagtagagatgggatttctccatgtcggtcaggctggtctcaagctcc

SEQ ID NO: 197089 - DNA, 756 bp, Homo sapiens
taaaacacagtgagggtgggccaggcacagtggctcacacctgtaatcccacctgaccaacgtggtgaaaccccaactgtactaaaagtacaaaaaaattagccgggcttggttgtgggcacctgtaatcccagctactcgggaggctgaggcaagagaattgcttgaacccgggacgcagaggttgcagtgagcagagatcgcgccaccgcactccagcctgggtgacaaagcgagactctgtctcaaaaaaaaaaaacgatggggtattgacagacaactaaataaatttttaaagacaattaaaaataataaataagatggaaatttaagattaaaatggttatttgggagttgtctacatagagatggtaactgagaagttatgagtcgatgcactcctttaactggaacataaaaagaaagaaaaataggtgaataatgactgaatattggggtactacccccatgaagtaggttaattaagaagacaaatgatcagaaaagtagtgagaaaactgaaaaatcctaatgccttgtaagtcagtattagaaaactttaagaactaagatttcagcctgaggaagctgattaaaaaataaaaataaaaaaccacaccaagattgatggcaatagatgtaattgaaaagaggaaacagaactgaggaatgatttttgaatttgagtaggaggaggtcattggtatttttagaagagtttctgtggaatacagaacacagaaatcatgttacaga

SEQ ID NO: 197090 - DNA, 501 bp, Homo sapiens
tgacctagaggttcccaatttccaactaaataaatttttaaagacaattaaaaataataaataagatggaaatttaagattaaaatggttatttgggagttgtctacatagagatggtaactgagaagttatgagtcgatgcactcctttaactggaacataaaaagaaagaaaaataggtgaataatgactgaatattggggtactacccccatgaagtaggttaattaagaagacaaatgatcagaaaagtagtgagaaaactgaaaaatcctaatgccttgtaagtcagtattagaaaactttaagaactaagatttcagcctgaggaagctgattaaaaaataaaaataaaaaaccacaccaagattgatggcaatagatgtaattgaaaagaggaaacagaactgaggaatgatttttgaatttgagtaggaggaggtcattggtatttttagaagagtttctgtggaatacagaacacagaaatcatgttacaga

SEQ ID NO: 197091 - DNA, 455 bp, Homo sapiens
ttttatatggtcacgtagtcttccacgatttttgtgtaccatattttgtttttactaaatctttattttatttttggaagagcgtctcactctgtcacacaggctggagtgcagtggtgcaatcttggctcacttcagccttaacatccaagtctcaaggctcaaggaatcctacctcagcccgttaagtaactgggactataggcacacaacatcatgcctaatttttcttttttgtattatttgtagagatacagttttgccatgttgcccaggctggtattttattttattttattttattttattttttgagacagagtcttgctctgtcaccaggctgcagtgcagtggcacgatcttggctcactgcaacctctgactctctgcttcaatcaattctcctgcctcagcctcccgagtaggtggggtaacaggtatgtgcaccatgctca

SEQ ID NO: 197092 - DNA, 642 bp, Homo sapiens
gccataaatagataagtacaggtacttcatttaagttttactttcataggcacttgcataaggtcttaaaaattgatcgaaactcaccaatgtaatccttacacagtcttttaaggcctggatcaaactttgcctctttcaagaaatcaccctatattcctcgagtcaggattaatctatccagtgttaacaatggtgataacaataacagcttgcatttattgagttcttactagtcagccactccacaggtttcatttcatttaacacccaaacagaactgtagaaggtaggcactaacaaggatttactgaaagtctgttacatgatcactgtcttcatgacactcagaattttgtgggaagggaataggaacaattaattacaatactaagcgatgcctgcaacaacaggattagcaataggagcactccaggacagcagttcttaaagctgattatgcataagaaccagtactcttaaaatccaaaccatctaatacaacatttaaggccttgaatgatacaattcctgccagcctcgaccatctaccttaccattctaccactcaggaagggcttcacagagatgacttttgagctgactctaaaagagtgaacaaagtttatcaggtgaccaaag

SEQ ID NO: 197093 - DNA, 185 bp, Homo sapiens
cctgtttctcaccaataagaggggtcagggcagagtgagtctgggagagagagttctaccaccacggttcccaaagcatcgtctaggggcctgttaggggagcccgaggtctaaactatttccacagtttcactaagatatgattttccttttccatcctcacattcgttagtgtgcagtgaagt

SEQ ID NO: 197094 - DNA, 293 bp, Homo sapiens
aaatgctctgtaatcaggaaaaaataaggctgcttcaaatttatacatatttaacaaacatgtatacgtaccatttccctagatagtacatatctaaagactcagtaactgtgttaaggaagaataataatgaacatttattgaactctcactgcggggcagactgtgttttaagatttttaagggtattatctaatttaatgtgtataacaaccctataaagaaaaattactcttattactcttttctataaatgatgatgctttagttttagaaagcttaaatcattttcc

SEQ ID NO: 197095 - DNA, 491 bp, Homo sapiens
acagaaggaagatttaatgtagtaatggtttagaactttccaaacttgtaactgacaccaaaccacagatccagaaagctcaacgaatgccaacaccaagcaggataaatgccagaaagtcaaccccaggccaccttgtattcaaactgcagaaaatcaaagaaaaaagagaagatcttgaaagaatccaggagattccttataggcgaggtgattccttatctgtaaaggaacaaggataacaattacattggaccttttcccaggaaccatgcaagaaggaagagagtagtgtgaaacatttaaagcattataagaagaagaatatcatattcagaaaaagattattcttcaaaagtgaaggaaattgactttgtcagataagcaaaaattgaagtaatttgttgccagtagacctgccttgcaagaaatgctaaaagaagctcttcaacggaaggaaatatcatatagcccagaaactctggtttacc

SEQ ID NO: 197096 - DNA, 178 bp, Homo sapiens
catgtccagctgaggaatgagactggggtggggagcgaggagagcactgcttcacgctaacagccacttttccttcacacttccagtcttgcccggcttgcaaattttcgctgatgtattttatgaggtcacttattattacttagtacctatcacatttactacttctgatggctca

SEQ ID NO: 197097 - DNA, 377 bp, Homo sapiens
tctttgctttttaagagaagacaggccgggcacggtgactcacacctgtaatcccagcactttgggaggatgaggtgggcggatcacgaggtcaggagtttgagaccagcttgaccaacatggtgaaaccccgtatctactaaaaatacaataattagccgggtgtggtggcgcacgcctgtaattccagctctgtaggtggctgagacatgagaatcgcttgaacctgggaggcagaggttgcagtgagccgaggtcgctccactgcactgcaccctgggcaacacggtgagattctgtctcaaaaaataaaaaaagaaacatcctaagtcgaatcatggtaagttgggggctgcccctacctctccccagctgaa

SEQ ID NO: 197098 - DNA, 462 bp, Homo sapiens
ctttggcagggggtggttattggggaaggcttctcaaggagaacctctgaactgaaacccaaaggatgagaagaagccagcatgccgagatcttgggaaaaaggttccagccagagggaagagtcactgcaaaggctgctcaggccctagaaagaagacacaggtggctggagtggtaggaacaagagggaagtgaatggaaatgggtcaaagaggttcgctgtgagtctctgcaaattctagtagggaacaggaagccactggaagattttcaaatggaaaatacaatcagattcgtttccaaaatctcattctggctattatatggaaagcgactgtttcacatgtgtgttcaaggtcccagctcagtttttctacccagcagcatgttcccaattcacaggcataaaaagattgaacctcttcttgaccaatgctgactagtaactcactggcccttct

SEQ ID NO: 197099 - DNA, 513 bp, Homo sapiens
attgtatgaacatactacagtctacttattacttgttgacagacatttagtgtctttccaaattttactgtaacaaacaatgctcctacaaatatttgtgtactttatgtaaaactcacgtgcatgtattaaaatttctccagggtatatatctagaagtaaaattagtatgaaaaaagtatgcagtatgcatatcattgtgggctattgtctgtttacattatatggctattgtattagttaacactttcaccagcaatttataagattctcatttctcctcattttcccacatatgcatacatacataaatacatacatacataccctttgtgacttatttatcaaataatagttaatgatatgtctgagcaatgctaaagagatcaactatggatatgtgctattgtacataataaccattctcctattgtaatataattacatcattgttttcttttcctgaaatcaatttctttgcaattatttattcaggataatgttcaaattgaa

SEQ ID NO: 197100 - DNA, 795 bp, Homo sapiens
ctgcactccagcctgtgtgggagagccagaccctgtctcaaaaaaaaaggccttgggctgggcgaaatggctcactcacacctgtaatcccagcattttgggaggttgaggtggacggatcacgaggtcaggagatcgagaccatcctggctaacatggtgaaaccccgtctctactaaaaatacaaaaaaaaattagctggtgtggtgacacgcacctgtagtcccaactactcagaaggctgaggcaggagaatcacttgaacccgggaggcggaggttgcagtgagccaagatcgcgtcattgcactccggcctggcgacagggagaataaaaaaaaaaaaaaccctttatggggtgacaggacaggactaagcctcagtgagccaggctggggaggtcatcatcggcccaatctttcttttcaaaaaggtcaaattgacttacttatctagggagaaatggggccctcctgcctaggtgagaaactagagctgggcttcttcaccagataaaccgtcttggtacggtgatgcctggagactggtagaggcaaccatgggctccagcagcataaatgctttcaggcaacaggctgaaacacctttccagaatcccagctacacacctgaccgagcacagtggctgatgcctataatcccagcactttgggagcctgagttggagatgaccctgggcaacaaagggagccaccccgtatctacaaaaaaatataaggagccgggcacagtggctcacacctgtaatcgcaacactttgggaggctaaggaggg

SEQ ID NO: 197101 - DNA, 208 bp, Homo sapiens
gacacacaaaaaatggagatatcccacgttcatggattgggagaattgatgttgttgaaatgcttatgctacccaaagcgatatactgtcaatgtaatctttatcaaaataccaatgacgttcttcacagaaatagaaaaaaaaatcctaaaattcgtatgaaaccacaaaatgccttgaatagccaaagtaatgctaagcaaaaaaa

SEQ ID NO: 197102 - DNA, 274 bp, Homo sapiens
tgacttttctaattccttggctttccatataaatttcagaattagtgtgctgatttctataaagaaatcttgctggaattttgattggaaatgtattgaatctatattgagtccaaaatctatattagatctatcagtttgaagaagctgacatttaaagaatattgaatcttaacaacattatgtctttcaacctatgagcatggcatatttttctacttatgtaggtattctttttttttttaaagaaatatagaagagagatgacttgatt

SEQ ID NO: 197103 - DNA, 507 bp, Homo sapiens
tcaggtggccacactatgtcaagaagcctctccacactctgtggcacttccagtcccataaatcctgtttcttatccactttggaaatgcatgaacactttacaaagaacatgcccgggtttttacattttaaaagttattctagacaatcactattggcttttttcttttatttttaaaaaactcacatagaggagacaatcagaaatttaccatagtcccaagaattcagctacatgatgactcgaatttaaatttagattaatcaaatggtctcctgttctctgatttctggtggcttttagacactaatttttgagaactacttttttttttttaccaaacttcagggacactctgctagttttgaataagtaaccatcaaagttactaaaacatggccaggcgcagtggctcatgcctgtaatcccagcactttgggaggccgaggtgggcagattgcctgagctcaagagttcgagaccagcctggccaacatggtgaaac

SEQ ID NO: 197104 - DNA, 568 bp, Homo sapiens
aacgagctcttaccgggtgggagtacggaatcaaaagttcaagaccagcgcaagatggtgacactcgtctctactaaaaatacaaaaattagctaggcacggtggcaggcgctgtaatcccagctactcgggaggctgaggaaggaagaatcgcttgaacccggcgggaggcagaggttgcattgagccgagatcatgcaatggcgacagagcaaaactccatctccaaaaaaaaaaagtcaggttatgattctgtagttgaagaaaaaaaaccttttttgaacttgtctttatagttgaacccaaaagctactttataaaaggtggaatttcagactttgatgttttaatcttttggtttaattatctttgagcactcaagttggagactgatgtcacttgcttctgttttctgcttttcatcctcttgtgctagtgagaatagtttgtctgctttttgtgttgtctaacttttctagtcagtttgtaaatagtgctactattataattgacaactctcagaatagacataaacagattaaacagtaaagtttattgtgaacatttg

SEQ ID NO: 197105 - DNA, 791 bp, Homo sapiens
gcaggcatttctgagatgaaagttgcaccccttccaaaggccttctcctcggctctcccttagatcctcaggagggtttccccaatgtacaaaaaatgaaagattcaaaagggacagtgactgttctaaagtcacacagcaagtgtggcaaagtctagatgagggccctggggcagggctgcctttcccctcatgggcagcacccacatcccgcctggcccagtctccattgcaggatgctggacccgctcagctttcgtgtacatggtttcaggagcagactgggcaggcaggaggtaccatgaagccacatgaagccacttccacaaggtctgggctgggggccaacatttgtaagcctttagtgtggtgtcccttggagtaaatgtgcttgttttcaaagaacctcagacacagcattggaaacaaagcctcattcttacaggcgtgcatcctaggctggtaccacacttctctctgcctctggcctcaggaaggcacattatgtggttgggctcaatttggaaaaatagtttgcagtgctgtcgattgaagagagcaaatctttttctgagaaattgtactggttaggtgcagtggctcaaacctgtaatcctagcactttgtgaggccaagacaggtggattgtttgagcccaggagttcgagaccagcctgggcaacatggtgaaaacctgtctctaccaaaaacatacaaaaattagcccggtgtggtggtgcatgcctgtagtgccagctgctcgggaggctgaagcgggaggatcacctgaa

SEQ ID NO: 197106 - DNA, 317 bp, Homo sapiens
aaagtagacttccctccatctaatgctgcttctgtgatgctataatatttatggtgcagaaatctagatttagaaagagaactttattcgaatctgtttatacattccctaatacttactgaggctttatgaagtaccagatattgtccttagcactttacatgtttcaatacatttaatctttgagtcaatctagaaggtagactcaatctccattttaccaataagaagtgaggagcagtggttaacttacctaaggtcaacttgtggcaaagctggaattcaaactctgattaatggttttgttttatcaaaaa

SEQ ID NO: 197107 - DNA, 226 bp, Homo sapiens
caaggaaatgtgaacagcatgagtgaatcttgaagcagatactaaaaaaattcatcagcaagttattttcaaactcaaagagaagaaaatgtcaagttgagctccattatagtttcattctcatcgagaaatcacagcttaaactatccacagagaaggcttgtctccggcaaagaaattcaacactcacttacatatgcttgggtttgaaaaatcataatattga

SEQ ID NO: 197108 - DNA, 228 bp, Homo sapiens
ccgaacagtagatgggcatagggaggagggggcaggtcatggaaggcacagtgtttacaaagccattaaaggagaatgaatagatctagcctggtcccaaaaggcaaagaaatgtgaattttcacatataaatagaaaacgttaagaatggtattaattcaagaccaagctcctaatgtctttccaagattagccggctgtgcggcgtctgcttagctgcactgaccc

SEQ ID NO: 197109 - DNA, 319 bp, Homo sapiens
tctgattgatcgatggctctttctctaaatttgccagtaacttttctgaaaatggaaaatccttgcctctgttactcaccaagtaatagagtacagaaaatttttaggtattcaaagggatctgttgaataacttcatggctgagtttaggcaaggagaagaactgccaacaaataacattattataaccactgtactggagttcaggcataggacaccagatcctgggagagccatgtcttagaaagagaacagcaaaaacctgccttagacactctgggggacttgtaaatacaactgacacttattagtctttttc

SEQ ID NO: 197110 - DNA, 2039 bp, Homo sapiens
tcaggtggtacgctgggcagaggcgggcagaggcggcgagaggcggcgagaggcgggctgaggcggcccagcggcggcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggctctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggttctcgtgccgaattcaaaaagctt

SEQ ID NO: 197111 - DNA, 352 bp, Homo sapiens
tcaggtggtacgctgggcagaggcgggcagaggcggcgagaggcggcgagaggcgggctgaggcggcccagcggcggcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaagcccgtcctaccctgggctcacatggggcctgtgcccacccctcttgagtgtcttggggacagctctttccacccctggaagatggaaataaacctgcgtgtgggtggagtgttaggaccaacggtt

SEQ ID NO: 197112 - DNA, 2628 bp, Homo sapiens
tcaggtggtacgctgggcagaggcgggcagaggcggcgagaggcggcgagaggcgggctgaggcggcccagcggcggcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggctctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggttacaacacaaaaaaaaaaaaaaaaaaaaaacaaaaaaaaaaaaaaaaaaacaaaaaagaaaaaaaaaaaaaaaaaaaaaaaaaaagggggggggggcgaaaaagacctctccggaggggccaccaactgggccccacgtgatcgaagaacaagagggggcaccactataagggaggggacagtaattataaaacacaggaggagcgtgacgggtattataaacacgcctgagcagaggagggaaaaaaaagttcgatgagatggtaatattgtaggggagagagaacgacatcaatagacggggggggggggcgacacattagggaggaggaaataatctgattgagagagagagaataggaagacgcctcgacgaggggaggagaatgtattaatagagtactgaaagggagaggaggagaagagggtgtgtaaaaaaaaaaaaaggagggtgtatgatgatgatggtagagaggtaggagagagaagaaaatgtgtcgagcatcaacgggtagaagctagaagtgagtgatatgaatagaagaaacattatttaaaaagagaggggggcgttagtgtttattgatatacaaaataagacggttaaaatagg

SEQ ID NO: 197113 - DNA, 1732 bp, Homo sapiens
tcaggtggtacgctgggcagaggcgggcagaggcggcgagaggcggcgagaggcgggctgaggcggcccagcggcggcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggctctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatcgtcgacgcgcccgcgaatttagtagtagtaggcgg

SEQ ID NO: 197114 - DNA, 1840 bp, Homo sapiens
tcaggtggtacgctgggcagaggcgggcagaggcggcgagaggcggcgagaggcgggctgaggcggcccagcggcggcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggctctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgccctcgtggccagcagtggctgcgtggctgggagcccggtcagaggccgccgggccctcagtaggtgcgtcgtgggcgctggggacgcagtacggtgcctggcggccgcgtgcaccggagagattccattccagctctctg

SEQ ID NO: 197115 - DNA, 2049 bp, Homo sapiens
  misc_feature (13)..(13): n is a, c, g, or t
cggaagttcaggnagggcgaggccgtgccccacatccaggcagcgcaggccgcgggccgctcccctagccaggaagagccgccgtccgcaccgggaccggagaggaagcggaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggctctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtt

SEQ ID NO: 197116 - DNA, 2511 bp, Homo sapiens
tcaggtggtacgctgggcagaggcgggcagaggcggcgagaggcggcgagaggcgggctgaggcggcccagcggcggcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtgagggtggcctcacaccgggccccctgtccgggctctgctggcggatcctgctgggcgcgtgtagctgggctcagcaacagggccttccgcctgctccccagggaaccctggagggaagcccttggggccaggatcctgctgggcagcaacatgctctccacggggccaacccaggcagggcgcgaagtccatcctggcccctgtccaaacgggtcggctgtatttatagaccgtctcagaggacaggctcctgagagccgttcctgaaaaggtggctgttcctgagctgcagggacccaaggggcccagcaggcggcgctcacgtgtcatcatggcctgcgctcggggagcctgcccacggggtgcccctggtgcccgcggggggaggggtggtgtgggaaggggaggccggctccaggctgtgagctcagtcggctggcgggggtagagctggctgcaggcccggcccctctcagctgctgccctctccaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggctctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtt

SEQ ID NO: 197117 - DNA, 1742 bp, Homo sapiens
aaggctgagctgagaaaaacggggaggtggttcacaccccggaaacaagtgtctgagtggctgggcggggcggcacgacagggaggaggtacagaagccggcaacgcttgctatttattttacaaactggacggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggctctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtt

SEQ ID NO: 197118 - DNA, 1666 bp, Homo sapiens
tgggtgggtggcaggggctctgcaccctgggagcctgagcctgtgggaacctgggggcagagatgagggtctcgggctttggggcagccttggggggctctcaccacattccctttcctccagggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggctctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtt

SEQ ID NO: 197119 - DNA, 1238 bp, Homo sapiens
  misc_feature (13)..(13): n is a, c, g, or t
cggaagttcaggnagggcgaggccgtgccccacatccaggcagcgcaggccgcgggccgctcccctagccaggaagagccgccgtccgcaccgggaccggagaggaagcggaggtgaggcggaaccaaccctcctggccatgggaggggccgtggtggacgagggccccacaggcgtcaaggcccctgacggcgggtgcggccctactccgtctacctcttcagcttctccatgttcttcaacggcctcgcggacctggcgggctctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtt

SEQ ID NO: 197120 - DNA, 1207 bp, Homo sapiens
tgggtgggtggcaggggctctgcaccctgggagcctgagcctgtgggaacctgggggcagagatgagggtctcgggctttggggcagccttggggggctctcaccacattccctttcctccagggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctggaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtt

SEQ ID NO: 197121 - DNA, 1307 bp, Homo sapiens
  misc_feature (13)..(13): n is a, c, g, or t
cggaagttcaggnagggcgaggccgtgccccacatccaggcagcgcaggccgcgggccgctcccctagccaggaagagccgccgtccgcaccgggaccggagaggaagcggaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggccaaactccacaaagccattgctatttttagcctcttaagtcttggttcccctgaggaggagggaggatgcccccagctgaaacacatggaggggagagaacacctcccagccccacaagctcagaggcagacagggtgacccttgcgtgctgagacaccgagacacaggcttgggtggagccgtgggccctgggggcagcccgcatgagcggctgggactgacggggtcttcccgcaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtt

SEQ ID NO: 197122 - DNA, 808 bp, Homo sapiens
ttggagccccactatcgctaagcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtt

SEQ ID NO: 197123 - DNA, 2016 bp, Homo sapiens
tcaggtggtacgctgggcagaggcgggcagaggcggcgagaggcggcgagaggcgggctgaggcggcccagcggcggcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggctctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtt

SEQ ID NO: 197124 - DNA, 2592 bp, Homo sapiens
tcaggtggtacgctgggcagaggcgggcagaggcggcgagaggcggcgagaggcgggctgaggcggcccagcggcggcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggctctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggttacggtttcctaggagtatgtggttttgctgtgtggcctgtgtcctgactcgcacgtctgctgatggcctggctgttcctaccgtggctctgtcctcgccagctttccctgcagcggcatagcattcgtagcaggggcaggcgctgcatggagggggctgcggggcaggtgcctggaggccgctgtgccagggtggcctctgaaatgtgccagggagcccctacgtggtggttagatgggagctgaggtggaacaagccactttattcactgctgtgtttaagaaacaggaccctcctgccttccctttttcgcccctctgcctggctggcagtgtgcgtggtgtggtcagtgcccagggctcggtctttgcaccctgtcctccatccagcccggcccagcgcttgggtctgtcctggacacctaacacccacctgccctcgtggccagcagtggctgcgtggctgggagcccggtcagaggccgccgggccctcagtaggtgcgtcgtgggcgctggggacgcagtacggtgcctggcggccgcgtgcaccggagagattccattccagctctctg

SEQ ID NO: 197125 - DNA, 1650 bp, Homo sapiens
tcaggtggtacgctgggcagaggcgggcagaggcggcgagaggcggcgagaggcgggctgaggcggcccagcggcggcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggctctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggcctgcggccactgctatgctcaaggacctggaaacccatgcttcgagacaacgtgactttaatgggagggtgggtgcgtgggggcaaaaaggtggcacgccccaaagattgtacacctgtctcaaacatacaataacctgtc

SEQ ID NO: 197126 - DNA, 2825 bp, Homo sapiens
tcaggtggtacgctgggcagaggcgggcagaggcggcgagaggcggcgagaggcgggctgaggcggcccagcggcggcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggctctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggtgagcgctgcgcccccaggcagttccccacacctgcccttcccgtcagacgcccgctttgcgaggggggggacgcgcacccctcggcagccacccgcagtgtgggactcagagctggagggggtgcactgtgctggaccaaccctgattctgctggggctagcgggtctccattaggagtggggtgctccgtccggcacagtgtgtccagacaggcagggtggctaggggctgggcccggtgggggggcagctcctccaggctctgcctgggcaccacgcggcagctccaggcaacccaacagccggcttttgcattttggggcctctcctttttgaaggatgactgagctaacacgtgagggaaattaagttctgactggagcagccttgcccaggctccgcctgcctggcgagggggtcctgggcttggggagggctcatgtcttggagtccgcggtggccagggcacagggctggtactgaacacagtagggcttctggggctgccgactggaagcctcagggggactccgtggggaccagcgtgactcctgccaccaaccgaaacccaaactccacaaagccattgctatttttagcctcttaagtcttggttcccctgaggaggagggaggatgcccccagctgaaacacatggaggggagagaacacctcccagccccacaagctcagaggcagacagggtgacccttgcgtgctgagacaccgagacacaggcttgggtggagccgtgggccctgggggcagcccgcatgagcggctgggactgacggggtcttcccgcaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtt

SEQ ID NO: 197127 - DNA, 1972 bp, Homo sapiens
  misc_feature (13)..(13): n is a, c, g, or t
cggaagttcaggnagggcgaggccgtgccccacatccaggcagcgcaggccgcgggccgctcccctagccaggaagagccgccgtccgcaccgggaccggagaggaagcggaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacagggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggctctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtt

SEQ ID NO: 197128 - DNA, 1769 bp, Homo sapiens
tcaggtggtacgctgggcagaggcgggcagaggcggcgagaggcggcgagaggcgggctgaggcggcccagcggcggcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctggccatgctctacgggacaggtccgctctgcagtgtgtgcgtgaaccgctttggctgccggcccgtcatgcttgtggggggtctctttgcgtcgctgggcatggtggctgcgtccttttgccggagcatcatccaggtctacctcaccactggggtcatcacggggttgggtttggcactcaacttccagccctcgctcatcatgctgaaccgctacttcagcaagcggcgccccatggccaacgggctggcggcagcaggtagccctgtcttcctgtgtgccctgagcccgctggggcagctgctgcaggaccgctacggctggcggggcggcttcctcatcctgggcggcctgctgctcaactgctgcgtgtgtgccgcactcatgaggcccctggtggtcacggcccagccgggctcggggccgccgcgaccctcccggcgcctgctagacctgagcgtcttccgggaccgcggctttgtgctttacgccgtggccgcctcggtcatggtgctggggctcttcgtcccgcccgtgttcgtggtgagctacgccaaggacctgggcgtgcccgacaccaaggccgccttcctgctcaccatcctgggcttcattgacatcttcgcgcggccggccgcgggcttcgtggcggggcttgggaaggtgcggccctactccgtctacctcttcagcttctccatgttcttcaacggcctcgcggacctggcgggctctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtt

SEQ ID NO: 197129 - DNA, 1385 bp, Homo sapiens
  misc_feature (13)..(13): n is a, c, g, or t
cggaagttcaggnagggcgaggccgtgccccacatccaggcagcgcaggccgcgggccgctcccctagccaggaagagccgccgtccgcaccgggaccggagaggaagcggaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaaggagctcatacaggagtttgggatcggctacagcgacacagcctggatctcctccatcctgctgtgcggccctactccgtctacctcttcagcttctccatgttcttcaacggcctcgcggacctggcgggctctacggcgggcgactacggcggcctcgtggtcttctgcatcttctttggcatctcctacggcatggtgggggccctgcagttcgaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtt

SEQ ID NO: 197130 - DNA, 1171 bp, Homo sapiens
  misc_feature (13)..(13): n is a, c, g, or t
cggaagttcaggnagggcgaggccgtgccccacatccaggcagcgcaggccgcgggccgctcccctagccaggaagagccgccgtccgcaccgggaccggagaggaagcggaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaaggccgtcagtgtcttcttcaagggaggtgctcatggccatcgtgggcacccacaagttctccagtgccattggcctggtgctgctgatggaggcggtggccgtgctcgtcgggcccccttcgggaggcaaactcctggatgcgacccacgtctacatgtacgtgttcatcctggcgggggccgaggtgctcacctcctccctgattttgctgctgggcaacttcttctgcattaggaagaagcccaaagagccacagcctgaggtggcggccgcggaggaggagaagctccacaagcctcctgcagactcgggggtggacttgcgggaggtggagcatttcctgaaggctgagcctgagaaaaacggggaggtggttcacaccccggaaacaagtgtctgagtggctgggcggggccggcaggcacagggaggaggtacagaagccggcaacgcttgctatttattttacaaactggactggctcaggcagggccacggctgggctccagctgccggcccagcggatcgtcgcccgatcagtgttttgagggggaaggtggcggggtgggaaccgtgtcattccagagtggatctgcggtgaagccaagccgcaaggttacaaggcatcctcaccaggggccccgcctgctgctcccaggtggcctgcggccactgctatgctcaaggacctggaaacccatgcttcgagacaacgtgactttaatgggagggtgggtgggccgcagacaggctggcagggcaggtgctgcgtggggccctctccagcccgtcctaccctgggctcacatggggcctgtgcccacccctcttgagtgtcttggggacagctctttccacccctggaagatggaaataaacctgcgtgtgggtggagtgttaggaccaacggtt

SEQ ID NO: 197131 - DNA, 928 bp, Homo sapiens
tcaggtggtacgctgggcagaggcgggcagaggcggcgagaggcggcgagaggcgggctgaggcggcccagcggcggcaggtgaggcggaaccaaccctcctggccatgggaggggccgtggtggacgagggccccacaggcgtcaaggcccctgacggcggctggggctgggccgtgctcttcggctgtttcgtcatcactggcttctcctacgccttccccaagcccgtcctaccctgggctcacatggggcctgtgcccacccctcttgagtgtcttggggacagctctttccacccctggaagatggaaataaacctgcgtgtgggtggagtgttaggaccaacggttacggtttcctaggagtatgtggttttgctgtgtggcctgtgtcctgactcgcacgtctgctgatggcctggctgttcctaccgtggctctgtcctcgccagctttccctgcagcggcatagcattcgtagcaggggcaggcgctgcatggagggggctgcggggcaggtgcctggaggccgctgtgccagggtggcctctgaaatgtgccagggagcccctacgtggtggttagatgggagctgaggtggaacaagccactttattcactgctgtgtttaagaaacaggaccctcctgccttccctttttcgcccctctgcctggctggcagtgtgcgtggtgtggtcagtgcccagggctcggtctttgcaccctgtcctccatccagcccggcccagcgcttgggtctgtcctggacacctaacacccacctgccctcgtggccagcagtggctgcgtggctgggagcccggtcagaggccgccgggccctcagtaggtgcgtcgtgggcgctggggacgcagtacggtgcctggcggccgcgtgcaccggagagattccattccagctctctg

SEQ ID NO: 197132 - DNA, 172 bp, Homo sapiens
gggccagtggagggaaggctcagagatgcagagatgcagcctgggctcacttaatgaaggaactttctcatggggagggctgccccgcaacagaggggtctgtctggggacatggtgagcttcctgtcatgggaggtgtctgatcactgaccaacagttagaaactgcagtg

SEQ ID NO: 197133 - DNA, 423 bp, Homo sapiens
cataagtgttaaatcatttgtaataaaacattttaaaagtgttttttaatagaaggaagtagtcatgtgaaggccatgcttatatttggcataaccatgagttaatataccactcattgtgccccatataaaatcccacttgagaatttattttagaatttaccatttggaaaagtgttgttcaatctcaaatggtgtattttcatctttccagtaataaaagctatataatggattacatttttcttctggccctggaagccaaggaaactcagagttaaaaatttaacactcaagctaaactgttgagccttctactacatagcatatttccattcttctttttgctgtaattgtcttgcattactgtttctagtcactctgtactatattatctgtgtatgtatgtttgtgggagtggta

SEQ ID NO: 197134 - DNA, 562 bp, Homo sapiens
agaccatggaattgttagaacaattctactctatctgtagacttgttttatttgaaagataagtagatttctgtcttattcaattcactgattttggttctttgttatttgcaatcaaatctaattccagtagatacaactcctaagtgcagagcactgttctagggattgtggggcatgctgacatgggtctcatgcctgcatagcactcatagcctgcagaagaacagcagtgctgccatatctgatggtcatttgacacactgaactccagccatatcaattttcttttcagtccccaaatggcagtcaccacaaaagaagaaaagataaagctcttagtgggatctgaatcaagagataccacttacagtggaaggaaaaaagatcattttcatggaggaactgcccttgaatttcgccttgaatattgatgagtattggaatctgcagagactgggataaggttgggatgaggtcgaacactacaggaacagaaaatatggaacatgtttgggagcaggccagggattctgtcatataaagtgcatgaaaaagcata

SEQ ID NO: 197135 - DNA, 607 bp, Homo sapiens
ttaaaagagattcttactttacatctggcatatttcttgtgttacatattataatttcattgaacatggctgtctgtaaaactatgtatatgatccggaagagactcaaattaaattaagttttaacagccatcaattcattttaaaatgacacaggcatgaaaaatgatctatcaagatttgtaaatcttattctgttagctattgctagagatagtctaaaggtattctacttggaatttgagatcaagacaaagattttctgttagtaataatattcagattatttttattttaatgtataaatttaaaattcttagaatattttcaacaatattttccatttctaaatttattttatttctaaacaaatgtaattactttatttattaacttttattttcagttcaggggtatatgtgcaggtttgttatataggtaaacctataggtaaataggtatacagattattttgtcacccaggcattaagcctatgcgcgttagtgaaaaatgttattgctttaaatatccaaattattcagctgcatttgatctcattctttagtccaatgtaagtaagagtaaaacaatgacatttaaggccac

SEQ ID NO: 197136 - DNA, 204 bp, Homo sapiens
taacacacatctcagacttacacagccaacaaatctggtccttcttcaattttattttatatcagttaatggcgtctctattcatccagcagctcaggccaaaaactttatagtcccctttgattcctctcctttcctggcctcaacatccagtccactaacaagtcctcagctctctcccaacaaaatctaatccaagtcttg

SEQ ID NO: 197137 - DNA, 601 bp, Homo sapiens
attaagtgagaagaaatagatgaaacaagattggcaaaatgttggtaatagttgatgggtacatgggggttcattaaactattctcccttttttttatatgtttgaaattttctataataaaaagctatttttaaaaaacacacaagctactctctcacggaaggaggcttggcaagctctttctttccttctgtcacctagaagcctggaggagtatgaggaggcctgggatctgtatgctaggggagaagatccagccagctctttctcctggaacactctctctcatctagctagtataatgggtatccaggtggacacaggacagacacccacctgctcttttcctctggttctggtgggtatagttgggattcacctttcctcagcttacagcagtaacatcataatctgggtctgggcttagggaagagaagcaaagccagccttgtgacctgccttagttttagcctatctggcaaacctagctcaggtaaagaagctatctacatggtctagcctaaatcatgaattctgcttcagggtttgggaccaatgcttcagttagtaataaagtgtcactttgtcttgctttctcct

SEQ ID NO: 197138 - DNA, 331 bp, Homo sapiens
tttaaaatcataatagaatggcctttagaagaattatacttgcccttccctttgtgaatgaccatatcatgtttttctcatttcatcaggaaaaatgttatttttggcaatcaaatttagagattatatccttaaaagaaaaaaacccactaaacatgccatcttttgattatgtgtacaatattcagaatgctgttgctgtaatctaatacattagaattggtattttcaaattgaattatgtcaaggatgtcttttcaaatacttttgtttcttaaaaacatctatctgcccatttaccttcttaaccatccgtgttgaaaaagagaat

SEQ ID NO: 197139 - DNA, 430 bp, Homo sapiens
atctgtacttgaccatgaaagagtatactggtactttctttacggagaaaaccttaaagacggtttcctaaggtggacccaatgggaaattacacaggtttacatgagacaaggtagtaaaagagtagattaattcggccgggcacagtggctcacgcctgtaatcccagcactttgggaggccgaggcggatggatcacctgaggtcaggagttggagaccagcctggccaacatggtgaaaccctgcctctactaaaaatacaaaaattagccaagcatagtggcacgtgcctgtaatcccagctactcggcaggctgaggcaggagatcgcttgaacccaggaggcagaggctgcagtgagccaagatagtgccattgcactgtagcctgggtgacaagatcaagattccgtcttgcaaaaaaaaaa

SEQ ID NO: 197140 - DNA, 630 bp, Homo sapiens
gaataagtataggtagggtatttatttatggcaataagtagccttgatgagagtttatcatgaatcactgtgatgggcatttaagtgtactgaacggttttccaggtttctattgttcagtcttatgcttattgtgcatgttttgggcgttaccaactgtggggtggaaatagcatttttaggatttgaagttattggctttaatgtttcacttatgcttcatgaattttgatttatatatgaattgagtctcctcctcctatgacctgcggagtggctgcttggtttgggaggcttagaagcgtggtgctgttggtgtaggtccatctgtttggcaatattcagagtcagcatcctctgcattctttgtgaagtgaatgtaaagctgctcttttcctttttcagatgccccacaaccttgtggtcttaattttagagtgtcattttgttatcagtgattcatttcttttgttctggtgcttgtgttcttttgcagagtcccagggtagatgtaattatagatcatgtattctataagtgagctttggtggaaaagtcaagtgagggataatgaaatatttgtaattaacgtttaataaaaagggtgtttgaagtggtgctaataaacaa

SEQ ID NO: 197141 - DNA, 631 bp, Homo sapiens
gaataagtataggtagggtatttatttatggcaataagtagccttgatgagagtttatcatgaatcactgtgatgggcatttaagtgtactgaacggttttccaggtttctattgttcagtcttatgcttattgtgcatgttttgggcgttaccaactgtggggtggaaatagcatttttaggatttgaagttattggctttaatgtttcacttatgcttcatgaattttgatttatatatgaattgagtctcctcctcctatgacctgcggagtggctgcttggtttgggaggcttagaagcgtggtgctgttggtgtaggtccatctgtttggcaatattcagagtcagcatcctctgcattctttgtgaagtgaatgtaaagctgctcttttcctttttcagatgccccacaaccttgtggtcttaattttagagtgtcattttgttatcagtgattcatttcttttgttctggtgcttgtgttcttttgcagagtcccagggtagatgtaattatagatcatgtattctataagtgagctttggtggaaaagtcaagtgagggataatgaatgaatcacctgataacaaaatgacactctaaaattaagacggtaccgagctcgatc

SEQ ID NO: 197142 - DNA, 365 bp, Homo sapiens
gtgcacctgaaggcccaacaccacttgtaagctgccaaggcttggggcttgcagcctccaaagcaatggcctgagtggtatgttgaccccttttaaccacagctacagctcaagaagctaggatacagggcaccatgttctgaggttgcactagacagggtgcagcctgtccgagccacaactgccacaccagtctggatccaccttaaggatcccacttcctttcctaaccagagacaatatcccctgaaatcagaagttaggaaaggactagaagccatcattgataacttgaggattcagggcctcctcaaaccctgcagctagtcgacgcggccgcgaatttagtagtagtaggcggccgc

SEQ ID NO: 197143 - DNA, 119 bp, Homo sapiens
ggcaccctttgcatagctgtgatgaaaaacgtgcccagcatagttgttaaacatggcagccacagcacgtctgctggctctgagcaggctcccaggcccagactggccacacacgcact

SEQ ID NO: 197144 - DNA, 534 bp, Homo sapiens
cgagcgggaggtaagaagcgtgaaggttcaactctgagaagcacttatggggcagacagaagaacttatgaaagagatcaatgaggaccatctaacatgaaatgtcacagaataaaaccagatgtcacagaagtcaaggtaagatgatcctgaagaagagagtgtgtaccaataaaagacacagcaaaagacaacgtggagatgaaggggtcttagccaaggaaagatgtgattacttttgcatttaagagatgtctcaagtttataatgtggagaagagactgaagagtcagaaaaatgaagcgaggagttagttataagactattgctcatctgttaagtcttatattaggtttctatgaaggtgtatctgctgggcaaatgaaaagcctaattgcatagagtaagagatcagttgtcttctgctctgctgcagtcacggagaaagcatttccttcaagcaagccagcctgttcacctgtgttgttgatctattcatttcgttctaattcccaagggtattgtctttcctac

SEQ ID NO: 197145 - DNA, 158 bp, Homo sapiens
gcatttagtgggtaaacacagtcccatggagtcatatgagaacactacctagcttcaaggatctcaaccaagtttccagaggatgtaagatgtaacatctaagctgagttctaaaagacaatcagaaatttatcaggcaaatggtgtatgtgtgcatg

SEQ ID NO: 197146 - DNA, 462 bp, Homo sapiens
caggagtttcggcacggagcgtgcaggctctacgatgagggccagtgtcgaggaacaggtccctgggaggttttcagtctgctcagaagtgttctcatctgatctcagcatcagactgatccacagcctggctcaaacccatgaccacttgaaagctgacctatttttatttgtttcctcgagacacacttaaatgcagctaccacgattacccaaatgactgtctgcgtccatctcatggaagcctgtcattctcctgtgcttccctgggcaccagcacctttctgctctgagaagatccttcccaagcatggacttggttcccttttgatgagccgtctagcctgctctagacggtacatttaagaattatgtgatccaagatcaaggcagatttggtaataaacttttaaaataataaaattaattaaataaaaatgggtgtgtgagccctaggaaaac

SEQ ID NO: 197147 - DNA, 498 bp, Homo sapiens
tatagagttgctctgtgctgccagttagaaaagcggtgccactgtgtcttggagaggcgtgtaacaggcaggtggattcctgggtgggtgctgaaccttcaagagcttccaaaggctagggctggtttcacttttaaaaatttgtttttgaatcttaagtctaggaatcagcacgaagcaaaggctggacctttgcttctatgttcctctcaaattccggagcagctcaagtcccctgcatccagccgggacagagaggcttccggcctacacaaccccttcgcttccttgtaattcttaaattgggctgggtctacacaagtagcagggaaaggctttcctataacccaagcttttttccaacaaaacacactcccaacccctttggggaagcattttctgacactgaacggactctgtttgggcctcctaaaattggtcccatttggatctttccttagcaactaaaaatccagaaccctctgacatttgcctatg

SEQ ID NO: 197148 - DNA, 495 bp, Homo sapiens
gtaaaaaaaaaagtcattttctgtttttacctaataaatcaacattagactccgtaaagcattattcctttgggaactacctagatctctaggagataaagtagaggagagaaagagggggaaaaacagggaaaaaaaagtggatagcaaagaaacaatatgccacagaacttttcaggtcgaaaaccctagaagtgactatgttggtaggaagccctgattctgtaggaaacactatttctagtgtcctccataattcaagttgctcatctttttgttttgttttgttttgttttgagacagagtcttgctctgtagcccaggctggagagcaatggctccatctcatctcactgcaaactccgcctcccaggttcaagcgattctcctgcctcagcctcctgagtagctgggattacaggtgcctgccaccacaactagctaatttttgtatttttagtagagacagggtttcgcgatgttggccaggctggt

SEQ ID NO: 197149 - DNA, 510 bp, Homo sapiens
ccatttctcgaattacttccatgcccttctcaatgtgcatcaagaccttcaaggtcatattctaagggagtggggagggaagtccagccgctgtggcagttaacagagaaacaggcttctaagaaaaaagataattattttattactaaaatcctctgagtgagagtcactataaggccatggagacaaggatataggctggttaaaggccactgataaaagtgtgaaaggaaaatatcttgtgccctcaaaatcctagctaaagggaacactcaagctgggcaaatctgcctcccattctattcaaagtcatccctctgctcactctgatagaagcttattctgattgcctcctttggaaaagcttatgagaaactcaaaagaatgcaaccatttgtctctcacctacctgtgacctggaagccccctccctgcttccagttgcccccaccattctggacagaaccaatgtacttcttacatatattaattgatatctcatctctccct

SEQ ID NO: 197150 - DNA, 446 bp, Homo sapiens
agcccatttctcatgatatattttatgttatatatattaccacgattttagggggaggtcatggtattataggtgagaagttccatgtgtagattgtttttcagagtttagaaaattagtctcaaagggaagagagaaccacctgtattcacagtaatattaatattactaatattacatgataagggctttttcatagtcccatataagtgtttggggcaaatccctggcacagctagtatcatttgtaagctacattggtgtctgacaaaatccagttatttaaaaaacagaaaacagtggcttatttataatagcaatattctggacatatggccagtgtccatcagtgggcgtagttgaagcaagctgtggcatgcctgtgccgtggagcaccactcagctgtgaaaaggaaggagttgtgggtaggcacagcaagctggag

SEQ ID NO: 197151 - DNA, 301 bp, Homo sapiens
aactcagtaaaacccagcaaccaacacctatcagctagaatgaccccatcatgcatcatttagcatatatatgttaacctaggcattgtgtcagacactggagatttaatagtaaaaaaaaactacccacataggaatggtgcctgtccttatggagatgaccaactggtggaatatagagttacaaatcagagagctaattatgatacactgtttcaaggattgtagtagaaataatatgacttatcatgggtacagagaaaagagacactgatctcttctgaggggatgtgagagagta

SEQ ID NO: 197152 - DNA, 447 bp, Homo sapiens
gtatacattttcatctattacattttccttttgcataaaaacttcctttagcatttgtttttgtagtgcaggtctgatagccgtaacttttgttagcttttatttgtgtgagaaaatctgcattttgtcttaagatgtttccctttctttaaaacagttttgctgagttaataacaaattataaataatttgtacatatttaaagtgtacaatctgataacttttgacccatgaaatcatcaccacgataaaaataacatccccacaaatgttctcctatacaggagattttaggaggaaaggtgcatttgaactaaatcttcaagaacaggtatgttccccaaataagattagctcattcaatcaaaagtatgtattaaatgcttactgcgttcgctaggatgaataaaacagtcatgatttctagaaggagatgcatattataaa

SEQ ID NO: 197153 - DNA, 462 bp, Homo sapiens
cgacggacggtagctgttactggtagttatgtggtcaaccaattcacttgtattttaacgtagacgaacaaggaaaagtttactatgtgagtaataaggcatttgtaagagtaaatggcaatttagggatgcaaacgtgaaattagacatgttaattattgttgatgtgagagttgtgaaagaattggattatgtatagtttcaggatataaacttggaacatatctaagagaaagttttgggaggtaggtttgtaattttttcttttcttggcttaggtaaatgatggggtggcccagatgtagcagtgaacagttactgcaacttggacataatggcttctcactgtgtgtaagagggagatgctcattggtaattggatgtctttctttttaaaagtcatttaaaagtatttcaagtatgaaaaggtatgaagagtaattacagtacaacaccatgcat

SEQ ID NO: 197154 - DNA, 426 bp, Homo sapiens
agcttgcctcaggatgctgaagtgtggtttacctacacaggagatgcaaaattacttggaaatttgcacttcattggaggcaacccagaaggaatgactgattagtgtgaaggcgtaaatactctagtcccactaccactgacaaggacaactgcggcatcctttgagcaggaacaaagcctaaaaaccctataagagtccagaaaagcaagaagccacctacaaaaatagaaggaggtaagtgaaaagtgagagcaagttcctagcaccctaaagaaaaatctagctcgattgattgattgcaggatccctttccaactcactggctatgttcccctcctttccataaatgatcaagttggatccccagttccttcaccaaaaggaaagggattttgaattaggaataaaccctttggacagtgt

SEQ ID NO: 197155 - DNA, 271 bp, Homo sapiens
aaagagacatgaaatgagcacatgctattggaaacacgttcagctgatagactcgcttgatgtagggttgctaaaaaccttcaatttgttaaggaaaaaaaagtgcattatctatgaagtgcaataaatcaaagtgtaataaaatgaggtacacctgtactttgtcttcatcgagcacttctcatatttgccaagttcccactgattgctgagtaataagaataaagttaaaatattttaaatactgtatcatcacagctcaatgggatgt

SEQ ID NO: 197156 - DNA, 615 bp, Homo sapiens
tgaaactaagaagcaagtgattggaaagcaaagactaagttctatagttctagccttctggaatcagtctgaacagtctgagctcttgggcactgacacagggttatgatatacttcaatgccttactgaacttcactggcaaattggtgatacccaatcaactggtgcattcctgctaaatcttgctgtaatatataactgaaatctattataggcataataactgatctgaaaacaaaatttgtaagggtaaaatgcactgagaggctcaatgtgcaagtaagcacaatgttttaagtgcattttatatcaaatttccaccttctacttggagtcactgtgtcacaaagcaaagaaacacctacgaaatacatgcccaacagattgtgaaaacagtttatttgtccttatggcttcaaatgtagccatttgaagtcaattgtagacaatttggaagccaaatgttcccattctttcctgcttttataccacacatggtaacaggatagttactttaatttttttttttttttttttacctcttcttaaggaacatttattgttttacagattcttaaggaaccaacaagatagttagaagggactgtctatac

SEQ ID NO: 197157 - DNA, 105 bp, Homo sapiens
gataagtgcaatatcagagatatttttatattacagaaacacagaagagggttctgaatccaaattagagattagggaagacagtaagtatagtagtctgggagg

SEQ ID NO: 197158 - DNA, 347 bp, Homo sapiens
gttggatgtggatgtgtagccgtggactcagagttagacactgtggaattggagccctgactggtagtgtgttttcatttctctagggctcaattttttatttaataaaaagaatacttctgtattttaatgaataggatcaagtgagaaactgctttgtaaaatatgaactatgttcaggtcagcaattatactaattctttctatgatctcatctagtctaagatgccgtaagtgggggggtttttcatgaggatgaaatctgtccgttgccagatggttcaaagggcaagccctaagtcagaggttttacctcaactgctttcaagtcacagataaccttgggc

SEQ ID NO: 197159 - DNA, 477 bp, Homo sapiens
tcagtccagaccctgggcaccccccttttgccaggatcgtccccacccagcctggacacattgactgaactgttttctaggacactggattcaggtcaggtattacctccaccaagaagccttccctaatgttctcagcttggatgagatgctcctcttctgatattctacaggtcctgtttattcctcttctacagcagtgctcacgctgtgtcacaaggatgtactcatatcctgctcatcattgcatgtgaactactggagataactatctatatacatatatcacatctcctaatatgcgaagcacaaagtaggaactcaataaacatcaaacatcccacttccttggcagtggatagcatgaaactgtttattggcactaacctacggatagttaatcagactgattggttctctgtttccttcttctgagatttttacatgtgaataaaagtagatggactgagaagcaag

SEQ ID NO: 197160 - DNA, 151 bp, Homo sapiens
cccttggtctctgacacctgctccccctgtttcctgtgaccctgttctctgtggtccccttcggacaggcttgtctggattggcttttattgctttctcttctctaaagggttgggattccagtccatcctgaggtgctgtagatagtcac

SEQ ID NO: 197161 - DNA, 557 bp, Homo sapiens
ttctgttattagaattagtttatttatttggaataattcacttcttggattggatggatgccaagctggattattaccctaggctgctgatggaaagcatccaaaagttttaccagttcttttgttagtttcttgtatagggtaagaataaaaactcatttaaattgccataatttatgcaatgaaacccaataaactagccaaatttcaagttcctgccttccatcaacatttccattagatgaaaactccttctttatctaaaccaattgatggtagttagatcttttaatggatttgattctctacttaacattcatgagtctttaggatgaaaactgcttcagaaaatgaagatttcaatgactagtttagtctgaatcatcatggctgaaattagaaaacacaaagccagtgtgatcaatgggaagatcattgacataagtgtcagtttctgttaatggtgtggcctctaattaattttgtgatcttttgcaagttacttaatccctgtctgttttttactctgagagataataaaattggaccaaatcaat

SEQ ID NO: 197162 - DNA, 840 bp, Homo sapiens
atgcttactgagtaattcccatgtacctgataccgtgccaggagccgaagatacctacatgaattaggcatagcctcttctttgaagagaggctgatgctgttttggaggtaacagacatataagcaacacattctaatacactatggcgagtacaggatagatggtgtttcaagttcatgcgttaccaaagtaaggagtggttaattaattttactaaaagggagagaacagtattggctttaaagaaaaagtggtttgagccagacctgccagaataagtcgatgggaaaagatattctagcacagaggacaggaagagcaaagacagggaggcctaaaatgaagggtggatttgcagttgttaagtgggaagactagatatagactgggtttgaagtctactctgccacttactagctgggtggctgtggacaaagcagtaagccttcctgtgagtggtttcatcatctgtcaaatggggatgcaggatccatgcctcatggggctgttgggaggattccatgttagtttagtgtgcttgggatgttgtgacccctcctgaacattacagccctgaggcatcccctgttctttgatgtgctgtatataagaaaagagactgggcgtggtggctcacgcctgtaatcccaccactttgggaggccgaggcgggcagatcacctgaggtcaggagaccagcctgaccaacatagagaaaccctgtctctactaaaaatacaaaattagccaggcatcgtggcgcatgcctgtaatcccagctactcgggaggctgaggcaggagaatcgcttgaacccaggaggcagaggttgcggtag

SEQ ID NO: 197163 - DNA, 362 bp, Homo sapiens
ccctggctggcccttaagtcctctctgccttttgtgtttacccagaaggcctaagaggtgtggagtgggcagaggctttgtagtatgggggctgtgtctgggctttggatttcattccatccccctgcccaccaactgtgtagccttgggtgagtaaggtcttcatctgtagaatggggagaatgatccgtacccaactgtccactgcagtcgctgaggttgcccagcccttgcagcctggataagcttgcctcagactttcttccatgccccatagaaatccagagccctgtccaggctttctggtggcacttctgtctctttagttctgtttctgtgtcttctgccagcaccaccaatac

SEQ ID NO: 197164 - DNA, 519 bp, Homo sapiens
actctggggacatgcaaagagtcatggggcttcttctgcggagatgctcacagtatgcaatggagcataatgtatacaccaagtagaaattgagataggatgtggtaaatgtcttgaaagtggtgtaaggagagtgctgtgggaattccgaggcgaaaagattacctctgactgtggatttaagagcttcatggttggcccggcatggtggctcatgcctgtaatcccaacactttgggaggccgaggcaggtggatcacctgaggtcaggagtccaagaccagcctggccaacatggtaaaaccccatctctactaaaaatacaaaaaattagccgggcgtggtggcatgtgcctgtaatcccagctactgaggaggctgaggcaggcgagtcatttgaatctgggaggtggagattgcagtgagtcgagatctcaccattgcactccagcctgggcaacaaaagtgaaactccatctcaaaaatgaaataaaataaaataaaaataaaaataaaata

SEQ ID NO: 197165 - DNA, 983 bp, Homo sapiens
tatttttttgcatctcacagatacatttattcatgctatgaagtaaacgacacttatacaggtgccccgtgatgtttcacatttccatctaacatagcttgcattgcatttttaaaatttattattgttttttttagagagacagggtctcactatgttgcccaggctggtcttgaactcctgggcccaagcgatccttcctgcctcagcctaccaaagtggtagaactagacaggagccaccatctccagccacttgcactgcattttaaaagtgcactccagtgtggaagaacagactgtagctggcaagagtcaaacacagactgtctgttattgtagtccaggcgcaagagggaggtggctgggatggggtggtctggatggatctggagcagtacaaggatcgaacatgttttttgagatggtgtggacaggacttgttgctgacccaggtgtgggaggtaaggaaaggaggaatcaaggaccttagacacaggacttgagcaactgcatgactgggatgccctcacttgatgtgtgcaggagtaggattggcagaggaaattaagagtctagtttgggccacatggttagtcatccagggactgactatatccaaggggcagctttaggtgcaagtccggagtcctggacacagctcatggctagagggatagatacaagcatgcctgctgtagaggcaggtgaaacgtggagcagggcactgcggacatggaagagccagaagagaatcctgggccaccccaacattgagagagtgaacagaggggaaagcaagaacaaatggatctcagggaccatgttctgtgccaaagaaagacatgacctttggaaccatagttatgctatgactttcatatttttactgcatgaaagaagtcttttgtctttccatttccattgtgaagggaatgtgtttctcttcttcggccactgttttgtggctgatccctccccagg

SEQ ID NO: 197166 - DNA, 292 bp, Homo sapiens
aatgtttccattatagtatgagaaaattaggataagttaaaagtgcttactgaaaaatatttcacgaggctaattttgttcattacagatccaatcttgcagtcctgatccatagaatggtgtgcttgtgtgattgattttaagtcagtataaattagtaacttttgtatcattcaggtgatcttaacaaaactggcagaatatagaattgagaatgtgaaagaagctatttataaatgaatatttaggttaaaaacgtccatttagtaaacaatttttttaccctgaaatg

SEQ ID NO: 197167 - DNA, 396 bp, Homo sapiens
tgagaaagatgttactatggcttcaagatccaaggtgagaaatgggagacaataaggctcataaaagagaaatctgtttggatctgaatcagaaagatcacacagtatagtaatgagaattaaaactgcacagaaacaatcagggtttagaaggctaaagtggacaatttgaactcatttactagtagcttggcaacagttaaaattttcaaaacaagctgatttgagctaagtctcttagcattcaccacattatactgagttatctatttctgtgttttgctatcccaccaaactgtaaattctgctgtgttttattcatcattttactgcctctgcctagcatggtacctggtacatgcttgccactcagtaatcacttgtggaagtcaactg

SEQ ID NO: 197168 - DNA, 730 bp, Homo sapiens
taagggacttcattctcccatgtagaattaatctcagacatgacattctcatgtgaaagacctaacaccttactagatacgcataatacatctagaaataatttcaagttttattaatgtttaaatctctaattgcaattattatttaattgaggataaatgtgtttttccatgtcaatacatttttaattttataaggaaccttttttaaaaagtcattcacaaaaattacttttagaggctatgttcaagagcatatctattttataagatttatgatgtattttttggaataaaaacactctagaagattctgcaatgtaaatgttactgtctcaaataatatatttgccattatagtattcactattaaaaaataactatagttaattattttatagtatcaatgtcttctttttccaatttagaaatttgagtttaagagtttttataatgtggatgggagcatggcacagtgactgtttcagtccagatcacttccctgtccaaagatatcacccagaggaaaaggaagactccttaccagtaacagcacacaccatggtgactgttcacactgtgatgctcctatacaatcttaattaagctcaacagacacctggtatcctacctaatgtgtcttactcaaagcacaaagaaaaaaaaaatcagcaataattgggagacactgcaaataacctgaaaataaatgcatgttttggccttttta

SEQ ID NO: 197169 - DNA, 180 bp, Homo sapiens
gggatttgggatccctgggaattaaatttgatgtggtaatgaagtgcagatggttttctggaggctcatttttgtgagaaggaattttaactcatggtcactagaaggaattatttctcaggaatcttgcctgtgctgggtaggccagttagacaataaaactatttgaaatttaaaaag

SEQ ID NO: 197170 - DNA, 455 bp, Homo sapiens
tcaggagctggggctcctctctgcaaatactgtagaacatcagcgtcactgaatgaatggagttggttacctgaccagctttcctactcaacatggagctctgtctgtctcatctctctcgattcttcagtgcataacccagttcctagcttgtgatggatccttcctaaggatgtattgggtaaattaatgaatagtgattcgacctaaccaattaaatccctgggagttttaaactcttgtccaacatcagttttatttcacgtcttattataaaacagtacatacctcttccagaaaaagtgaaaaacccttatatcacttagatgtaactaattaaacaaactgatgcatgtgtgtgtgtgtgtgtgtgtgtgtgtgtgtgtatagttgtatggtggtatatatattagtttgtaaatagctcttctactaaatacatgataaatatactt

SEQ ID NO: 197171 - DNA, 774 bp, Homo sapiens
ggatgattgattaagtctaagtgggtgaagttgtggtgaaccatgatagcaccattgcactgcagcctgggtgacagagtgagaccctgtcttaaaatgaataaataaatatttgtaaagaaacaccatacttacatgactcattcacgaagacagactatattctgggtcagaatacaagtcacaattaatttaaaggattgaaataatacagattatataggaatcagtaatatctccaagaaaatctcaaatatttataaattaaataacattcttctaaataattcatgtatcaataaggaaaccataaaggaaatttaaaaatattttaaactaaatgataatgaaaacacagtatctcaaaattgtggggtgcagccaaagcagtgctcagagggaaacatatagctttaactgcttatcttagaaaagaaggaaagtctaaaatcaattaacaaagcttcaaccttgagaagttggagagggtgttggggggaaaagcaaactaaacacaaaataagtagaaagaaggacataataaaggtaagagcaaacatggatataattgagaagagaaaaccaaattagactcttagatgaacaaagtttataaacttgtagctagactgatcaaatcactggtatgacaaatgaaagagagggtataactatggaacccacagacattagaagggtaagaaaactggttgcagtggctcatgcctctaatctcagcattttgggaggctgacgggggaggatcacttgagc

SEQ ID NO: 197172 - DNA, 547 bp, Homo sapiens
catgaaagcctgtttcaaatcatttaaagaaagcttactggcaaatggaaaagagtaagttgtatagcacgatacataaaaggttaatatccttaatgaataaacaacacaggagtaaggaaaacacaagaaattcatggaaaaacagacaaaagacaaggaggggacaattctttggagaatcacagagaaccaataaaggaaaaatgaagtcacactcagtaatataaagatccgcaaataacgtagtcgagtgatagcatatttttaatctcttgggttaaagatctagacaaacaaacatagaaagaaaaaaaaaaactattaaggcttaggggttgctgagattgtcctggaatgcagtctcatggcctgctggtgcaaccacaagtcaatatagagtttctggacaaccatttagctgtaggtattaagaagcttaaagagtttcttatctccctgaacctagtaatattttcctctaggaatctactttggggaagtaataagacaatcagacaatgatcaaaggaatatttataacagc

SEQ ID NO: 197173 - DNA, 423 bp, Homo sapiens
  misc_feature (409)..(409): n is a, c, g, or t
ctcagctagactgagaggccactgcaggtgctgccacagccccctgtccctgcctgattccttgtttctatcctccgccagactggacactaaaagacggcagagatgggggcatgggtccctgtgatggctcagtgtccagcccagcatacccggcaaagatggctgcctccccgcagccccagaagtagccctcccccagcaggacagctaccacaaagtcccagggacaggtgtctccctccatctgattgcactgggggctgcctcgtgccaggcatggggctggaccatgtgtttcctcccagctcagccctgctccaggttgggggttctcctcctctgggctgcccttcctcaggttccatgagcctggagatgcagaggtgctcagagctggagcccaggnctgaaccaccgctc

SEQ ID NO: 197174 - DNA, 550 bp, Homo sapiens
acctgccacaaggtgtaagccttttctaatgtcctgttgcaaaggccttgaagacaagggccataaattttcttcttgtgtgtggctggcatataggcacccaaggaatggttgtaaagctattttagttgttccttctcagggtgctgaaacagccttacttaccaacccagtgcttctgaaacatttttcttaccaagtcatctggagatattgctaaaatgcaggttctcattccaaggttctggggcaggacctgagaatctgcattcccaacgagctctgaggtgatgcagatgctgctggtgctggatcacactttgatagtgaagtgctaaccctagtatctacatttgctttttagaagtattgggtaaatgggttttattttcttatggtattggaataaaatcttgggtttaggagcttttttctattttttgttttaacaatttctctatcttgttaaaaaaaaactatttgaggaattgttccaacatactttgatgtaataagatttttaataacagcaattgaggcacatggagtg

SEQ ID NO: 197175 - DNA, 422 bp, Homo sapiens
gaaggaaaaataagaaaaggaaaatgcaagcctcaggaaaagctcctagagtggaggaaaataaaacccaagaaacaggagcagagtcttcaggaatgctttcctggccaccatatttaaaattgtatctccctgtccccatacacactcaccatctatcaactatttatcttgttcatcatctgctttcattagaatatatgctgtgtgagggcagagatttatgtttcttttctgctcttttgtgtctgtaacttagaaggtctgttgctgtcaagagggtgccattcacgttataatctgaagaaagtggtcttcccttcaatacaaccccaaatgaaaagtgaatcattggcatggaagaaaagactggagatactctcagtgacaggaaaaagatgaaaagatcagagatatgttag

SEQ ID NO: 197176 - DNA, 242 bp, Homo sapiens
tgaaggtctttatcttcattgtcttcacattgagtaggatgtgagtaggctgaggaggtggaagaagaggagggttggtcttgctgtctcaaggtggcagaggtagaagaaaaactgcatataagtgggcccatgcagttcaaacccagttgttaagggtcaactgtattttctcatattttgtgggttgtcttttcattttcttgatgttgttttttaaagcataaaagtttttaaagttt

SEQ ID NO: 197177 - DNA, 438 bp, Homo sapiens
tcaacttcggttctgccctaacggagagccacaaataaccctaaaccatagataactcaaatgcatttttacttggcttttgactgctttttatgataattttcacagcacattgctcttctaattatgttttgtttgggatcatattaaaattaacttgtatttagtgattatgtgctacctgatgagttaaagaggagccctgggagtgtattgaaaaaccaggctgtggatggccttcagtactttacacaaagaaaagccaaatagttaaaaaggcattaaaaatggaaaggatgtaactagtgggcaaatagctccaggacctcagttgcatgaacttagtatatctctttcctcctccttctcccctccctcctccacgccctctttctcctagtctctatttccccttttccttatcctcttcctccatct

SEQ ID NO: 197178 - DNA, 415 bp, Homo sapiens
gggaagaggctggtggctggggaagaggtggctctcagaggtcatggatgggcttttgggagggaagtgatccagtagagaagcagaggcgtcagagctccttgcagagatgaggagagaacccaagtgcgggtggagaggccaccctaagcggtggcttcccccaggaagtaacctggtggtgggagaacgagccaattctctcttggctcttattttctcggtgatacaagtgagacatcacccgagggtgagaagtggggagaaggtataaagcagtctggggtcggggagggaactcctagcaaatgcagtcaaatggctggaagtgcgacagctcttgagatgcgtggatgtgaactgcaggctggtctagggcatgactagcaaggaggccggtgacagctcacctgtg

SEQ ID NO: 197179 - DNA, 573 bp, Homo sapiens
cttagaggatccccgactagtccaaccatacttagcaaggaatcaatctttgtgaggaaataagcccagtctggtggaatggggtatttgaggttgcttcactcaggagaatgacggccccagcattctgcagtgaagagtttctgtaaaacagtcctgtgaggttggttttattccaggtggacaacttgggatgctgaggcttcaagaggatacctacttaggaagtggcatagccagggtttgaaagcagatttgtttgtctcttagatatgttctttttccatcttattacactgtttctcaaacattgagtggatcctccatgacctttggttgcttgtcctgtgaatgcataggactgaggtggactgggagaataagagcttgtgggcagctcatgttgtcatggtgaatatctgtgtgtttgaatacatgtggactaatgtgatgaatgatcgctattgatgagtgacgtatattaatatatccttaatgttctcagcctgtgaagtttgtttattatttttatgtaaaagttatactgtggtcatatgtatgtaagagggattc

SEQ ID NO: 197180 - DNA, 934 bp, Homo sapiens
agagtagcgggactatgggcagcagccagcaggccagggttagtatgtgtgcgttgtattgaggtagagacggggtttcaccatgttagccaggctggtgttgaactcctgacctcaggtgattcacccacctccgcctcccaaagtgctgggattacaggcgtgagccagtgagcctggctgatgcggaccaagtctttaacagttaactaccttgtactgatctgcaaaatgatagaaaaacatgtaagtttaggtggatcagcagagagtctgttacatcttggtggtctcagagctcttttctagctctctgagtttctgggattctaacccacatacttcaggagatgtcttaataatggttgtattagccacttgttacaaaacacttagcaaggaatcaatctttgtgaggaaataagcccagtctggtggaatggggtatttgaggttgcttcactcaggagaatgacggccccagcattctgcagtgaagagtttctgtaaaacagtcctgtgaggttggttttattccaggtggacaacttgggatgctgaggcttcaagaggatacctacttaggaagtggcatagccagggtttgaaagcagatttgtttgtctcttagatatgttctttttccatcttattacactgtttctcaaacattgagtggatcctccatgacctttggttgcttgtcctgtgaatgcataggactgaggtggactgggagaataagagcttgtgggcagctcatgttgtcatggtgaatatctgtgtgtttgaatacatgtggactaatgtgatgaatgatcgctattgatgagtgacgtatattaatatatccttaatgttctcagcctgtgaagtttgtttattatttttatgtaaaagttatactgtggtcatatgtatgtaagagggattc

SEQ ID NO: 197181 - DNA, 333 bp, Homo sapiens
tatatttttaccaaaatgtaattatttattcctgtacatgctgttttttatcaaatgctgtttcatttcttatgagtgacataaagcctttgccggtgatatttttctcttatagttataaaatcaaaaatatgacagagagttgtacctctctagagaatgtataatgcaaatggatcttatatataatcatatcccctcagccttctcattcttgtaagttcatttgcttcataaataaactaaatagtttgtactgaaaccagaagttgaccttaatatttgtgttggctgggcacagtggtgcacgcctgtaatcccagcactttgcga

SEQ ID NO: 197182 - DNA, 586 bp, Homo sapiens
agcctgcacagctagtcagtgaagagtccagcagtgagacttggctgccggactccagacaccatgctgttcacctgtgctgtgctttctcctgttattttaccaaaatctcctgtttacctctgtcaacaaccagcaaagccggacgcttgttaaagtggtaggggcagtttaatgggtaacatactatggcagtagggaggatgtttcagcatgaactggactcagcttcgtttgtacagaggttactggtgctttaaagggagaataggggaatgagcagaggctccgtagagtcagggaagtgaaaaaaattacaaaggcttggtcagtgtagatgctgattagaccaactgtgtctgtttgctggcaatgatccaagaagtcaggattcaaccctcccatcgaggccctgttctttctgatgagtgcatttcagagggatggatagctttcaggtccttgagaaagacactcctgaattgtaggagatgtatatgcatctcacagggacacaggaaggattcaccattgtaagccctttttactaaagagtgtaagaaacaatggtcaggggcctacagtc

SEQ ID NO: 197183 - DNA, 364 bp, Homo sapiens
tcttctggaaattaatatccaaacaagcaagttattgtgaaataaagagaagtgggagatctccttacctgctctgattccaagatagactttaaaatatatttgagcaacccttgggtttcatgtcacacttcaaaaaatacgtctagagcataaatgctagaccactgctaaaataaaattagaaaaaaaaaagtgattactaatggtaagagagtactatcaggagcacagaaaaaggagaacatgctcttaatatttgtaattatgtatatgcacttcttctacggatacaaactttgaggttaattgaagacccagcaacaataatgagctgagagaagccagtgatgtagcaaatggt

SEQ ID NO: 197184 - DNA, 874 bp, Homo sapiens
gcctctgttttctaaactacttgcaagccctcaggcgatcacttgaggcacaagctcgacgaattgcgtaggggtctgtaattattcacaaacgacaccacgacttctagcacactgctcaatttatggaatgagagacagggagaagatgccagagtactggagttgcgcccggcttccctggagttgccaccaccttggttatttctagatgatagaccgtccctagctgtggagtcacaagtagttgaattaattagtcattgaaggtcgcagccaggtggaacccctgtaactctaaggtattattggttaaataaacaaataaacaaggaacaataattatagaaaatttaacgtcactaaccgccgattagcaatacggacattactcaccacccccttaaagtagtattttgtcatctgtccgcttaactatcagcccaactgtcagcccaataggatggatttcactcaagggtttatatgaaaattcgtttttattgttgttggtttttttattgtcttttttggtttagatttaagtgaaaatttatagctgttaggaacaaagaccacaagttgaagttttatgacatttctaaaaatacttagaaatctgtgttaatgttatcgttgagaaaggaaacgatttgcttcaatttactgggctggagaatggaagagagcagtgtttttaatattttgagcaagtatcagtccttaaatttttttattgcttccatgatgcattttgagaattttcaatttaaaacaaccattaggtgtatgtttttacaagtagagttttgaagaatgctagcaaaattggttgaggcatcacaagttattagaaataaagtggtaacctggt

SEQ ID NO: 197185 - DNA, 243 bp, Homo sapiens
tgctctcacattctagtgtggtagacagttgatgcagaattaaagaatatatgggaataagtgtattaaagagaaaaaacaagcagggtaaggggaaacaggtagtgtaatatgtatagggggtaggtgtacatggggggagtcaggaaaggtttcactgaggtgagactagaggacagcttaataatgtaaagaaacacgctatgcaacaattaggggaagagcattccaggaaagagggag

SEQ ID NO: 197186 - DNA, 208 bp, Homo sapiens
tgctagcagtgcaattagactgggggtctaatgagaaatcaaaatgggagcaagtcattataatatgatatgacaatatttgtaattgaatatccttggaagcataatggaaatggtgccagtgggactgaaggtaggaaagaaagcttcactgagaagtccagttgagctgagacttaagcagaagtgacagagataggtaagtgta

SEQ ID NO: 197187 - DNA, 256 bp, Homo sapiens
ggataatgagcccagttctaaactggaacctcccagttcaaaatataaaacctagtcctcatttagcttggtaaaaacatgtgcttcgattcttaaaaccaagtacaaagaggattttttaaatgtggcaattccatttttatgttataaatggcatcagttattctgctttacaaatgtgaatcctactttaagataaatcaaaagtccctatacatgattataaaaataccagcctttacccacacacatacaa

SEQ ID NO: 197188 - DNA, 422 bp, Homo sapiens
ataatccaagcactttgggaggctgaggtgggaggatttcttaagcccaggactttgagaccagtctgggcaacatggctagaccgtgtctctctctctctctttttaaatttctttttcttttttcttttttttttttttttcgagaaaggttcttgctctgtcactcaggctggagcgcagtagcacgatcatcgctcactgcagctttgacctcctggctcgaacagtcctcctacctcagtcctcctgagtagctggggctactggcatgcaccaccaagcctggctacttttgtattttttgtagagtggggtctagctatgttgcccaagctgttctgactcctggactcaaacgatatacccacctcagaatacaggcatgagccactatgcctggctgagaccctatctcttta

SEQ ID NO: 197189 - DNA, 452 bp, Homo sapiens
taggctaaatgataagattggttctaacataaaggttaaataacagtacttacaacaatataaaagttttgcttttctgtcacacagcactcagaatcagcagatcagggctgtccatgtgagggatccaggctctttttgtgtcgatactgtgttacttttgacatggggtgggtgcgtgcggctcttaacagaaagattcaagtttaatagatacagaagaattgatggaatcagaagaatcatcattttgcaacccccatggtaataactggttcagaaagtagtcatcagtggccaaaccataggtgaaaagttgtgctgtgtgcaaagtatccaacagattatttatttaaaatggaggaaaattcctttacaactaagatgtggctaatatctcagttataaaggtactttaatgggtccgactgacatgctttctaatggggtgc

SEQ ID NO: 197190 - DNA, 575 bp, Homo sapiens
cctgggtccagattatttatcatatattcctttaatttagccctacctccacctctccatccatgttccaagagcctataccttgccaaagagttcacttctctcctcatttctcggcctcttagcaacatttgacaagattgattttcctaccttttaaaacactttcttcttgatgcttttgagacaaaccatgaataacaatcacctcactctattttcctgctatctcacaggcctcaacactagtctcctttgctgattcctcctttgtatgatcactaaatactggcttgtttgagtgtccattctcagccatcctttcttctctatctatacattcttccaggtaatcgaatctgtctccatcccataatctctgttgagctccagacgcatgtcaccacctacctaatctctacttagatgtgtaccaggcatctcgatatctacacggctgaaaaagaaccactgactttctcccatgctctaaaatttcctcctccacaattctttcccatctaggcatcaaaactaatatttagtctcattttttccctctttcatcataagcc

SEQ ID NO: 197191 - DNA, 299 bp, Homo sapiens
attttccattcccaccaacagtgcccaaaggttctaatttctccccatcctcaccaacacttaattatttattaataatagccatcctgatgggtgtgactttggtgtcccatttcccccaatgaatggtgatgttgagcctcttaggtgcttatagccatttgtatatctttggagaaatgcctattcaaggcctttgctcatttttgacttcagtttggtttttttgttgttaggttgtaggaattatttgtataattctagtgcatattaggtcttaaagagtgggcaaattaaag

SEQ ID NO: 197192 - DNA, 210 bp, Homo sapiens
ctatttaaacaaaagtatgtatgtgggcaaattcataaagacagaaagaaggatgagatgttatcagatgctgggggaaggggaaatggggagctactgcctaatggttgtacagtttctgtctagtaacgaaaaagttttggaaatggtggttttggaaatggtggtgagggtcacaatgacactgtaaatgcagttaacaccactaaa

SEQ ID NO: 197193 - DNA, 751 bp, Homo sapiens
gtaggagcctccgagccaggtattcagtgacatctttctaaattgtttaaaatgagaagcattgcacactgagagtcaggatccaagtgtctttgactgagccaactcagctctgctattaacttatggtgtgatcgcaggctgtctagaaaaggacaccaacaatcacccatgaagattgcccttcaacctttgggaggaaatgatcgaaatgggagctagagaagattgttgttggaatctcagagattataagcaatttctccatggctggaattcagttgatctgggactgaacctatttctaatggagctgtgacgagagaccacagtaaatccaagcttggaaaatgagctgtgtcagccctcccaaagacaacctccttgcaacaggaagttgtcaaagccccagggaccagaaaccatgaagttatttggatgatagatacagagatacgctgctcagatgcccctttcaagaaagaacttgctgcctcttgctcagtttcttcctggagctttcaagcatctttgcagggaagtcacatccttcccagggcagcccgactgaccatgggagaagaagtttaacagagatgaggcatcctggaatatccaggtggcaacatggagtagagatgatgactacttctaggccatgaaaaaccagcaggatccatgatggctgagaaatgacaatattggtgaattaagtacatctcagggagaagctttattaaattagcctaat

SEQ ID NO: 197194 - DNA, 500 bp, Homo sapiens
aaaacacaagactcctggattagagccaaaggacttcattatgcatgtgttgggtccctaacccacccagtcgcacggggacaatgcagggcccatggtgaatgcctgcacatgcagtggattgcatcataagagaagaacacaaagcttgggggattcaccatttttatagtgagcagtaataggcatgctcattgtgcagagagaggcaaaacctcgcctctccaggctactcactgcaaatgcaactcagaaaaatgggatgggtaaagagcaatcaaaccttgcattcttggcatagccagcaagtagatgtagggaaactcaggacccatggaagactgcctctcccaatgatacatttcataaaggactagtattcagaataaagaactcctataactcaatagtaataagacaaattaataaacagattaaaaacttcataacagaagatatgtgaatggccaataatcacatgaggacatgttcaagatcac

SEQ ID NO: 197195 - DNA, 286 bp, Homo sapiens
tagtttatatttgaggaacatggagaggacaaagcagcttaaactaaaggtcacataaggtggtggtaagtcttaggaattgagaaataacatgtcaccaagcttcgggagacctaggaaccaggctacagtgcgtgcttttagttccagctccgattcctactgttcctcactcactaaagcaatgcttgtggaacttgggattcctcatctgtaaaacaggcataattctacctcctttacgtgtttgtgtgtgaaataacttttaactttaaattggaataca

SEQ ID NO: 197196 - DNA, 278 bp, Homo sapiens
agtgagcaggccaacaagaaactccctgaaggctgatgaagaacaatgatcaaagtatacacagccaagcttcagggcagccttggggatgcagactgggtcatgaatgatagctgtggctgtcacggggaagggggccactccaaggtggagcagctctggcgctaatgaaaacctgatgcagacaaggtaattttgggaagcctaagagttttagcattagtcttttggccccatgactacctgatttccctaaattcacccaggaaagatcgaga

SEQ ID NO: 197197 - DNA, 575 bp, Homo sapiens
gcatgacctctgctaaaaaaagtaggatgaatcctaaggaagttaatagctgaaggctgcagctactagattccagagagtggcctggggcacaagatactcaaccagagcagacagtgtcagcctctgtcatggaaagcacagagcttcctatcctacatgattgtctattgtaatgccaaattacaagcaatggagtctcactgtgttgcccaggctggagtgctgtggcatgatctcagctcactgccatctctgcctcttgagttcaagcgattctcctgcctcagcttcccaagtagctgggattacaggcgcacgccaccacgccccgctagtttttgtattttcagtagagacggggtttcaccatgttggccagactggtctgtaactccagacttcaggtgatctgcccaccttggcctcccaaagtgctgggattacaggcctgagccaccatgcccagccaatttccatatattttttatactgggatttcagagagtaatttcctcttcatgtgtaaccagttatgtgaattaaaacagattcagccttcttttacggttgtg

SEQ ID NO: 197198 - DNA, 330 bp, Homo sapiens
aaagcagagcaggctgttttcattccattttacaaataaggaaatgaagactctgagaggttactgacttaattgagaatcacacaattagaagcggtggggttgagatttctaagctagtgttctttgaactgtatttatactataatgaataggctataatgaagtttacagtcccctaaagtatgtccagtggagcagttctcaagaaggctctggcggggagccaggagaataggcagatcaatgagaatatgaatataggtgaagaaaccgagaattttccactaatctgagtctaagttgattctagaaaggcaatggttaatc

SEQ ID NO: 197199 - DNA, 894 bp, Homo sapiens
aaatccaagtgaaaaatatacggaggtgtccctcacatccaaataacagtaaagcaacttgcctaaggaagaaagtgtactaaaaattggaaccatgtatggactctttctcaggttgttgcctctgaacctatcaaaagtgatgtgcataggggagatgaaggtgtgacagaggctgcaaccaggtgggtgaaggagagaacaggcaattctcagaaaaggagtgctgggtagttaatccagtaggtgtctactacactatcctcaaaccctttagttaagaggaactcttcagagactggcaattgcctctttaaatagctttggatgtttgaaagtacaattgaaatgctttcgagtagtttctaattattgtgcacattatcccatcttaaggtgattcagaaaaatttaaactccctctctatgactgttcttcagataagtaaaaatagattttttgtatgactcttttccttatccaagctaaatatgcttgtttcttttaactgtttctcatatgacctgtctttaagtctctaaacctgtctctttttttacattttccacttaaagttttctagtttgccaaaaactgaaggcactacttcaaacatctctgaaaaagagggggacgggatgggcgtggtggctcacgcctgtaatcccagcactttgggaggccgagatgtgcagatcacctgagcccaggagtttgagaccagggtggccaacatggtgaaacccagtccctactaaaaatacaaaaattagctgggcatggtggtgggcgcctgtaatcccagctacctcgggaggctgtggcaggagaatcgcttggacccggcaggctgaggttacagtgagccaagattgtgccactgctctccagcc

SEQ ID NO: 197200 - DNA, 278 bp, Homo sapiens
tagcaatgtcaggactaaatgtggttttgtacttcctactaaacatgagcttaataaatgtttgtggaataaacagatgaatctgatgaatagttcctggactctcggagtttaaactctgggaacagggcagggactcctgaggaaagcagacaactcctcaaccttctcatgggagggaaggagaccttctttcctgaacaccaattatgcttcccaggtggcatggggtccttaggccacaatgccaaacacttttgcagttaaacttccgatga

SEQ ID NO: 197201 - DNA, 569 bp, Homo sapiens
aggacactgaggcccccaaagaaggagaaacttcatctaggtcaggcttggtagagtgggaggaacacggggctgggggtcgggaggcctgggctcacatccctgctctgccaccaggtctcggacagccttgggcaagtcctttcttccccatgggttgggccagccatggtttcaggctgaggcctgagctccaggggtacctggctggatatgggacagagcagggaaggatgcaaaccttcagaggcctggagcttgtcttggcggtaattctaaaacatgtgaataatgtgtataaagaaaatgtgggtggattatgaagtctatgcaaaatttccttgaagtctaaaaaggaagcttagacttgcaggaaattttgacctgtgcaacatgcccccagacttcccctgctgccagcttctagggatggtttacatggaaagtttgaggagcactggaatactggcttcctaagattctttgggattctcagacctgtttctgtcttccatggcagaatgtgatatcctttagacttagaataagaccaacctgtaatcccagca

SEQ ID NO: 197202 - DNA, 238 bp, Homo sapiens
ccccttggcagagctccccttggcagagctccccttggcagagctccccttggcagagctccccttgcagagctccccttgcagagctccccttgttttcgatgatttcaaggtaatgtttcttccagggaaacttcttctagtagcaacccactcagttaccctgcaagttaggccccaatattccttgtggaagctcaggtgggaaacaggcatcactgacactggctctgccaca

SEQ ID NO: 197203 - DNA, 489 bp, Homo sapiens
cttatcttcactggcaccagatatagctggaaatcagtaacagacagtatccctagaagccatggaaagaaaaaaattccaaaagctaaggtatacatgtgggcattcatttttcatttgtttgataaacctaaagttgatgtataattactaaagattcatatagtctggagtttacctcttcattttgtatgtttatatcctgggaatgtctaagtcagattattatttactcagaatattacttatggtaagcaatgatgatataagtccttcctcactccctctaaaaatctttgacttcagtgctagcttgcactttaaacatgtattccaatattaagaaacaatcacttgttacaaaagagtagaagtacatgcaagattttatccaaaatccaaatgcataagacataccagcactgatcatgttttgtctaatttctccattcttctttcttttgtggtctattcactaattacttgatg

SEQ ID NO: 197204 - DNA, 325 bp, Homo sapiens
tcattacagtcaagtaggggtgagtatgtagctgttgacagttggtatcagcccttgctgggggtggtggtagacaatgtcagggaagcctccttcagagatgttttatcttgagtgagtctggaaggatgagccacaactggccaggcagaaggcaggagaagggaaatggtgttctagttgaaggctcaaagatgtagaacacaacctggcaagttctagaaactcgaagctgctcaggctgcagcaagcacatcagaaggcagggctgagagaagacactggaggccaggccaggactaaagggaacggggagcctctgaag

SEQ ID NO: 197205 - DNA, 465 bp, Homo sapiens
cttcatcacatcctaataaagtattaatatgcatggtctttttgagatcaaaagacatgacagtcataaaaaaagttatcataattccagcttctaccattagtggtaatactgcaatattcaaatgtttcatatgttgtggcttcaaaagaacttaccctatagaggcagctacaccccctgctggaaatctttgatcataacaactttggcttctgtagtctcaatcaggaacatatgaaaagccaaataaagggccttaccactcatgacagaattgaccaatactttagcctgtctgatacaagacaggcttttggagaacaacctatgtcagaatatcaccttgattacagacaaaatacacaaagaggatggagaataatgatgtaaatagctaaatagccaaaacacttgtaagatatttgcttaatttccaactgtatttccactctttaccttatc

SEQ ID NO: 197206 - DNA, 380 bp, Homo sapiens
ttgtttctctcccttcttccccctattttctcttcataggacatgagacttcacaacctggtaaaaatgaactttcctaataactcaggacctacccgcctgggaattgatcatcctagccatgagagatcagacaaaacctgagaccagagactcattttcacctaaaacacttgctccaaaagatttttttaagtggggaaatgtggaaggagaatataactttggggccccaaaattactaagtcaaagggaaaagtcaagccgggaacttcttaggtaaaacctgcctcccattgtattcaaagtcacccctctgctcactgagataaatacatttatctgattccctcatttggagaggctaatcagaaactcaa

SEQ ID NO: 197207 - DNA, 429 bp, Homo sapiens
ataattggtaatgcgaaaacaatgcaataacaaaaaaataaaagcttgcttgagctaaattgatggcaataaacaacctgtattattattttgctaggtaatttctttgcccatttttcttccttatgtagaaatatggccggcatgttggctcacgcctgtaatcccagcactttgggaggctgaggcaggtggatcattaggtcaggagattgagaccatccctggccaacatgttgaaaccccatctctactaaaatacaaaaaatttgccaggtgtggtggcacacacctgtagtcccagctactctggaggctgaggcagatgaatcgcctgaacccaggaggcagaggttgcagtgagccaagatcgcaccactgcactccaacctggtgacagagcaagactccgtctcaaaaatataaaat

SEQ ID NO: 197208 - DNA, 212 bp, Homo sapiens
aagagagaacagctgcgagaggccactggggagctggaaagcgtgtgtcgccaaatacccaaaaagtgacaagggagaagtggtttctaatcggcatagtgagaaataggcctcgattaaaaacaataattccagaactaataaagggatataatgtgaacaaggaaaagaacacaaggcttagggtcagaaaagcccagatgtgaatcctg

SEQ ID NO: 197209 - DNA, 535 bp, Homo sapiens
gctttttgagcaggaagtgtaacttgcctaaggccatcaggtcagtctggtggctgtgtaagcagcagtgagtgtgactctgaagacatatcatgtatcagttcactgattgcttttcctgccagatatttaagagcattctgttgatgtgtaaaagccacccagtaaatagttgaataggtatgtgctgttaatgtaccctctctccttcattttcctcactgaaacaaaatgtacggaccaggtgactctgaggcttctttcagttataagatactatgtaagtttttttttttctcctcacagaatttactgtttggaaattggtagtttatgatttgaataagtgaattttcacttccttacatgaagatctatggtcacatttaaagacagtaatatttgattgattagctttggtccagtttctgcctattaatgtattattctacatccaaagccatgctggagaaggactaattcaagatggagcagaggccttgactctacttcttggtggacatgccacccttgt

SEQ ID NO: 197210 - DNA, 183 bp, Homo sapiens
tgtaaggggagcccgagtaccacgtcttacgtagttgatgacatacaagtagaatttcactgaaaatatgaaggaatttcttttttcttcactcaaaactagttattaagaagaaacacaaatgagcagcaacgtctgtctggctttgtggaggggaccacctggcgcaagcagcaccctccc

SEQ ID NO: 197211 - DNA, 563 bp, Homo sapiens
ccagccccagatctattccttattggttgagtatgacctcagtcaaaagattaaccctctgaacctcagtttcctcatctgtgaaacgggaaaaattacatatacctgacaggttaaccataaaaattaaatgaaatcatgagagaaagagctattacttatattgtgtccccactttgtacccaatgctttatacttattaacaaacttaaggacttcatacacaacatctagcctcatgtagtacctgaaatagcaaaggtgcatcaataaatgttagttatttcttttcttaaaacaaaccagtttgagtggataaacaaactgtggtatatccacacactgaaatactactcagcaacagaaaggaataaactactgatacccccagcatggtacattttgaaatcatgctaaatggagaaagccacacgcaaaaggccacatactgtatgatttcaaatatattaaattctagaaaatgcaaacttatacataatgaccaaaagcagatcagtggttacttgaggacatatatagagggagggagtgattaaaaggag

SEQ ID NO: 197212 - DNA, 225 bp, Homo sapiens
attgggcaagattccacgtttggcagcaggcccgtgagcggcgacagacgcgtatgggcctgtggcaacctcggttcctgcctcctgagaagaaagacatcgagtggcacacggtagagtgagagaccgaggcacgcattagagcaggggcgaaagttcctgaaatggtatcgtggcaggagccaaaggaagtcaaggaggcttggaagaggcccaggtgggcgg

SEQ ID NO: 197213 - DNA, 286 bp, Homo sapiens
atttgccatttgtagttacgctcacatgacagattatcttataaatgtgtatgtttctccttccctttcatgctttcaggactacatcccctctattatattctccctaaatgggacttcacattctaaactgtcaaaaatcctatatgaatcttaaaatagttctgatcacaatatgatgctagtcaataaatatccttttcctcttcgcataggtgaaggtgggagctcccgcacgatagaaaacattgcttacaaagaagattatgtcatatataggaagaaa

SEQ ID NO: 197214 - DNA, 499 bp, Homo sapiens
cttctgttttctgatccaaggtgtctgtggttaggcccgggatctccatcttcacctaaacctcacgtgcttcacacagaagtggtctgggaaccacacctgagaaacatcaaactagaatatcatgaaaacaagtatgttcttgaatattagagctgtgattagatttacagtagccctttttgcttcaaactatgttcccataaatatagaatccctttagttttatatgttgtaaacataaattttaccagttaaactagtctacagaaagttggatatacaaaatgagatcacactacactgtgcttaatttttaaaatttacttttttcaattaacacataatgaattatatgtcaataaatatatttgtaacattttaagttggatatacacatatatatgtaattaagtcttgaacacaggcagcttagttgaacacaacttggttcacaagctccaataaagagtttaacttgtgcccattcaaggtgaca

SEQ ID NO: 197215 - DNA, 501 bp, Homo sapiens
cagcaagtcaacttctgtacgtgcctatagtcagtcctagttcctcaggaggctaagatgggaagatcacttgagcccaggagttcaagactgaagtgagctatgatggcaccactaccctcctgcctgggcaaaagagcaagaccctgtatctaaaaaaagaaagaactgtaagaggtactaggaatgttctctatcttgttctttgtgatggttacatgaacatacacatctgtaaaaattcaacaggcttacacttcatatttatgcactttgctgcattaattatacctcaaacagttttaaaaaaagaaaaatggctaagcatggtagctcacacctgtaatgccagtactttgggaggccgaggtgtgaggatcactttagcccgggagttcaagaccagcctaggcaacatggagaaaccctgtcactacaaaaattagctggccatggtggtgtatgccagtagtctcccagctgcttagttgggggggtggg

SEQ ID NO: 197216 - DNA, 358 bp, Homo sapiens
gaggcatattgatttggggagcacagacaagtcaaggttgatgtgcatccgctgaacatgatcttaagttgttgaagtaggtattattaatgaacgaacgtctattttagctccaagagcccctggtcttccagaagagactcccaatgatcttccagaagcagctgggcttcttttggtcctcccccacccaggtgcagtcccgttctccctgcctgggtgagtttgattcctctgccgtggaataggctaggctgctacctcttgagcctcttccaccaggccatccattaggtggcgacagagagcactaaaaggaactactatggaaataaaacttgttttgcttcttgggggg

SEQ ID NO: 197217 - DNA, 391 bp, Homo sapiens
agaatgaaaaagaggactttttcattcattcatgtaggcaggggaaaatcattggtgaaggctgaggacggtgcctacactcacagaaaatcagagatagtactcattttcataagacagactgaaaaattcataattcatgggtcactggatggaatactcataaatgttgttcctcagtagtgagaaattattagtcttacagggagtactgctgtggatctctctaacaaatggtgatggccagacctaaaaggggcaaactatttccacataatttaatcatatcccaaaacaaagcttaataagatttacaggaatacaaaactatctggcacccagctggatataattcataatgtctggctccaaccatagattaccagacatg

SEQ ID NO: 197218 - DNA, 379 bp, Homo sapiens
tgcatttgcggagtttcttataacaactgtattagcctcttttttggaatatttaatagactgaagaaattgtgtcataaaaatttataaaaatttgaaaagcaggtaaataattgggaggaataaaagttttatttgcttgtagtgatctcaaaatcagtgttgttttccaactatacaaaaccgtacagctctgcatgaaagcttaatcattgatgtccttaaagccagtaacatattaccgtgtgtaagtattaaacctaaaaaggcattggttaatgcagtctcttagtgccagattcataagcatggaaaacaacagatacgttttgtttacagctggtttccttaaacaaaataaacattcgaattgttgaca

SEQ ID NO: 197219 - DNA, 313 bp, Homo sapiens
tattaccccaggacatggccatgagaaactcttgtctcttctgtaaaccagaagaaattatgagaatgttcacattcttggttttaaggactccaggaggacgattaaggaccctgaagccagatcttagtgatttgcaacggaaatgttgttaaagacccaacagaatgaatagcaaaggatctagggaaactcaagaggaatcttcatagatttgctagaaacatgaacatcaagtagcacgtggaacctctaataaaatgtatatttatatgtccatgaatgaggtgcacctctgcttaacaggtggcat

SEQ ID NO: 197220 - DNA, 736 bp, Homo sapiens
cacagtcaagtgctctttcactatataaactaaccctttgtaccccaaaggccaaagatattagggagctcaaatgcaaaagacaacagagctccaacctgagaggaacttacttatgactcctggagctccatgagaaagacagaggaaccccttcacccccgcccctccaaaagggactacagcatttttcctatgtttctcagaaggtctcagggttttcagcagtctccttcagtttcctttgtggtcaccagatttgccaaaggacaaaattacacgtttagtttgaagatctcgactagctttattgcaattctaggattgggcaatgtctcattccataaaatagaataagtgtcccaaagagttgagcagaggggattcattttatagacagagggggttgaagaaaccagaagcaaagaacaaaatgtggactcgtcctttgaaagttacctcccttacaaggtgagaacaaggaaacagaacaatagagaaataacagatttgttagcatcaggttacgtcgggttacttttgttgtaaggattaaaacagagggaacttcgttatcctgctcattaaagacggaaactggtctgcttggaacattggctgttactgctctgtcctgattttggggaagatgaaataacaacttattttcagtttggtgatatggaactttggcatgggtgactccattttgatttttagtctggtctgttggggc

SEQ ID NO: 197221 - DNA, 482 bp, Homo sapiens
ctgtttcatggcatgggggaggggaaggagagcagcaggaagaatagctgcggatgctgggcttagtacctgggtgatgagatgatctgtgcagtaaagcacaatggcacacgtttatctatgtaagagacctgcatatcctgcacatggacccctaaacttaaaataaaagttgaaaaaaaagcttatcacatatggaccactgaacttaaaataaaacttgaaaaaacatgagtatgaggtggattccctaggttagacccaaactgaggatcctgaagctcctgctgggggatttggggctgggggcaccctggggagctgctgccaaggccatccaccgtccatacaggccgcctcccttcccggcctgtgatggaaaggagaaggggtatgtgaacagctgtggaagtcagactctcgggaactgaatcaggccccagcccatgccccccagcccagtccagccaacgtgcccgctg

SEQ ID NO: 197222 - DNA, 797 bp, Homo sapiens
caacacgaacaaagaggaaggcatgctttcaagagaaatgactacagccagagcaacgggatttgattatcgagtagatgaggaggaggaaaggggaggccatgacttgcatgtaatcagacctcactgaagaaagtggagagaacagaaagatgaaaacggaatgcaagttatatgcaatcatacactgatgactttctgaccctggcagtgccaagcgcagacaaccagtcttgtatgattttagcaatcaccatgcccttcatgtctcctatgttgtggtaatggaaaatcttacttggataagatgtaatatgagcaagatgtgtatttagtttgagcccggcaggcgtctccagtggagcacaggcataacacaccagggcctaggagcctgagccccttttccagtaatttgttcactacatgtaggtcggtatcattactccgggccctctgcattctgactgcagccatgaggtctgattaccgtcagcaagaagacgctgacacactcaggtttccagagacacttggaggctgctaattgcaccctgagcctcatgactgcatttatgagcgcagaaaagctgcaggcactacttggcttttttaattattttctattaaatttaggcagactgggtacagtggaaaactacaggatgcttgttccacatcactaccaaccatgtcaactgcacagacacaaaaggcaaacaggtgaatacagatcaacaagttggtcagttctttgctaatagagctgagccactgtcacttgtcatggatgctga

SEQ ID NO: 197223 - DNA, 452 bp, Homo sapiens
ttgctagatgcttactatgtgcttacaagcccctgccctcatagaacttactctcaagtggagtagatggccttaaaaatgcaggtaagcatttggtgacgaggaaggacttgagtggcagcagtgaggctgagccaaagaagcatgctctgtaagacaagctcagcgcgccaccgtcctccagcacagcgccgcatgtgtgtgggagagagacagtgtgacttgagagcacgggcgccccctgcagtgctgccaaggtgagggactggccacctcatcctcctccactgacaaggttgtgggatctccaggcctgtgaaccccaaggagaaccccctacttgggagctgcccattctggactcaagcaccaaccacagtcatgggctctgaatgcctgtgggtcttcagggccaaattggagacgctgccgctgccaagttgagacctgaa

SEQ ID NO: 197224 - DNA, 525 bp, Homo sapiens
gtcaatagggcatttgtttgtatttccacattggcttcatgaacgaaaatacctcctccacctagaaaaacaatcagtaacattcagacacggaacttggagggcaaactttttagtgcatgctggggcacttttatgtagtgtttttaaaaaataatgtaaaaagtatttttaataaagttttctcctatgagtatttccctcaagtttccacgtacgcctggtttggtctttcgatacctttcagaaataccgatttttaaaaaatgttctccgttaaaattggagccagaaagaaccttcttcctacagatctgaacgttttactctgtttagggtggaaaaacacacacacactcattttccttcactcactttaacttttctgctctgcacgcactaggttctggtagagttaaaagttttctgaggttagttcctgtggttaaggaaaaaaaaaatacaccaaacaactacatgcttaaatttagactccgtaaaacaatactgggaaactttcaaagc

SEQ ID NO: 197225 - DNA, 524 bp, Homo sapiens
caggcagataatgtttttattctttgcttgaactattctagtgacaagagcgcattcctaagagaatgtttgtctccacattgtatttctttgtttcagggtctgaagattaccagataaatttttgttctgttctcttttttgttctttttttggatatagggaggaaggcgataggcaggggagaggaaatcgacctggtcccagacacaagtgagatgttatcctaaaagtgcatcagtgtcaatgtcacctgtgccctcttcccttcccttcctctccaccctgaagagaatagaatagatgggatgggaatagggatgggagactttgtttgcactcaagaccctccagcctggctcagttgtgctaaaaagaggaaatggtggacaataattctataaatgtcctcagtaagtaattatctcccctttatattccccttggctgtttggcacccttcttaggcttatcaggttgtattacatattgttgctgactaagatgctagaaccagtacccaa

SEQ ID NO: 197226 - DNA, 478 bp, Homo sapiens
attacctcttgtgaatataatacatattttcctatagtataaatgttgattctaggttttattctggacctgattttcatctaattcagtttcttttatgcagagattaactggttttatccttattcccctgtggcaaagactcctaaatggtcaacaaactaattttctcttcttcttagacacattgttagtctacatttgttaattccccctgtagttaaatgtagcaaataggacgtgagaaaaaagaatgtgcatctcctccagccaggtcaatgaaaattactcatgtttgtcctccatattcttttctgatagctagataactatgcctagtgtggctcaggaagccacacataagatggcaaaccttccatatgctgggataccttaacaaccctgtggagcagaactccctaccacgaagactgaccttgaacttccttggactattaacaccaggaaagaagcttcc

SEQ ID NO: 197227 - DNA, 377 bp, Homo sapiens
cacagtacgccacacgtgatttctgctctccagccctccagctccttagaatgtgggacagagaccatcggctcagggggtgggggatgaagagatgaagactgagcggttgtggccgcgttgccgacctcaagcagtagttggcttctccacgtagaacccgggagtaggagactcagaattgaatctcttctccctgcccgctcctgtgagacttttttgatcttcagctacattttcagctttgtgagaaatcttatcatcaaacacaacggccagcaatgttaccaacaagagagatcctcgctccatgaacgcgtgttcgttgggaatctcaacactcttgtggtcaagaaatctgatgtggaggcaatctt

SEQ ID NO: 197228 - DNA, 736 bp, Homo sapiens
aaaaaaattgaggaattgatagatgccttctgaatgactgagaatatggcacagggtaaatattatgcagttaaaattaaatataaaaaatatacgtttattcatacacacagatatgtatgtgtgtgtgtgcacatacgtgttcagccattgtctgtgaagaaacataaagagggtggcctgcccctcctcttgggagttatgtcccaaggagacctgaagcctctgtcagcctgagaacacaagttgtggtagtcagagaccccagttgggaggctccacatagtgatgaggaatgagattggggtcccgcttaaaaaagcagtctggccacattttgtggggtcattgtgctgttctagggtaccgcttccaccacctggtcggcttcgcctctccaaagccccaaggctggagctgctaagtcactcaaacagcaaatatggtggctcgctccttcctctgggagtttcatctcagggagttttcaaatctctgtaggtcacagaacatccacaggagtggctaaaggccctgactgggaagctaaatgatgaaaacacatggacacatagacagtaacaacacacaatgagaccttttggagggttgagggtggagggtggaaagaaggagaggatcaggaaaaataactaatgggtactaggcttaatacctgggtgatgaaataatctgtacagcaaacccccatgacacaagtatacctatgtaacaa

SEQ ID NO: 197229 - DNA, 425 bp, Homo sapiens
tggggctattgacagaattcaagggatttggttgtgatttttcccagcactctttcctgcccttagactttcagagtgctgtccttctgtccctgggtctgaaatgtttatgtcaggtggctttttcctccttctggactccagtgatagagcagtatgtagagtagcaagccaccgtggctactcactgctagttaacgttgatccagaaaaggagtcatactctaggatgcttttgagactctaacacaaagcagccaaagcaccaagaataaacccaagaacagcatggtaaagaattaccatttaccagctgggcacggtggctcacgcctgtaatcccagcactttgggaggccgaggtgggcggatcatgagatcaggaggtggggactatgctggccaacatggcaaaaccccgtctc

SEQ ID NO: 197230 - DNA, 335 bp, Homo sapiens
aattaaaaaaataataactagctgggcatggtggtgcacatctgtggtctcaggtactcaggaggctgaggtggaaagatcacttgagcttaggcagctgaggctgcagtgagctatgatcatgccactgcactccccgctgggagacagagtgagactctatcttggaaaaatttaatttaatttaatttaatttaatttaaaaaatttaatttaaaaattttaattttaaaaatttaattaaattaaaaaatttaatttaaaaattttaattataaaattttaattaaatttaaaaatttaatttaaaaaattaatttaatttaatttaaaaa

SEQ ID NO: 197231 - DNA, 553 bp, Homo sapiens
agtctgttgccaagtctagtctgctttagctgccaagtatctctggagccctacatctcccacccaccactccagcccaacttgatacggacctctgcagccactgaccagccggcctctgactgccctccccctgctcctggctgttctgaccccagtccagccactcttccctttaaacctccttgagccctggcccatgtcaagtccgtgtgtcagccctgtccagcaagatgcccgcccacccatgaaaccccaggtgaggactcgctgagtgtgcaaatgaatcctcaaaaagagcagcccatccccaggccctctgccctttcccacaggctgtccctagatgtgtggccatggccacgtccacctgtggattccatgctggggccacagattttagggtgtcactgtgtctcctgctctccaacatggaggttccccattactgttagtggaagaacacaactccaggcccttcatttttctgtttgtatgccaatcctgataagatctttgcaggcctgcagaaaacaaatccacacactggtgg

SEQ ID NO: 197232 - DNA, 548 bp, Homo sapiens
taggttcttaggatcatggaaacgtaaatttggaaagagctttggtggtggtgggggctggagtgggggtcatctgaagaaatcttctagccattcttctagcaagaatctttccttaggacataacaatcattccatattccatgcctgacttaccacttccaggtatgaaaggtgggctcattacttctgaaagctgcttcatttctccaattaggaggaactatctttctaatattgagctctaaactgtctccctgcggcttctactcatttgtcctcatttctctctatgaaataactcaaaacaagtcaactttttctttcactcagaaccgttcaaggatcctagcatctagtaggaccctttgctccatcctaggcttcttttttctaggaacatgaggcccagcctgtccacttgttcttcccggaatgtacactctcgtttatgtttttttgaccttcactccctttttcatcatgtgcattgcctcctcaacatcttaatcactctaaaagcatggtgtccactgcattccactttg

SEQ ID NO: 197233 - DNA, 420 bp, Homo sapiens
ggagctactaatctaatagtgaaattcaagatgtaattggcccatgttctggcagccagggtcaccaatggattctgttctgcctcctccacacacatagcttgatggattagttgagccagaaccagctctgcagatctgctcatttcatttatcctgtctccttgattttctccatgtagcctgatagaggttaggatcctgtgattttaatgagcaaggaattggtggctctttgaggccagaaatctaaacctcaacctcattctcagcctatggattaccttccatgtgaaagagagtattgtcataaacactgagtatacagtggtgaccaaagcagactcagtttctgttttcagggaacagtctggtagaaaacagtaagcaactaagcaaatcatgtaggaaaaggcaagg

SEQ ID NO: 197234 - DNA, 564 bp, Homo sapiens
cccagttccttctctaaattcctaattctccactatgctttaaaacaaaccttctactccactcacagtatatcctttctgctcaaatactccaagttgaggctcttgctcttaatttacagtgctaccaccatatttgtcacctttctgcaattatactggacaagatctgccccattctctcaagaccttgagagcttgtctggaggttctagcaggtaagcacagctactcatatacccttgaccgaagactggtcctcctctatcgaggatggtcgttctctttgactgagcacacagcattgggagggacgcacatggagtggtgagggaggaaggggacaaccacctagccagccagatcagcgaaatcaaccctggtgatcaatggggtgacagatatcacagccagatcaccctcacattcgccattctctcaagaaacagctgaagtactatctccttcatgaaactttgtctgcaactgtctatatccttttctctatttgccatggaaatataccacaaaccacatatgaaatttagaatttttaaagcctca

SEQ ID NO: 197235 - DNA, 680 bp, Homo sapiens
ggacctgtcagtgattgcagttgttatttaaatgaaatcacttctttagtcatctgtctagcaccttaaaactttattgtggtctgagtaattcagttggagatttgttacaatgtacctgatgcagattttagaaagaaaagaagaactgcatttcgtctggttccagtacctttccagtgggaactgccaatatatcgtcagtctttttctccctactatccatgagggaaatctcttctaacaaactcctcttcatatttcttaccctctccattcccctctcctccaatgcactgtctcagaagtcaatgggatgatctataaggaacacatgctcagctcccagcagtaacgccgtatataactcttgttcccttcaaactggaagcagtctctctcttctgaggtccagtagtccttggagtctccctgcaccagtggttttaaaaatgtgatccctggaccagcagcgtcagcctcccctagggcctcattgggaatgcagattctcaggacccacgacagacctacagaatcagagactctggggtagggctcagcgacctatgtgtcaacaagccctcccgatgatgctggcgcacttgatagtttgagacactgtcatcatcataccactttgtattggttacttatatgtggttgaagaactctcaaaa

SEQ ID NO: 197236 - DNA, 431 bp, Homo sapiens
taatccgtataatgccaacaagtaatttgttgtgagtaaatatataattttgtatcttccattaattttcctgccccgccaatttttcatacaatagtagaattactttcatgatgccgttgtctttttctcagtgagaaagatttgtaattatttacctgctaacaaactcattctttcactcattcattaatttttcaccatttaagaagggcctattatatgccaataactcaataatacaaatatactgagagatttttatgattttcctatttttgttatgcattgcttttttattggcattgtttatccaataatgatatgataattatgataaaatgtattttgtcatctattaagcttgcttttttttgtggtagaattagtgcaagtcactcaatatttccagttatttcatgcccccttaa

SEQ ID NO: 197237 - DNA, 385 bp, Homo sapiens
cagccaaccaggacacataccctcctcccaggaccaacttcaatctgagggtagggcaatgtgcagacagggaaggatgtcaaacatggtaattttaatgatgtaatttatctcaaaagaatgattatggtggtataattaacacttcatatgcagacatttccatctccaaggagctctgagagccttaaggatgattatttaaatatatatcacatccattgctggagacaaggtctattgttttaaaagataattaaaattccttcccctttggaattaagaagatttcctataggatgaatattttgcccaccagacacatgaatagatctaaatctgggaattcctgacacagggctggaaaagatcttgaagagcaatc

SEQ ID NO: 197238 - DNA, 283 bp, Homo sapiens
ctgcccacttcagcctcccaaagtgctgggattacaggcatgagccaccatgcctggcctgaagacatttttttttttttaccttgtttagtggtcaagcgttaaccaccatgttcttcagaagagaattctgctgtaacatgtttttataagttactctgtactattcttcatgcaattgctttctttatatttgttaatattaaatcactgtatattgacttgtgactggtaattttaaattcagcttgtgactataataatacagtaaagatgaagaatg

SEQ ID NO: 197239 - DNA, 492 bp, Homo sapiens
ttctgctatctttctgcctttttggagggttttaggtatagcttaaattcctagctggtcttctgatatctaggtgtaggtggtttggaaactttttaagagtttaattgacagagatatttcccctattatgagggaaattttttacttataaaagttttctaatgcctagaagctgcttggatacaaagaagcaagatacaagaataacttcaattgtagcatagcataagaactttattaacagatatacggtattgtagaatattaaagaagtttattataaaaatctaccagtagacagtactgtttttggagagaaaacatcaccaaaagtagttacagaactcttctgaatacatataaattttcagaacttctacatgtcagttgccataaacaaaattgagactacttggaaggctgagacagatcacttgagcccaggagttcaagtccaacctgggcaacatagtgagatcctgtctcttt

SEQ ID NO: 197240 - DNA, 256 bp, Homo sapiens
gcaggtggttagaaaggagcgacctcggttggttggtttcttcttcttcccttcctttcttaggggaaggctagagagcaaagaaacgacaaaaaaaaacaggccggaagaaggaaagcgaaaagcatgagggctggacaatcagcccttaaataaacgaaaactgtatccaaatcagattaagttgagagacagcgaactgctaaacacctccccataactctaacgtacctgaaaccgcgagtagagaaacccg

SEQ ID NO: 197241 - DNA, 308 bp, Homo sapiens
gagtgggggagaaaggagacaagtatctgatgggtgggaatggaaggtgtgtatcctgcagcagacctccagagtagctgactgactgatatgcatggtagtcctaagatgtgtttaaagaaaatatttagagctcttgacaaatcttgaaatcaatacaaaaattagccaggcgtggtggcgtgtgcctgcagtcccagctactcagggggctgatgcagagaatccctagaacctgagaggcagaggttgcagcgagatcgcaccactgcactccagtctgggcaacagagtgagactctgtctca

SEQ ID NO: 197242 - DNA, 693 bp, Homo sapiens
acttagaggatcccgactagtccaaccatacggaggattaatagctttttgataggcaggatgttgctgtgctcctccttccatctggaaagacatgactggaagattcaaaggtatatggcatattttggtgatttagagtttggaatgtaggctaccaaagctggtgggaaaagagtctgggaaaaattatataacagatataaagctttcgatgacttattaaggaggtgaagcttttttgtcaacattgaggagcttgaacatttagaacttggtactggatgtgtggctgagacatgggggcgctgaaagattgtgatgtggccttctagcttggagaataaagcactaagtggacagcagcgccactgacacaggtgcggaatatagaagatcaggttttggggtggaactctggtgggcagagatggttcaagtttcggacaatattgcgagtgacttgctattttattttgtgataccgagtattctggaagtctaggttagagttggagttgagctttgcttgtgtagaatcctgtactctttcctctggttttttcttgtattgttcttgttgttactggttgttattttcatctgctgctgaactctatacttgaattgtgtttcacgaatacttaagtcatgtggttgtggaaaaagaatgttgatagcatcttcagttat

SEQ ID NO: 197243 - DNA, 147 bp, Homo sapiens
cagtagctatggcagtggcagatgattttaattaggaaacaaagcttagcaggaaagggaaattaaggactaaaataagaaaacactactctcttcattcaagctattacccgagttcttacttaactggacaaatggtgataatat

SEQ ID NO: 197244 - DNA, 379 bp, Homo sapiens
tgcattcaggtggggttatgtgattagtctggccaatagccaagtgtcatgtgatgtttccaggccaaaacatttagttgctggattttgactcccctccttcttttcctgccacagcctctgagcgtggtacttctttcagatgatgtaactccaagatggcacagcctcagagagtctagacctctgaatgggtctagacctctatgcggacagagactcctatcagcccacaatggaactgcggcatgactgagcaagaaactcagtgtcagacagggggatttcagggttaatttgtaactgcagtaaacttgggctgttctaatataaccattacacttatagactaactgaagacagaattgctgtatttata

SEQ ID NO: 197245 - DNA, 267 bp, Homo sapiens
gactacagatgcacatcatggtgtccttatgccatttcttttgtacgtaggtgaatgcaagtgtatgattacatcatatgctattttggaggtttgactttcttttcactttcatcatctttccaaggtgttattttcctagtacatctttttaaatggacatagaacattcttttgtatgaacaaacaatagttttatttaggcggtcctttcctgttggacatttatattattttcagcatttctccacagttgttgcagcattc

SEQ ID NO: 197246 - DNA, 140 bp, Homo sapiens
cactgaccaacatctacaaggtgggctggtggaggaggctggtgggttgatgccatgctggaacgttgatttgttctctcacagccaagtctcagagcagcagtgccgggtgctgatgggaatagctctgcagggttaaa

SEQ ID NO: 197247 - DNA, 763 bp, Homo sapiens
ggggggtgggaagagcagtggctgggagttggacatagggtaaggaacaaggagagaagacagatacttcttcatggagttcagtttgaattgacagtgggatcggatatcatgacaacttttggctgtgtgtttacacaagcctaactaatgtaagctggaagactgagagcagagtttctcaatgtggctcaaagaccactgggggatccccccaccaccataccccaaagtcagttaggtgatctgcaggtgctttcgcagtttcagaggaaaaatcaatgcagtcattttattcttacgtattttattaattaaaaatcgtgtgaatcattattgttgtaggaatcctgttattaatcatctttaagattatatatatgccaaaaagagtgttaatcactttgtcttggctagtatttggtcagctgagtgcagttcacctcagctgatatatttttccattatctgccattcttattcacaaattttcattgattataggtattctacgccaattccaaaaaatagctcaatggctcagtgttgaagggcaaaagcagagatagaatgaatcgagtaaatattagaattcataaaaatattagaactatagtgactaggaccacagtacaggtatagaaatgtatatgttgtggatgagacaaatgattcctttgagtagaatgatttaacacaaacagccaaaaaaggaaaaaataattattactatatgaaattagattttattgaacaaggctgg

SEQ ID NO: 197248 - DNA, 623 bp, Homo sapiens
tcactcagtgaagtaaaacccacacaaatttacctttgggaaaggtgttgggcgataacatcactatgttatccccaacaccataccccaaagtcagttaggtgatctgcaggtgctttcgcagtttcagaggaaaaatcaatgcagtcattttattcttacgtattttattaattaaaaatcgtgtgaatcattattgttgtaggaatcctgttattaatcatctttaagattatatatatgccaaaaagagtgttaatcactttgtcttggctagtatttggtcagctgagtgcagttcacctcagctgatatatttttccattatctgccattcttattcacaaattttcattgattataggtattctacgccaattccaaaaaatagctcaatggctcagtgttgaagggcaaaagcagagatagaatgaatcgagtaaatattagaattcataaaaatattagaactatagtgactaggaccacagtacaggtatagaaatgtatatgttgtggatgagacaaatgattcctttgagtagaatgatttaacacaaacagccaaaaaaggaaaaaataattattactatatgaaattagattttattgaacaaggctgg

SEQ ID NO: 197249 - DNA, 288 bp, Homo sapiens
acgtcgaaaggtttctgagaagcctggagaaagatcaaacctaaaggtgaccctggaagtctggctgggaatagaagataaaaattcctttctttaatttccaaagttcactgattcacgagaaaagtagatatcttaaaaggacacggaaatgcaccaaaaaaaataaacacaacgatgcataactagctgttttaattcaacaccctctctcctgtgcctgacatggtatctctaccatatcctccaaaaagtaaggacaggcaaggactgaagtgtcctccttat

SEQ ID NO: 197250 - DNA, 1459 bp, Homo sapiens
caagaccagcctggccaacatggtgaaaccctgtctctactaaaaatacaaaaaattacccaggcatggtggcgggcgcctgtaatcccagctacttgggaggctgagacaggagaatggcttgaacccaggaggtggagattgcggtgagctgagatcgtgccattgcactccagcctgggcaacaagagcgaaacttcatctcaaaaaaaaaaaacaaagactaattctatagtacccatgaccctgcaaccagagaaactgcctgtagggaggccagagtccaaagcagccacctgtaacctgaaaatgaaacgcagacccaggcatctgtgggtcttcatcagcaggatgaccattctaaggctaaaagacaggcctttaaatctgatgctataattccatccaaatacacagttaggtttctaccatagggaaagctattctccactttttgaagtatctgtttcaaagataacttgctctctggttctcttttatctaaaagagagaatcaacatgctaatttaaaggttaacatcattttaattcaaaaattttagtctccattccatatttaatgatgaagacaaatctgctgggtgctgggagggaataaaaagtaatgcaccccattgatttcagagtatctgatcacttgggttatgcaagctgctacttacccgccattagcatgggtagttaagtgctgattaaacctaagtggactcagtgaaaaagatattgggaaaaataatatgatattgtggcctatgttgaatgatgttagcttgtgtttcagcctgggtgacagcacaaggaactccatctcaaacaaagacaaaaaaaagagggaaagaaagaaagagagaaacactaaaaggtggggatccacaaccttcagccgagggccagaaggggaacactgtggagaatataacacagggcctgtgccgaacacgagagcaaaccacgaccgaacccaagaggagagacgagagcaactacaaaacacacgaggcaagagtagaaccgtggacagaaccatagagaggaatataagacagcaaaaacttacaaaacgcatactaccccacaaggaacgggaaaactacaaaaaggtgataacaagtggaccaagaaaaacacagcacaaaaaaccacacaaggtacgtagcccccgtgaaaactatgaacgggacagcacacacacgaagaagtagtggaggaaaaaacagggtttggccaaaaagagggctatgtaagttacagcagaggagacgaaaagaaaaggctagacacgaagatagttagtgtaaaacaacccacaaggggatgattggaacgcacacaaggacgtggagggaagagaacgacataggggcaccagcaagtgggcagagaggacgcatcaaccggacgaactgaaaccggagagaacataaacggggaagtaaat

SEQ ID NO: 197251 - DNA, 1129 bp, Homo sapiens
caagaccagcctggccaacatggtgaaaccctgtctctactaaaaatacaaaaaattacccaggcatggtggcgggcgcctgtaatcccagctacttgggaggctgagacaggagaatggcttgaacccaggaggtggagattgcggtgagctgagatcgtgccattgcactccagcctgggcaacaagagcgaaacttcatctcaaaaaaaaaaaacaaagactaattctatagtacccatgaccctgcaaccagagaaactgcctgtagggaggccagagtccaaagcagccacctgtaacctgaaaatgaaacgcagacccaggcatctgtgggtcttcatcagcaggatgaccattctaaggctaaaagacaggcctttaaatctgatgctataattccatccaaatacacagttaggtttctaccatagggaaagctattctccactttttgaagtatctgtttcaaagataacttgctctctggttctcttttatctaaaagagagaatcaacatgctaatttaaaggttaacatcattttaattcaaaaattttagtctccattccatatttaatgatgaagacaaatctgctgggtgctgggagggaataaaaagtaatgcaccccattgatttcagagtatctgatcacttgggttatgcaagctgctacttacccgccattagcatgggtagttaagtgctgattaaacctaagtggactcagtgaaaaagatattgggaaaaataatatgatattgtggcctatgttgaatgatgttagcttgtgtttcagtaacagagttgggtaatactggacgtgtagatgaagctttagcagggctgggcacggtggctcatgcctgtaatcccagcactttgggaggctgaggcgggtggattacctgaggtcaggagttcaagaccagcctggccaacatggggaaaccctgtctctactaagaatacaaaaattagctgggtgtggtggcgtgtgcctgtaatcccagctactcaggaggctgagacaggagaatcgcttgaacccgggaggcgaaggttgcagtgagccaagatcgcgccactgcacttcagcctgggtgacagcacaagactccatctc

SEQ ID NO: 197252 - DNA, 492 bp, Homo sapiens
tgctaaacccttacctgataactctcattagagcaatatatgctggaagcagagggctcttgttatggactaagtgtttatgtcccccacaaagtgttgaaatcctaaccccagtgtaatggtattaggaggtagggcctttggaaagtaattagggcatgagggctctgccctcatggatgggattcatgctgttataaaagggaccccagagagttctcctgcccttttctcaccatgtgaggatagacagggaagtcagctgtctgcaatctggaagaaggccctcaccaaactcggctgtgttggtaccctgatcttagatttccagattccagaactgtgaggaataaatgtttgtcatttaaggcacccagcctgtgtaatctgtaatagcagttcagactaagacagccccatattactcactctccatctgagagtgagccgagcacatagcattcttggcatcagtagcacaagggtatgaag

SEQ ID NO: 197253 - DNA, 502 bp, Homo sapiens
gaaacccataatgcaaatacatgttcctccaaaggtctcaatgttcttatctcaaaatacacattttattgcttttgaaatacatgattatcatatccctttggcatgaatttgtatgaatccttagatttaagtatgtaaaatataataaaaacaaaagtgtgtgaataccccctactgcagagttatgcaagcctaatattcaaagcatgacatattaaatattataccttaaagacagaattagaacatgaacacatgtataatgtctttgcctcaacttcaaaaatgcacagttgttgagagcctggaagagacattcaggaacgggctgcaacaagccttgctctggtgtggtcctgcttatccaattgttgctcaataatgtcccttcccggaggcatagaaggcaggcacccatacattcacacccacaaaaatgtcacctcattccccagagattgccagtctgggcattgaccttcacttaagcagggcatca

SEQ ID NO: 197254 - DNA, 262 bp, Homo sapiens
atttggtgtctggtgagggctgctttctgcttccaagatggtgccttattgttgcatcctctggagaaggaggtaaagccgtgtcctcacatggtagaaggagaatagaaaagaaaaaggctcatttttcagagataatgcagtctaggtgtcctcatatggcaaaaggcatgggagcagggaggcagctctatgatgcattttttaaaagggcatttatcttatccatgaaggcagaattctcatagcctaatgacctgcg

SEQ ID NO: 197255 - DNA, 742 bp, Homo sapiens
ctcagacggccaaggaggcgtccggatttccccaggagaaggtgcctctcctcttggtaatcagtgggtcatgtgtggtgatgctcaggacggggcgaaggtcccgtggctgaggtgtccactgaccgtttctgcctaaatgggtggttcggtggtggttgccacagggctgtgttttcaaggggagcagcaggtgcctggcgtctgcatccacacctgcctggagcctccttccatttgttactctgtctcctcctgtgtccctgcagctgtgtctccagtgatcttgcctgtactctccgcctctgcagagtgaggttttcactgattgcaaagtaaacatgcacgccccttcagggtcctggtccttagggagctggttaacaagttgaccagaaaaacaacccgaatactcctcaactcttgatgggagctcagttcacacggctccgaatcggcgaaacgcaaccaacgctgggcagaaccttggcacaactttgctggtgtctgctgagaagccgaggggaggttctggggcttggcttgagctgcggggtgagtgtgggagagacggcgagctccctcccatcaatcaatcaacagactgtcctattttcatagtagtccccacccaaatgtcattcgagtccaatctcaggatcctggatgcacgcctgttctccaggtctgcttcccgtgaaattcgtggagattattgtacattcgggagtgggagtgcgat

SEQ ID NO: 197256 - DNA, 424 bp, Homo sapiens
cgctcggtccgttttgggctgtcgtgcgcgtgaggccatcactcctataatcaatcctataagcgcggtcgtttggggacatggtcctctagtcaaatggtcctctatgaaagcctgggagagaatacagggagaatcggcgaaacgcaaccaacgctgggcagaaccttggcacaactttgctggtgtctgctgagaagccgaggggaggttctggggcttggcttgagctgcggggtgagtgtgggagagacggcgagctccctcccatcaatcaatcaacagactgtcctattttcatagtagtccccacccaaatgtcattcgagtccaatctcaggatcctggatgcacgcctgttctccaggtctgcttcccgtgaaattcgtggagattattgtacattcgggagtgggagtgcgat

SEQ ID NO: 197257 - DNA, 562 bp, Homo sapiens
ccagtgaacaagagtgaaaaagcaggtcaaagtttttaactaaaaccagcacattcatggcaggaccaaattctccagaaaactctagcatgccactcactcacaaacattacatgcaaaaagccccaactgtgtagcaatgggttatcttcaatgcattatattttctaaagtctgttgtttggcatcatgatacagtattaatgaaaccctaaaaataactataagcagcacagaaagaatggattaagtatcatgcaagtcatacagccagagaaacaaactccagaggaaaaaacagaaatagccaagttaaaaaaaatgttaatattctgaaccttttgctttcagaggcattagacatgtatgtgagagagtccagacaaaatcagcaaagccacctggtcaacttgaagctaaccacagagccacagtgagtcctaccaatcgcagctgtgaatgacacaacagcccagctggtctgtgaacacaatgtctcccggtgtgtgctcttagggtctaactggcctacaatacagcatcttgtgagaagaggtaactg

SEQ ID NO: 197258 - DNA, 781 bp, Homo sapiens
taagatggttaaggtctgagcctcagcgcctcattagaagcttttgaggtcggttgcaatttgatcatccgctttagcagatgaagaaactgtggcccagaataattaataataaacccgcaggcagtgagtagaggagtggggtcggggtccgccgcagctctctggaccacctcagtccaggcctcctgggggaggctccaggctacaggagagcagggcacctgcctctatccccagatctcatggctctctgtgcttcttaacccaactacaaatcagagctcctgggaagactgtgaagaaatatcactgcctagggttcccccaagactgtggagtcccctgactgtggtgtaagtggtaggggtggagtttgtgtgatgtcggtatgtttttaaccagctcctgcaggggatttgaggagcagtgttggctgagaactgctcaggctgcccccaggtgggatcccctagggcttcattacccacagttccagatgtggtccagtggtcattttctgatctaagtcaggcaatgttggggcattttcggtcaggaagaaactggggaggtgtgaaaggacgggggtcgattagagaggtttccgaaaggacagtggtaactgagatggctatctgtgggtgacccgcctcccactgccccagccttcccatgggagccccccaagggaggggagaccaggctgggtcctcttgctgtcagcaccctgtttaaggatctggtgcaggttttgaagctgagcaggttgttaaacttc

SEQ ID NO: 197259 - DNA, 931 bp, Homo sapiens
ttatttggctgacattcaatatcattgcattgcaggaatagggaggccacaggagagggagagagagacaggggagctatcagtggtggagcagtcagaacacacacatttatgaagttcagccttcatatacggacgtgcttcatggtgccccaaaaagaggacaatagcaacatcgaagatcactgatcacagatcaccatcacagacatgataattacaaaaaagtttgaaacattgtgagaattaccaaagtaacacggagacacaaagtgagtgcatgcagctgggaaaacagcactgatagacttgctcagtgcagggtcgctgcataccttcagcgtgtaaaaaatgcagtatctgcaaagcgcataaaacaaggtatgcctgcgtgtgatgggttgtgggaattggtacgaactgtttgcagtttcatgacaacacgtgggcccttgttattctcaacagtctttcaccctcttctttagattccccttcaggtgttaaactatgtgttttttgtttgtttgtttgtttagagatggagtctcactctatcacccaggctggagtgcagtggcgcaatctcagcacactgcaacctccgattcctgggttcaagccattttcctgcctcagcctcccaagtagctgggattataggcatgcgccattacgcacaactaatttttgtattttgggtagagacggggtttccccatgttggccagcctagtctggaactcctgacctcaagtgatctgcctgcctcagcctccagccctagctgggaccacagataagagctaccatgcccagctgatttttaaccatttttagtagatgtgaggtctaactatgctgtccaggctgatcgtgaaatcctgggctcaagcatcctcctgcctaggcctcccgaagtgcttggcca

SEQ ID NO: 197260 - DNA, 393 bp, Homo sapiens
ctcttgtactcacctcttcatatcttcctcagcttatatctaacccatgcagcaaagtaccatcaattttatctccaaaatatatatgcgatctgactactttttctagtgtcaccttagctcccctaacctgcagcagtagccttccttttactgcatccagtcctttctcaacgcactagtaatgagttttttcaaagcaaatcactatgctgcctaaaaccaacacttagtagcttttgcatttaaaatctaaatctctttccatggcccgtatggcccagcacctgcttttcattctaagctgaattagtgtgagtttcctgtcatttgctgttcagttcttgaaactctttcacaacccagcgcctttacatgagctatcattaacac

SEQ ID NO: 197261 - DNA, 382 bp, Homo sapiens
cttctcctaagagacttaatatactgatgcccaggctccaccctcaactcattaaattggtttaaggaggagcccagacatgagtttttttttaaagctcaagttactttaatgtgcagccagggttgagaaccactgccccaacatcttttactgaggcaacaaattttcaaaggtgtgtccttcaacacgaaaggaagatagcccatccagcaagaggggggcatgttgccagcaaaagtgaaggggctcttagccaagagggcgaagctgcaggctgcgcctctcaggcaacccctggtgatactcccaaatcacatcccaatttctagaggagacagtcctccagatatccacacagccttaactaaattactgctta

SEQ ID NO: 197262 - DNA, 225 bp, Homo sapiens
gcctggacgacagagcgaaactccatctcaaaaaaaaaaagaaaaaaaaaaaagtactatcaagatgaaacatctgtcattcttattttgctatcagttttaagaatagtatttttcttacataataaaagtcatcctcatcaggtactcctttaaatgtcttactgtatattgttttcattgcagtataatatgaaaatttgtttccaacagatacattgtagc

SEQ ID NO: 197263 - DNA, 451 bp, Homo sapiens
cccgagaggcggagcttacagtgagccgagatcacacaactgcactccagcctgggcgacagagtgctgtgtctcaaaaaaataaataaataaataaaaaatttcccccataaacaaattttcagaattacctttaaagttctaaactttgcacataagaaatatagttttaacatgttctaagatgaatattgttttaacatgaacaaaaacatgaacattattttaacttctaacactgttttaacacgaataaaataggtaactctggcagttgttgcttttacaaaatacaggatcaaaacctttgaaaatgaatccaagctttaacttattttatccatagattaaatcataccaaaggaattaaaccatgtttttcttattaacagacttaaaatgaatttcaaacacaccactttacctgagataggctggttgttttcatctc

SEQ ID NO: 197264 - DNA, 329 bp, Homo sapiens
ggcttggcacctctggggcttcagcagtgcagctcttgggccctgtgctgccgactcagcacctccagggtgggcccggggctcagaccaccagcgcagtgagacatgatgaccagggcaccactcgaaaagagagcaggcgagattgcttccctgatgaaaagagagcaggcgagattgcttccctgatgaaaagagagcaggcgagattgcttccctggtgaaaagagagcaggtgagattgcttctctggtgagggagcaggttggttaatagatagcgggcgagattgcttctctggtgaggtagcaggttggttaatagagagc

SEQ ID NO: 197265 - DNA, 347 bp, Homo sapiens
gaaatgcaacaatggtctggttaactcaataatctctatgtcaaggttccttataaacatgcaatctgaactgtcttggagtgtctttctaccccaattcccttacctacagtagattgttgtaactggaaaagaaatttaagtacccagagcaactggagagactgagtaacttcagaaccaaggcagttattattaagcctggggtaattctgtgtgcaaggttaaaaaaaaaaatggtctgggggccgaaaactaagacataaattcctaaattcactggctatatcatctagaaatgtcttttctcagtaaggactggttgtgtacacatacttgtaatgagc

SEQ ID NO: 197266 - DNA, 755 bp, Homo sapiens
agtcctcaccacaccccttcgggccagcctgctttaaacggggcctttctgtaagatgtgacacataatccattgcaccaactgctgtggggcttctggtgccaaaagaccattgagaaaaaggctgcttaaaaaagtatggagtgactcagtactgccaagtcctgtgggattacttattccaagcctgtccttcctgtgtcaggcttcttaaatgttcatgctcctcccatgttttgttgacaccctagatctaggctgcccaatgaaactgtctgctgtgatggaaatgttctatatctatactatccaacagggcagccatgagccatgtgtggctactgagcattcgaaatgtggctagtgtgactgaggaaatgaagtttcagtttacttcattttaattcacataaacataagtaacttcctggtgctcatggctccctactggacagcacaggccagagacataattttgaggggaggccagaggatagcatgcatacttggcttatgttacaatcacctgaggacctcttgcaagtcctggtgcccattctgtatcccagacaattcaatcagattctctggaagtgggacccagacatctgcattttttctctaattgtttctaattttttctttttttttttttcctgctgtagagatgaggtcttgctatgttgcccaagctggtcttgaacttctggactcaagtgatcctccctcctcagcctcccaaagcaatggaattt

SEQ ID NO: 197267 - DNA, 453 bp, Homo sapiens
agcctttgctgtggttcctacccccttgagttttgtcttcatcagcgtttgtcacctggattttgtcatctgaggttgctggagaggcccctgtgctggctcaccgtgtaatttatcatcctacctggagcacttgacttctactttttagactttttatctggaaatgatctcaaacttagacaaagtcacaaaagcaaaaagagtgcaaggaatagccatatacccattgctcagatttacctattattctatcccatttgctgtatcatttgtgttgtaagaacaggagtattctcttacataacctcaacacagtcatcaacctcatacatctccattagtattaataagaagtatttttacatgatatgccatctgtattccaatgttgtcagatgttctaataatatcctgtaattaatgaattaaaagatgaggtctagctctgtt

SEQ ID NO: 197268 - DNA, 232 bp, Homo sapiens
cctcatctctactaaaatacaaaaaaaattagctgggcatggtggcgcgcacctgtggtcccacctactcctgaggctgaaacgggaattgcttgaacgctggaggcagaggatgcagtgagccgagatcgtgccactggactccagcctggcgaaagagcgggactcggtcaaataaataaataaatgcagaacgataaactgttaaacacaagaatcataggctgggcgc

SEQ ID NO: 197269 - DNA, 290 bp, Homo sapiens
ccgacccggacttctggtgtgtggcacatgtctgtagtccctacgcgcttggtggctcgacggctagaggatcgcttgaatcttctggaattgtgacgctgccgtgatggcatgatttcaccactgcactccagcctggtaacagagcaagactctgtctcaaaacaaacaaacgaatgaacaaaacacttcatcatatcttgtgagacatattcactgtcatgcaaacagcaggggaaagacccacccccgtgatcccatgattcagttatctcactgattctctctta

SEQ ID NO: 197270 - DNA, 652 bp, Homo sapiens
cacgtggatttcgctactatggaggctgaggtgggaggatcactggcacatagtgaggcggcggttgcagtgagctgagatcatgccacatgcactccagcctcggtgacagagagagaccccgtcttaaaaaaaataaaatgggcccaggcgtggtggctcatgcctgtaatcccagcactttgggaggccaaggcagacggatcgcctgaagttaggagttcaagaccagcctgggcaacatgttgagaccctgtctctacaaaaaatacacaaatgagccaggggtggtggcatgtgctggtgatccaagctactagggaggctgaggcagtatatgattgcttgagcctgggaagttgaggcttcagtgaaccatgttggcgccactgcactccagcctgggcaacagagtgaaacgctgtttcaaaaaaaggacaaaagaaagaaaaaagaaagttctcttcaacagaaggctgtacttgcatatagtatatagtcatctggagcttgggaatttttttgactaggttgcatcaattgcaaataatgctgtgacattcaaactttaattgcaatagtaattatgctgaaataccttccttaaactcagtttcttcttctattaagaagagccagtgatagaaatggt

SEQ ID NO: 197271 - DNA, 673 bp, Homo sapiens
taatttaatatattttatttaacccaactatctgaaatattatttcaagaaataagataaacaatattgacatattttacattttttggtgctaagtgttcaaaattcagtgtgtactttttcttagagcacttctcaattcaaaccagccacagttcaataacacaatagtcgtatgtggtcttaatgaacagtacagctctagactctcattttccaatgaccactggacacttctgcctcaacattccacaagaacaactgaaaattttctaagccaaattaatcctgtctgctcagatctgttcctcttcccgtctttattacatttctattttattttctcctctctctcattttccattgagaaaagggtcagaacaagtgctcttggaagtctcctttctgttcctatcatcacactagttctcaccatgataatttctaccttgacaattgcaataacctcctaactggtctctccatttgtaatctcctctccatgttatgctttgcttcaggagaaatccctcttgatctcaggtttcatgatgtcactttaagtcttgctggaaggacattggtgcagattttagttcccaaagtggatccaccaatatatctatcccacattttctcctcatgcaacatacagttgatacttgtctacgtg

SEQ ID NO: 197272 - DNA, 661 bp, Homo sapiens
agctatttcccgcgactatcacaaccaccatttaatcaaatatgatggacaatgttgacacatgagcagagaactgccgctaagtgttcaaaattcagtgtgtactttttcttagagcacttctcaattcaaaccagccacagttcaataacacaatagtcgtatgtggtcttaatgaacagtacagctctagactctcattttccaatgaccactggacacttctgcctcaacattccacaagaacaactgaaaattttctaagccaaattaatcctgtctgctcagatctgttcctcttcccgtctttattacatttctattttattttctcctctctctcattttccattgagaaaagggtcagaacaagtgctcttggaagtctcctttctgttcctatcatcacactagttctcaccatgataatttctaccttgacaattgcaataacctcctaactggtctctccatttgtaatctcctctccatgttatgctttgcttcaggagaaatccctcttgatctcaggtttcatgatgtcactttaagtcttgctggaaggacattggtgcagattttagttcccaaagtggatccaccaatatatctatcccacattttctcctcatgcaacatacagttgatacttgtctacgtg

SEQ ID NO: 197273 - DNA, 529 bp, Homo sapiens
ctaagaattcctgcccagcaagttggtttgcagatcagaggcagtgtgtgagaagtacttaacccagcacctggcatatagtagatgttcaggacatcgtagcaggaataagggagacatctcacaaaacattttgtgagaaaggatcagtttctatctagtcaatgtcttaaacattcataggttgttcatggtgggagctgctcgaggaatcatcctagttttatggaggaggaatctgaagctggaggaattgtctccttcaagattacttagttaaaggcaaacaggttcatagccagtggctcttcaccaacccacaaaaaggcctcagattataattttgaagattaagtatatgaaagtgctatttgagtgattaagtgtaagcatcagatcattttgaactggtgagatggctcacgcctggaattccagcactttgggaggcccaagagggaggattgtttgggcccgggagttcgagaccaacctgggcaacattttgagagcctgtccctacaaaaaa

SEQ ID NO: 197274 - DNA, 227 bp, Homo sapiens
ctaagaattcctgcccagcaagttggtttgcagatcagaggcagtgtgtgagaagtacttaacccagcacctggcatatagtagatgttcaggacatcgtagcaggaataagggagacatctcacaaaacattttgtgagaaaggatcagtttctatctagtcaatgtcttaaacattcataggttgttcatggatagtcagattcaacagggtcaaggtgctgatg

SEQ ID NO: 197275 - DNA, 576 bp, Homo sapiens
cctctgcatacattttatcggttgaccctaacacctctccaaaccagacatcatctccttttcacagatgcaggaataggttcagaagaaacagattaaaagtggccaaatagggatgttaacacaagcctggctgactccaaaacccacgcacgttctccactccatcaagcttcctgggcttacctcaacaaggaagcatcttctgaacaaaccagggattctctatcttaacttgaagtggacacattataaagcttcaattctatcacaccaaaaaaacaccttaaactccaccaagacccagcaagaagagcctcatggcaggctaggactgagttcttcccagaagacaggtctaaaacacaagcttttccaccttaacaatggatgtctcctgaccccttcctccagaaatcaaatggccaatctgatgcccacttcagcttctgtcatccctctgtagtcagacaaggagggctcgctcagcttgcatttccttcctgaagagtattcactacctctcttgttcaaacactatgtatcactcaatattctattccttctgctctcaaa

SEQ ID NO: 197276 - DNA, 440 bp, Homo sapiens
ctagagtgttaatctggaggcctgacagatgactgggcagcttagctgccagtttagtagcatcaggcctacctctctaacctctctcatgtgaaatgtcccttaagcccatcttgtttatccacgactagcatatgactctgggtcttaacactgctgtgaagctgcctatttatctgtcttccgggtttgaatgcagtccaggaagttgcatctagaggatttactgtgacctttgtacatagaaaagcataattcctttctccgtatttgaaaatctgctaagaggtagttcttaccttctctgactctggtattggtctgcttcctcacctgccaggtaaaggcctgtcccttctgtcccaggccttttaagctgtgtgtaattgtgggcttgactactcaggatcagccagggagctagacttttgggggaaaat

SEQ ID NO: 197277 - DNA, 399 bp, Homo sapiens
tttttcaggaaacaaatactgagccattttcttgccaacagacatgcaacgtaaggcataataagggaaattctacagagcaaaaaatatggtgacaggagtaaatcgagatatacacaaagaaatgtagactagtagaaacagtaaaagtcaaggtaaaggaaaaagttttaaaattttttaatcatttaaaaacataacgttgacataagcaaaaataataactattattgtggattttacaacatatataggaaaaaatcatagttcagattctgagaaagacaaaacaaaattatactattgtaacttccttacaatatataagccacagtgcaatataatttgcagtagacatagtaaattttatatgaaccaaacacaataaatcctataact

SEQ ID NO: 197278 - DNA, 519 bp, Homo sapiens
atttggtatcagttttctgtcttaacactcttcggcatttcttgtgcagctctgctggcaaggacttctctcactttttttcccttcttacaaattttaatctctaaatgtctgtattcagtcttgagtttgaaggttttttcactgaatgtagaattctagattgatactttttgtcttttagcactttaatggtgttccattgtcttctggcttccattgtttgtgatgagaattgcttgaacccgggaggcagatgttatagtgagctgagatcatgccacagcactccagcctgggatacagagtgagactcttgtctccaaaaatgaaaaaaaaaattatatctatgtatatctctatatatctctatatatctatatatgtatatatctctatatacatctctatatatgtatataattatatatatctatttatatatgtaattatatatatatatctttagtagtgacttttactagtgaaaattttaatatcctaattaccgttatttag

SEQ ID NO: 197279 - DNA, 465 bp, Homo sapiens
tagggagagcctcaggcaggtcaaacaatttgttcaaggtcttacagcttgtaggtcatgaagcagaagtaccaacctaagctgcctgattcctcgggcctgtcctcttaaccactaccggactgtcccacctttataagtcctgattgcatcaccaaaaaggacgtccagccttagacaatgccagaaaaacaatgtcctgttggctccttaggctttcgggcaaaagacacctattcccaggagagccaggcaaaggcaataattgtgcactgcctctgaaaacatcctgatgccctgtcagctgatagtgtagggacaaccatggttgagaattctgttcactctagtgttgcgaaattcaacttttaacaagtagagtgaggtttttggtttttttctgagcatatttattaagattttttggttgcaggtaacagaaactaaggtaaaccaacctaacca

SEQ ID NO: 197280 - DNA, 395 bp, Homo sapiens
tgacatctaattttcactttttggcaatatttggtctcatcaagctttacacataaatattttcagcaaagtgctccaaatgcctttttcagaaatctgaatccacatgaaaacaatggcaacaagaaaaaggtgtaaactttccagaacaggcccagaatttgaaaatgtgataaagaggttattgtgcgcccgaacttttcacacaagaattggaggagatttaacacatggaataataaacagaggaaggcgggctaatgcagagcagatgggcctgcagggcagtgctcagcatttcaacatctttcccctggacctttggacccaaggtgattgcatgctggtgtctttagctaaaaataaagttaatgtctttggggcaatcataaata

SEQ ID NO: 197281 - DNA, 535 bp, Homo sapiens
tattagcaggatcatagaattttaaggctgaactgggttttctggtttcatctcccttcagatgcacagacttccccatgacatccatgccactgagtgctgggcctccctcactgtctcaccccctcaccctcaggcttttcatacctggcagtgctgaccgtggccatccagacctgtttagagatgcagctttctccagcatccacccgctgctcctggtttggctgctggaggccatcaagaacaaatctaatcccttctgacagtcgtattgagagacaagacacctacccattccccagtcattctcttcagcccatgctcaacgccttcagattcttcagagtctctgaaaatgtgataatgaggctactggtcattgccggtcacgcctgtcctagtgcttgccattaccaaagttgctttttgcttgctttctcttttttctctcccccttcatctctttttctgatggacacgcctgctagctcgcctgcctgcagtctatctctctgccctcctgcatggtcct

SEQ ID NO: 197282 - DNA, 437 bp, Homo sapiens
gaggcggaagacaataagtgtcagaagattagcagcaggatctcctcccataagattgatttgatacccacccccatcacaatcacatggtccatggaaatcagaaacccatgcaacagtttgaatagtttaaattcccttgttactgtgatcactgggcttcttactctgtcttgttctataccatgctatgttgatcctggggtgaaactcaaccacctacaaacccctcactcaaagctttaaggagttacaaagagggaggaagcatcacttaccacattgcatggcaccttaaaaccatgtattagccctgggctaatacacctgtgtggtggctcatgcctgtaatcccaacactgagagggagtgtaggaggatagcttgagtccagcggttcgggaccagcctgagcaacatagggagaccccatctct

SEQ ID NO: 197283 - DNA, 154 bp, Homo sapiens
ggactcgggaagaaccccagctgccagcttagccgcccctccccagccagaagattctctcccagagcacttctttcaaatctggaagttctgaaattggctgaagccaaatgctgactttactccttcaatctcagatagcctactccatgaa

SEQ ID NO: 197284 - DNA, 204 bp, Homo sapiens
aacacctctcccaaggagatggaatgcaagacagaggcaccctaagagtgttgttccatgtacagtgaggctgtagggctgagccaggctgcttgctggcttcccaaactgagagcaaacaatgttaggggagcttttagccatctattattcccaaatgtaggccttgtttcaaactctatctgttctctttgattgaaggag

SEQ ID NO: 197285 - DNA, 314 bp, Homo sapiens
atcagactaatgagttttggggactaaccaggtttttggaatgcttctgtcccaggtcctgttcacctccattttccattaccttctctctattttcatgaaaaccagttttcagaatagtttataggacaatcgcagcatgccagttttaaatcactttaatcaatgccattctttatcaaccatttcatgagagcggaggtgaacgattttaggaggttttttgccttatcctttcaaattcacgcccccaaggtacagctctgtgattgatatttgagaacactgtttccgtgataaaatctcagtgctca

SEQ ID NO: 197286 - DNA, 393 bp, Homo sapiens
acttgttaaaaggtaaaaaggttcattatctgttccctctattttgtatatggttaaagtttcccataatgtccttgctcactcgttcaaatcacaacaggaaacttgatgtacctccaataagcaagttatattaaccagaaaataaaaaaatatacttacaatggataggactatcctgaggaaaggaccaggtagtcatgctttaactatgtgaataagaatttatttattagaaaaataactggctgtcactgaaatcttttgataactgaatcaaggtgatatctaaaatgcttttactcatgaaaattgctgggagatggctgaagcaaaggaaaccaagtgccttttataacatatcaaacaacaacaaaaaaggggactttatct

SEQ ID NO: 197287 - DNA, 495 bp, Homo sapiens
gacagcatgttactgtactgtaggcaattataatccaatggtaagtatttgtgtatctaaacagctaaacacaaaaaacttacgtaaaaatatggtattataatcttatgggaccattgttgtacatgtggtctttcattcactgaaatcttattatgggtacatgactatgtatgaaaaaatacttttctttttccttttttttagatggagtttcgctcttgttgcccaggctggaatgcaatggtgcaatctcagctcaccacaacctccgcctcccgggttcaagcaattctcctgcctcagcctctagagtagctgggattacaggaatgtgccaccacccctggctaattttgtatttttagtagagagggggtttctccatgttggtcaggctggtttcgaactcccgacctcagatgatccacccgcctcggcctcccaaagtgctgggattacaggcatgagccactgcgcctggtcttttttttt

SEQ ID NO: 197288 - DNA, 468 bp, Homo sapiens
ttattaatttttcaaagtcatggtccctgtcctcaatggagctcatggctccctggggaagacagacatgtcaacaagcagatgcagaccaggctgtgagcaactccactgcaggaggccaggaaagtaaactggaaggctgaggcttcccaagccaaaaaggagggtgaggtcattgccggtggagagaacagcaagcacagtgtgaaaggcagtgttgagtgcagccagcttgaagaagttcagaaccactgggacttgggtacagacagtgtggcagctgtggaggaagaggcagaagacaggatgggaataggcccagggtggcttccaggtggggaccgagaggacagggccaaggcaggacctgggccacagagaggtggaaacacatgccatgcaagtgggaaagccaggagggttaaatgagaccgcctaagaaggtaaatcctgaaagaagaagagggc

SEQ ID NO: 197289 - DNA, 435 bp, Homo sapiens
aattaggattcctgtacaaagcaatgtttttctgttgtgatatctgagataaaaagaacttcaggctgaaacttctttaaagtggtctaagttaagcttactttctttccatagtgtataaactccttataggatacatttattatctactgtgtcttacacactctcccagacgctagggatatacagttacctgtccacaagggtgtgaaacccagtgagggattttaaatattttcagaagtttagtttaatgaaataagttatttattttgaattttaagtcataggtttaaatgaaatttttaattcagcaaaaaattaataaggttttaattcaccaggcatatgctaagctgcatatatatggaatgtggcccatcttaaaggaattctgggacctgtggtagagacagaaaagtaaacaaatagtgc

SEQ ID NO: 197290 - DNA, 579 bp, Homo sapiens
agggcttcttggcagttgcagccctttatggaatgaatggcaccctcccttctcctgcatccatgcagttttcatgttaaactaggttggaaatactggtggggaagagcttgctgtcaggaagacattggaacaggctaatcttgccaagctcaacctctcattaatcacctgtaggagagggttccttttacatgtctttattggaaatggcatatggaacattttttgcttggctgtgttcactcaaattatgattattgcaccctcgccctcacatcccaccatctccatgcctgttgagagaagaagtcaacagggttcttgccattcctgagatatggcaatttagcttgggaacagatgctgtttgccccctaagtcaaggtgacttcgtgggcaaactgtttcttggccaggggatgtgtccatgctggtctttgtcaccatttctcagattggggttggcccagtgcccttactcacaaatagcagacctggctggtagaagctgcacccctggaagcaccacatgaatttgcatggcactaacaccaccactcaagggacccagaccag

SEQ ID NO: 197291 - DNA, 268 bp, Homo sapiens
actggtgtgctggtttcaggggtgtatttgaaattctgttcatttgttaagagggagaattctgttaggactgattaacttactcgcagatactgttcctttatcatctatgtctgttgattaattcattatgtaatcctatcctttaatcacaccacacagaaaatttacctaaagaatacaggaaaaaaatgtactgaatttctctctctgttaagacagggaaataatgtggtgtgaaattccaagataggctttgcaagtgaga

SEQ ID NO: 197292 - DNA, 215 bp, Homo sapiens
agacagcaacaccctcagcctgcctcggaagagacaaaagtaaatacccgtctcaaagagaatgcactgaaatatgatatcagctgcaagagagggccatctcctccggtcaaatgagaaaaatcatattatcctcgctgtggtatacaaatagcttgtaagccacattctccatttgaatgataacaataaagtgctaacctcgctgctgcagg

SEQ ID NO: 197293 - DNA, 563 bp, Homo sapiens
cacaggagtgcagtgactaccatattggacagcacaaattctaattgtcatgacatggaacaatgcttgcttccccagcattttgaaagccccagaatgataacctggcccagaatgacacatggatgaataagaggaattaaaacaaagtccatatacgtcaaatatcaaaatgagtgtgagacagcctccccagatgcagtttccaaaggaaatgaccagtttaactggttccatgatacttgcccctttttccctgccagataaaggctattaaaaaacaatcaaagtgtgaagagggcagaaaatgtgatgaagagattctttggagaaagtagctgccactgttaccttgggatctgcctatagtcctcacagagcttggtaagacaaaagatggctttcctgtagacataggagggagagaaagctgggccagagctggttaaatcctgcccatgaagactgccttggagagcagtgggactccaaaagcacgagccaggatggggtggactcagtgatgtgctggtaaatgtttaagaaccagctctccagaaaga

SEQ ID NO: 197294 - DNA, 237 bp, Homo sapiens
aataaatcaaaaatattttatttttgtgagaaactatagtatgaatttttttccctgagtttaatttttaaataatttattactgtatatcttcctaaagatacgaccagttctgttatttatttgataggggttgattggctttctgtcatgtgttaggtgctgtactaagttttacatgtatagtctcatttagtttgtagttgttctgagggaagtgtctaggattactacaat

SEQ ID NO: 197295 - DNA, 218 bp, Homo sapiens
gtgggatgagttaattaatctcaaacacatttaaattaacaggaagaaagaaatagggcatggtaggaggagagaaaggaggacagttagggatatagtgaatacttttaaagtcagttgaattatttcatacgggataatttttcttgtcacagtaaatcaccctgtgccccacccccgctccaggaaggcagggaggttgtaaaggagaagcgaga

SEQ ID NO: 197296 - DNA, 1034 bp, Homo sapiens
ggacctctcaggctaatcccgagggccgggcctgttgggcttttctgcacaccagccgaggcagcgagccaacatgagccaagtgctgttccaccaactagtcccgttgcaggtgaaatgcaaagactgtgaggagaggagagtaagtataagaatgagcattgaactacaatcagtttctaatccagttcacagaaaggttggtatttagtccttttttgaaatatcatttcggtacattgtagacaattagttttgttctttaagaatgtgacatcttttattgcatttattttgcttttacattttaggctattttgcaactgttggaaatcaagggtggtggaatctagtgaaatcccatctctacaaaaaaatacacaaattagctgaatgtggtggcacactcctgtagttccatctacttgagaggctgaggtggaaggatcacttgagactgggaggttgaggctgcagtgagctgtgagggtgccactgcaacctagactgggcgacagagcgagaccccatgtcaaaaaacactgaaatatagcatctgttttctgtgtgccatagctttccctgaacacattcaaggacctagtagtattaatagtacctttggttttttaagtagcatcctgggtgaatttcaggaagtacttaaatagaagctgcttaagaacaaggcattctgaggcagagcaggtgcctaaattactaattttccagagtagagatgatatattatacttcttacatgttattccttatgcctgctgtacctcttcattttctagcttggtgcataagtggtttagatttttctaggatcttagcatttcctcagtagacatgagtagagattttatttcaaatgaattcttaaccttaatgcccagttctttattagttttacatcatcttgtaactaatgctgtttttctttcaccagtgttctctggtacataattttggtgtactttttgtgagctctagctgttatgatggtctcccacactatgtacacgtag

SEQ ID NO: 197297 - DNA, 578 bp, Homo sapiens
ctgtacaatgtcagatttgctgtttcatgtgtcttcaactttatgggtttaatttatgtcttcatcaaatggctatggtatggatttaccataattgtatacatgcatacatgcctacctatgtatatataaacaaacatttttgtaaacagctcagtgaggactttggactggcataaatcataggaatatgattatgaggatacatccaattttcagattgggcaatgtatacagtttattatcatttctgattttgggtagagttagtactaagaacagcattgaagaaaagcagtataacattaaaattaagaagatttaaaatacaagaggattcataacagtcacttttaaaatattgttttggctttctactttggagctgtaattttaaaaaaagaatgaacaggtttttgtatgaatatgttagaatgactaattatagagcatctttcaactggaatacatgtagatactaacacctggttgtatttgatgtaatttcagtgcatacagtgtgtataatctgtattaagtgaaatacttatgaataaagttgtttctgcattgcaaaa

SEQ ID NO: 197298 - DNA, 406 bp, Homo sapiens
gcggatgattctggatcttgggaggactacatctttttgcaccctcttttcaggacatctctttcatccttggttaagtcataaaagactgactgattttggttctgagtcacttggttggggcctcagtttaaaagcagaaaaaaaaaagccacaagtagttcaagcagttgctgtttgttctggctgaaatctgaaaataaaatatttgaaaagtttttttgttttgtttttttcttcaatgaattctgtggtcagaagtctgattaattgaaagctgatattcaggctttactttttttaaggcctctgtgttctcactattggatattgcttcttccatgggaacttagttgactgaaactcctcttgttgaatccctgctaactatatgctcagcccttct

SEQ ID NO: 197299 - DNA, 705 bp, Homo sapiens
aaagtggtgctgtgagagaaatgtatatccttaattacttatattagcaataaaactgtgatcattggtcagataggtatttatcttaaaatattattaattgaaaaggagagtaaatccaatgaaagaaaaagtaagaaataataaaaatgaaagtgaaaattagtacaatagggaaaaatgataaggtagagatcaacaaatccaaaaattagttctttggaaacaaatcaacaaaatagacagatgtcttgcaaaactgatcaagagaagaacacagaaataaacaattttatgaatgaaaaattgggcatagctataaatagagattacaaggtaaccaaacgtaaattataagatgcaggtagttcaatgggggaaaggtaaatcttttcaacaaatggtgctgaaacaactgaatatctgtattttttaaaaagaaaaccttgattcttacctcacaccgtgcataaaaattaactctagatgaatcagagataagtgatacggctccagtgagtggaggaacaccagggttcttaattctcaggccagtttagacaaaacacggacacatgtggagcggttttaaggagcggagagtttaatagacaagaaggaagcggaaggcagaaggaagaggctcccccatacagagatagagggagaggaggctccaaagccgaaagaggaggtccccaagtg

SEQ ID NO: 197300 - DNA, 635 bp, Homo sapiens
ttttattacttttactgtcattatgaataaggtcagtttttcacaattattcttattggaaaatctattaattttatatatacaaatatgtactgtgcaattagctatctattgatccttcttatttctaattgcttgagttgattcccctgggttttctaagcctgacaatgactttgtcattaagtaatcatcattctctcctttctatttgattctgcttctttaaaaatagagacttccataaaagtgtcaaatagattgcgccaatggtttggtttaccattcctccagctttggggggatgccaacatctctccactgaaaatgccactgacagctggctgctctctagtattagggaaatctgggttcctagttgattcatatttgtgatgttttcaaatcagtagcaggtgatgaatgtcatcaactgccctgttcggcctctgtggaccctgcacgtctcttgcggcatttgctgtggcaaatcatgctgacaggctgcctcgccccacatcaccctcgcccgctgtccatgtgctggtatttcacttgggattcccatgcctgcttcacctgctggaggtgagacacagtgttcctgcataccacgtggccaacaggctcagtaa

SEQ ID NO: 197301 - DNA, 837 bp, Homo sapiens
atcccacactccactctcctgctcaaaaagtcatattaaacttttcccctgttctgggccttcatacatatttgttttctcaataacatacctctgtgccctcttctcccaactaattcctactcttcaagtttcactttccatatcacttcttcctgatctattccacacacctgcagtttcctttgtcatagtatattaattacacttctgtgatttctgccttgtttgtccggtcttccctaaaagacactgtatccatcctacttaataaagcatctccagatgtaagcgactcacatggaatgaatgtgcacttaatattacggcaaaaatgttattataaggctaaatatcaaatacaatgcaagctaagtaagacagtaatatagggcttatgtacaacaaacatttctcccttttttcccccccagagaaggtctcactgctgtggctcactgctggctgatgaattcgaattcatcagccagcagtgggaaagatatagcagggagcagaaatcaatgaatttgaaaacaaaaaaacaatagaagacatcaacaatacaaaaagctggttctttaagatcagtaaaattggcaaacctctagaaaaagataaagagaacatgcaaaattaccaatatcaggactgaaaagagatatcacaacagaccccataggatggatatcccatcctccatgatgagattatttcacagtgtatgcctatatcaaaatatctcatttaccccattaatatatacacctagtaggtaccaacaaaaattacaaattaaagagaccctaagatgttaaagaatatatggatactaca

SEQ ID NO: 197302 - DNA, 568 bp, Homo sapiens
atcccacactccactctcctgctcaaaaagtcatattaaacttttcccctgttctgggccttcatacatatttgttttctcaataacatacctctgtgccctcttctcccaactaattcctactcttcaagtttcactttccatatcacttcttcctgatctattccacacacctgcagtttcctttgtcatagtatattaattacacttctgtgatttctgccttgtttgtccggtcttccctaaaagacactgtatccatcctacttaataaagcatctccagatgtaagcgactcacatggaatgaatgtgcacttaatattacggcaaaaatgttattataaggctaaatatcaaatacaatgcaagctaagtaagacagtaatatagggcttatgtacaacaaacatttctcccttttttcccccccagagaaggtctcactgctgtggctcactgcaacctcaacttcccagactcaggtgatccatcttaaaagtagctgtgactataggcacacaccaccacacccagccaattcttttatttctaatagtgttgggggt

SEQ ID NO: 197303 - DNA, 517 bp, Homo sapiens
aagcagtatttacacagtcatgattaaaaattgaatatggattaaatataatacacatactttttatgcacagttgtattgaagttatagttgtcccttagtatccacagggaattacttccaggacctccatggataccaaaatctttgcatacataggttccagaattgatcctacggaaccccccgatgtgaaaagttggcccttccatattcatggatttcacatcccactaatactgtattttcaatctgcatttggttgctgatgcagaatctgccaatacagagggccaaatctgtttattggaaaaatctgtgtataagtagacctggtcagttaaaacccatgtcttcaagaatcaactctgatacttactgtcaaaaattgatgagtgaagaaatctgtaagtcaagaagtagtaggtaaaatagatgaaaacatttttcttggttttggctatcagcctttggtacatctgattgtttaaatttttcacatacattacttgatatg

SEQ ID NO: 197304 - DNA, 421 bp, Homo sapiens
cctttggcctcttcctgtttctgaacagtagagctgtggcctcagccttatcgccaggctctgttgttgtaccatgtgtcttgtttgttctgttggtaaacatgcctgccttccttgcttccttccatcctcccatctatcattgctaccatttgccatagtgagtgatacgtaaaacctgaactcacaaggcattttgcccagaaattgtcttagcttcttggtctttactaaataatctcaaggtcccgtccagctccaaaaattctaagttgccgtatacacagcaagagaatttacctatgaccaatcactttcctgtccttatgcgtctgggccaaacagtctcatgaattattgatcgcagaagatgtccaaagtattgtggcctctgcagaagcttttccagttttatttgcct

SEQ ID NO: 197305 - DNA, 265 bp, Homo sapiens
accaaatatgtgtagtggctccaggccaatagggaggcagtgagagttctgacttgggtaaactgacaggtttgaaaattgaaggctatttcagtaccaggaatctgtaaggcgggaagcctcttttttgatctgtgtggaaattgatgcctagggcaatacatacccatgatctgttattcacaaaaccctaatccataaagctctggcaaggctttttcataagcctgctctaaattctcttgctagtaaaacctaaaatgga

SEQ ID NO: 197306 - DNA, 890 bp, Homo sapiens
  misc_feature (25)..(25): n is a, c, g, or t
atacggctaggtacgaggctgggtngtgtcacgtataaaataaatctcgcttccatccctctgctgctgggttggctgtccacagaatgggcacagcgaggcaggtgtgagggagaagcatatacttatgttaatatgtatgtcaaaagtaagaggagcagagggaatgaaaatatccatatgaatttttttttccagaatttaaagcaacacctagttgacgattcagatgaaaacgtctcagtcccttatggctgggaggtttagcaaagctttcccagaggaaagaacacatcatttgtgtggggtggctctgcttcactgaaatgaccagaacgtagctgttaagcctgggaggatgggtcaggccacaggatcaggtaagagtgtacccttcaggccgcacatggcagagactgcacatgacttgtgcacggataaggtctgggccttatctctgtctcttctggctctggaatatagtacatttctcaattaagcctcagtttccttatctgaatgctggcatggtaatggcagtcttgcaggatagttagaatgttcaaatgagagagtctatcatagtttgctctgctgtttgctccatagaagctgcggatggttgagattttggtcaagacctttctttcgtctgatctgacttgggtccagatacttggaaaaatatggcaatcatgctgggtccaaaaggctgtgggattcttttacttcagcttaaacctgttttattggtcttccggaaatgcttgcagaaataagagcatgttaacgtgggtggacacaatttggagtgcttgattaactcagcaattaataaaaatggagaggtgacaattggtgttaccaagctacagttgaaagcagtgcac

SEQ ID NO: 197307 - DNA, 276 bp, Homo sapiens
gcttttgcactcttaggcgccatgggctaacttgctggagagccacatggagagactgtatggaaaaaccacagggagagggagaagccttgagatcacatggaagagaactgaggaattgagctgacaatgagaattgaggtcccagcctatggtcccagttgtgtgttccagccagcatccagttgtttgaactgcctctatactagtaaacaagtaattaattaatacaagtaaatgaaaacaagtaataaagtaattaatacaagtattaag

SEQ ID NO: 197308 - DNA, 437 bp, Homo sapiens
ctgtggttagaacttttcatattattatctcatttatacacataatgattttatgaggtagttgttatcatctccatttcgcttgtttaaggtcacacacctggtaattggtggtgctgagatgaaagccaaggtctccctgccttcaccaccgggccaccctgccccttctcctgccagtccactgggctttctcccctgagagtcaaagtttcagcctgtttcccctctgaggtccttggtgttgacaagacctcagtctagatcagattgcattttatccctttactctctgtgccttgtatcccctgagctttttaacatatggggagcccttccttagaatagctgtcacctaggcgtattgtaatttatacctattgacactatgctgcagataattcacctttgcaaactgtcactttccaccgtcacca

SEQ ID NO: 197309 - DNA, 150 bp, Homo sapiens
gaggatggaagtgtgaagtccaagaagttcaaagtcatcaataagcattttgaactcatcaaaattgatgttaagatttcaaaaatgtgatgtgagcttgtgctgagattatatagaatgtagaaatgtgagcactgaagaagataatat

SEQ ID NO: 197310 - DNA, 641 bp, Homo sapiens
gagcaccctggccaacatgatgaaaccccgtctctactaaaaatgcaaaaatgagccaggcgtggtggtgggcgcctgtaatcccagctactcgggaggctgaggcaggagaatcacttgaacccgggaggcagaggttgcagtgagctgaaactgcgccactgcactccaacctggagtgcaaagcaagactccgtctcaaaaataaaattaggttgaactggaaggtggcttgtttttaggatgacaggttttagacaaatatgtataaatttctctttatatccttttgcccatggtatcctgcagtgacataggtaatcatattgatgaaaaggactggaaaacagaattaaaggggatacattattttgctatgtaacaaataactgcagaaaatctgaaatttagattctgtttatattcaatacttctaatatcttatttcagtgatccagtgacctaaagatagagtaaaagaacaaatgcttttgttagaaattgtggcacgtgcctgtagtcccagctactggggaggctgaggcaggagaatcacttgagcccaggaggtggaggttgcaagttagccgagattgcgccactgcattccagcctgggcgacagagcgagactccacctca

SEQ ID NO: 197311 - DNA, 438 bp, Homo sapiens
ctatggccattaaaacaatgttataaagaataaagactatgtaaattgatcactgaaacaaagtaagagtcagattgatacaaccagtttggagggcaatttagcaggatgtttaagttaaaaatgttcacactcttctatccagctactttctgggcacatgtacacaagacgtgccctagagtgagttcaccgctacaccggacatcccaaaaaaacaaaagctgcagacaaccttaatgtccttcaatggggaagtgactaatcatttaacactgcagaagtaaagttaggaagcaactaagaaagaatgagacaggtctacacacaccacacagagtgatctttagaggtatctagggcatcttgttgatggaaaaagttacatcatatcgtttgtgtacattctaaacacacattggcagtactttctatgtt

SEQ ID NO: 197312 - DNA, 240 bp, Homo sapiens
caagaaaacttcagaacatcttacaatttcagctctacatatatatgaaaaggcaaggtgagtggccttctctgtactctccctcccagttaaaaaaaaaaaaaaaaaagttgaagacttcaagttgaatatctgtgaaaaactaagaaactgaaaaacaacgtgtttgaggaatggctccctttgttttaatcaaactgaatttcatgtaaccacattttataaaaaagactttatgta

SEQ ID NO: 197313 - DNA, 322 bp, Homo sapiens
cctcccatgacacatgggaattatgcgaactacaattcaatacgagatttgggcggggacacagacaaaccatatcaagcagcatctaccattactgctaggactggcagattagcacatttacagtttttttaattcaagcttcctctaactttcaaagctaagctttaccctatgcactttgaataacacgctgtagtactcattcataaataaaaccacatattttcttacatttttcccaaatactttgtattaacttttgacttactaaagtaaaatattaatgggcaaaaaccagtccgtttgggccaataaatgg

SEQ ID NO: 197314 - DNA, 297 bp, Homo sapiens
tgacgcaggagagctgtgaacacgtgatgggcctccgtcgccggttccttaccctgccacggccaagcgccatcctgcctccatgcaaccccaaggagaggagggcagtgagcatctctgacaccccttggcactgaggtgagactcttcctgtgagcccgcaccccatcaacgtgctccataagccataggagtcaccacaaacttcgcaagtggataatagtcaggcctcactgaagacacagctacccatgctgatccagccaggagggtcgcttctgtgtctcctcctactcc

SEQ ID NO: 197315 - DNA, 1971 bp, Homo sapiens
  misc_feature (1409)..(1409): n is a, c, g, or t
  misc_feature (1625)..(1625): n is a, c, g, or t
gtagcattaagcttgatgccaatcttaatatccattgttttaaatatgttgttttagaaagcatattttgcttacttttcctcaaaactttctgttcattgttactcttcccaaaagaacaaagatctccacagctaacaccaaacatcatataccatatttgtttttgtgggtattctgtaattattttcaagctcctaggcacatttgcgtacactacttttgtttctgcaatgacaaatttctaaaatgttagcagcaatgactgtaaaaaagggtagttaattggaaaagagttcagatcctaactctgtttagggaccatgtaacccaggcaagccgctgcacctccctgggcctcatcctggaagtagagatgttgggcagacacatggggagggattgcgtgtatgagtgtaacaggctgggtgggatgctcgagtgaggtggggaccctgcagcaatgcagaggacatgctcggtctaaggaaggcagctgcaatctcactgctactcagaaatgtaggcttacagttggccactcttctcatgtctcaaaagaaactgggtttttgtgggaatttccttttcctcaatttggcaataattcaaactaaaatctcttcttctttttttttttttttgagacagagtctcactctgtcgcccaggctggagtgcaatggtgcgatctcggctcactgccacctccgtcttccggattcaagcaattctcctgcctcagcctcccaagtaactgggattacaggctcccaccaccacgcctggctaatttttgtatttttagtagagacaggattttgccatgttggccaggatggtcttgaactcctgacctcaggcgatccacctgcctcggcctcccaaagtgctgggattacaggcatgagccaccacacctggccaacagatctcttcttcaaaacagttcttccagccagactgggtttgtgggacagcagtgtgtaacctctgggcaggacatccccaggatggaggtgctctggcccatgcctgcactataccagcatgtgccctgggacattgcagatggctccccaggcctccacgggcctgcactcacagtctcttcaccagagagctcgaaatctcagaacccaactctctcatgtcatcaagccagagacatgagtctgcttttctgtctccttagatttgtctgttcttagacattttgcataaatgaaattatgtaatatgtggtcctctatgactggcgtctttcacttggcataatgttttcaaggtttcctcatgttgttgcatatatcagagctttattctttttattactgcataatattccattttatgaattatttgtccattcatcagttggtggacgtttgagttgtttccactttctngctactatgaataatgctactgcaaacattcatatacaagtttgtgtgtggacaagttttcatttttcttggatatgtatgtgggagtggaattggtgtatcatattgctttgaggacagaccaaacagttttctgaagtagctgtaccgttttatcaaatacattcccatcagcagtgtatgagggcttcagttgctctacctcctctccaacangtttaatttttctgattttctatgataactatcccagtagttgtgaaagtggtatctcactatagttttgatttgcattttccttatgactaaggacattaagcatctttttatatgcttattgaccattcatgtcttctttggagaactctccagattctttgctcatttttaaatttggttatttgcctttttattgctaagttataagagttctttatataatctggatacatgtctcgatgagcctcatttttgtcacccaaatttaatgatattcaaaatattctacttactaagataggaaactattctgtttgaaaaacagtataaataacaacgtttt

SEQ ID NO: 197316 - DNA, 544 bp, Homo sapiens
aattaatagctcttttgccccccctcaacaactagctacagggcagctgctgagcctgtgagatagaacttatgttattaagcagaagagaaacatttagccctccgaatcatttcagcagggttccagtccagaggtcacagcactgggcatctcctttccctgggtccccgttcccagtattcaagttggtgttcacgggtgtgtttatagccagtctgtgaactacagaatgttcatcgaaattaatgcccctgctcatggtgaacatgcaacatcattcctcctgattcttcttgtgttctctgtcctggagaattgtcctgccgtttgccccgttgtccaactggatagctgaaccatcatcctggataccttctcccttaatagccatatccagtgatggccaattcctatggattctgccttctaaatacctctgctatgccctttcctgcattgcacctgcctgttccttgcgtggtgctgaggtttgaggtatgattgatctgtcacccaggtaatgagcatagtaattgatagt

SEQ ID NO: 197317 - DNA, 263 bp, Homo sapiens
tgggccactcccatctgcggtttcacacttctgggctctgtggcgagggtctgcccctccatggctctgaaccgctttcctctgtgcgatgaaagtaaacgacgtctccctttgagggcttggggtacggggagaacaaggctcgcacagtaggtgtgcaggccacgtccccacagcagggttccaaagcctaagatccatcagtgaccctgaggagggattcgaagaaaagttcagatttcagatttctggcttcatttgaa

SEQ ID NO: 197318 - DNA, 316 bp, Homo sapiens
acattgccagtttctgttcttctgcattttctccaacacttggtattgtcagagtttttaagttttgctgatttgcataaaatggtatctcattgagattttaatttttgtctctgaaaattattgaacgtgagcatcttttacatatgttaaacattttaattttatcttttagtaagtacttgtttatgtcttttgtccattttcctattaggttgaggtgggaggatcacttgggcccaggaggtgaaggttgcagtgagcaaagatcatacccctgcactcgagcctggcaacagagcaagaccccgtttca

SEQ ID NO: 197319 - DNA, 941 bp, Homo sapiens
gaaaaatgttcaatattctaatcacataagtatattccaataggttaaattgattatttcaatttactatgcaaaacttgtagtgtgtggttaatagattacatggcttatatacatacaaaaggttttcatgttaaattttgtttgaataataaaatggactaagagagttcagtttcagccttcatatggcacttagtatgagaaaactcaactactaatgttgtatccctattttaagaaaactcacatacaaatatctgaacttgaaatagcaagaaattaagaaatttggggaagattattttgtttcctttatgaacacattatatcttcaataacttccaatagaattcctttaaatagtgaaattccccagtgtattaaaaatattattttctattctgataaatatttcacagtacatttatttcatacagaatggaacactgatacttggctttgtcttcaagagcccaagcaaagctgctgaagcaggccgcagttatgggtaatcaagtgagattctaagtccccagacgataattgtgcacttttttctggtgtgtcctaactataaattggaaacagttggactaaaacttacagcaacaactccaatagaatcagatttctccttaaacttggagaagctggaactgtttctgctttaaagtccaaactaggaaggtcatgttccaaagcagccttaaattgctaagaaaccaagaatcaccttcagactgtttctaaaagaaatgttaatcagaataaatttccttctgaaaatgaactggtaatagtaacactagtcaaactttaaaatagttgtaaaaggagcagattgtggtttcattggacctaaactgaaaggcctgtttgcagttcccaaggaaatggcatgagtgcagacttaacaatttaactataggcaacaacca

SEQ ID NO: 197320 - DNA, 510 bp, Homo sapiens
catggtagtggctgcctctggaaaggaagcaggcaaatgagatttagggtagtagtaaaagggaattttagctacctctgtaatgtttatttttttaaaaaagaaaaaaagccattaagctaagatgactcacttaggcatagttaggggatgtgaagtgtcattgaaattcttgtctaaaaaacacagcagaagtttgagatctcgtctttgtcctcataaactgttctttcacgtaatgtatagtttttttgtgtgtcagacactagttatgtctcgctttcttgaaacaacagtaaaacctgtttcaaatcgattgaataattcagaatagttgttacctcctctttgcccacaataaccttctttctaaattaatatactgtgatgatgggactttatctttgtgtgtgttctatgaagaaagggacacgctatgagtccttggtaaaatgaataaatagatgaataaataaataagccctgtttgctggccaccctgcatgcaac

SEQ ID NO: 197321 - DNA, 1023 bp, Homo sapiens
aaaggaaggaaggaaaaaagaaagagaaaggaagaaagaggaaggaaggaagggaagatggaactaaggaaggaagaaaggaggaaagaaagaaaaaggaaggaagaaaacaaaaataaaaaaaaaaaaaaaaaaatcttgttcgcggcgccggctttcggggcctttcggaaaaaggttttctctaaaacattccgtgttggggcggcggcgggcccagtaattgttatgtgaaccttgggccattaggctggctccaaaaggagaatcccgggcgctggagaactacttggttggggttctctcacccaatataaaaaaagcgccggcggggaaacccggaggggtttctggaaacaatctcccaaagatggagaggctcgagaggagggccaattaacgggggtgagtttatttccaaaaaggggggagttcccaaggggggagcctccggaatattacaaaattatcccgccccgtcctgtgtggggaaaaaggataataagcacgcatgtagatcaattaaagagcacacaagagaacgaagtaagtataataacagtaagaatcacataataatatcagaaagaacatacatcagagcatgtacaaaaccatcgtaggacagccacaattaggataaatatctatataggacaaaaacattgatagtaaaaagcgagagaatagagagaggagggaaaaaaaagggagaaaaggaaggaatgagtaggaaggtagccacagcaggaaagcgtgaagagaggagtgagagagagggaagaaggtgaaggagaaagaaaaccaacagtaacaggaaaggagagagaaaagaggtcgaggaaagaaaaatgaagagggaaggagtatacaagtgagaaaaaaaaaaaaaaagagaaggaagaataagaagatacaagaaggagacaagaaaatagcagctaactaagcgaagagcaagggagcgcggacagggcagaaaatcaggaaaaatataaaagaagaaaagaaaaagataggaag

SEQ ID NO: 197322 - DNA, 418 bp, Homo sapiens
cggtcattagtggaacagttagtgaaatttaaataaggtctatagatcaggcaatagtgttattgtggatttcatgattgtcctcattgttctataattattgaagatgttcacatttggccaggcacggtgtctcatgcctgtaatctcaacacattgggaagccgaagcaggtaggattgcatgttctcaggagttcaagacaagtctgcgcatagcgagatccctctctactaaaaatttaaataaaaaaaaaaaatcagccagttgtggtggcacacacctatagtcccagctactcaggaggctaaggtggaaggatcacttgagccccagaggtagagcctacagtgagccgtgtttgcgccactgcaccccaacctgagccacaaagtgagaccctgtctcaaaaaaaaaa

SEQ ID NO: 197323 - DNA, 326 bp, Homo sapiens
caatgatagacaagtactggaaagacaaccttaacaccaatctcatataacttgaattgaatgttggggtgaaaatcaccgtaacggtagtcctaggaagggaatatagccagtgtgcataaaatgaaagataaactctagtatggaaaaggaatgcattatccactcttacacgaagcccctggcatgcagattgcagcaaccagctacagctttctagcaatagaaacggaatctcaaaacagggaggaggagggaacagtagatgaaaagacttacagagaagcaaaaaaccaaagggacacaaaaagcaagagcacgctaaa

SEQ ID NO: 197324 - DNA, 433 bp, Homo sapiens
attgacaagatacttaaattttgtctatggccataccaccttgaacgtgccaatctcatctgatctcagaagatatttaaatttaaaacctatacactttgatccaacaatcccagtttttaaaatctatgacaaatacatatataggtacataggaacaaaacatgtatattgcagcactgtttgcagcagggggaaaaaacctagaacccacctgaacgtccatcaatagaagaatagatgaataatttatggaattaaggagaatgagttaaatctatgtgtagaaaccaagatagagctatgtaatatataaaaacaggaaaaaaggaatatgtctaatacactatttttatagcaaccaaataactctgtggatatgtgtttttaaaagaccaaacagaaaggtgtaagatacacaccaaactgttaa

SEQ ID NO: 197325 - DNA, 612 bp, Homo sapiens
gagacagggtctcactctgtcacccaggctggagtgcaaaggtgcaatgtcggctcactgcaacctctaccttccgggttcaagtgattctcctgactcaacctcccaagtagctgggattacaggcacatgccaccatgtccggctactttttgtatttgtagtagagacagggtttcaccctgttggccaggctggtctcaaactcctgaccccaagtgatctgcccaccttcacctcccaaagtgctggcattacagatgtgagccaccgtgcccagcctacaatgtaatcttttaatttacatttctgtgattaacttgagcagcagtactgcattgaggttgggggcacacaggtaagaggccaacctgagtttaaatactggacaatttactcagcttctttaggcctcagttttcttatctacaaaatagggattataggaccttcctcattcatctatactcaggattacataatatgttattaatcaagtagaactttcttttcatttttactggctgtcatagatggctagtgtttcgcaaaccgattctgcccttcttctccagaaggagttttccagccttccttgcagctacatgtggc

SEQ ID NO: 197326 - DNA, 451 bp, Homo sapiens
ctgcagtattataaaaattcctctataaaatttcatcttgtcagatttggatgcctctgtaaaaatcatccttaagtatattctttatctaaaaactgagctatgccttctagcttcacactttgacaaatctgatgttcttatttaaatcatgtgtgaaagtgctgggttatgccaccttctgtttcacttagtcatcatcaattcatttgtgaagcccctttggttatttgtctttagctgggagaatgtcttgtaaataagaacattagggtgcctttgagttttcggcacttttctcattctccacaaagatttaaaaagtgatcatgaaccctgaaatacttaaatgcaataattagttttcatgtccatctctctacaagctctttgaagaacagaactacctaattcaaatatcagtaatttaaaacatttcttgggacatact

SEQ ID NO: 197327 - DNA, 468 bp, Homo sapiens
ctgaacagaattgcaatctaacatgttacattttgaggtaaagaagtatgccaaggatcctcttatttgaagcataaaggagaagcctttaaatcagcctgtggtttttaggcaaagcttcctgggggagaggccattctgtgttgagttttgaaggatgtgtaagaagagttagccatttaaggaaagtagaaaggctttttcaggcaaagaagtataacaaagatgtggtggcaaaatatgaaatatgagtgcggcaggaaatgtagctggtgtatacttggcctcagaggcctttatgtgtcatgctgtaagtacttgaaagcttgtagatactggggagctaatgaaggaatcaaaacagacaatttgattttctaaatgtctttattattgtatattctattttttaaaaactttcttatttgataattttgaaataaatatcatgataaatactttttaaaa

SEQ ID NO: 197328 - DNA, 561 bp, Homo sapiens
gactgaaaatgtatctcaaaatacatacataaaagtcatgagagagaaaataagtagtagtattatataaattaaaagcaaaactagagggaaaagtgggtaaatatatctgatagccacatgaaatgcttcatagaggcagggctggactggcacaaaacagtaggaggcaaacacatacctatacttatataagatgtgacaattatccagtacctctccatcccagtctcaaactacctttccatcagcttcacattgtgcctggaatttcacttttagaaattcattaattggctcaaggcattttgtgtctagaaatcttatattaaaatgtgaaggattctggaagaagtaatatcttctctttattctcaaccattggcctcttcagcatgagttagtttattttaactttaggtattgaccttgtgtgagtattgacctcgaagaatggaccaaagaacacatttaccgtgttttgctttgtgtgtgctcttggtaaccttatgactttactggggtcttcagccttgacataaagtagaaatcaacttattt

SEQ ID NO: 197329 - DNA, 418 bp, Homo sapiens
tttattctactaacatgtgcatttggtctatcaaattgaacatatcccaaactaaacacatctccccaactctgcattttttccttatttccaattcttgttaaatgtctctgttgccattatccaaatcccttttgcctcagtttcttgtaacactcccgttttctcaccatcttctgaataggaagattgatttaaggaaagattccttggcatctctcataacttccctaccttcactgccactacttggtggctcttactgacttctgtgtctgaattgcatacactggcctgtcatggtggttcacgcctgtaatcctagcactttgggacgctgaggtgggtggatcacgtgaggtcaggagtttaagaccagcctagccaacattgtgaaaccccgactttactaaaaata

SEQ ID NO: 197330 - DNA, 125 bp, Homo sapiens
tggcttgggcccaggagtttgagaccaggcaacgtagcgagatcctatctctacaaaaatgataaaaatgtttcaaaaagaaaaaataaacaattataattgtatatgtttatgtggtacaatat

SEQ ID NO: 197331 - DNA, 491 bp, Homo sapiens
tgtttgcaaatgatgtttccccagagacagggctgagagcacagttcttattagcacagtgtaacatgaaacaactctataaacatttttgatgcactcaacactttgagtactctctcttcttaataagcacatccccactgcagtggaaagatgatagcaaaaattaagataataatagcatgatctcttaatgctttgcctcaacaacaatctaagacttgtaagcttcctctaactgcatcaatcccaaccctgtgtcaggcgcactacaaggtgctgaaaacatctagatgatgagtgggcaaagtcttatctttggaaaaggaactaagaagaactcatcattaacaattcctttgttaatgttgaaccatcttacaacacaaatggcgttgaataccaaagaagtccttgtgaggtgggttgctaagtgtgaccatagcttatcctgtagggaacttaggaaaactaaataattctgaatacct

SEQ ID NO: 197332 - DNA, 447 bp, Homo sapiens
gccaccacactcatggttacactgcgtactgtgtcatgactaatcactggcatcgccaacagttccatttcaagcatcccacgctgtggtcatcacttcttctctctctagtcactccccttagcaccatcactccaaattggtaagttttcagcgactatcatcccccatttcattacttccctccttgaccagcttagcttctatggttccttctcataattattctcttgcccccatttccaaatcccattatgtactctcccagcactgtactactcttttgagaattaaaaagaaacaaattgcaactctagtaattttttcttactcttaacctgtgcctaaaaaaactaaacatgactggagaacaaaagaccaccaagttgacctgtgttcctttgtatttatattaatatggctcacatggttttcatcactgtccag

SEQ ID NO: 197333 - DNA, 642 bp, Homo sapiens
  misc_feature (58)..(58): n is a, c, g, or t
  misc_feature (82)..(82): n is a, c, g, or t
  misc_feature (97)..(97): n is a, c, g, or t
aaatcgcggtcttaaccaaaaataaaaaaaaggaagtacctgactcagaattccaacnaacattgtcaaaaactatgaatgnaaataaaaactgagnacaatcctattgaatataatcagaatgccaggatgattcaacattagaaatttgttaatgttacataacaagtcaagcagtcaaaatagcatcacttcaaacttcacagggggaaaggggaaagaaggcagaactaaataaaaagactacaaaacctgaaagatgaaaaagggtgaattagggagaaaacactctaaggtggatcttattgttcatggacaaaaagaaagaacatctttagaatttattaagtagttgtttttaggctgggcacggtggctcacgcctgtaatcccagaactttgggaggccgaggtgggtagattgtttgagctcaggagttccagaccagcctgcgaaataaggcgagaccctgtctcactttgtatgctggtgccagccgggggtgcccctggtaggtgctccctggggtgtctgcttcagggcttctgcgaaggtgcaggtcagggctcctccagctgggaaacttggaatagttggcagctgctttgaatgttggttccttcttctctgatgaccgtgct

SEQ ID NO: 197334 - DNA, 310 bp, Homo sapiens
tgagctgactcttgaggatccccagtcactgtgagacctcgtggctcacgcctgtaatcccagaactttgggaggccgaggtgggtagattgtttgagctcaggagttccagaccagcctgcgaaataaggcgagaccctgtctcactttgtatgctggtgccagccgggggtgcccctggtaggtgctccctggggtgtctgcttcagggcttctgcgaaggtgcaggtcagggctcctccagctgggaaacttggaatagttggcagctgctttgaatgttggttccttcttctctgatgaccgtgct

SEQ ID NO: 197335 - DNA, 252 bp, Homo sapiens
cagaggaagcatttcttttagaagatgaggtgttagcactctgtattctgaggcacgttgtaatagtcattgtcagaggtgccagcagatgaaaataccagtcactataagagatttctgaagaagtcagaaaaaaaagtcaattttgtcttctcaaaaaatagaaagtgggtcaggaaattctgagaaaagacagcatttatgcatagggatttcgcattctgattacggagccctactacatgataataa

SEQ ID NO: 197336 - DNA, 996 bp, Homo sapiens
gatctcggctcactgcaagctctgcctcctgggttcacgccattctcctgcctcagcctcccaagtagctgggactacaggcgcccgccacgacgcccggctaatttttgtatttttagtagagacggggtttcaccgtgttagccaggatggtcttgatcgcctgaccttgtgatctgcccgcctcggcctcccaaagtgctgggattacaggcatgagccaccgtgcccagcctacacttaccagttttttaatgtataaagcagtttcatttggctcatcaatcttatttgtaccatatttttttcttaaaaacaatttttccctttaaaagctggtatagtgaaattctaattatttagtataatattattaataatttatcttgtggcatataaaaagagtatatagttttgagagtatagagtagcttcacttaaagatttagtgttagaaaacaaagtggaaatacagtatccttgatttttgcagtttgaatatcttagaagattattgctttcttttcagaaatgaaggaaggaaatgctctttgacagattgtctcttctaaataatcatcagaaagcagtttgtccaatcattagacaagccaagataaagagcatttagtcagatgacttaaatactagttttgaatctactgctgcatgtctttgtacgattctgttcaatctcatagtttctttggtgtgaatgatatggtcgttatattgagagtgcttttattctttggagaaatatattgaaatattccaagtgaagtatcatgttgggctcaggagtgggttcagaaaaaaaagtgtgtggatgtctggatactcggcgtgtgcatgcacacgccgaatctccatacacccggctaattttgtatttttagtagaaacggggtttctccgtgttggtcaggctggtcttgaactcatgacctcaggtgatctgcctgcctcggcctcccaaagtgctgggattacagg

SEQ ID NO: 197337 - DNA, 213 bp, Homo sapiens
ctgttctttcaccccccatgagcccccacaagcacagccctgaagtgttcacccttgtcctcaactgaccctcccccatgtttttaaatctttaatctcctaaatccagtgttcacccggaaacctttcactctctccaagccctcctcaacaggttcctcccctcaaaatatccttcctcacccacagtaccccttgtaagtgcagctcacc

SEQ ID NO: 197338 - DNA, 231 bp, Homo sapiens
tttggcctacgagattactgagccacactaaggctgtggatgaagctgttttccactatggtctgatcctataccatctgtaaggtacactgctaaatgcaagagagaaaaataaaaatgagataacagaagaggaaaacatattagatgggagcagccaagacagcttggatagtaaatcctacccctgccacttgctaaccttggggtgaaaagtcacctagcctcgct

SEQ ID NO: 197339 - DNA, 757 bp, Homo sapiens
tacatgaagaaagagtatttaaacatgttaatgataggcaacaaactctatcagaatatcaagacactggtaatactggtgattcttctttgaaaggctacatgaataatggtgggatatcagttatcagacagaatacaagggctggatctatttgtcaagaacttgaaagtactgacagatgtaaaacaattggagtaggaatttccaataatggtaagaatgatttaaaggaggtaggatatcaagaaatgaaaggaaatcagaagaatgccaacggaataaacaaattgtatgagcaaaagaaatatgttggtacagataattgtaaaaaggaggaatattctaaatctcgacatgtatatttgggaagagatcaagagaatatggggcatttcaataaatgtaaacatcttcccgatttagggcattcagatcatttaaagaaagctgaaaaatgtgttaaaagtaaagcatccaaagggaatgagtgttcaggaaatgaatgttctttaaaagatattttgacaagcaataggcatatgacacagaaatctattataaaagaagacatacatccagcaccatcaactaattctaaagataagttatctgggaaaattgaagaacaaataaattcaacgaaatactgtaaagtgaacgaagacataaaaccaaagaaaactgaggccatttctgccaagaaaggaacagcaaagagtaaagatgaaaaatattctaagataataccagaaaa

SEQ ID NO: 197340 - DNA, 368 bp, Homo sapiens
aaccactctattgtccatctggagtgcagtggcgtgatcatggatcactacagccttgacctcctgggctcaagcagtcctcccacctcaccctcctgagtagctgggactacagtcgtgtgccaccattcccagataatttttgtagagacagtgttttgctagttttgcccagactggtctcagactcctgagctgagcacaagtgatctgcccacctctaccttcctgtgctgggattacaggcataagccatggagcccagccctccaacaccatttcctttttttttttttttttccagatgcagtcttgctttgttgcctaggctggaatgcaggggcacgatctcggctcactgcaacctc

SEQ ID NO: 197341 - DNA, 313 bp, Homo sapiens
gcatagattgctagtagtagatttactgggtctgatagtatttgtgcattttattttattttattttgtagaggcggggtcttactatgttgcccaggctggacttgaactcctgggcttaagcaaacctcccacttcagcctaccaagtagttggaactgtaggcacgtgcaccacgcccagctagcattttaaattttaataaattctgccaaaataccatccaaaaaaaggctttgtgaaattacactgtaatgaatagtatgggagtgatacccttgccaactttttaaaaatttaaattaatccaatg

SEQ ID NO: 197342 - DNA, 267 bp, Homo sapiens
atgaaagggaggtggggcctgacagagagcagcacttatgtgtttgtcagatgaggggatttccagttgaattggcctgcagtggcctaaagacactagcctggttagcgatgacctgcatttctctcatagagcacctcccttttcatcgtatccactagctctctaatcaccatgaccatcatgatgaattttggcgaatcgatgaaagggtagttgcttttttcaaatacttttttgaaacacacatacatttttgtatgtatg

SEQ ID NO: 197343 - DNA, 466 bp, Homo sapiens
gtgtgctggtattatggccaaagagtaataccgtttcctcttaggatttaagagaactatattcaagaaaggtcaccattgtatgagattttttttaaacagcttattaaagtgttaggttcatgaaaagtagcgtacataatttatccaaaattaataaacttttatgcaattgtaagtcttcagttgaaacaactacatgggtactaacttaagtgtttccacacattcaccatccttgtttgaccaaaagtgaatcagaagtaacggctcaccttgaagatattggaagaatttgtaagtactgttaagatacttgttgaaaataagtgtaaatatactttgtttaaataaacaaacgagcttatatcatttaattgtagcctcgagacaattctaagacagaagtagaaaggatatcatcagtgttgcagggctcatcaggctcaggaatgctgattttcat

SEQ ID NO: 197344 - DNA, 528 bp, Homo sapiens
ctggcttatcatcttcaatctcaaagaacttccaaagttaactaattgttgactttttagatcaagtgcaagaataaagaactgaaacaagtgtgatgtatggagaaatgtattagtatgtctgaaaaagaggaaaatcacaggtttccagtgttttgaggtcacaaaacttaagcatttctacttcaatctgccaaagagataaccaacattgaggcagagaatgtcatcatgtacactacagatggtctgaaaacacacaaagcttgggtcagagaatgaggttgctgcaatacatattctagaactgcttctcaagctgataaaatatatctggagagaccaccagccaaagttgtttctcttatttgatactcaaaatgaatacactggaaacttagtacccaaccttaattgataacaaaaataaatggtagtgaggaaagaaggctgactaaataaagaaaaaagacacccatttgtgggaaatactcagttgccagccttcatttgatttctccacttttc

SEQ ID NO: 197345 - DNA, 130 bp, Homo sapiens
tagatggtttcagtgcagcgtggaaacctgcagcagtagaagtgacaaaaggtatgttggtagcacggaagatgcagtgctagttccgtgtggcaaagggtgaaggtgtcttagaggactccttggtcaa

SEQ ID NO: 197346 - DNA, 396 bp, Homo sapiens
catatccatcttccccctcaggaaccctgcccaagaacaaacagctcagctttttgtccaccgctgtagtcccagctgctggaacaaatactgggaaatgcttcattatatcagtttggtacatcagatttaggtacttcccttttttcacataaaacttccttgacttataaacacctagctgagcatggtggctcatgactgtaattccagcactttgggaggccaaggcgggtggatcacttgaacccgggaggcggaggttgcagtgagctgaaaccatgccattgcacttcacctgggcaacaagagcggaagtccatctcaaaaaaaaataaataaataactgccttttctgtactatcacccttaacaacccatctagatgggtaccga

SEQ ID NO: 197347 - DNA, 476 bp, Homo sapiens
tctgcccttcaaacccagctctgccccaagctggctgcataacttcaggtccatccattatgtaccacatgggctatgagtgatatgttcattaatttgattgtgatcattgttacacaatgtatacgtacatccagtcatcacactggacactttccatattacagtctttgtcaaataagtatttttaaatgaaaaaaaatgaatttaaataaataactctgtgtcttggtgtatgagtttcctagagttactatcaaaaagaatcacaaggcttatgtctcaggaaacaggaatatactctctcaaagttctgaagtctagaagtccaaaatcatgatgttggccatgctccctctgagggttcttggtgaggatactttcctgtctcttctaaattcagggagttgccagtaatccttggcattccctttttgtagctgcatcatgccaaccttccatcatcagatggccgt

SEQ ID NO: 197348 - DNA, 524 bp, Homo sapiens
ctgcaaagactggagcctgaaccactcaccaacttgtctcctttgggttttccagtgtctgtctctgtttaaattgtgttctttttctttctttctttctttgcctagcctagtcccttttgatgtataactttttaaagttttaaaattttagatttggcatctccctagatgctatttcctgaatcaaagctttgtctctttgcaaaatccacaggctcctttctctctctttctctctcgttgttttgttgttgttgttgttgtttaaagatgaggtctcactctgtcacccaggctagagtgcagtggtgtgatcatagctcactatagcctccaacttctgggcttaagtaatcctcccacctcagtctcccaattacctcattcattttgagattcctacatttctgggacaccacggtttggcccaacaactcaagccccactactcaaagatgccaaggaggaggtggaagtaggcaggtgaatcaaacttttaaaagatgatactatcagtgtca

SEQ ID NO: 197349 - DNA, 326 bp, Homo sapiens
ccaaggggtggctcgagtgactgacgggccttgaacgctcccaggacccacatctggagagggaggtgggggtggggtgctgaagtcattcttggggcccctgggggcgggcatggacctgggtaaggccagagaaattgacacctcgtgacatccctggaagagaagtacgttcagtgtcactccagagctgaaaccgccttctggctggtccctcctcacctacatacttttctaatttgtctggagcaggccgggcatctgtattatctggttatttaaatatctggttatttaaaagctctccattaaattcacatacacga

SEQ ID NO: 197350 - DNA, 636 bp, Homo sapiens
tggcaaatcgaaggtctgtggaaaccccatgatgagactatcagcaccatttttctggtttgttttttttttttcctgcttggcctgcactttttgtttctttttattattattattatactttaagttctaggatacatgtgcagaacgtgcaggtttcttacacaggtatacacgtgacatggtggtttgctgtacccatcaacccgttatctacattaggtatttctcctaatgctatccctcccctagcccccactccccgacaggccccagtgtgtgatgttcccctcactgtgtccatgtgttctcattgttcaactcccacttaggagtgagaacatgcggcagcaccatttttctaacagcatgtggtcgcctcatgtctgtgttttggtaattcttataacatttcaaacttttcattattttcattctatctgttatgacgatctgtgacctctgatgttactattgtgattgttttcgggtgccataaactgtgcctatataaggtgacggagctaacggataaatgttgtgtgttctaactgttcactgaccagctattctcttatctctctccctctcaggcctccctatttgccgagacacaatattgaaatttggccaatt

SEQ ID NO: 197351 - DNA, 2668 bp, Homo sapiens
cccgggttcacgccattctcctgcctcagcctcccgagtagctggaactacaggcgcccgccatgatgcccggctgattttctgtgttttcagtagagacggggtttcactgtgttagccaggaaagtcttgatctcctgacctcgtgatcctgacctcggcctcccaaagtgctgggattacaggcgcgagccaccgcgcccgacagcagttatgaagttctaaaagcaagtcttaatcaggaagtgtccttgatcaccaacggctcgcccaggcatgctggctctcttccacttccaccttccaccatgggatgacgcagtaagaaggccatcagtagatgccagtccctcaaccttgaactttccagacgcagaactttatgcctccattttcctctgctgcatggccccaggagagattttaattagctttctaaccttggtccagattgcacatgcaaatggtagaggatgcaacacccccgcttgtggagctgccgcttgtgtctggcatgaaaattcacaagaagagaggaaatactgaggagaaaatggcagattgtgtttgctgaatttgattgacgaagaagtcaccatgaaaatcacagtgaaccatttggaaagcaaactgccaaaaaataatagttagtcatgctctcaggctggttgttttggctgttgtgggtttcttgcatttccagatgattgcaaagagctgtttctcaatttctgcaacaagtgccagctgaaattttggtaccagtttcattaaatatgtagaacaatttgagcctgagtgagttctgtggagcccatactacctgcgattcaagccagcaaccttggaatctccctgaacaatttctatggtgtccaatcacatttgcaatcactccccacactcagtaggttctgcccccacatcatttcttttctctatcctctttcccagctttataatatgacttagttcaagccctaatcactggattattcaaagtcccttaacaggttaattcctactgtgatcaacactttaaaggaaggcaatagggccaggcatggtggctcacggctgtaatcccagcactttgggaggctgaggcgagtggatcacaaggtcgggagtttgagaccagcctgactaacacagtgaaaccccgactctactaaaaatacaaaaaattagccaggtgtggtcgtgggtacctgtagtcccagctactagggaggctgaggcaggagaatggcgtgaacccgagaggcggagcttgcagtgagccaagattacgccactgcactccagcctgggtgacggagcgagactccatctcaaaaaaaataaaaaataaataaaacagaaaggcaatggctatcccaaattgctgaagcctttgctaaaagcacagacagaaaacaacaatatggtgatgtttgtgttaaacaaatgttattgattctaggacacaggtcagatggcaaatagtcaaactcaaatgttgatcccaggggtggctgtatcatcactaaggccaaatcacaactttgactggtctcatgggaacacagatcttgggtttggaaagagcacaggcctggccatgggaatggacacagggtaattttaagatgactagaggttcctcaaaccctaaaagtaccactgaaccttgtttaaagctaaaatggctcctaaatgatagacacgtttctcagttatctctgcaaactgaagatcctatcagcctgttcagggtctcacaggcctctgggtttgtacatgatgtccctacagtggcgatggggactgatgagagccaccgttcccattggaggagggcaagctgccactgagtgtcagctgctggagtaaacatccaatcacatgtgtacctgtatcctatggatattggcttcccctcatacaacttgttgttcctttgttttccattcctgactatatttgaatctttcttggatttccaggaaacatctgactgctttcctatgccacttcatacccaagagaagctcagggagatcctttaaggtcctttatgcccattatgatagtacatgaataggtaaatgtaccactgctccctgtacttcttggataatgcacaaatagtaagacagtctcgcaaccagcagcctagacagcccaaatatgtgaaaccaaaacagcttgatcttccagacctgttctgactccttgagtcttaaatctccaagcctcttgaatgtttcacccacagccttccctttgggatctggcatgggacaggaagggcagagaagggcctggggcttttcctcagggatccaccacagtctaggccagtgggtggcaaactttttctgcaaaggatcagctgggagatagtttcaactttgtagtctcgtcgcagctactctactcgactctgccactggagtgtgaatgcagtcatgaataaaagaatgaaagttttccagtgaaactttagtcacaaaaacagtctgcaggctgtgtctggcccgtgggctttggtttgctggcctgcgggctcctagaaggctctgactttatccctctatgagggaaagcaggttttggggtattctcccaaatctttataccttatgtctgtgtctctttttaaattaaaagtaaaatttaggcc

SEQ ID NO: 197352 - DNA, 668 bp, Homo sapiens
cccgggttcacgccattctcctgcctcagcctcccgagtagctggaactacaggcgcccgccatgatgcccggctgattttctgtgttttcagtagagacggggtttcactgtgttagccaggaaagtcttgatctcctgacctcgtgatcctgacctcggcctcccaaagtgctgggattacaggcgcgagccaccgcgcccgacagcagttatgaagttctaaaagcaagtcttaatcaggaagtgtccttgatcaccaacggctcgcccaggcatgctggctctcttccacttccaccttccaccatgggatgacgcagtaagaaggccatcagtagatgccagtccctcaaccttgaactttccagacgcagaactaaaattcacaagaagagaggaaatactgaggagaaaatggcagattgtgtttgctgaatttgattgacgaagaagtcaccatgaaaatcacagtgaaccatttggaaagcaaactgccaaaaaataatagttagtcatgctctcaggctggtaattgaaagttttgttcaaatcgtacttaatattcaataattgtttaaccataccactgcttatcttgggaatgctgatactatggagacaataagataaggtggctgctgaaaatcagatttagacactactttg

SEQ ID NO: 197353 - DNA, 1119 bp, Homo sapiens
cccgggttcacgccattctcctgcctcagcctcccgagtagctggaactacaggcgcccgccatgatgcccggctgattttctgtgttttcagtagagacggggtttcactgtgttagccaggaaagtcttgatctcctgacctcgtgatcctgacctcggcctcccaaagtgctgggattacaggcgcgagccaccgcgcccgacagcagttatgaagttctaaaagcaagtcttaatcaggaagtgtccttgatcaccaacggctcgcccaggcatgctggctctcttccacttccaccttccaccatgggatgacgcagtaagaaggccatcagtagatgccagtccctcaaccttgaactttccagacgcagaactttatgcctccattttcctctgctgcatggccccaggagagattttaattagctttctaaccttggtccagattgcacatgcaaatggtagaggatgcaacacccccgcttgtggagctgccgcttgtgtctggcatggatgccccttctagatgttcatggctcactccctgccatgttgtcaggtatttgagctctctgttcccactcagagtagatgagcagaagaggaaatgagggccttcccagagcaactcccccagatgaacagagccaggctgcctggattcaatgttatcttcatttcttagctgtatcatcacgagttgtttaattcctcagcacttaattttcttgacctgcaaaaatatggatcataatgatcattaactaataagtttgccatgaggattaactgtatattaagggctgataaaattatatgttacaaaaaaattcacaagaagagaggaaatactgaggagaaaatggcagattgtgtttgctgaatttgattgacgaagaagtcaccatgaaaatcacagtgaaccatttggaaagcaaactgccaaaaaataatagttagtcatgctctcaggctggtaattgaaagttttgttcaaatcgtacttaatattcaataattgtttaaccataccactgcttatcttgggaatgctgatactatggagacaataagataaggtggctgctgaaaatcagatttagacactactttg

SEQ ID NO: 197354 - DNA, 849 bp, Homo sapiens
ctagtagattaaaactgaaccttatccatgaaatgtctgggttcttgataaccaagcttatctaaggctccgtgtgctaacggcattacagttaagtgtgtcatatggcaggggcaggggaccaagatggccaactagaaatagcggcaatcagaggctcccatcgaaaagagccaaaataagtatgtgaatctttcaccagcaaccaaggtatccagcttctctcatcagaactgactaggaagctggcatgctccacagagagaaaggaggtgcagtgtggtgtagcagcccacctgagagccacacgagcaggggagcctccaccacccagccaagggaggtggtgagtgagcatgctacccaggctgggaaaccgtgcttttaccacagaaatgtgcaacacatgaagtggaagatcccactcacaaacccatgccacggagccatgcagattatcaacagcctctcagctggaataggcttaagcctaccaatctcccagggggaggggcgaccagcaccacagctgcagctgcctgctgtctcagccatctgagcttcttggggaaggggcagcattcagcactgggactcacaacttcctaacacactaaggtccctgggcaggagaagggtggcattcatctctatagctccaggctgtgcttttcccctgctggaaccagggaggctggacagcttggtcccaagatgtgtcccccacagccaacacaccagctgtggaagactgcagcagagtgctcttcaggcctgaccccgactcattattcctcactgggcggggcttccatgcaagaactcccgtaactccagccagaggctcag

SEQ ID NO: 197355 - DNA, 321 bp, Homo sapiens
atactgatatgcacagtgaagtccaagctgtcgaggtctcagatggaaagaatgaacttattggcaactggagtaaatgacatgtttgttatcccttagcaaagaagttggctgtattatgtccatgctctagatatctgtgaaagtttgaacttgagagtgatgatctcgtgtgtctgacggaatgaatttctaagcagcaaaatgttcaagacgttgtgtggccacttctaacaacctactctctgatgcaggagcaaagaaataagatggaatatttattattttattttattgtactttaagttctgagatacatgt

SEQ ID NO: 197356 - DNA, 504 bp, Homo sapiens
gctgggtatggtggcacgtgcagtgaaccacagtcatgccactgcactccagcctgggcgacacagtgaggccctgtctcaaaaaaaataaaatgacaaacatttgcatcaattgttttatgcttcatgggttcattaaatattcaacgctccttgttcagtttctacttatgtttattggcacctatcacttcttaatctcaaaggattttgattggcctgtttatgtctcgtgcttagtaatagccaacatgatacagtatttgtactatggtacgctaagctaaagagtgtatcattatcgctgtacaataatctgtagaaaactctattccttgcaaacttgaggcagcacttttagcgttgtataaatgcatgcagaaataataccatattcagaattctttcagaattagagtactcatgctttagaaaatactgggtttcttatctcttaatgtgtgtaaaataaacttggaatgtccaataaaaaaaaaaaacaaa

SEQ ID NO: 197357 - DNA, 99 bp, Homo sapiens
cctaatctgtcctgttatacagtatgtgatataaattaaataaattgtgttcctttggtagttaatgtaagtttggttgaataaaattttcccatgata

SEQ ID NO: 197358 - DNA, 214 bp, Homo sapiens
gtttggctgtctggtgagagctgcatttggaggaatgctgcgtccttacatagacggtgggaggtagaaggtggaagggcaggtgagccccgtgctgggcgaagcctcttttatgagggccttaatcccactcatgaggaaggagaccccctcgcctaatcacctatcacaggccccatctgttaatcctctcacattggcagcacctgaattt

SEQ ID NO: 197359 - DNA, 889 bp, Homo sapiens
gttcaagaccagcctggccaacatggtgaaacccttgtctgttaaaaatacaaaaattagctgggtgtcttggcgcacatctgtaatccgagctaccctggaggctgaggcaggagaattgcttgaatccaggaggcggaggttgcagtgagccaagatcgtgccactgcactccagcctgaacaacagagcaagaatccatctcaaaaaacaaacaaacttgattgctaaaaaatgctaatgattatctaaaccttcagtgagtcataatctttttgctcacgcctcaaggttgatggctgctgactgatgacagccatggttgttgaaggttggggtggctatggcaatttcttaagacaacagtgttcaacttttctgttttcttgcctgtgctttggatgtcctgtataagagtccatggccaaatctgaggtcatgatgattttctcatgttttcttttaagaattttatagaattagccgttaaatttagctctttaactcaaatgttcaatttgagtatgggtaaggattaaagacacatgggtttatttctggattctcaattctattctacttgtctgtatgtctgtctttgatactaccacactgtcttgattaccaacttcctttagagtaagttttaaaattggaacatgtgagtcgtccaactttattgtaccttttcaagatttttttttgactcttttgggtcccttgcaattccatatgaattttaaaatcagcttgataatttctacaaagaagccagctcaacttataatttctacaaagacgccagctcaacttctgatagggattgtgttaaagctgtagataaatttggggagtatttccattaaatcttccaatccatgaacagtgg

SEQ ID NO: 197360 - DNA, 293 bp, Homo sapiens
aagtttcagatgagtcttgacatcgggtaggataagtctctcaccctattctttttcagaaatatcctcactattcttggtgccatactcttttatgtaaaactgataattaatttaccaaattctatgaaaacccctcctgggcttttcatgggatttgcacttaatctataaatgcaacttggagagatcaaaatctctatgttactaaatcttcctgtgcgtggacatagtatatttttatatttctttaggcctctgttaaaatcatttcataaagttttaaatttttc

SEQ ID NO: 197361 - DNA, 247 bp, Homo sapiens
tcctcagactggggacagggagtgaaaggaggattccctggaagacggcatatgaactgaagttttgaagaactggcagaatttactcaaagaaaaatggctgtcaaagggcactctgggctaagaagacagcatgtgtgagggaaaggagatatgaaagaaagtggcactgccaatgttactgggagcagggtaggtagggagcaggaagaaacgtggtggtgaggtagagggggcagtgaggcag

SEQ ID NO: 197362 - DNA, 586 bp, Homo sapiens
aaaataattgattagttgcctatatttaagaattaggttattccaattataaatgtggattcctggctttatttgaaaaaccaaaagatcgaattatgctgatcctgcattctcccatgggaacaactgatcctgtgaacaggtgaatggtgacccctccatggacagggccgaaggtccccagctcagcacagctcctacttgatcctttcatttatgggtgatctcttggtccctcagtcatctgagtccaggacttcaggtttagtgagtctcaggtttagtgaatgtcttagtttgggttaccccagaccctgagacaaaaagattccagtgaaaatgattttttgggaagtgatttcaggaaacagaggcaggggagcaggggaattagagaagggagggcagctaatacagggtgtggagcaaacgagtaaccactgtaaggaactggtaactcccactgggatctgggaaaccgcatagagaacatgcctcagcattttcctatctgagacaatgttaaactttacccaagccctgtgatcctggaaaacagtgaaggttaggagtcccccagcccttc

SEQ ID NO: 197363 - DNA, 703 bp, Homo sapiens
cacagtgttgagtgaaaaaaattacagatacttaaagagtcatgaagattaaaaaaaataattttatgtatgttctagacaccagtctctgtggtcaaagtacaaacatggtctggggctatataccaagttcagatcggtggtttcctatggggagcaagagaagagaatggggtctgggagaggtgtgtcggggccttcagcgtatatttgtaacttgttatttctaaaactatgaagcaaatgtaccaaaatgtcagcactggttaaatctgggtagtgggtcagggattttgtcttcttattctctgtatttatatacatatttaaaatatgtgtaaatttttaaaaatacacgtgggtctggtgtttgtagagagggcaggactaaagctatagcattggctcaccttcacagcaggctcaggtgaatcagtgggctggggagtttcacctgggcctcggcactggccactggcacttcacacagaggcgagcaagggccttgggaagcacttatttttcacaaagcaggtagagaaagagaaggaaaacgatgggaataggaggtttcagaaaggagcagagccaggagagatgtgtcataaggaggtccaggaaagaaaaataatttctaattatggggccggtcatggtggctcatgcctgtaatcctggcactttgggaggccaaggtgagtgg

SEQ ID NO: 197364 - DNA, 501 bp, Homo sapiens
tcagagtaggcattctgcaacaagatgccaaaatcacatttatgatgcagaagtaatgttgaaggtcatggtctgcaaaattatatttggagatggaagaaagatcacaatttcaaaaggatgaggtaaaagagtcaaatttagttacaactgtctctataattcaacaataagtgagtgaaaccagctcaaggtgggagcttcaagtagcaaaacggaagccaattgtgtaattctagttggtatgcacttaatttagaaaaatttctgtggtcagccattccctaatacaaaactttgaaactgtaggccctaaagactgtgctcactcaatttaaaaggcatatcctttggtttctatatctcataggcttctgttccccttgaacaatctgtgtttcatgtatatatacacacacacaaaattgaaaagctgtatcagatattagaaaataccacatcaattgttgctttggccgaatgaaaggcctgaaaaatttg

SEQ ID NO: 197365 - DNA, 112 bp, Homo sapiens
agaaagaacacagatttggagtaaaaagagaactgggttccaattccatctctgtactctaatgagttgagaggttcttgggtgagtcacttaacctctttgaattgcagct

SEQ ID NO: 197366 - DNA, 556 bp, Homo sapiens
gtgggtgttttccgtttgcagtcttccaagccatttctgacataagaattcagctcctgtcaaggcatgtgcagtaaaggtacccttccaggtgcctagacaaatccttagtgctgtctatttgtatttagaatcctacttttttttatatttacttttttttatatatcttactttttttttgtatttagaatcctactttttttcttctttgtccgtcttcttgttattgcccttagctgaccagagactccgtgccatccagcccctttcctctcttgcctctctctaacttcttttgtgctgcagatttcaactaaattaagttctaattaaaataattttcaccttaaggtttgaatgctcaaccagcttgacactttcaaagataatttgcttttaaaattgtttatcaaaataaatctctaaataggttatgagtcattgttattaatgagattgtgtgtatcctcgaactgttttggggcagagaaaaaatgttgagaatctctcttctaaagccatgcttttgaagaaacagtcttaagagtttttc

SEQ ID NO: 197367 - DNA, 400 bp, Homo sapiens
aaatgttgcttattatcattgtggaattttataaggcttctgtgtaaatgtccttaactcatttttggtgatattctgttctagattgttctctcagcttctcctttctctcaccattctccttttgctccaagctcatgagaggttcctcaggtggttcttttttttttttaagctcaacatttaaacttcagtttcccacattatcaagcccgcattcctacataaaacccccaaaagggtaaaggattaataagttgaatatgttggtaccatttggttttggtccagaaattactggagactcatggctattctcctacaggagataaaggagaccaacaaaaatcagtttgcactgcctagaatattgtctgggaaatagtatgcagttaataag

SEQ ID NO: 197368 - DNA, 512 bp, Homo sapiens
tggtgcctggagttaaaaagtgatgggtaacatggtaagaaatggcatcagaggtgggaactttgtctcagaagttgtagtgagctgagtgatgttccccccataatatatgttcactcagaacctgtgaatgtgaccttatttggaaaacggtctttgcagaggatctcaagatgagctcattctggattagaccccaaatccaatcacacgtgtctttataggagaagaaaaacagacaagacacacagaggagaagatgatatgaagacggaggtggagattgaaatgatgcatctacaagacaaggaatgccaagaattgacagcaggcagcagaagccaggagagatgcatgaaacagattcttctttgaatcctccagaaggaatcaaccttggtgacatcttgattttggatttctggtttccaggactattagaaaataaatttccattgttttaggtcattatatttgctgtaatttattacagcagcctcaggaaactaaca

SEQ ID NO: 197369 - DNA, 706 bp, Homo sapiens
ggacagaatgtcacactcagggataacacaaccgtaaccaaggaggtgaaggggagaaagccttgtggtaccagagagccaattgtgaagcataaatatgataaactcagatgccttcaagaacaagttgggagaatctggaatcccaacatttatggctgagggccaaagacagagaaatgctatttcattattatttttatggccttttttctatctttatttttttctggagaaatgctccactgctatatttttaaaaatttagatgtaggccaggcgtggtggctcacacctataattccagtgcattgggaggttgaggcaggaggatgacttgaagtcaagagattgagaccagcctgggcaacatagtgagactctgtctctacaaaaataaaaataaaaaattagactggcatagtgctgtgttcctgtaggcctagctactcaagaggttgaggcgggaggattgcttgagcccgggagttggaggatgcagtgaattatgattgcacaactgcactccagcctggctgacagagtgagaccatttcacacacacacacacacacacaaaatctggatatataattatcttcatagactcaacttaaatagaaaagtggataatgtcacttcccttttagccaaatcaggagagactcataataaacagttaatgtatttcctagaaattttacag

SEQ ID NO: 197370 - DNA, 125 bp, Homo sapiens
gaaaaagttcaactcaggcattcacagccattcaaaatgtggtcataattcaccccactcatcaccaacacacaggagccactattcttatcagaatagtgaagtttaaagccattctctctacc

SEQ ID NO: 197371 - DNA, 346 bp, Homo sapiens
gagatccaggcagcagcggcatcacctttcaatgacctaacgtaactcctccttttcatgaggactggcaaggtcacattgtaagaagagcaagtgggatgggagatgacactgtcgcatttgaaaatgcaatttgtcacatcaggtcatgagcaggtcacctcctggtccatctgcagaaggggcccaggggattcagttctgccttctaggaaggccagtgttgggatcttagagccctgctgggaaaaaggccaggggagagttgggaacttggtcttcacaagcactcccagcttcccctctccggggtcatttaccaagtgctcagaggaattgtcgacgc

SEQ ID NO: 197372 - DNA, 354 bp, Homo sapiens
tgttgttcccagtgagcgtgtgtaccagatgtatttcaggaagttgaaagaaatggtcatgtgtgatggctcatgcccataatcccagcacagtgaggctgaggtgagaggatcatttgaggccaggaatttgagaccagtctgggcagcaaaacaagaccccatctttacaaaccataaaaaaattagctgggcatggtggcgtgtgccagtagttctagctactttgggggctgaggcgggaggatggcttaagtccagagtttgaggcggcattgagttatgatggcaccactgcactccagcctgagcgacagagaccctatctctgaaagaaattgtatttttaaaaaa

SEQ ID NO: 197373 - DNA, 1073 bp, Homo sapiens
gctaaacaatggcagggcagagagcacagcgcggattcaccccactggtttaatactctgtttcaaaccatcgatgaatgcaggctcttgttgacgtgggcattactctgcccctcaccgggatgttactgccattctgttgctaaatcaccaggatgaggttaggaaccttctccaggcctcaggctcctgctctgcaaactgaaggaactagaggtgtggttaaggtgcctgaacccccttttaggagaaatcccagcagaagatgcctaagcaagccttgcaggaagtcatctaggccaccttcaagtcagtgccaaccgcagaatctttagatcccccaaaagagcacctgtccctttgtggtgcttctgacagagaaccccaagcagccctagacctccctcaacctgactcaggggtgcccaccactccccatcctccctgacacacataatcctggctgaggcagcccaaatagcagcttccccggattactcaccgtggctctgtgagaagaatgcctctcccaggcagcgtccgcagttgtgaccacagatgggagactagcctaattggacttaccagcagctcaccttggcttcctcaaggcccagcagcaggacagggcctttctctgagcagaacttgaatgataaaagaagcaggtgaagctgatccagcctcagacagacctccagtgggcccttgagggtgtgagaggcagctctgcgggcccaccctagaactgcgtgtggacagctagaaagcctagcctttctgacattgctggcctaagaggtttcatctttagggtttttttccttctcaggctgctagcttccatctcacttaatacagaaggatggtctcaatttaagcatctgaaacaaattacttagcaaaaaccattttcgttgtatccaaacccagtgtcttcagtttgagctctctgaaattccaaacacatgttcaaaccaccaggaaagagggaaagagagactgagaagagggggactgaagcagggaagtcactatgagattctccccaaaatcccgatgttcagcctctg

SEQ ID NO: 197374 - DNA, 126 bp, Homo sapiens
caaaaaaacactttaactaacaaagggctctatatagaacagggcagatggtaggcattatgcttctcccacattctttaacaagctctaaatttttttcctgaagccctaaattttataattatg

SEQ ID NO: 197375 - DNA, 222 bp, Homo sapiens
gaagaagaaataaaaaggcatataaacacagtgaaaaatattcaattagccctctcctcaaaaaaagataagaacaaagaacagaagaggaaatgagccaggtttcagttacttggtaggctgaggcaggaggatcacctgagcaaaggagtttgaggctgcagtgagctatgattgcacctctgcaccccagcctgggtgacagggtgagaacccatcgct

SEQ ID NO: 197376 - DNA, 193 bp, Homo sapiens
cgctgtgtgccgagacccccaacaatgatgactgcggagagggaggcacctgggggaggatcattagggagaggtagaaagcagggaggcctccaggattctttcccagtgcccctggttcccagagctgatgatgcctccagggtgattggcagctctttgtttcagccccccctcacccgcctgctggccc

SEQ ID NO: 197377 - DNA, 580 bp, Homo sapiens
cttgtattttcattttcatttttttttgagacagagtctcactctgttgtcgaggatagagtgcagtggtgcaatctaggcttactgcaacctctgcctcctgggttcaagcaattcttctgcctaagcctccccagtagctgggattacagatgcccaccactacacccggctaatttttttgtatttttagtagacacaaggcttcaccatgttggccaggctggttttgaactcctgacctcaagtgatccgcctgccgcggcctcccaaagtgctaggatacaggtgtgagccaccacaccgggcctattttcattttcttaatggtacctttcaaagataagtttttaatttttaataaaattcaatttattagtttttattattagagttttctatgtcctaagaaatctttacctatcagtgtcacaagattttcttctacctattttcaaggcgttgtacaatcgttgcccttaggcctgttatccattttgagttaatttttgtatgtcatgtaaaatataagtacgaggttcattgttttgtagtggatgtgcagttattccaacatcat

SEQ ID NO: 197378 - DNA, 324 bp, Homo sapiens
gcctgtactgagggcctactgtgtgccaaccacttttcacatcttcccaattgcttggttttagagttaggcactgtccccattcttcagatgagaaagctgaggttcagagaggttaaggaggaatttgctcatatgtaagagagccagggtttgaagcaagatttatcaactccaaagcccatggctgttctattttgccaagatgcttcggaaaagtcccagggttcatggttgcacactgcttggcatggggatggggagagcccttccggcattccttctctcattcactctaataacatttatatgcctggcatcaag

SEQ ID NO: 197379 - DNA, 318 bp, Homo sapiens
tgggtctccctccttaattattaattagtcttgccattttcatttacctactcagactgggacaatgtgtttgaggaatgaactccaaccttgccactcatctgtctttatgttcctgcttctgtctccaaaggcagccctagtgtcagtgtggtatttcccatcccagcatctaaaagtcacatgggcctgccttgaaaattgctcccaaagtacctacaacatgtcaaatgtcaagtgaaataggcaattattttaaattatatttctttcctttaaaaaatatagatattgcaaactgatgtcggagttccccct

SEQ ID NO: 197380 - DNA, 343 bp, Homo sapiens
ctctggattgtttttagtctagtgaagggaggaaaactatctcaaaggagaaggaaaacctgccccattgaaatggtgcgagaacctgaaagttaaaatgcgcttggggcagagtgagcagggcacaattcactgtcttcagggaggttggtcactgagcactcagtgagccagggtggggctgggagatgtcctaggggatagggtgacctcacctgacattggaatcagataaatgtctgtattccaggtcagcattgcctctccctgggtttgtaaacccttgaaaaggtttatttgcttatttgatcctgtttttcattaaatgtagaatgtattttat

SEQ ID NO: 197381 - DNA, 398 bp, Homo sapiens
caatatctcattcccagtgtcatgtttgcagccaaccagtaacatctcattctcagccctgcctcttgcctctgttaaaagaggtgggaagagggggtcgtttttgaggtctctttaagctctgctgttctctggactggttggttagctgacctttccctggtgggagagtaagaaactccagtgccagccttagagttattctggtgcaatgccttgaacctctttgacacagtggcatctccatatcttagttgtggcttgggagcctgctctttctcttccagaaatgtgaacaagccagtgtgtttttagggacctaaaagtgatctgtttcattggacacatataatgtaatagatgaaaagataataactttttcagctctggctcctccc

SEQ ID NO: 197382 - DNA, 509 bp, Homo sapiens
  misc_feature (12)..(12): n is a, c, g, or t
gtgtgagaggcnacttggagtggcacacactgacactcacatgcccagacgtccctgtcgaagcgagagacgcagatggggctagagcagaggtgttgcgggagcccgggagagttgaaatatgccagggagtgtgggagccaagcatgggggctcgaaggcaggggcggggacagttggccaagagtcaaagaaagggggtttgatatcaccctcccaccgaaagcagctcaaagtccaaatgacagcctgtacagtaggcagagcactggcccagagttaaggaacctgtaccccagtctccgggcaaccagtaattccgcctaactctgggcaagtccttctcaccaagcctctgtttatctgggggaaagtcagtggtttttttcaatcatctccctctgcctttttttaaagagaggatctcactctgtcatccaggctggagtccagaggcgtgaacatggctcactgtagctttgacctcctgggctcaagtgatcctcctg

SEQ ID NO: 197383 - DNA, 659 bp, Homo sapiens
gatctttgacaaagttgccaagaatatacattggggaaagggtaccctcttcaataaatggtgctgggataactggataagcatatgtggaaaaacgaaactgggcctttgtctctctccttatataaaatcaatcaagatggattgaagacttaaatgtaagacccaaaagtataaaactactaggagaaaacataggaaaagctcttcagaacattggtctaggcaaagattttatggctcagacctcaaaagcacaggcaacaaaaacaaaaataacaggactacattaaactaaaatgtctctgcactgcaaaagaaataacaaacagagtaaagagacaacaccctttttttgtttggttttagagacagggttttgctctgtcacccaggctggagtgcatgggcacaatcatagctcactgcagcctcaaattcctgggctcaagtgattctcatgtctcagcctcccaaatagctgagagtacagtgtgtgtcaccacatccaactagtttatttatttacttttgtagagacaggatcttgctatattgcccaggctggtctcaaactctggcttcaagtgaacctctcatctcgggatgaggcgctactgtcctaaaagcatggcctctccttttcgggcagtccacct

SEQ ID NO: 197384 - DNA, 999 bp, Homo sapiens
atcacaattcatcttgaaaagagcttttttccctcctaccacatacaccattcttagggagcaatgaggtaacaggtctgtgttgtctagatctttgctttttatccccctatcagtccagggcatatactaacctgcaaactgattctgaatcaggaaggtggtaatcaataagtattctggctgggaaagaccgtgggcccaatgatcaaagtcttcttggtgctgttcattaattcttgtgccttttggcttgttttctagagtttctgggctttggctgctgatactgcctttcttagactgtaatttttatctgcatgcccagtttctgacctatcaacttgggttttattgtgcactctaactgagcttgtcttcataattttctgtttattgccctgggcttggatatgtctcaagacactcatgtgaatcatgccaccccaaatcctggcttatcaagtcccagactataaattatgaactcccattagcttggtactaacatatacttgatgtaggtatttatggacttgatgatccaagaatattatattcttcaaaatggttaagctccatggagttagatgactacacttaatgctattaagttgaacttttgaatgtcaactaatttgcaatcaattaaagatacatatgcctagaaattttgaaatttcggtatatttatccagttaaagggctaaattatataagcaaacactactttttttaaaacgtctggactcaaaaaatgctttgttccatgttttaaaatttttaagtagcagtctcaaagttgcttagctgtttattttgctatgttcctagctaagagtttggttataggagttcatcaataacttattttttgtacagttcccacattagatactgtttaaaagttcttttttaaactcaattttttttagaaacataagagaaatatttagatacatacaaatgtttttatgattaaataattttatgcttatt

SEQ ID NO: 197385 - DNA, 152 bp, Homo sapiens
atgagactggcaaggtaggcaggaataaaatgatcatcagagttcttggatgttgttccagggattttggactttaccttaaaggaatcaagggataatccaatcagattgtgctttagaagtagagaaggattggaggggtgttaggcgac

SEQ ID NO: 197386 - DNA, 204 bp, Homo sapiens
aggaacgtgatcagagatgtgtagcatttctgggtctggccctaaaacatccccatatgtgatcctccttgcctccttccctacactgagttgatgaaagtgactgtagtaacctagtaagtcatgtgctaaagataacagaaccacagaaaggaaggagcttgagtcattgctttgaggagagctgtctgctgatcaagaaca

SEQ ID NO: 197387 - DNA, 424 bp, Homo sapiens
ctgatgtatccccaacaccccttagtgaacatacattcaaagtggatgaggatattttacctgattagtaaattccatctcccacttccatgcacagtatttaaacagccaccagtgcaagtgtgtataatggaccatcatagtcttataagtgttctgaggctcatagcaacaatttcttatgacgggaaaaaaatcattgcctctcaaagaaaccaacattttatttcagtgacagataccaagtaaaaacagtacttgtattatttttctttttaggagtttgatacttttcttgtattaaccttgacttcaaagaaaaatcataggcttacatcaaaaacacttgggaaatttgtcttggctctgttccaatgaggccagttattctaaaaggggttactggattgtgttgggccttcat

SEQ ID NO: 197388 - DNA, 537 bp, Homo sapiens
acagcagctgtaaacccagcagcacatcaaaagcatgtgaggagcttttcaaagaacaccaatgtctaggcagcacagacattccgattcacatccagggtggggccccattttctgctgtatcccctcagcggctggttctgagaggcagccaagacggatcccatatggttcggcccagaatgcccttccccgactctgccggcttggcaaacttccacttgttttcaaaactcttcttagactgagactggcagaagccacctctgaaccttcctatccactgcccataattactcctccttctgtcctacttcacatcatggtgcatgtccacgactgtgtgtcatacggtacagtgacagctcctcacttcagttcccttcactgacctgagcaccgggtaccttgcttatcaattactgtatgcttatcaaacctatcctaaagcatttcaagatcaggagtgcgctttccacctacactcctccaaaagtcacactgtgaccatgtttcaaagggggaattcaaatgctg

SEQ ID NO: 197389 - DNA, 286 bp, Homo sapiens
aggattcacgtatcttcgtcccatcaggccgcatggtatgcttttaaatcaggagacagatcatgtcgcctctctgctcagaatattcttgctgttacaatctcagtcagagtaaaagccaaagccccagcaatagcctccccatagctaggactactggtgagcaccacaacacccagctttttttttttttttttttttaattgtagagagaagccttgctatgttgcccaagctggcctcaaaatcacaccctcaagagatctgctcacctcgacaacctgat

SEQ ID NO: 197390 - DNA, 335 bp, Homo sapiens
aggttttatatagcaaaagaaccatttaaagacttgggttacaaatgtattttattttacctctggcatgccttgggctgagaaagcattatatggtgacacagtatttgtaacattctcatagccatctggcggtggttcaaggtatgacattttgaaaatctagcaagaattaaaatatgtcaagttagagataaaaattccagattattattaagatataattcattttgccccaagtatatacttcagattaagcatcctggaactaggttctataattaaatagataaattacactgacaacaatgagaaagagccttatcattattatt

SEQ ID NO: 197391 - DNA, 1314 bp, Homo sapiens
gcccggccccctcccccgccatgaagaagctgtgggtgaagaagcgtttccagaaaaccggccattcccgccgggcctttggcgactcacccatgttttccgctcctgcagaaagcaaagttacgactcagagacggctgaggatgacatcagcgatgtgcagggaacccagcgcctggagcttcgggatgacggggccttcagcacccccacggggggttctgacaccctggtgggcacctccctggacacacccccgacctccgtgacaggcacctcagaggagcaagtgagctggtggggcagcgggcagacggtcctggagcaggaagcgggcagtgggggtggcacccgccgcctcccgggcagcccaagcagcgtccctcagagcgggttgcgcagggaggagcccgaccttcagcctcaactggccagcgaagccccacgccgccctgcccagccgcctccttccaaatccgcgctgctccccccaccgtcccctcgggtcgggaagcggtccccgccgggacccccggcccagcccgcggccacccccacgtcgccccaccgtcgcactcaggagcctgtgctgcccgaggacaccaccaccgaagagaagcgagggaagaagtccaagtcgtccgggccctccctggcgggcaccgcggaatcccgaccccagacgccactgagcgaggcctcaggccgcctgtcggcgttgggccgatcgcctaggctggtgcgcgccggctcccgcatcctggacaagctgcagttcttcgaggagcgacggcgcagcctggagcgcagcgactcgccgccggcgcccctgcggccctgggtgcccctgcgcaaggcccgctctctggagcagcccaagtcggagcgcggcgcaccgtggggcacccccggggcctcgcaggaagaactgcgggcgccaggcagcgtggccgagcggcgccgcctgttccagcagaaagcggcctcgctggacgagcgcacgcgtcagcgcagcccggcctcagacctcgagctgcgcttcgcccaggagctgggccgcatccgccgctccacgtcgcgggaggagctggtgcgctcgcacgagtccctgcgcgccacgctgcagcgtgccccatcccctcgagagcccggcgagcccccgctcttctctcggccctccacccccaagacatcgcgggccgtgagccccgccgccgcccagccgccctctccgagcagcgcggagaagccgggggacgagcctgggaggcccaggagccgcgggccggcgggcaggacagagccgggggaagg

SEQ ID NO: 197392 - DNA, 2370 bp, Homo sapiens
gcccggccccctcccccgccatgaagaagctgtgggtgaagaagcgtttccagaaaaccggccattcccgccgggcctttggcgactcacccatggtgcgtggaccgtgggcgtccttgctctagcccatgcctactcctcctcttggtccctgtccctctgtgaggcatcgagttcctgaagacagcccatgagatgtggaaccctcccactcacccccacacttatctaccacccacccgaccaggccccctgtgccctacagctgagagaggacccagcagaagggagggcggctcactagcacacccctgcatggactgggtgccctgttctccatgtgaggcctaatgggaaggagttcattgccatgctttggcaaccagtacgtggctcctgcttgtcatggcagccagagggaaactgaggcacagaacctgctagaatctgggaaagttgaaaatactcccaggaaccttttctcctaacctaaccactgggcatttttgaggacgattcaacagtagaagggagggaccttgaggaaggtgcctgtcacatcatgatgcagacagataaggggttggtttgcaaagaggggtcaaagcacaatgcaaatattgtaatagagggtgggcctgactcctaatgggaggcccaggtctgcggctggactggacacaagcaggtgtgtgtgtgtgtgtgtgcatgtgtgtgtgtggccagtggcagcaccagtaagtgccaaggataccagaaccactggggcagctggaataacaagcccaagtatgggggtccccagtgctgggcacatcccaggtatctccctccccacccattgccacaggacacctctggggactgggtgcctcacgccccttctgtcttgactgccctccatgccctgccccacaaacgctctgataacagtctgtccctgtctctctcctgctgctcctatggaagcgaagttttccgctcctgcagaaagcaaagttacgactcagagacggctgaggatgacatcagcgatgtgcagggaacccagcgcctggagcttcgggatgacggggccttcagcacccccacggggggttctgacaccctggtgggcacctccctggacacacccccgacctccgtgacaggcacctcagaggagcaagtgagctggtggggcagcgggcagacggtcctggagcaggaagcgggcagtgggggtggcacccgccgcctcccgggcagcccaaggcaagcacaggcaaccggggccgggccacggcacctgggggtggagccgctggtgcgggcatctcgagctaatctggtgggcgcaagctgggggtcagaggatagcctttccgtggccagtgacctgtacggcagcgcattcagcctgtacagaggacgggcgctctctatccacgtcagcgtccctcagagcgggttgcgcagggaggagcccgaccttcagcctcaactggccagcgaagccccacgccgccctgcccagccgcctccttccaaatccgcgctgctccccccaccgtcccctcgggtcgggaagcggtccccgccgggacccccggcccagcccgcggccacccccacgtcgccccaccgtcgcactcaggagcctgtgctgcccgaggacaccaccaccgaagagaagcgagggaagaagtccaagtcgtccgggccctccctggcgggcaccgcggaatcccgaccccagacgccactgagcgaggcctcaggccgcctgtcggcgttgggccgatcgcctaggctggtgcgcgccggctcccgcatcctggacaagctgcagttcttcgaggagcgacggcgcagcctggagcgcagcgactcgccgccggcgcccctgcggccctgggtgcccctgcgcaaggcccgctctctggagcagcccaagtcggagcgcggcgcaccgtggggcacccccggggcctcgcaggaagaactgcgggcgccaggcagcgtggccgagcggcgccgcctgttccagcagaaagcggcctcgctggacgagcgcacgcgtcagcgcagcccggcctcagacctcgagctgcgcttcgcccaggagctgggccgcatccgccgctccacgtcgcgggaggagctggtgcgctcgcacgagtccctgcgcgccacgctgcagcgtgccccatcccctcgagagcccggcgagcccccgctcttctctcggccctccacccccaagacatcgcgggccgtgagccccgccgccgcccagccgccctctccgagcagcgcggagaagccgggggacgagcctgggaggcccaggagccgcgggccggcgggcaggacagagccgggggaagg

SEQ ID NO: 197393 - DNA, 192 bp, Homo sapiens
ctggttttttcgatctgcttcttctgtcagttacatttctcttagattatggacttgtccatttctcttttcagttctatcaatttttgatttttaagtgtgcatatatctataaagccatgttattaggcgcaaacaattttaaaatctttttatcgatataaagtgacctctttatcttaagtacttttt

SEQ ID NO: 197394 - DNA, 499 bp, Homo sapiens
atcccatgagacttctggcaaggggatctaccaagggccaaaaactggttttaaatgaataatagttaagatgttattttgcccttttccattctcaattcactttatgagtgtaccagtggagtttttccagaggttacaatggcttgtgagatgtcatggctgtgactgatggaatatatactgtgtgtcccttgttttaaaagttgctcagttttggccagccgtgatgactcacacctataatcccagcactttgggaggccgaggtgggcagatcacttgaggtcagaagttcgagatcagcctggccaacatggcaaaaccccatgtctactaaaaataaaaaattagctgggcatggtggcacgcaccttaatcccagctacgtgggaggctgaggcaagagaatcgcttgaacccaggaggtggaggttgcagtgagctgagattgtgccactgcactctagcctgggagacagagcaagactccatctca

SEQ ID NO: 197395 - DNA, 374 bp, Homo sapiens
atccatgtcaccatgggtgctcagtacctgccctggagcagagatggagcagagaggggctgggagcctggccagagccctcaggcagctccctccagcctccacttcaaggcagtgatgcaaaacaggcccagctgctgtgttcctcttccccaagtactgggttgaggtgggggaagtccaggaaacctttcctggtgtttgtttataccacgagccccacgtttccttagcctctttcctgcccaggcatcagcttcctggcattggcttgcccactcccagggagtgcctcttctttgtgatctcttgtaaagggctggcatgaaatgggctgggatgtgagacaaggcactcccttggccctgggctct

SEQ ID NO: 197396 - DNA, 578 bp, Homo sapiens
gtgtttctaagcagtgatcatcaatagctgctaaaaatcatcagttggatcaagctgacaacatctgaatctaccagttggttttaaaatcacaaaaagacaggcaaacattgctgtgtctccttgtatgatttgacagtggatgtctgtgatggtcaccaaaaattcaaacatggacttcatcacatccctagatataactactagtttacaatgaaatgcaggggaaattgattgaccacggggtgcagtccagaataggggaaattctactacacaaataccaagttttctcaacaaacaaatggctagaaaaaattttaaaagaggggaggggctggttattagaagaaacctaaaaggcttatcagccaaatgaaatatgtaggccttatttagatcctgatttaaactaactgtacaaagacatttttatgctttaatttagtgctatttgaatattaggtgatgctaagaattgattattttaaggtatgatcatggcattgtggttatgtttttaagtcctgtctcttacagtacatattgaagtatttacaaatcaaaacgagataatg

SEQ ID NO: 197397 - DNA, 419 bp, Homo sapiens
ttctgaggtttgaataagagtattgaggtaaagacctatccagatatttagggaaaatggggaaattatttctcatagcaaccatggcagtgagaaagatgctttctccctagaaaaggataaaaatgcatgcagccaccatacctggtcacagattttttaatggggagtaaagcactataatatagcagaacaagagtaggaatacaaagatacttttaattttttacatgttataaactgtctgacactgggagtattgtttcatctgagatactgttttttaacttgtaacaaagctgtaacacttatcttttttacccctcctttgctgcttccagattccaccgctgttaaaaataacatgtcggccgggtgcgttggctcacgcctgtaatcccagcactttgggaggccga

SEQ ID NO: 197398 - DNA, 316 bp, Homo sapiens
gttttaagctgagccaacctaaggtcccacagatcaattatattatggagcccttttctttagagaatatgcctttttccattcttggatatctctgttacagtagactcttgaataatgtgggggttggggtgccaatcccctaagcagttgaaaaatgatgtataacttttgactcccccaaaacttaactactaatagccttctgttgactggacaccttactgataatgtaaatagtctattaaacatattttatatgttatatatattaaatactgtattcttacaataaagtaagcaagagaaaagaaaa

SEQ ID NO: 197399 - DNA, 1037 bp, Homo sapiens
tttaaatgtaccttttaataatatagtctctaattttatgctgacagaggaccctgcagactggtctcatgataggaaaatatcaggtgtggagaggcagacatgttccataggaaattttagagaaagcctggaattgttcaccttttcctcattaatctttgatgacattagacatttaattcacttggcaaaatcagttttttcaaaatctggcatgtaatggtttcataaaagccttgggtggcttctaggaaaatataagtagttgaaagtttcttgtacattttcattttaatatttaatcaggacaaaagagtacagttttagaaatcctgggctcttactcatgagctctacaaaattttaatggagaacatttgaagccagtggttttgccataaagtggtcatccctctccagcgcttcctctcctggtctttgaatgtttcaggactggtcttgagagctgcatatgttgttccctgcatatcgaaaggacacttctcatagaccgtgaagtgagtgagtcctctggagttgtacaacctataacattcctgatgaaaacaccatttcattgctcttgctactgaaaccaaaagcctttgtggtatcctttactctgcttttgtccctcgctgtctttattaaatctatggggagtctcaatagcagtgcatacataattcttccagaatctgcctctgtcacttacaccactgttaccactttggggtggagcatggcaccttctcttacctggaaaactgtgataccctcctaactagtttgtctggctcccgttgtccttctacagtcttgatttcccagcagccagcgtgatatttttccaaaataaaggaatgtcctttcctctgctcaaaacctcccaaatctttctgtatcttttggactaaaatccagtgtcactgtcatggcttgcaaggaatacacgctccctatgatctgcccctaccacctcccatcacctttgacacacttgtttactacttctgctccagctgtagagacaa

SEQ ID NO: 197400 - DNA, 230 bp, Homo sapiens
gttggaggtaggcagcagcttcctctacacctgctctctctggccagctcagctcccagtcccaccctggccttggagcaagcagtcagggtaggtactgtaagccttgagctctgccaaaggccatgaggcttgcctaatgggatggagcttttccctggctgggatgggtgggcaggcaccaggcttcctcttagggagggagggctgtaaatgggggtgggtgggag

SEQ ID NO: 197401 - DNA, 246 bp, Homo sapiens
aggtctataaagggaattttggaatactcttaatagatctgttcttgaaataagtcagctaaactgagtgaggtgctttgccaacacattaactgaaagtcctgaccaaccctgatcccagaccttcatggacaattctcttgttttatttccatttccagtagttgtatgtaattcttctaagagacttgttccaagccaaccttcctagtggtcttgttgaaatgagatagtggttgtaggtat

SEQ ID NO: 197402 - DNA, 264 bp, Homo sapiens
tgagccacagagcctggccatctccactttttcttatcccccaaaaggattaacatccctggctttatgtagaatagtgtacgctgccacatcagtgtttgagtcattccccagaggagaggggaatcccccctccattttttttttggcaacatcttgtcttcccttggctgttgcttcccccaacacacttggtttggttctatcctgtacttcagatttgtttttggtttggtttttttcatattgaaaagatgaccatga

SEQ ID NO: 197403 - DNA, 233 bp, Homo sapiens
atacaaggtaaggagactcgtttgtgaatggccttgaatgacagcctaatagcatgaattttagtatgtaatacaaactttattaatttaaaaccttctacaattttaggtataagttcactcatggcaatctttgtagatcatagttttgggcctttaagtcattaagtcatttgggcctttaagtcatttaatatttaagtcattaaatcttatgaaataacatagtttag

SEQ ID NO: 197404 - DNA, 334 bp, Homo sapiens
tggtgtgtgttaccttgtctgggcttccatgtctggctgtgttgtgatttgactctagtttttggcctggtggtcaggaagagatggggggatacacgtgcctggggtgggcacgtatgatagcatctttggatcatctttaagcaaggtgacaccctagcctgtgttagggaggagtgggtcagtactgcaggcctgggggttcaggagaatctggagagcagggtcttcaggtaaattgacctggtgtctccattccaagtctcaggccctgttctccaattagagccctgatgtcgacgcggccgcgaatttagtagtagtaggcggccgc

SEQ ID NO: 197405 - DNA, 284 bp, Homo sapiens
tgtcatttaagaccacatctccattcacctgcctcccattcccagaatctgcggtcacggtcttaggtggctgtcggggtattttggtggaaatttttagaaagcccttggaggggaatcaaacaggtgactgaaactgctggtgtgcttttaagagaagttggaagaagagacattctctgtgcacagggtagtaaatgcacatgcctgcaggctcagggcacagcctgcccagccacatctactagggagtgatgggaagtgtggtaaaatggaaaagatct

SEQ ID NO: 197406 - DNA, 508 bp, Homo sapiens
agatttgacagaaaaagaatcagcaaacttgaagacagatctgttgaaattaacctctctgagaaaaagaaagaaacaagaatgaagaacaatgagcaaaacttctaaaacctttgggataccaccaaatgtacccatatacacataaaaaaagagaaaggggcagaatattggaagaaagaatggttgaaaatgtctcacatttgatggaaaatattaatctacctatccaagaagctcagtgaactccaagtaggttaaactcaaagagctccatacctagacatatcataatcaaaccctcaaaagacagaattttgaaagaggcaagataaaagcaactcatcacacaagggagtctcaataagatttacaactgacttctcatcagaaaccatggaaacaagaaggcaatgggtacatttaaaaataactaagtataattggattgtttgtcacaaaggataaatgcttgaggcactagataccccattttccatgatgtgat

SEQ ID NO: 197407 - DNA, 691 bp, Homo sapiens
tgtcctcacctgcactgactcttcacccacaaaattctattctagctagcttgggagaattctagtccagccccgcatcctgaaaaatggaggcccagggaacctgagtgacttggacccaaccaagataatggcaggcccagtcgcccttgctcacaggacaaaccagtcctttcgtggtggacctggggtggggtgggggcagtcacttgcagacattgggtgtcctcctttcccatgctgattaggatcctccccaactgtagcccatcctaccccagcatctgtgagacgcttgagacccccaagtctccccacagcccagcctccacctcagagagcccagtgggttttgaaagccactgttaggctgtgtgctgaggaactgattatttaatgttatagcaacaaccctacaatgaagatcttatctctacccagctgcctaggcagggtattttgaacctttatcatcttgacaccaaagactttttttcccttttagaataataactaagggacattgtcccaaatttctcatagatgagtaatctatgtcaagaaataattgagggtgggcacggtggctcacacctgtaatcgcagcactttgtgaggccaaggcaggtggatcacctgaggtcaggagttcaagaccagcctgggcaacatggtgaaaccttgtctacta

SEQ ID NO: 197408 - DNA, 6278 bp, Homo sapiens
aagggagccccgctcagcgcggggagcgcccggccccctccccgccccatgcgcccgcggctctgaagcctgagcggggccgggggctgggcggggccggggcccgccgtaggcatggcgtccgggagccggtggcggccgacaccgccgccgctgctgttgctgctgctgctggcgctggcggcgcgcgcggacggcctggagttcggcggcggccccgggcagtgggctcgctacgcgcgctgggcgggcgcggcgagcagcggcgagctcagcttcagcctgcgcaccaacgccacgcgcgcgctgctgctctacctggacgacggcggcgactgcgacttcctggagctgctgctggtggacggccgcctgcggctgcgcttcacgctttcgtgcgccgagccggccacgctgcagctggacacgccggtggccgacgaccgctggcacatggtgctgctgacccgcgacgcgcgccgcacggcgctggcggtggacggcgaggcccgcgccgccgaggtgcgctccaagcggcgcgagatgcaggtggccagcgacctgttcgtgggcggcatcccgcccgacgtgcgcctctcggcgcttacgctgagcaccgtcaagtacgagccgcccttccgcggtctcttggccaacctgaagctgggcgagcggccccccgcgctgctgggcagccagggcctgcgcggcgccaccgccgacccgctgtgcgcgcccgcgcgcaacccctgcgccaacggcggcctctgcaccgtgctggcccccggcgaggtgggctgcgactgcagccacacgggcttcggcggcaagttctgcagcgaagaggagcaccccatggaaggtccggctcacctgacgttaaacagcgaagtagggtccttactgttctccgaggggggggccgggagaggaggagccggcgatgtgcaccagccaacaaaaggcaaggaggagtttgtggcgaccttcaaaggcaatgagttcttctgctacgacctgtcacacaaccccatccagagcagcactgatgagatcacactggccttccgcaccctgcaacgcaacggcctgatgctgcatacaggcaagtcggccgactacgtcaacctgtccctcaagtctggggctgtctggctggtcatcaacctaggctcaggtgccttcgaggcccttgtggaacccgtcaatggcaagttcaacgacaacgcctggcacgacgtccgggtcacccgaaacctgcgccagcacgcagggattggacacgctatggtaaacaaactgcattatctggtgaccatctcggtggacgggatcctgaccaccacaggctacacgcaggaggattacaccatgctgggctctgatgacttcttctacattgggggcagccccaacacagctgacctgccgggctcgcccgtcagcaacaacttcatgggctgcctcaaggacgtggtctataagaacaatgacttcaaattggaactatcccgcctggcaaaggaaggggaccccaagatgaagctgcagggggacttgtcattccgctgtgaggatgtggctgccctggaccctgtgacctttgagagtcccgaggcctttgtggcgctgccccgctggagcgctaagcgcactggctccatctccctagacttccgcaccaccgagcccaatgggctgctgctcttcagccagggccggcgggctgggggtggagctggcagccacagctctgctcagcgggccgactactttgccatggagctattggacggccacctctatcttctgctggacatgggatctgggggcatcaagctgcgggcatccagccgcaaggtcaatgatggcgagtggtgtcacgtggacttccagagggatgggcgaaaaggctccatctcagtgaatagtcgcagcacgccgttcttggccactggagacagcgagattctggacctggagagtgagctgtacctgggcggtctccctgaggggggccgggtggacctgcccctgcccccagaggtgtggacagcagcactccgggcaggctacgtgggctgtgtgcgggacctcttcatagatgggcgtagccgagacctccggggcctggctgaggctcagggggctgtgggcgttgcccccttttgctcccgggagacgctgaagcagtgtgcatctgccccctgtcgcaatgggggcgtctgtcgagaaggctggaaccgcttcatctgtgactgcatcgggaccggctttcttgggcgggtctgtgagagagaggccacggtcctgagctacgatggctccatgtacatgaagatcatgctgcctaacgccatgcacacggaggcagaggatgtgtccctgcgtttcatgtcccagcgggcctacggactcatgatggccaccacttccagggagtctgccgacaccctacgcctggagctggatggggggcagatgaagctcactgtcaacctcgactgcctgcgcgtcggctgcgcacccagtaaaggccccgaaacgctgtttgcggggcacaagctcaatgacaatgagtggcacacggtgagggtggtccggcgtggcaagagcctgcagctgtctgtggacaacgtgactgtggagggacagatggcaggagcccatatgcggctggagttccacaacattgagacgggcatcatgacggagcggcggtttatctccgtggtgccctccaacttcatcgggcatctgagtgggctcgtgttcaatggccagccctacatggaccagtgcaaggatggtgacatcacctactgtgagctcaatgctcgctttggcctgcgtgccattgtggccgatcccgtcaccttcaagagtcgcagcagctacctggcactcgccacgctccaagcctatgcttccatgcacctcttcttccagttcaagaccacggcccctgatgggcttcttctgttcaactcgggcaacggcaatgacttcattgtcatcgagctggtcaaggggtacatccactacgtgtttgacctggggaatggcccgtccttgatgaaggggaactcagacaaaccagtcaatgacaaccagtggcacaacgtggtggtgtccagggacccaggcaacgtgcacacgctcaagattgactcccgcactgtcacgcagcactccaatggcgcccgaaacctcgatctcaaaggggagttgtacattggcggtctgagcaagaatatgttcagcaacctgcccaagctggtggcctcccgggatggctttcagggctgcctggcctcagtggacctcaacggacgtctcccagacctcatcgccgacgccctgcaccgcattgggcaggtggagaggggctgtgatggccccagcaccacctgcactgaagagtcctgtgccaaccagggcgtctgcttgcagcagtgggatggcttcacctgcgactgcaccatgacttcctatggaggccctgtctgcaatgatcccgggaccacatacatctttgggaaggggggagcgctcatcacctacacgtggccccccaatgacaggcccagcacgaggatggatcgcctggccgtgggcttcagcacccaccagcggagcgctgtgctggtgcgggtggacagcgcctccggccttggagactacctgcagctgcacatcgaccagggcaccgtgggggtgatctttaacgtgggcacggacgacattaccatcgacgagcccaacgccatagtaagcgacggcaaataccacgtggtgcgcttcactcgaagcggcggcaacgccaccctgcaggtggacagctggccggtcaacgagcggtacccggcaggaaactttgataacgagcgcctggcgattgctagacagagaatcccctaccggcttggtcgagtagtagatgagtggctgctcgacaaaggccgccagctgaccatcttcaacagccaggctgccatcaagatcgggggccgggatcagggccgccccttccagggccaggtgtccggcctctactacaatgggctcaaggtgctggcgctggccgccgagagcgaccccaatgtgcggactgagggtcacctgcgcctggtgggggaggggccgtccgtgctgctcagtgcggagaccacggccaccaccctgctggctgacatggccaccaccatcatggagactaccaccaccatggccactaccaccacgcgccggggccgctcccccacactgagggacagcaccacccagaacacagatgacctgctggtggcctctgctgagtgtccaagcgatgatgaggacctggaggagtgtgagcccagtactggaggagagttaatattgcccattatcacggaggactccttagacccccctcccgtggccacccgatcccccttcgtgcccccgccccctaccttctaccccttcctcacgggagtgggcgccacccaagacacgctgcccccgcccgccgcgcgccgcccgccctctgggggcccgtgccaggccgagcgggacgacagcgactgcgaggagcccatcgaggcctcgggcttcgcctccggggaggtctttgactccagcctcccccccacggacgacgaggacttttacaccacctttcccctggtcacggaccgcaccaccctcctgtcaccccgcaaacccgctccccggcccaacctcaggacagatggggccacgggcgcccctggggtgctgtttgccccctccgccccggcccccaacctgccggcgggaaaaatgaaccaccgagacccgcttcagcccttgctggagaacccgcccttggggcccggggcccccacgtcctttgagccgcggaggccccctcccctgcgccccggcgtgacctcagcccccggcttcccccatctgcccacagccaaccccacagggcctggggagcggggcccgccgggcgcagtggaggtgatccgggagtccagcagcaccacgggcatggtggtgggcattgtggcggcggcggcgctctgcatcctcatcctcctctacgccatgtataagtaccgcaatcgtgatgagggctcctaccaggtggaccagagccgaaactacatcagtaactcggcccagagcaatggggcggtggtgaaagagaaggccccggctgcccccaagacgcccagcaaggccaagaagaacaaagacaaggagtattatgtctgagcccccggcactgcgccccactgccagctgcccctcctgggagggcccgggaggagggtgccaccctctccctgccaggggcctggggaccctctccctggctgcctcaggcttctcttacgaagaggaaacgcaaaaaaagaaaaggaaaaaccccgtgctcgcccccttcctcctgccgtccactgcgcggcctcgtcagtcccggggctgactgtccctctcagctctgcgcctgccaggcagggcacgtgctcacagccctgggttgatttatttttttaagggggtagttttattttggtggggttgggtgggaaggaaggctgggggttttgtaaagtgtccactgctcgtcctgttaattttcctcaatttttcttcttcttccttctgtccctcctgccttccttctcttcccaagccctccaatccccatcccaggcttgctgtgtctcactgtccccaccctccttccctacttctttttttgtgtgtctggtttctcccttcctttcctccctttgggtttccagagtcggtgggagaagggcgggagggtgggcccgagtggcccagtgggtgggtggggtggggtggggcaagtgccccaactcccctcaccaggagaggcacctgcttggtgccgcccagggaaggggctcaggcctgacggaaggcctgttctgtgtgtgccgccgggcgacgtgcattgatggggaagctgctggaggagcaggggtggggggtgggagggaggggaaaggcaaatgcagatatatattacagacaaatactctagattccacgagcagcagcctgtggcacccgctgggcgcgggcagcagggaagagggagcaaggcattgtccacagactgctggggtcacttctttgcccacgggctccctgctcccccagttttttttctctctttgttaacaaatgtgtctgagtcttggaaaacaccccaaccccggaaatgtgtgggaaaaagaaaacaaaaactttccaaattccaacgg

SEQ ID NO: 197409 - DNA, 6257 bp, Homo sapiens
aagggagccccgctcagcgcggggagcgcccggccccctccccgccccatgcgcccgcggctctgaagcctgagcggggccgggggctgggcggggccggggcccgccgtaggcatggcgtccgggagccggtggcggccgacaccgccgccgctgctgttgctgctgctgctggcgctggcggcgcgcgcggacggcctggagttcggcggcggccccgggcagtgggctcgctacgcgcgctgggcgggcgcggcgagcagcggcgagctcagcttcagcctgcgcaccaacgccacgcgcgcgctgctgctctacctggacgacggcggcgactgcgacttcctggagctgctgctggtggacggccgcctgcggctgcgcttcacgctttcgtgcgccgagccggccacgctgcagctggacacgccggtggccgacgaccgctggcacatggtgctgctgacccgcgacgcgcgccgcacggcgctggcggtggacggcgaggcccgcgccgccgaggtgcgctccaagcggcgcgagatgcaggtggccagcgacctgttcgtgggcggcatcccgcccgacgtgcgcctctcggcgcttacgctgagcaccgtcaagtacgagccgcccttccgcggtctcttggccaacctgaagctgggcgagcggccccccgcgctgctgggcagccagggcctgcgcggcgccaccgccgacccgctgtgcgcgcccgcgcgcaacccctgcgccaacggcggcctctgcaccgtgctggcccccggcgaggtgggctgcgactgcagccacacgggcttcggcggcaagttctgcagcgaagaggagcaccccatggaaggtccggctcacctgacgttaaacagcgaagtagggtccttactgttctccgaggggggggccgggagaggaggagccggcgatgtgcaccagccaacaaaaggcaaggaggagtttgtggcgaccttcaaaggcaatgagttcttctgctacgacctgtcacacaaccccatccagagcagcactgatgagatcacactggccttccgcaccctgcaacgcaacggcctgatgctgcatacaggcaagtcggccgactacgtcaacctgtccctcaagtctggggctgtctggctggtcatcaacctaggctcaggtgccttcgaggcccttgtggaacccgtcaatggcaagttcaacgacaacgcctggcacgacgtccgggtcacccgaaacctgcgccagcacgcagggattggacacgctatggtgaccatctcggtggacgggatcctgaccaccacaggctacacgcaggaggattacaccatgctgggctctgatgacttcttctacattgggggcagccccaacacagctgacctgccgggctcgcccgtcagcaacaacttcatgggctgcctcaaggacgtggtctataagaacaatgacttcaaattggaactatcccgcctggcaaaggaaggggaccccaagatgaagctgcagggggacttgtcattccgctgtgaggatgtggctgccctggaccctgtgacctttgagagtcccgaggcctttgtggcgctgccccgctggagcgctaagcgcactggctccatctccctagacttccgcaccaccgagcccaatgggctgctgctcttcagccagggccggcgggctgggggtggagctggcagccacagctctgctcagcgggccgactactttgccatggagctattggacggccacctctatcttctgctggacatgggatctgggggcatcaagctgcgggcatccagccgcaaggtcaatgatggcgagtggtgtcacgtggacttccagagggatgggcgaaaaggctccatctcagtgaatagtcgcagcacgccgttcttggccactggagacagcgagattctggacctggagagtgagctgtacctgggcggtctccctgaggggggccgggtggacctgcccctgcccccagaggtgtggacagcagcactccgggcaggctacgtgggctgtgtgcgggacctcttcatagatgggcgtagccgagacctccggggcctggctgaggctcagggggctgtgggcgttgcccccttttgctcccgggagacgctgaagcagtgtgcatctgccccctgtcgcaatgggggcgtctgtcgagaaggctggaaccgcttcatctgtgactgcatcgggaccggctttcttgggcgggtctgtgagagagaggccacggtcctgagctacgatggctccatgtacatgaagatcatgctgcctaacgccatgcacacggaggcagaggatgtgtccctgcgtttcatgtcccagcgggcctacggactcatgatggccaccacttccagggagtctgccgacaccctacgcctggagctggatggggggcagatgaagctcactgtcaacctcgactgcctgcgcgtcggctgcgcacccagtaaaggccccgaaacgctgtttgcggggcacaagctcaatgacaatgagtggcacacggtgagggtggtccggcgtggcaagagcctgcagctgtctgtggacaacgtgactgtggagggacagatggcaggagcccatatgcggctggagttccacaacattgagacgggcatcatgacggagcggcggtttatctccgtggtgccctccaacttcatcgggcatctgagtgggctcgtgttcaatggccagccctacatggaccagtgcaaggatggtgacatcacctactgtgagctcaatgctcgctttggcctgcgtgccattgtggccgatcccgtcaccttcaagagtcgcagcagctacctggcactcgccacgctccaagcctatgcttccatgcacctcttcttccagttcaagaccacggcccctgatgggcttcttctgttcaactcgggcaacggcaatgacttcattgtcatcgagctggtcaaggggtacatccactacgtgtttgacctggggaatggcccgtccttgatgaaggggaactcagacaaaccagtcaatgacaaccagtggcacaacgtggtggtgtccagggacccaggcaacgtgcacacgctcaagattgactcccgcactgtcacgcagcactccaatggcgcccgaaacctcgatctcaaaggggagttgtacattggcggtctgagcaagaatatgttcagcaacctgcccaagctggtggcctcccgggatggctttcagggctgcctggcctcagtggacctcaacggacgtctcccagacctcatcgccgacgccctgcaccgcattgggcaggtggagaggggctgtgatggccccagcaccacctgcactgaagagtcctgtgccaaccagggcgtctgcttgcagcagtgggatggcttcacctgcgactgcaccatgacttcctatggaggccctgtctgcaatgatcccgggaccacatacatctttgggaaggggggagcgctcatcacctacacgtggccccccaatgacaggcccagcacgaggatggatcgcctggccgtgggcttcagcacccaccagcggagcgctgtgctggtgcgggtggacagcgcctccggccttggagactacctgcagctgcacatcgaccagggcaccgtgggggtgatctttaacgtgggcacggacgacattaccatcgacgagcccaacgccatagtaagcgacggcaaataccacgtggtgcgcttcactcgaagcggcggcaacgccaccctgcaggtggacagctggccggtcaacgagcggtacccggcaggaaactttgataacgagcgcctggcgattgctagacagagaatcccctaccggcttggtcgagtagtagatgagtggctgctcgacaaaggccgccagctgaccatcttcaacagccaggctgccatcaagatcgggggccgggatcagggccgccccttccagggccaggtgtccggcctctactacaatgggctcaaggtgctggcgctggccgccgagagcgaccccaatgtgcggactgagggtcacctgcgcctggtgggggaggggccgtccgtgctgctcagtgcggagaccacggccaccaccctgctggctgacatggccaccaccatcatggagactaccaccaccatggccactaccaccacgcgccggggccgctcccccacactgagggacagcaccacccagaacacagatgacctgctggtggcctctgctgagtgtccaagcgatgatgaggacctggaggagtgtgagcccagtactggaggagagttaatattgcccattatcacggaggactccttagacccccctcccgtggccacccgatcccccttcgtgcccccgccccctaccttctaccccttcctcacgggagtgggcgccacccaagacacgctgcccccgcccgccgcgcgccgcccgccctctgggggcccgtgccaggccgagcgggacgacagcgactgcgaggagcccatcgaggcctcgggcttcgcctccggggaggtctttgactccagcctcccccccacggacgacgaggacttttacaccacctttcccctggtcacggaccgcaccaccctcctgtcaccccgcaaacccgctccccggcccaacctcaggacagatggggccacgggcgcccctggggtgctgtttgccccctccgccccggcccccaacctgccggcgggaaaaatgaaccaccgagacccgcttcagcccttgctggagaacccgcccttggggcccggggcccccacgtcctttgagccgcggaggccccctcccctgcgccccggcgtgacctcagcccccggcttcccccatctgcccacagccaaccccacagggcctggggagcggggcccgccgggcgcagtggaggtgatccgggagtccagcagcaccacgggcatggtggtgggcattgtggcggcggcggcgctctgcatcctcatcctcctctacgccatgtataagtaccgcaatcgtgatgagggctcctaccaggtggaccagagccgaaactacatcagtaactcggcccagagcaatggggcggtggtgaaagagaaggccccggctgcccccaagacgcccagcaaggccaagaagaacaaagacaaggagtattatgtctgagcccccggcactgcgccccactgccagctgcccctcctgggagggcccgggaggagggtgccaccctctccctgccaggggcctggggaccctctccctggctgcctcaggcttctcttacgaagaggaaacgcaaaaaaagaaaaggaaaaaccccgtgctcgcccccttcctcctgccgtccactgcgcggcctcgtcagtcccggggctgactgtccctctcagctctgcgcctgccaggcagggcacgtgctcacagccctgggttgatttatttttttaagggggtagttttattttggtggggttgggtgggaaggaaggctgggggttttgtaaagtgtccactgctcgtcctgttaattttcctcaatttttcttcttcttccttctgtccctcctgccttccttctcttcccaagccctccaatccccatcccaggcttgctgtgtctcactgtccccaccctccttccctacttctttttttgtgtgtctggtttctcccttcctttcctccctttgggtttccagagtcggtgggagaagggcgggagggtgggcccgagtggcccagtgggtgggtggggtggggtggggcaagtgccccaactcccctcaccaggagaggcacctgcttggtgccgcccagggaaggggctcaggcctgacggaaggcctgttctgtgtgtgccgccgggcgacgtgcattgatggggaagctgctggaggagcaggggtggggggtgggagggaggggaaaggcaaatgcagatatatattacagacaaatactctagattccacgagcagcagcctgtggcacccgctgggcgcgggcagcagggaagagggagcaaggcattgtccacagactgctggggtcacttctttgcccacgggctccctgctcccccagttttttttctctctttgttaacaaatgtgtctgagtcttggaaaacaccccaaccccggaaatgtgtgggaaaaagaaaacaaaaactttccaaattccaacgg

SEQ ID NO: 197410 - DNA, 4112 bp, Homo sapiens
  misc_feature (2)..(4): n is a, c, g, or t
tnnntttttttgtatcccaaagccctttaatccctggggccatgggagggtacattgcctttccacctgaggctgatcagtaattatcaggggggctgctgggagccagctctgaaggagggctatgacagagtgcatgctgccactctgtgatgtcacttctgagacagatgcctgggagccttgggcccactgtctccaacccacagggcctgggcggggaaggaacccaggtgaggcagggctgggaagccagtgttctttcccctgagttcctttccatgcagactgctttgtcttacctccccaacacgtgttcatactacgaccctgctctctctgtccagccagggccttcgtgggtctgtgccacgaagaccactcacttctgcctattccctgcacttgaggcacaggtcactagttaacaggttactagttagtgcctagccgaggacatctctgcagatgtcactcatgggtggccctcctgtggaggggaggctcctgggaacccaagccccagccctgccccaaagccatccccctcatcttggtctcctgtcctgagcaggacagatggcaggagcccatatgcggctggagttccacaacattgagacgggcatcatgacggagcggcggtttatctccgtggtgccctccaacttcatcgggcatctgagtgggctcgtgttcaatggccagccctacatggaccagtgcaaggatggtgacatcacctactgtgagctcaatgctcgctttggcctgcgtgccattgtggccgatcccgtcaccttcaagagtcgcagcagctacctggcactcgccacgctccaagcctatgcttccatgcacctcttcttccagttcaagaccacggcccctgatgggcttcttctgttcaactcgggcaacggcaatgacttcattgtcatcgagctggtcaaggggtacatccactacgtgtttgacctggggaatggcccgtccttgatgaaggggaactcagacaaaccagtcaatgacaaccagtggcacaacgtggtggtgtccagggacccaggcaacgtgcacacgctcaagattgactcccgcactgtcacgcagcactccaatggcgcccgaaacctcgatctcaaaggggagttgtacattggcggtctgagcaagaatatgttcagcaacctgcccaagctggtggcctcccgggatggctttcagggctgcctggcctcagtggacctcaacggacgtctcccagacctcatcgccgacgccctgcaccgcattgggcaggtggagaggggctgtgatggccccagcaccacctgcactgaagagtcctgtgccaaccagggcgtctgcttgcagcagtgggatggcttcacctgcgactgcaccatgacttcctatggaggccctgtctgcaatgatcccgggaccacatacatctttgggaaggggggagcgctcatcacctacacgtggccccccaatgacaggcccagcacgaggatggatcgcctggccgtgggcttcagcacccaccagcggagcgctgtgctggtgcgggtggacagcgcctccggccttggagactacctgcagctgcacatcgaccagggcaccgtgggggtgatctttaacgtgggcacggacgacattaccatcgacgagcccaacgccatagtaagcgacggcaaataccacgtggtgcgcttcactcgaagcggcggcaacgccaccctgcaggtggacagctggccggtcaacgagcggtacccggcaggccgccagctgaccatcttcaacagccaggctgccatcaagatcgggggccgggatcagggccgccccttccagggccaggtgtccggcctctactacaatgggctcaaggtgctggcgctggccgccgagagcgaccccaatgtgcggactgagggtcacctgcgcctggtgggggaggggccgtccgtgctgctcagtgcggagaccacggccaccaccctgctggctgacatggccaccaccatcatggagactaccaccaccatggccactaccaccacgcgccggggccgctcccccacactgagggacagcaccacccagaacacagatgacctgctggtggcctctgctgagtgtccaagcgatgatgaggacctggaggagtgtgagcccagtactggaggagagttaatattgcccattatcacggaggactccttagacccccctcccgtggccacccgatcccccttcgtgcccccgccccctaccttctaccccttcctcacgggagtgggcgccacccaagacacgctgcccccgcccgccgcgcgccgcccgccctctgggggcccgtgccaggccgagcgggacgacagcgactgcgaggagcccatcgaggcctcgggcttcgcctccggggaggtctttgactccagcctcccccccacggacgacgaggacttttacaccacctttcccctggtcacggaccgcaccaccctcctgtcaccccgcaaacccgctccccggcccaacctcaggacagatggggccacgggcgcccctggggtgctgtttgccccctccgccccggcccccaacctgccggcgggaaaaatgaaccaccgagacccgcttcagcccttgctggagaacccgcccttggggcccggggcccccacgtcctttgagccgcggaggccccctcccctgcgccccggcgtgacctcagcccccggcttcccccatctgcccacagccaaccccacagggcctggggagcggggcccgccgggcgcagtggaggtgatccgggagtccagcagcaccacgggcatggtggtgggcattgtggcggcggcggcgctctgcatcctcatcctcctctacgccatgtataagtaccgcaatcgtgatgagggctcctaccaggtggaccagagccgaaactacatcagtaactcggcccagagcaatggggcggtggtgaaagagaaggccccggctgcccccaagacgcccagcaaggccaagaagaacaaagacaaggagtattatgtctgagcccccggcactgcgccccactgccagctgcccctcctgggagggcccgggaggagggtgccaccctctccctgccaggggcctggggaccctctccctggctgcctcaggcttctcttacgaagaggaaacgcaaaaaaagaaaaggaaaaaccccgtgctcgcccccttcctcctgccgtccactgcgcggcctcgtcagtcccggggctgactgtccctctcagctctgcgcctgccaggcagggcacgtgctcacagccctgggttgatttatttttttaagggggtagttttattttggtggggttgggtgggaaggaaggctgggggttttgtaaagtgtccactgctcgtcctgttaattttcctcaatttttcttcttcttccttctgtccctcctgccttccttctcttcccaagccctccaatccccatcccaggcttgctgtgtctcactgtccccaccctccttccctacttctttttttgtgtgtctggtttctcccttcctttcctccctttgggtttccagagtcggtgggagaagggcgggagggtgggcccgagtggcccagtgggtgggtggggtggggtggggcaagtgccccaactcccctcaccaggagaggcacctgcttggtgccgcccagggaaggggctcaggcctgacggaaggcctgttctgtgtgtgccgccgggcgacgtgcattgatggggaagctgctggaggagcaggggtggggggtgggagggaggggaaaggcaaatgcagatatatattacagacaaatactctagattccacgagcagcagcctgtggcacccgctgggcgcgggcagcagggaagagggagcaaggcattgtccacagactgctggggtcacttctttgcccacgggctccctgctcccccagttttttttctctctttgttaacaaatgtgtctgagtcttggaaaacaccccaaccccggaaatgtgtgggaaaaagaaaacaaaaactttccaaattccaacgg

SEQ ID NO: 197411 - DNA, 2835 bp, Homo sapiens
aagggagccccgctcagcgcggggagcgcccggccccctccccgccccatgcgcccgcggctctgaagcctgagcggggccgggggctgggcggggccggggcccgccgtaggcatggcgtccgggagccggtggcggccgacaccgccgccgctgctgttgctgctgctgctggcgctggcggcgcgcgcggacggcctggagttcggcggcggccccgggcagtgggctcgctacgcgcgctgggcgggcgcggcgagcagcggcgagctcagcttcagcctgcgcaccaacgccacgcgcgcgctgctgctctacctggacgacggcggcgactgcgacttcctggagctgctgctggtggacggccgcctgcggctgcgcttcacgctttcgtgcgccgagccggccacgctgcagctggacacgccggtggccgacgaccgctggcacatggtgctgctgacccgcgacgcgcgccgcacggcgctggcggtggacggcgaggcccgcgccgccgaggtgcgctccaagcggcgcgagatgcaggtggccagcgacctgttcgtgggcggcatcccgcccgacgtgcgcctctcggcgcttacgctgagcaccgtcaagtacgagccgcccttccgcggtctcttggccaacctgaagctgggcgagcggccccccgcgctgctgggcagccagggcctgcgcggcgccaccgccgacccgctgtgcgcgcccgcgcgcaacccctgcgccaacggcggcctctgcaccgtgctggcccccggcgaggtgggctgcgactgcagccacacgggcttcggcggcaagttctgcagcgaagaggagcaccccatggaaggtccggctcacctgacgttaaacagcgaagtagggtccttactgttctccgaggggggggccgggagaggaggagccggcgatgtgcaccagccaacaaaaggcaaggaggagtttgtggcgaccttcaaaggcaatgagttcttctgctacgacctgtcacacaaccccatccagagcagcactgatgagatcacactggccttccgcaccctgcaacgcaacggcctgatgctgcatacaggcaagtcggccgactacgtcaacctgtccctcaagtctggggctgtctggctggtcatcaacctaggctcaggtgccttcgaggcccttgtggaacccgtcaatggcaagttcaacgacaacgcctggcacgacgtccgggtcacccgaaacctgcgccagcacgcagggattggacacgctatggtgaccatctcggtggacgggatcctgaccaccacaggctacacgcaggaggattacaccatgctgggctctgatgacttcttctacattgggggcagccccaacacagctgacctgccgggctcgcccgtcagcaacaacttcatgggctgcctcaaggacgtggtctataagaacaatgacttcaaattggaactatcccgcctggcaaaggaaggggaccccaagatgaagctgcagggggacttgtcattccgctgtgaggatgtggctgccctggaccctgtgacctttgagagtcccgaggcctttgtggcgctgccccgctggagcgctaagcgcactggctccatctccctagacttccgcaccaccgagcccaatgggctgctgctcttcagccagggccggcgggctgggggtggagctggcagccacagctctgctcagcgggccgactactttgccatggagctattggacggccacctctatcttctgctggacatgggatctgggggcatcaagctgcgggcatccagccgcaaggtcaatgatggcgagtggtgtcacgtggacttccagagggatgggcgaaaaggctccatctcagtgaatagtcgcagcacgccgttcttggccactggagacagcgagattctggacctggagagtgagctgtacctgggcggtctccctgaggggggccgggtggacctgcccctgcccccagaggtgtggacagcagcactccgggcaggctacgtgggctgtgtgcgggacctcttcatagatgggcgtagccgagacctccggggcctggctgaggctcagggggctgtgggcgttgcccccttttgctcccgggagacgctgaagcagtgtgcatctgccccctgtcgcaatgggggcgtctgtcgagaaggctggaaccgcttcatctgtgactgcatcgggaccggctttcttgggcgggtctgtgagagagaggccacggtcctgagctacgatggctccatgtacatgaagatcatgctgcctaacgccatgcacacggaggcagaggatgtgtccctgcgtttcatgtcccagcgggcctacggactcatgatggccaccacttccagggagtctgccgacaccctacgcctggagctggatggggggcagatgaagctcactgtcaacctcggtaaccaccctgccctgtgcttcctgacccctcacctggccttgtctctgacccacacctgcctctgtctggagaagctggtggtggcaccagcaagaggtgccctcagcagagtttggaggtggggaggtgccagcctgggtcagagaccctgagagctctgtccctggtgaggacgcacagtgtagggcgacattccatgctcgacgacactgtgaggggcaagacccagagtatctggggtatgctaactgtcctccctggtgactcatgtggatcttggtagcatctgtcctgcacacacacagatgacacagctcattttctggtcaacgctcatccacttgctcatt

SEQ ID NO: 197412 - DNA, 6167 bp, Homo sapiens
aagggagccccgctcagcgcggggagcgcccggccccctccccgccccatgcgcccgcggctctgaagcctgagcggggccgggggctgggcggggccggggcccgccgtaggcatggcgtccgggagccggtggcggccgacaccgccgccgctgctgttgctgctgctgctggcgctggcggcgcgcgcggacggcctggagttcggcggcggccccgggcagtgggctcgctacgcgcgctgggcgggcgcggcgagcagcggcgagctcagcttcagcctgcgcaccaacgccacgcgcgcgctgctgctctacctggacgacggcggcgactgcgacttcctggagctgctgctggtggacggccgcctgcggctgcgcttcacgctttcgtgcgccgagccggccacgctgcagctggacacgccggtggccgacgaccgctggcacatggtgctgctgacccgcgacgcgcgccgcacggcgctggcggtggacggcgaggcccgcgccgccgaggtgcgctccaagcggcgcgagatgcaggtggccagcgacctgttcgtgggcggcatcccgcccgacgtgcgcctctcggcgcttacgctgagcaccgtcaagtacgagccgcccttccgcggtctcttggccaacctgaagctgggcgagcggccccccgcgctgctgggcagccagggcctgcgcggcgccaccgccgacccgctgtgcgcgcccgcgcgcaacccctgcgccaacggcggcctctgcaccgtgctggcccccggcgaggtgggctgcgactgcagccacacgggcttcggcggcaagttctgcagcgaagaggagcaccccatggaaggtccggctcacctgacgttaaacagcgaagtagggtccttactgttctccgaggggggggccgggagaggaggagccggcgatgtgcaccagccaacaaaaggcaaggaggagtttgtggcgaccttcaaaggcaatgagttcttctgctacgacctgtcacacaaccccatccagagcagcactgatgagatcacactggccttccgcaccctgcaacgcaacggcctgatgctgcatacaggcaagtcggccgactacgtcaacctgtccctcaagtctggggctgtctggctggtcatcaacctaggctcaggtgccttcgaggcccttgtggaacccgtcaatggcaagttcaacgacaacgcctggcacgacgtccgggtcacccgaaacctgcgccagcacgcagggattggacacgctatggtgaccatctcggtggacgggatcctgaccaccacaggctacacgcaggaggattacaccatgctgggctctgatgacttcttctacattgggggcagccccaacacagctgacctgccgggctcgcccgtcagcaacaacttcatgggctgcctcaaggacgtggtctataagaacaatgacttcaaattggaactatcccgcctggcaaaggaaggggaccccaagatgaagctgcagggggacttgtcattccgctgtgaggatgtggctgccctggaccctgtgacctttgagagtcccgaggcctttgtggcgctgccccgctggagcgctaagcgcactggctccatctccctagacttccgcaccaccgagcccaatgggctgctgctcttcagccagggccggcgggctgggggtggagctggcagccacagctctgctcagcgggccgactactttgccatggagctattggacggccacctctatcttctgctggacatgggatctgggggcatcaagctgcgggcatccagccgcaaggtcaatgatggcgagtggtgtcacgtggacttccagagggatgggcgaaaaggctccatctcagtgaatagtcgcagcacgccgttcttggccactggagacagcgagattctggacctggagagtgagctgtacctgggcggtctccctgaggggggccgggtggacctgcccctgcccccagaggtgtggacagcagcactccgggcaggctacgtgggctgtgtgcgggacctcttcatagatgggcgtagccgagacctccggggcctggctgaggctcagggggctgtgggcgttgcccccttttgctcccgggagacgctgaagcagtgtgcatctgccccctgtcgcaatgggggcgtctgtcgagaaggctggaaccgcttcatctgtgactgcatcgggaccggctttcttgggcgggtctgtgagagagaggccacggtcctgagctacgatggctccatgtacatgaagatcatgctgcctaacgccatgcacacggaggcagaggatgtgtccctgcgtttcatgtcccagcgggcctacggactcatgatggccaccacttccagggagtctgccgacaccctacgcctggagctggatggggggcagatgaagctcactgtcaacctcgactgcctgcgcgtcggctgcgcacccagtaaaggccccgaaacgctgtttgcggggcacaagctcaatgacaatgagtggcacacggtgagggtggtccggcgtggcaagagcctgcagctgtctgtggacaacgtgactgtggagggacagatggcaggagcccatatgcggctggagttccacaacattgagacgggcatcatgacggagcggcggtttatctccgtggtgccctccaacttcatcgggcatctgagtgggctcgtgttcaatggccagccctacatggaccagtgcaaggatggtgacatcacctactgtgagctcaatgctcgctttggcctgcgtgccattgtggccgatcccgtcaccttcaagagtcgcagcagctacctggcactcgccacgctccaagcctatgcttccatgcacctcttcttccagttcaagaccacggcccctgatgggcttcttctgttcaactcgggcaacggcaatgacttcattgtcatcgagctggtcaaggggtacatccactacgtgtttgacctggggaatggcccgtccttgatgaaggggaactcagacaaaccagtcaatgacaaccagtggcacaacgtggtggtgtccagggacccaggcaacgtgcacacgctcaagattgactcccgcactgtcacgcagcactccaatggcgcccgaaacctcgatctcaaaggggagttgtacattggcggtctgagcaagaatatgttcagcaacctgcccaagctggtggcctcccgggatggctttcagggctgcctggcctcagtggacctcaacggacgtctcccagacctcatcgccgacgccctgcaccgcattgggcaggtggagaggggctgtgatggccccagcaccacctgcactgaagagtcctgtgccaaccagggcgtctgcttgcagcagtgggatggcttcacctgcgactgcaccatgacttcctatggaggccctgtctgcaatgatcccgggaccacatacatctttgggaaggggggagcgctcatcacctacacgtggccccccaatgacaggcccagcacgaggatggatcgcctggccgtgggcttcagcacccaccagcggagcgctgtgctggtgcgggtggacagcgcctccggccttggagactacctgcagctgcacatcgaccagggcaccgtgggggtgatctttaacgtgggcacggacgacattaccatcgacgagcccaacgccatagtaagcgacggcaaataccacgtggtgcgcttcactcgaagcggcggcaacgccaccctgcaggtggacagctggccggtcaacgagcggtacccggcaggccgccagctgaccatcttcaacagccaggctgccatcaagatcgggggccgggatcagggccgccccttccagggccaggtgtccggcctctactacaatgggctcaaggtgctggcgctggccgccgagagcgaccccaatgtgcggactgagggtcacctgcgcctggtgggggaggggccgtccgtgctgctcagtgcggagaccacggccaccaccctgctggctgacatggccaccaccatcatggagactaccaccaccatggccactaccaccacgcgccggggccgctcccccacactgagggacagcaccacccagaacacagatgacctgctggtggcctctgctgagtgtccaagcgatgatgaggacctggaggagtgtgagcccagtactggaggagagttaatattgcccattatcacggaggactccttagacccccctcccgtggccacccgatcccccttcgtgcccccgccccctaccttctaccccttcctcacgggagtgggcgccacccaagacacgctgcccccgcccgccgcgcgccgcccgccctctgggggcccgtgccaggccgagcgggacgacagcgactgcgaggagcccatcgaggcctcgggcttcgcctccggggaggtctttgactccagcctcccccccacggacgacgaggacttttacaccacctttcccctggtcacggaccgcaccaccctcctgtcaccccgcaaacccgctccccggcccaacctcaggacagatggggccacgggcgcccctggggtgctgtttgccccctccgccccggcccccaacctgccggcgggaaaaatgaaccaccgagacccgcttcagcccttgctggagaacccgcccttggggcccggggcccccacgtcctttgagccgcggaggccccctcccctgcgccccggcgtgacctcagcccccggcttcccccatctgcccacagccaaccccacagggcctggggagcggggcccgccgggcgcagtggaggtgatccgggagtccagcagcaccacgggcatggtggtgggcattgtggcggcggcggcgctctgcatcctcatcctcctctacgccatgtataagtaccgcaatcgtgatgagggctcctaccaggtggaccagagccgaaactacatcagtaactcggcccagagcaatggggcggtggtgaaagagaaggccccggctgcccccaagacgcccagcaaggccaagaagaacaaagacaaggagtattatgtctgagcccccggcactgcgccccactgccagctgcccctcctgggagggcccgggaggagggtgccaccctctccctgccaggggcctggggaccctctccctggctgcctcaggcttctcttacgaagaggaaacgcaaaaaaagaaaaggaaaaaccccgtgctcgcccccttcctcctgccgtccactgcgcggcctcgtcagtcccggggctgactgtccctctcagctctgcgcctgccaggcagggcacgtgctcacagccctgggttgatttatttttttaagggggtagttttattttggtggggttgggtgggaaggaaggctgggggttttgtaaagtgtccactgctcgtcctgttaattttcctcaatttttcttcttcttccttctgtccctcctgccttccttctcttcccaagccctccaatccccatcccaggcttgctgtgtctcactgtccccaccctccttccctacttctttttttgtgtgtctggtttctcccttcctttcctccctttgggtttccagagtcggtgggagaagggcgggagggtgggcccgagtggcccagtgggtgggtggggtggggtggggcaagtgccccaactcccctcaccaggagaggcacctgcttggtgccgcccagggaaggggctcaggcctgacggaaggcctgttctgtgtgtgccgccgggcgacgtgcattgatggggaagctgctggaggagcaggggtggggggtgggagggaggggaaaggcaaatgcagatatatattacagacaaatactctagattccacgagcagcagcctgtggcacccgctgggcgcgggcagcagggaagagggagcaaggcattgtccacagactgctggggtcacttctttgcccacgggctccctgctcccccagttttttttctctctttgttaacaaatgtgtctgagtcttggaaaacaccccaaccccggaaatgtgtgggaaaaagaaaacaaaaactttccaaattccaacgg

SEQ ID NO: 197413 - DNA, 3805 bp, Homo sapiens
tggaaacctgcgacttcttacaggaaagactcatgactgttcaccacgtccaagccacgtctgcgacaccctacgccatggagctggtatgggtggcagatgaagctcactgtcaagctcgactgcctgcgcgtcggcgcgcaccgagtaaaggccccgaaacgctgtttgcggggcacaagctcaatgacaatgagtggcacacggtgagggtggtccggcgtggcaagagcctgcagctgtctgtggacaacgtgactgtggagggacagatggcaggagcccatatgcggctggagttccacaacattgagacgggcatcatgacggagcggcggtttatctccgtggtgccctccaacttcatcgggcatctgagtgggctcgtgttcaatggccagccctacatggaccagtgcaaggatggtgacatcacctactgtgagctcaatgctcgctttggcctgcgtgccattgtggccgatcccgtcaccttcaagagtcgcagcagctacctggcactcgccacgctccaagcctatgcttccatgcacctcttcttccagttcaagaccacggcccctgatgggcttcttctgttcaactcgggcaacggcaatgacttcattgtcatcgagctggtcaaggggtacatccactacgtgtttgacctggggaatggcccgtccttgatgaaggggaactcagacaaaccagtcaatgacaaccagtggcacaacgtggtggtgtccagggacccaggcaacgtgcacacgctcaagattgactcccgcactgtcacgcagcactccaatggcgcccgaaacctcgatctcaaaggggagttgtacattggcggtctgagcaagaatatgttcagcaacctgcccaagctggtggcctcccgggatggctttcagggctgcctggcctcagtggacctcaacggacgtctcccagacctcatcgccgacgccctgcaccgcattgggcaggtggagaggggctgtgatggccccagcaccacctgcactgaagagtcctgtgccaaccagggcgtctgcttgcagcagtgggatggcttcacctgcgactgcaccatgacttcctatggaggccctgtctgcaatgatcccgggaccacatacatctttgggaaggggggagcgctcatcacctacacgtggccccccaatgacaggcccagcacgaggatggatcgcctggccgtgggcttcagcacccaccagcggagcgctgtgctggtgcgggtggacagcgcctccggccttggagactacctgcagctgcacatcgaccagggcaccgtgggggtgatctttaacgtgggcacggacgacattaccatcgacgagcccaacgccatagtaagcgacggcaaataccacgtggtgcgcttcactcgaagcggcggcaacgccaccctgcaggtggacagctggccggtcaacgagcggtacccggcaggccgccagctgaccatcttcaacagccaggctgccatcaagatcgggggccgggatcagggccgccccttccagggccaggtgtccggcctctactacaatgggctcaaggtgctggcgctggccgccgagagcgaccccaatgtgcggactgagggtcacctgcgcctggtgggggaggggccgtccgtgctgctcagtgcggagaccacggccaccaccctgctggctgacatggccaccaccatcatggagactaccaccaccatggccactaccaccacgcgccggggccgctcccccacactgagggacagcaccacccagaacacagatgacctgctggtggcctctgctgagtgtccaagcgatgatgaggacctggaggagtgtgagcccagtactggaggagagttaatattgcccattatcacggaggactccttagacccccctcccgtggccacccgatcccccttcgtgcccccgccccctaccttctaccccttcctcacgggagtgggcgccacccaagacacgctgcccccgcccgccgcgcgccgcccgccctctgggggcccgtgccaggccgagcgggacgacagcgactgcgaggagcccatcgaggcctcgggcttcgcctccggggaggtctttgactccagcctcccccccacggacgacgaggacttttacaccacctttcccctggtcacggaccgcaccaccctcctgtcaccccgcaaacccgctccccggcccaacctcaggacagatggggccacgggcgcccctggggtgctgtttgccccctccgccccggcccccaacctgccggcgggaaaaatgaaccaccgagacccgcttcagcccttgctggagaacccgcccttggggcccggggcccccacgtcctttgagccgcggaggccccctcccctgcgccccggcgtgacctcagcccccggcttcccccatctgcccacagccaaccccacagggcctggggagcggggcccgccgggcgcagtggaggtgatccgggagtccagcagcaccacgggcatggtggtgggcattgtggcggcggcggcgctctgcatcctcatcctcctctacgccatgtataagtaccgcaatcgtgatgagggctcctaccaggtggaccagagccgaaactacatcagtaactcggcccagagcaatggggcggtggtgaaagagaaggccccggctgcccccaagacgcccagcaaggccaagaagaacaaagacaaggagtattatgtctgagcccccggcactgcgccccactgccagctgcccctcctgggagggcccgggaggagggtgccaccctctccctgccaggggcctggggaccctctccctggctgcctcaggcttctcttacgaagaggaaacgcaaaaaaagaaaaggaaaaaccccgtgctcgcccccttcctcctgccgtccactgcgcggcctcgtcagtcccggggctgactgtccctctcagctctgcgcctgccaggcagggcacgtgctcacagccctgggttgatttatttttttaagggggtagttttattttggtggggttgggtgggaaggaaggctgggggttttgtaaagtgtccactgctcgtcctgttaattttcctcaatttttcttcttcttccttctgtccctcctgccttccttctcttcccaagccctccaatccccatcccaggcttgctgtgtctcactgtccccaccctccttccctacttctttttttgtgtgtctggtttctcccttcctttcctccctttgggtttccagagtcggtgggagaagggcgggagggtgggcccgagtggcccagtgggtgggtggggtggggtggggcaagtgccccaactcccctcaccaggagaggcacctgcttggtgccgcccagggaaggggctcaggcctgacggaaggcctgttctgtgtgtgccgccgggcgacgtgcattgatggggaagctgctggaggagcaggggtggggggtgggagggaggggaaaggcaaatgcagatatatattacagacaaatactctagattccacgagcagcagcctgtggcacccgctgggcgcgggcagcagggaagagggagcaaggcattgtccacagactgctggggtcacttctttgcccacgggctccctgctcccccagttttttttctctctttgttaacaaatgtgtctgagtcttggaaaacaccccaaccccggaaatgtgtgggaaaaagaaaacaaaaactttccaaattccaacgg

SEQ ID NO: 197414 - DNA, 909 bp, Homo sapiens
tgtctatgtttgcttcctccgatgacagcaccaccattcggtccctcaaggtagaaatttttgaattatccttaacttccctcttttcttcctcatgtcccacattataccagttaacaaatcccacaaaagctacatcagagaggtaccctaagattgctcatcctttttataaccatagtgtaagttcagactctcatttattacctgaaacacctcaatagtcttctaatgctttctctgccaatagtttctcctcactgcagtctatactcaatacaacacacaaagtcctcttcctaatatgcaaagctgattatgttaccctccacctaaaagctagggatgcctcattgtacacagcagcacctatacttctaaccatatatctagcctcaggcacactccccacatatacaagatacactgaacttttcacttttttatgaacatgtcatgccatttcataactgtgcctttaaacatgctgttccctttgcctggcatgcctttctcatactttgcacatggcaaactgatattacagttcaatgttcagcttccttcgtaggtatctcccttataactcagtcactcaacaaaaaatgtatcgagtacccatcaatacgacaagaaccttcacctcaaggaactcgtactctatattatgttaggactcattcacactgttattattatgttcatcacattataccatagtcatccttctacttgtctctcctcccagctggatcatgagatctttgaaggcatggctcctgtctcattactctttacacatcttgaaaaacaaatcattttttctctagtttatgacaaaagctaaagaataatgagaatttaagtttttagcattagtgtccaaaataaatatctattcacttacct

SEQ ID NO: 197415 - DNA, 528 bp, Homo sapiens
aggcacatttacatggtggcagatgagtgaaagcgagcaaagggggaagtactacactttaaaaccatcagatctcctgagaactctatcatgagactgtactagggcaatgttgctaaactgtcagaaaccactcccatgatccaaccacctctcaccaggtcccacctccaacactggggattacatttaaacatgagatttgggtggggacacaaagccaaaccatttcatcaaccagtaagtgtatactagacacttacatgtccgtggcacaagttgtacttctgagattttctcatattgatcaggacagatactcatattggctcaaagtcatgttttccatttagcttcttttgacttaagatattctaattcaggtatgctagcaacggaaataccttataaaacggagctttcaaatgacaccctcattgattatcagaaatgtccatgagcaaaaataattctcctgtagattccaaatcacttcctgaccttaacaaaattcagtggagtggacgg

SEQ ID NO: 197416 - DNA, 709 bp, Homo sapiens
cccacgccgtatgggtagttgggttcttaagccactgcagtcacaggatgaggagaggaggagatgctctctggtaatgtggagaaaaaagaagttgaggtcatggcaggtgaagacagtgaggaagagacagagctggcttcttccacagagggaaggctcggccatggcacatctccaggagttctactcataagagtggtcatctctgagtgtgaaaatcctggagatgcagttgagtgggtccctgaccaaaaggttgttgttgaggtgtccaaggtgagggtaccctctgatgtagccccaggagaacctgtctcaatagtgatggcactttctgctgattctgtcataatgggggaagtagaaagcctggtgatcgcttcagtagagatgtctggtgatatggtgaactgatcaggccctgacatggatgttcccctagaggatatcacttctgtcctggagacctcagtggtagcaccactgggcacttcagaaaggacagtgcttccctctgtggctgagctgatcctctcagagctgctggtctccctcaatccagaagtcagggaggatgttggttctatctgaattctgctggtctcaaagaagtcagaagtggatatggaaacactcgtttcccccatggtgtaggtggtacccattggagatgtggctttgggtgtctctgagtcagataggacag

SEQ ID NO: 197417 - DNA, 412 bp, Homo sapiens
aaaacagaggaaggggatagatgtttataaatcacagtccctacattgactacaggtgtgtttgaggagggatgaattttctctctatctttggtgacttcagacgtggctaatatttcagctgaggtgctgctcaaatttggaggtgaactggtttcaggttctgagcttgtgcgcaacatgtctgtggtcttcactgggccaagggtgagaagtgcagtcacaggatgaggagaggaggagatgctctctggtaatgtggagaaaaaagaagttgaggtcatggcaggtgaagacagtgaggaagagacagagctggcttcttccacagagggaaggctcggccatggcacatctccaggagttctactcataagagtggtcatctctgagtgtgaaaatcctggagatg

SEQ ID NO: 197418 - DNA, 502 bp, Homo sapiens
ccgtcgttaaatggatcttgaatatgttatgtaaatgcaaactcccaagtcacaattaaaatggcgactgcaggtgcagtgggtcacacctgtcatcccagcacgtggggacaccaagtgcagtgaggattgcttgagactgcaggtgcggtagctcacacctgttatcccgtagcacgttgggaggccgaggcaggaggattgcttgagcctgggtgacagagcaagactctgtctcaaaaacaaaaaactaatagtaccgtgcacggggttttgtgatgattaaatacaataatatataaaaaatggttagaacctgactcattgtaagctctcagatgttaatagtaactttatatgatgacttctaattctcagagcttttgcctaagtagtcattttgctggggaggctgaagttcagggagatacaaagtgactttctacaacgtgatgtgctgttatctcactacctaaatatgttttttctgttgatacagtat

SEQ ID NO: 197419 - DNA, 475 bp, Homo sapiens
atgcttgaaagtataaggtttcgtttttgcactgacacctcgtcctttatcctctgcttagttacccaccttttccggatgtttttctgaccctcatttcttctccattggccaccttcatttgtttgtacagtcaacaaacatttatcgaccattatataaagctctgagcgtaaaaacatgtaagacactgtctctgctcaatagaagtttcgtctagttagcctcttgcttttaccatgtaatctattgttaattattgtttcttcctagcattcatcatagcactggcatcatttatgtctgtgtttctgattttgttttttgagatcctgccttgttcatagctgtatccccacttccaaatgcaggcattcaataaataattgttggccaatatttgtgaagctcagactgcctgttgaccttcttcccctcatctttccaataaagattttgtgtgtgtgtgtttgtt

SEQ ID NO: 197420 - DNA, 459 bp, Homo sapiens
agagtatcaggtgacccctgagccacctgggaaagcagtgaccaccccagatattaacagtaacctcattacccaggagcaggtgctggtgctggccacatctgagcaaacatcaggccagtcaaagcaaatctggccgggcgcagtagcttacgcctgtaatcccagcactttgggaggccgagatggacagatcacctgaggtcaagatgttcgagaccagcctgaccaacatggtgaaaccccgtctctactaaaaatacaaaaattagccagggatggtggcgcacaactgtagtcccagctactcaggtggctgtgatggtgcacaccggctactcgagaggttgaggcaggagaatcacttgaacctgggaggcagaggttgcagtgagccaagatggcaccactgcactccagcctgggcgacagagcgagactccgtctcaaaaaaaaaaa

SEQ ID NO: 197421 - DNA, 487 bp, Homo sapiens
agagaaatccttcacattttctgtgctctcattcaggatggccctaggcatgttacatgggaaatgagaatatgtgaataaatactctcatactttcttgggcctcaatgaaaagaacatttgttaccatttttagtcataaattaaaattatttcagagtaggaaatataacattaatttagaacatggctgtcatagatgaaacgttttacacatgtattgctgtggtagacattccttgcatttattgaaagcctctcctttataaagttagtgaagtgtgactactctgacctccaaatactgggtgtatttgaactatgaaagtaggtttaaaagttacacttttctttaatgcccattgatgatttctttctttttttttttttaagacgaaatctagccctgtcacccaggctggagttgcagtgagccgaaatagcgccactgcacttcagcccgtgcgacagagagagactccatata

SEQ ID NO: 197422 - DNA, 402 bp, Homo sapiens
cccccaaaacccccaaattgacaagttgactcttaaatgtatatagaaccgcaaaagatctaaaatagacaagaccatcttgaagagaaagaacaaagttggtggattatactatcagattttaaaatttaatatgaaattacagtaattaagacagtgtgatattagtacgagaacagacaaatcaatagaagagagtatagagttcagaaatagactcacatatatatagtggggaaaagatggtcttttcaataaatgattctggagtaattggatagtcttataaaaaaataatgagctttggccttttttcataccatatgtgaaaaattaacttgagatggatcatagacctaaatggcaaaacaataaagcttctgaagaatacatggaagaata

SEQ ID NO: 197423 - DNA, 257 bp, Homo sapiens
agatgaggagtttcctgtattttagctgaaaagctggtggtggactagaaagttggtgttaactaatgggtactagtttaatacctgagtgacaaaataatctgtacagcaagcccccataagtttaactatataacaaacctacacatgtaccccgaacttaaaataaaagttaaattaaaaagagaaagttggtgttaactggaatggcagaaagccctccatgaaccacccttcagtcatgcagagaaaatgac

SEQ ID NO: 197424 - DNA, 356 bp, Homo sapiens
ttttttcttcttttaggtattttaatccatttacatttttggaattactaatagatttacttagacttgtttctgtggttttattattatcaagattttagttccaatttttaaaaaacaaccatcattagctgtcatttgatattatagtcagtagttggtacaatttgttagcttattgttaaaaaattgttttctgtatttagtgttgttttattccagccccttatttaaaaggcttttccctctgagctcatcattgatctggatgaggtgcatactcttttaacagtgtttattacatgtgtatgcgaaggtctgtagataatacgctccattaaactcttttgcatatg

SEQ ID NO: 197425 - DNA, 399 bp, Homo sapiens
  misc_feature (27)..(27): n is a, c, g, or t
agtgttgctgaggtgctctagattatnccccggagccagtactgggaggtagggcacacacaagctggctagtttgggtctttgtagagacaaatttgccatgttagccaggatggtctccatctcctgacctcgtgatccacctgcctcggcctcccaaagtgctgggattacaggtgtgagccactgcacccagccatggggtgcattcttaacctctctgtgcctcagtgcccttatctgtaagttggagataataatagtatccaccttacagggctattaggaggattacatgagttgttaggaggctttatacatgtacagcactcagaacagtgcctggccctaataagtgtatgtattaggctgttattgtgacacaggtgtttgcctgat

SEQ ID NO: 197426 - DNA, 400 bp, Homo sapiens
  misc_feature (27)..(27): n is a, c, g, or t
  misc_feature (128)..(128): n is a, c, g, or t
agtgttgctgaggtgctctagattatnccccggagccagtactgggaggtagggcacacacaagctggctagtttgggtctttgtagagacaaatttgcatgttgtctaggctgtctccaactcctgngctcaagttatactgccactctcggcctcccaaagtgctgggattacaggtgtgagccactgcacccagccatggggtgcattcttaacctctctgtgcctcagtgcccttatctgtaagttggagataataatagtatccaccttacagggctattaggaggattacatgagttgttaggaggctttatacatgtacagcactcagaacagtgcctggccctaataagtgtatgtattaggctgttattgtgacacaggtgtttgcctgat

SEQ ID NO: 197427 - DNA, 291 bp, Homo sapiens
ctatcactttttcttttccctttttctctctttttattgttcatcataaccagcaaagtggatttcttaacctgctagtcagtcggttgtcctttgacaagcttgcagtatttcagtgctatggtagggacgcatggtttcttgcccttctccctgtattcttcagtaacttctacagcatttttttacccctaaaaatgcctcaaacctgccttaactttattctgtatgggccgagctctctccttccttttgtaataagcttctgtttctattttctcacctactgtt

SEQ ID NO: 197428 - DNA, 328 bp, Homo sapiens
aacaaactgttagggagatgaaagggcaggagaatcgcttgaacccaggaggcagaggttgcagtgagccaagatcgcaccattgcactccagcctgggcaacaagcaagaaactcagtctcaaagaaaaaaaaaaaaaaaaaaaaaaaggaaattctgatacatgttacatcatggatggaccttaaaaacattctgctaaagtgaaagacaccaaaggtcacatctgtatggttccactgacaggaaacgtccagaacgggcaaatccacagagacggaaagcagaggagtggctgctgggggagagaaagtgcggagctcctgct

SEQ ID NO: 197429 - DNA, 577 bp, Homo sapiens
tattcttccaattcaagattattccaagttattaaaacagttctttctcttccatttccttatccttctatactaaatatactgtttccctttattgtttagttttttttttgatagcacaacacttggtttcttaaatggtaacttttatctatataaaatatccctgtactatccacttaacggttttggtcttgaattctacttattttggcataatttacatacaataaaatacagattttcagtataaagagctttaacaaatatataggccacctaccatactcacaggcttatgtgatcctcctgcctctacaaaataaaaaaattagctgggcatggtggcccacatttgtagtctctgctactcaggaagctgaggcaggaagatcaagagttggaggttgcagtgagctatgatggcaccactgcactccagtctcgtaagaccctatttcaaaaatttttcttccagatttcctatctctatgtacacttaggctttcagatttattttttttaactacggatctatcagttgggaagcatacctttcagagatatctacattgga

SEQ ID NO: 197430 - DNA, 363 bp, Homo sapiens
gcagcctcccagcttgccctgggcacttctgaagttccccagtcccttctctgaaggtgttacatggggcttagctgtctctgtgtactctcatgtcttgaaaaacaaaacagttcttgggaacagtcaggatcacaccgagcactgtgactcagtagaaaaagcaaaggtttgcagcatcagacatgatggaatttgaggtcagcttccaccttgtaccatgacctcagagagctgcctgaccatctccaagcacgggtccctcatttgtgaataggaagagttatattactttgcaaatttctgatggcatcagaatgcgctggcacaaagtaggtgctcagagaatatttgtgggaggtt

SEQ ID NO: 197431 - DNA, 550 bp, Homo sapiens
caaaacagtaacaacatctcctacttattgaccacttccagacaattcactagctataacaatgctattagagactgctattcccatcttagagatgagtaacaaaggctcacaaaactcacttagctccatggttctcaatagagaatattttgcccctaggggacatttgccaatgtctaggaatatttttggtttttttggttagcatgacaggggaaagaaagctactggtttacattgggtagtggccaagtaggctgctaaacatcctacaatgaataggacaggccctgcaacgcagaactattcattccaaaatgctagtagtgctgcaatggaaaaagcttgattctcgattaactgatggaagcatattcttctaaccacagtgccttaccacctgaccagtataatatgattgagcacctagcaaagcacatgctcaataaatacttgttgaataaatgatgaaagggatttgaagaattgttttactttaggaatttttctttacctttctgggtctcaatttcctcagctgtaaaat

SEQ ID NO: 197432 - DNA, 346 bp, Homo sapiens
gagtcagggtctcgctctgtcacccatgctgaagtgcggtggtgccatctcggctcactgcaacttctggctcctgggttcaagcgattctcattcctcagcctgcccagtagctgggactataggcatgcgctaccaagcctggctaatttttgtgcttttagtagagacggggttttgccatgttggccaggctggtcttgaactcctggcctcaggtgatatgcccgcttcaggttcccaaagtgctgggataataggcatgagccactgcgcctggcctaactttttctactgaggggcagaacttcctttgcatatgttatgatttacctagaatgccttt

SEQ ID NO: 197433 - DNA, 385 bp, Homo sapiens
tgagaatgcctctcaattcccaaagcccaagacacaactctttctttacccgctgacagagatgagagcaaggggagcatagttggcacaatctcttcagacaacaattgggaaacatcttacaaaatgacaaatgcatgtgccctctgccccagcatttccactcctaaaaatttcccttccatcatgcctgcacatggttacaaaatggttacacaccgcagcatggttacaaaaggaggggctgcgaacaactacaatgttcacgaataagaggcctggtgagataaacctgggtacacgcacagagtggagttccacacagctatctaaaaaaaaccaaaggggccgggcgcagtggctcatgcttgtaatcctagtacta

SEQ ID NO: 197434 - DNA, 263 bp, Homo sapiens
ttgggagctttgagggtcttgttggaaacgggaatatgttcacaaaaaactagacagtggcattctcagaaacttccccgtgatgtttacattcaactcacagagttgaacactccttttcagagagtagttttgaaacactcctttgtagtatctgcaagtggacatttgaagcgctttgacaccttcgttcgtaacgggcatatcttcacataaaaactagacagaagcagtctcagaaacttctttgtgatgtgtccact

SEQ ID NO: 197435 - DNA, 523 bp, Homo sapiens
aaactgagtaccactaagttcttgatattaacaagccatataggcatctaaatagtgacaaatcagtttttggcttatttaatagatattatctacactactacatttaaaaatcataaagataaaaatgaatacattaacctatacactgtgttataatctttaacccttcaataattgttcctatgtatttacattatttctacagattgtgttttaaggtgcttgaggcctgtaccccataattttgaagacagtgtttgatgtgtataagctaatttgatagtatgcgtgttgaattaaaataccaactcatcggtcaggcatggtggctcacgcctgtaatcccagtactttgggaggccgaggcaggcagattacctgaggtcaggagttcaagaccagctggccaacatggagaaaccccgtttctactaaaaatacaaaaaattagccgggcatggtggcgggtgcctgtagtcccagctactagggaggctgaggcaggagaatggtgtgaacc

SEQ ID NO: 197436 - DNA, 409 bp, Homo sapiens
gcctcaatctcctcttcctgctgtcccagaagcgggtggctgagttccacatggagctggagtggctgcctgccaaggacatccagaccaatgtctacaccaaaaaccctgtgtccctggagcaatacctaatggagggcagctacaacaaagtgttcctggccaagggtaacatcctcgccaagagctacaccgtcttcatcgacatcctgcttgacactatcagggatgagatggccgggtgcatcaagaaagcctatgagaaaatcccttttaccgaggccaccagatcctcttcttcaacacacccaaaaagatgaccgactacaccaagaagtgagggtgggtcccgggccccaacaactaatatagttttgccggccagcagcaggagccagaagacactacc

SEQ ID NO: 197437 - DNA, 385 bp, Homo sapiens
aggaatctttgcaatgatggaaaagacaggtggcagtgtcttggcagggttcaggtttcagctattttttcttctgtggttcttttactccagaaagtccagttctttaagttctgagaatagaaagacacatcctttgcaactccagcaagaagcttacacccaggatggatgcggtcagctcttgtcatggttttgtgttgtggggttgtctgttctgtgtttacccgtaggtgccatcattgattcccaaaagcatcaagattacactttttagaatggacaaattagaacattgtcctgaagtggaggaaatggggaagaagtggaggcaaggaccctgctcaggcatcatttctttgctgagcacagccatgcagtcccc

SEQ ID NO: 197438 - DNA, 460 bp, Homo sapiens
gttttattctaatagaaaagtcaccatttttaaaataaacacaatccttaaggaagaagaatgtgattacagttctttagtaatcttgacatcaagttaataacaattaattgtcagattttgattttaaataatcatgaaacattttaaaaatacttataaacttttaattttctaaaaatagatttatcagttacaagcctgtttaaaactatagtgggtttttcaccactgataaaagcattcacaggatagtatttttgtagcattcaaaaaaagcacatatctagtggtagctttacatgtatgtggctcagcttatttctaaacaaaattttgagtgtgcgttttgccgaaagtcttcactcaccattaggatgaatcctttgtttttaaacttgctaaacaattttcctctatcttaaatgctaaagtcaagttgcttttgacttaattcaca

SEQ ID NO: 197439 - DNA, 479 bp, Homo sapiens
tcattgtataaaaattttagaaactagttgtgaaatctttaaaagaaaatttaaaaactcaaaaggcaataatctttaggcattaagttgaagcctggcagctattttcccaaatgccatcagaaaagttctctttctcttacacatacacatgtgcaaataacactcccagattaaaaatcactactggcatgataggaaaatgacctcattcattctttgtgttccaaaaaaaaaaaaagatcccaacaaagcaaagcaattagcttggttgagtgaatagatagcaaaaggggtggatggactgccccacattttcttgctcttaaaagatgatatccctaataataatggactagagttatttcgtgtgtgtgatttgaaagtcaagttaagtgtctcataagtgtttttccctctgtccctcagatttggaccatacagcagatgtccagtgagtatagcgggagtccattcct

SEQ ID NO: 197440 - DNA, 305 bp, Homo sapiens
attcaccaagtatttcctgtgtatctccgaggtgccaggccctgctgggagtgaagctgctgagtacgtgtggtgttgcctgtgttttcactacacttatatttaggtgtggaagaaaagcacacaaacaggcaattgttatacagtgtgaggagaatgcagagcacataggaggggggcctaggactggggggccaaggaaggtggctaggagggcttcctggagaggtgatgagaatatggaaatgctgagttgctgcaacaaaataccatagactgggtggcttataaacaaccgaaaatta

SEQ ID NO: 197441 - DNA, 183 bp, Homo sapiens
caaagaataaataaataagttagccaggttagtggtgtgcgcctgtgtttgtagctcctcaggaggctaggttggactattgcttgaggtggggaggttgaaactgcagtgagctgtgatcacaccactgcactccagcctggggaatagagcaagaccctatctcaaaaaaaaaaaaaatta

SEQ ID NO: 197442 - DNA, 479 bp, Homo sapiens
agaagtgaaaacacatatccacaagaaaacttgtgcatgaatgtttataacagcattatctataatgaccaaaaaagtggaaacaactcaaatacccaccaacggatgaatggataatcacaatgagatatattgatacaatgagatatcatttaaccatgaagaagtgaggcactgacatacactacaacatggatgtatctcacaaacattacgctaagtgaaagaagccaatcacagaagacaacgtattgtttgaatcttttcatgccagaatacagagacggggtttcgccgtgttggccaggatggtctcaatctcctgaagtcgtgatccacccgccttggcctcccggggtgctgggattacaggcgtgagccactgcacccggctgaaattgtatactttaaagggatgaattttatggtatgtgaattatgtctcattaaaaaaaacaaactgttaagaaaaaaaaaaa

SEQ ID NO: 197443 - DNA, 530 bp, Homo sapiens
cagatattttttaaagaactacttatttttaaaggactaagaattattttcaaagaagtatgtcttcaagcatcatgagcagaatgaaaggccgaatgctctccttgtgacaaagtgagtggacagacccatccgcagtgcagcatgcctatcaccagccaccagcgcagtccaaagttacatgattgaaaaagaaatttgcacctgattgaagatgctttgggctcagttttgctgtcctctccccacagaagtctaagctgttcagactgctcaagataacacttcacacagtttaggaattgtggtttatgtcgaacgccaatctatatcagctttcataacatttaatatggtggggggagtgataggtgtttgagaaattaagcaaaaccataaattttctcttggtatgtatagtatatacaaggagagctttcgagtaccttcttcctagtgttctctcttaactcttgatgtgagtgaaaagcttcatccattgcatgacacagactaggtcattgtgtttg

SEQ ID NO: 197444 - DNA, 633 bp, Homo sapiens
cagctatttgagaggctgaggtgggagaattgcttgaacctgggaggcggaggctgcagtgagccaagatcgtgccactgcactaaagcctgggcaacagagcgagaacctgtctcaaaaataataataataataataataataaaataaaattctagaaatattaagaaaataaaattataaataaataatgttactggaattcttacatcccatccctctcactaaattcctatttagcaaatcacattaggctaataagaaggctaaattctaaccacctgtcttcctatacttccatatgatcaaataaacatgattactaatacaaaaatagttcctttcggcccggtgtggtggctcatgcctgtaatcccagcactttgggagaccgaggcaggtcgatcacttgaggtcaggagttcaagaccagcctggccaacatgatgaaaccccgtctctaacaaaaaatacaaaaattagcagtgcatgggtggcctgtagtctcagctactcaggaggctgaggcaggagaattgcttgaaccggggaggcagaggttgcagtgaaccgagatcgtgccaccgcactctatatcccgggcaacaatgtgagactcggcctcaaaaaaaa

SEQ ID NO: 197445 - DNA, 996 bp, Homo sapiens
tgaggtagggtctcattctgtcgcccaggctagagtgcagtggtgaaatctcagctccacctcccaggttcaagcgattctcatgcaacatccacctcccaggttcgagcgattgtcatgtctcagcctcccaagtagctggaattacaagtgcccaccaccacgcctggctaattttttgtattttcagtagacacagggtttcgctatgttggccaggctggtcttgaactcctggcctcaagtgatccgcccacctcggtctcccaaagtgctgggattacaggcatgagccactgtgcctggccgaacctctgcttttaaccccaatggatttaagtagcatttacaagaggtagtctcaaactgacacgttttactccaggataaccttccccagtcccttgaggttcccctacactggtgagtaaacaagctgtaccatggtgccataaagaaatggctttctaccagagggaactaaaattagagagaaaaagttacaagtgctagcaaggatgtggaatatttggacttcttatatactgctggtggaagaatacgctggtacaacttttgaaaactggccatatctactagagcagaatagatactcttatgaagtgaactgtgtccacctaaaatttttaagttgaaattctaatccccaatatatcagaatgtgacttatttgcagacagggcctttaaagaagtaactgaggttaagtgaggtcataagggtgggcctcaatccaatacgactggtgtcctaaaagaaaaggagaataggacacagccaatacagaggaaagatcctgtgaagatacagggaagagaagacagtcatttacaaaccaaggagaggcttcagaagaaactaatcctcccgacagcttgacctcagatttctaaccttcagaattgagaaaataaatttctgtttaagccactctatctgtgatacttgttacggcagccctagcaaatgaataca

SEQ ID NO: 197446 - DNA, 218 bp, Homo sapiens
gcattcccccttagaataggaacaattcaaggatgcccactttcatcacttttattcaacctagtactggaagtcttagccgtatcaatcaagtaagagaaagaaataaagggcatttaaactgaaaaagaggaagacgaaatatcactggtcaccaatattattactagttctgctattcaccaacaatgaccaagctgagaatcaaacaagaacag

SEQ ID NO: 197447 - DNA, 388 bp, Homo sapiens
ctgcaaagtgcagggcctgttctaggcactggagactcagcagtgaataaaacaaagtcattgccatcatggagcctacttttgagggggctggactattcgcagttctgtgagctgccatgctgtttcgtacctttgctggaatgtgcctgcccacagctaatcttcctggacagtgtctgctggaatttcaggacgcagcgacggtgtagtgaccccactagcattaccactcttctttttatgtcttccttgtgttgtgtgcttcaagcttcctcttcaccagggcctggccttaccaggctttgtgtttccagcacctatagtagtgctcagcgcataacagatgcttctaaatgtttattgaatgaaaagcacacaagcatgg

SEQ ID NO: 197448 - DNA, 789 bp, Homo sapiens
atatttttaatcttcttgggtaaatacatagaaatgcaatttctgtgtcatttgttatgatcaacttcattaaaaactgcagactcttttcaaaatcagccataccattttgcattcccaggatgttacttgacaacatcaccacacttggcatggtagtctttttaaattttactcattctggtggatgtatagtggtattttttagcttcaatttgaatttctcaaataactaatgatattgaacttcttttcttattctgatttgccatttatacatcatcttttttgaagtatcttaaaatcttttgtctgttttaaaaattaggttgttgtcttaatattgagttgtcagatttatttatttcatgtaagggctttatcatatatatattttataaatattttctcccattttatagtttgtcttttcatttcataatgggaaattgttccaaaatacacttttgttgtaatctattgtaatcagcattttaatgcatagttagcattcagtaaaattaatcaattttgactgtacaatttagtgagttttgacagctgtataaagcagtttcccatcaccacaatcatgatctagaatgtttctttcacaacagagcctcgcatgtctctttaaagtcaattctctcccctcactctcaccctgaaaaccactgataggctttccaaccagtatgaagggcagacttctaaattagaggaaacacaattcattgattattttctcttatgatttgtacattttgtttttaaaacatctttttc

SEQ ID NO: 197449 - DNA, 161 bp, Homo sapiens
atgttcctttctctaaatttcaaaaatattttcacccttattggatgtaaagagtcttttttcattttataccatcagattacagagagcttatgcgctggtccgtgtgtgtggtgggctggggagagtgtgggtgtgtgtgttcatgcgcgcatccttta

SEQ ID NO: 197450 - DNA, 811 bp, Homo sapiens
tttcctctgtctcgaaaaaaactttcacttgacccttttgctacattgtatgtccacagttcaaagaacaaaaaagcatctatgcccattgtttccactttcttatcttcctcctaagctctgtgcagtctgtgtccactgccataactgtttggaaagtatctctaggtatccaagggtgtcttctcattccttcttctctgagctgacccctccttcctgaagctccttttctttcctttgtggcccaccatactggtctagctcccatctctccaatagtactctctcttccctggctcccttctgccctcagtctttggacttctctttctgtagtccattcttcctacctgcttttaacccaagagactatccaggctcacactgatgataatcaccctcctcccactcacactaaatcaaaacaatgggatcactgtgtaatcccccactttctttctttatatccaatcagtcaccaaatcctctagaaacagcatgaactatcatcactagggtgaagttgcctaaatccttgtgcctggctcttcctttccatttctacctctatctcagggcctcaaaaatgctcatttagtttcctcaacacccccagactgaccttcaaaactgctgactctacgcacaaccatcaaaatacttgctctatgcacaattgtcataagagttggatgcagcagtgagtcagcatggcttgggggtaagggagagaaggaatgtacgggagataaggctggagaagtgtgtaggggtcagatcacaaggtgcttgcaaagctttactaaag

SEQ ID NO: 197451 - DNA, 572 bp, Homo sapiens
ggaagttcttgagaggcagagggagagcatgagaatgttaggaagggaggagagattctcacacatctgggaagctgacaatccatcagcatggccagaaggaaaataaggaggaggagcagaaatagatgaggctggatatagaagcagggctgaagctgtgtcgattgtggtaaagagttgtgattctatccagaacgcaataggtagcattctaaacagagatcttttcaaacaagagtcagcaagtattttctgcaggaggctaaatgttaaatattttaagttttccaagccatatggtctctctctcaatgactcagctcttccattataccatgaaagtagccagagacattatgtaacacatgtattggctgtgtcctattacaactttacttacaaacgcagactgtgtcagacatggtccatgcatggtagtttgccacaccctgttttagaaagctcaggtttatgatgtgatggagaatgcctacaagagctcttgttttaaatggtagagtgaacatacactggaattctatcctgcttatctcctaagctcttgatag

SEQ ID NO: 197452 - DNA, 489 bp, Homo sapiens
ctttgctgaagaacgactttaccttctggagaggtttgggcaggctgggggaagagagtaataggggcccattagataggtctgagtgggaagagagtttaatgagggaaaagagggatatgagatttgatgtggcagctggataggctctcagggaaaggtgagtaagcaaccagttgtcctgatagccttcatcttaggcctagtctctctacatcattgagtggtgaaacagacctgctgtatctctaggaactaaatttggtttaaaagatgacactgcttctggcagggtgcagtggctcacgtctgtaatcccagcactttgggaggccgaggcaggtggatcacaaggtcaggagattgagaccatcctgaccaacatggtgaaaccccatctttactaaaaatacaaaaattagctgggcatggtggcgcacacctgtagttccagctactccggaggctgaggcagaattgcttgaaccc

SEQ ID NO: 197453 - DNA, 2089 bp, Homo sapiens
  misc_feature (1)..(1): n is a, c, g, or t
  misc_feature (4)..(4): n is a, c, g, or t
  misc_feature (6)..(6): n is a, c, g, or t
ngcncnaggccacctcagccccaaccccaaccccagccgcatcccctgccccagctgacgggtcaaagcctcaggagagtgtggctctccccaggcgctaccaggaggggcaggtctcagccagctggggaaaccttattgccatggttcttagaagccaccccttccccaggcaagacaggccccaagggagtgtcccgagggcggttcccgggagccccgtgggtcccagcacttccacacactctgaggacagacacggcccctcttcttcagtggggacagtcatagggacaggtacagggggcctggttgaggctggaggtcagccacagccaagaagctccgagaccaacggatcgcccagcccagaccctcccccaggcctaagaggagagggaaccagggagaaaagtctagacccgctgccccaagccgcgatgcccaggggccccgcacagccccccgcgcagaggccgcctggccccgcggcctcctcctctgcgaggcgctcacagccggtaccccagctacggaaacgcagcaggtgcgaaatcgccccgagctcggagcaggaggtcaggccggccgcctcgggggaccctcaaggggaggcgccgggggaggggggcagccctgccggccgcagcggggcgctcacggaaaagcaggaggaggcccggaagctcatggtgtttctgcagaggcccgggggttggggggtggtggaggggccccggaagcccagctcccgggccctggagcccgccacggcggcagccctgcggcggcggctggacctgggcagttgcctggacgtgctggcctttgcccagcagcacggagagcccggcctggcgcaggagacctacgcgctgatgagcgacaacctgctgcgagtgctgggagacccgtgcctctaccgccggctgagcgcggccgaccgcgagcgcatcctcagcctgcggaccggccggggccgggcggtgctgggcgtcctcgtactgcccagcctctaccaggggggccgctcagggctccccaggggccctcgtggcgaggagcctcctgcggcggcccctgtgtccctgcctctacctgcgcacctgcatgtgttcaacccccgggagaacacctggcggcccctgacccaggtgcccgaggaggccccgcttcggggctgcggtctctgcaccatgcacaactacctgtttctggcggggggcatccgtggctccggtgccaaggccgtctgctccaacgaggtcttctgctacaaccctctgaccaacatctggagccaggttcggcccatgcagcaggcccgagcccagctcaagctggtggccctggacgggctgctctatgccatcggtggcgaatgcctgtacagcatggagtgctacgacccgcgaacagacgcctggaccccacgcgcgccactccccgcaggcaccttccctgtggcccacgaggctgtggcctgccgtggggacatctacgtcaccgggggtcacctcttctaccgcctgctcaggtacagccccgtgaaggatgcttgggacgagtgcccatacagtgccagccaccggcgttccagcgacatcgtggcactggggggcttcctgtaccgcttcgacctgctgcggggcgtgggcgccgccgtgatgcgctacaacacagtgaccggctcctggagcagggctgcctccctgcccctgcccgcccccgccccactgcactgcaccaccctgggcaacaccatttactgcctcaacccccaggtcactgccaccttcacggtctctggggggactgcccagttccaggccaaggagctgcagcccttccccttggggagcaccggggtcctcagtccattcatcctgactctgccccctgaggaccggctgcagacctcactctgagtggcaggcagagaaccaaagctgcttcgctgctctccagggagaccctcctgggatgggcctgagaggccggggctcagggaaggggctgggatcggaacttcctgctcttgtttctggacaactttccccttctgctttaaaggttgtcgattattttg

SEQ ID NO: 197454 - DNA, 1111 bp, Homo sapiens
tggcaacccgctcgggtccccttccacactgtggaagctttgttctttcgctttttacaataaatcttgctactgctcactctttgggtccacgctgcttttatgagctgtaacactcacggcgaagatctgcagcttcactcctgagcccagcgagaccacgagcccaccgggaggaacgaacaactccagaggctctgccttaagacctataacactcaccgcgaagatgtgcagcttcgctcctgagcccagtgagaccacgagcccaccgggaggaacgaacaactccagacgctctaccttaagagctgtaacactcaccgcgaaggtctgcagcttcgctcctgagccagcgagaccacgaacccaccagaaggaagaaactccgaacacatctgaacatcagaaggaacaaactccagacgcgccaccttaagagctgtaacactcaccgcgagggtccgcggctgcattcttgaagtcagtgagaccaagaacccaccaattccggacacaccggcacagtgttgacagacaggaaggtaggacaggaaatgtagctgaaatataagaacttaactgtctaccaaatgattacttatgtgatcgtaattctatgagttgtctacctgggataaaggatgatgaggatgggtttctggcagctaggacaattatttgaaagaaaacatcaaaagcaaaagaagtccccaaaacaaaagtcttaggaatgagagcatacgttagggcaaatctataaatttcaaggaaaggattctgccatgagtcaggaaaattcaaagttccatgactcctacttaatatttaaaagaagacgatactggttttctaacagatcaagaagtaaaactagaggtgatggatataattaaaaattaaatcaatagtcatgcacaaaaataatatcaggtctctactgaggtatgtattcaaacaatggaaacattgatggccagggcctaacgaagccattaataatcataacagtagccactgaattaataaccacattggaacgatggaatggatatagtagtcacaaccagaaaggtataaaggacctctgtgtgtagaagaaacagaacaa

SEQ ID NO: 197455 - DNA, 587 bp, Homo sapiens
actagcacatttcaaatgctcaagagccacatgtgggcagtggctagcacactgcacagagcagctctagagggtaacagaggacgccagagaaaggctggggttcctgggttaatctatggagcagagctgccccactggctcttagactattttaaacatttacttcagaagaaaacaacttctaccttgttagaactactgtatagggtattttgttattacagcttatcatatacctaattagtacacccattgggacctcacagaaggaccctgcagcttctcagttatgaagcaacccttcaaagaatgaacaggccaggcacggtggctcacacctataattccagcaatttgggaggccaaggcaggcaaatcacctgaggtcaggagttcaggaccagcctgggcaacatggcgaaaccctctctctactaaaaatacaaaaaatcagccgggtatggtgtaatgtgcctgtagtcctagctatttgggaggccagggcaagaggattgcttgagcccaagagtttgaggctgtagtgagctatgataacaccactgtactccagactggaccacaaa

SEQ ID NO: 197456 - DNA, 424 bp, Homo sapiens
gaaggtacaacttagcttgagctttgaaagtaaaggaaagaatagggggcatttttttaggcaaggataacaacataaatgaagcctgtagtagtagtttaatagaaagaaggagtttggttctacagcgtgtgatacaaaattaggcatgtattgagctgcttcgggggggctaaactggcttatatttagtataaatcagaatatctgtacagaatagatcataaattcatcaattaagatatggaaatatacttatacgtggtgtttaaactcctgcatgatgggatgtgtgcgtttgtttttatttgccttttatgcctgaggacaatgctgctgtcttcttaaattcagcacctattgattaccccagataaaaagttctcttcactagctccattttatttatgacttatagcagggt

SEQ ID NO: 197457 - DNA, 297 bp, Homo sapiens
agggaggaagagagagagaggagtgtgtgtgtgtgtgtgtgtgtgtgtgtgtgtgtgtgtgtgtcagggttgggaccagagcaggaacacaagcaagaagggactgagaattgtatcaacagtgcaaaagaagtcaaaggaattacttaggcataaaatgaggactgttcctcagagatgagtcagtcctgagaagccaaccaagccgggtactctgagtctggatccgaccttgctagaaatatggtctgaggcagcagaggtcctatgagagtccacagaaggtcagcacaggct

SEQ ID NO: 197458 - DNA, 1126 bp, Homo sapiens
cgagatgttacaacaaataccaacttttcagtggcttaataaaatataaatttatttttccctcatgtaatagtccactgcggatgtttctggttggcagacagttgtttttttctgtatggtaactcagggacataggctccttccattatagggatccaccattccctagggccttgaattcttctgtttccagtggacagaattgcagagatagggtggagaatgcatactttcttctcagttaccttggcctggatacgacacacatcagttctgttcacattcccacattccattggccggaactagatgcgttacctcacctgtctgcaagatgtgtgttccaggggagggaaatggaaaacattatctggctggggaaccacaggtgtggtaacagtctcatttgtagttggaaggagtagaaattaggaatgccttagtggaggacactgtgtgatatctgtcaaattttaaaacatacatgttctttgacctcaaaattccacttccagcaatttttcctacagatatacccacaaatatatacatgtttacacttggaggatatacctagtaatattgtaatagtaaaagattggaagcattctgaatgtccatcaaaggggactgagttggaaacattctgaatgtccatcaaaggggactgagtaaattattgtttatccatacattgaaacactgcagccactgagaggcagtgatatatgtactgactggggagagaaatgcaaggtacagaaccgtgtgttcacagctaccatttacttaaaaagagaaatatatacatgtatgctcatatattcatagaatatttatggagggatcacaagaaactggaaggatcacaaaaaatgtaacagtggctgcttctggttaaaattataaggtcatgggtcatgggatgagagagtcaggcttttactgtgtcctcttttataccttttgatgtgcacctatttaaatataaaagtcagttgtagaagtataataaataacatggaaagatggctgtaatatattattgcctaaaaacaagcttactgaaaattatgtacaatatgttctcacttttataaataaataaagaaatgggatatac

SEQ ID NO: 197459 - DNA, 433 bp, Homo sapiens
ggcctaatgttcactgccaggttttaaatgcaagaagcctggggagggtggctcatgcctgtaatctcactttggggaggccaaggcggaccacttgaggccaagagtccaatctgggcaacatactgagaccccatctgcacatatacaaaaaaaattagccaggcgtggagtgtgcctgtagttctagctattccagaggctgaggtgaacccagtagcagttcgaggatatagcaagctatgatcacatcactgcactccagccgttataatgagactgtctttattaaaaaataatttttaggccaggcacagtggctgacacgtgtaatactagcactttgagaggccagggcgtgcagatcacgttaaggccaggagttcaagatcggcctggccaacatcacgaaaccccttctctactataacta

SEQ ID NO: 197460 - DNA, 356 bp, Homo sapiens
atcacagtagctaactctaggaataaaaaatgatttatttttatcgaatccccagagtaatctgattatctgtcaggcacgagagataaaggctatttcttttttctcacgttagttcttacaatgttttggaaaatactaacgccaggggaacccgcagcaggaagagtgctcagccctgcctctgctgggaatacaccagcccctgaaaccaagcacagtcacatgatgggcaggatgctccaggacagagaagcctcaccgccgagggcagcaatcacgcccccgggtttgcaatcatatctctgcagtgagtggcagtgcgccagctctctgccacctttctacaggtgaca

SEQ ID NO: 197461 - DNA, 260 bp, Homo sapiens
tttgcatggttttggcattttgtagttctgtcaagttagcatagcttccttttgtactggatagagcaggacatgggtccggggcaggagctcagacatggaaatgacatcatagacctgagctctcaattccctcgatggccaggctgcaggtgccagtgggctccaaggattctattattaatagggctatgacttagctctatagaagccatcagggttgaattgcattccatgtggaaaataaatagaattttgca

SEQ ID NO: 197462 - DNA, 402 bp, Homo sapiens
ccccgactagcccgacagtccccgactagcccgacagtccccgactagcccgacagtccccgactagctccttcagctcacaccggatcgcttacctgcctggaagtcttgtctggcatgttcctcagacaggtgtgtgagcgtacattgccctctccagcttcacaaacaaatgagtcatcgaagtgacctttttcttagtactggcacctgaggcagtggcgtgtgaccacacgcccagcacctgtgggagcccctgtgagctcttccgtgtctcctaatgtgggtgtgcgctgggtttctggatctctaggtctggaaaggctttcctttctttgacacccagcagtgatcttagggagtgcttcatgctctcttcaggatggaacagagcgctttgca

SEQ ID NO: 197463 - DNA, 362 bp, Homo sapiens
tagctggtaattccagcctcatggacatacagatgtgtgccatcacgctgggccaatttttatcatttttattttattgggtttgtttggtttgtatttagagataggctcatgctgtgtcaccaggctggagtgcagtggcgcgatctcggctcactgcaagctccgcctcccaggttcacgccattctcctgcctcagcctcctgagtagctgggactacaggcgcctgccaccacgcccagctaattttttttgtatttttagtagagacggtgctagccaggatgatctccatctcctgacctcgtgatccacccgcctcggcctcccaaagtgctgggattacaggcgtgagtcacc

SEQ ID NO: 197464 - DNA, 133 bp, Homo sapiens
agtaagaccagccaagagatgttgagttacacatattgtttggggccacagagccctactctgtttctcctccacctgtctgatcccacagtactaacaatacattgtctgtaggcccagttgtaaagactct

SEQ ID NO: 197465 - DNA, 852 bp, Homo sapiens
tggtaacccccattctactttcagtttccgagtttgactttctagattccgtgtataagttcatgcagtctttctgtggcttattttagcataatgtcttctagatttatcgattcacccatgttacaaataacggtttccttttaaaaagctgaatagcattctgttgtgtctacataccacatttaaaaatccatccgttaattgggcacttgggttgcttgcatatcttggctagtgtgaataacgctgcattgggtgggagtgcagacatactctgtctcaaaaaacgaagtattagatcctcaatctcaaggtattctaagaaattttggagaccattgagtctaaaattcccagtatctttgaggcaggaacagacttggagaatgtagtttatgagcaggagtttggagctggaagaaatactgctttctgttggtggttaatgctgtcagctccttggattgtggctttagccctaaatattggggcagtagagactcttacctggaaaacaattgagggccacccatgttagcggcaagaggcagaggaaagcttggatggttgggctgaagatggtggatgtgctgtccctgtgagagtgctgatgctggactctggagccaacgacaaagtgtttgagcaagcagggtccaagcaagggcagtcgagggccggatgaagtgggcaggaaccgagtttcccaggtgacatcctgcctgtgctcatcacgccgaggggtgttgcacaatcacaccgattctttgtcactactgagtgcagtgttcttaagaatggggacctggcagctgggtgcgatctcagctcacaatcactagtgaattc

SEQ ID NO: 197466 - DNA, 343 bp, Homo sapiens
gacttagctgttactgtagattctgttgataacagttgcttaaactcaactctgtccccaccatcacacacttggatgctaagatcaaagttgcctagttacttccagattcgttcaatatgcatttattgaacactacttcctaggtaacttgccaggcacttgagtaaaagggtgaatcttctcatttttttctcatcccacagaaagtcctactttctcacaaccaataagcctcatatcaacagcaaactccaagttgcacagagactatcacatttgcaatcttcttgtttttctgaaacaagcattggcataaacagtaacagcaatgacttaggcc

SEQ ID NO: 197467 - DNA, 561 bp, Homo sapiens
gtagcggggattacaggcacccaccaccatgcccggctaatttttgtatttttagtagagatgaggtttcgccatgtgggccaggctggtctcgaactcctgatctcaggtgatccgcccaccttggcctcccaaagtcctgggattacaggcatgagccaccgcacccggccccttatattcttttatagtcatcccttttctccactgccaatccctggcaaccactgtccatataggttgctttttccagaatagtatataaatggaagcatgctcctgattcattctttgtctggagaaaacttagttcctcaaagcaaacatatcatcaccttcttatgttttcaggaaggaaaaattacctttttacttatggccaatgctgcccaagttttcctggttaccttaggtttggattgtgtacattcttcgcacagcccattccgtcttgttcatgtacctagcgttaatgatctggagtacatcagaggtggccattctctgagggtattttagatttataggtcattcaatactgggtctgaccaacagttctag

SEQ ID NO: 197468 - DNA, 505 bp, Homo sapiens
gacatgtggccaaggcaaattggtttcttctttggtccaccaccaatggacagggattgaatggagcactgtggagggatctggaggctttgtttggtgcaagaaggttccatgaagctaggctgtccttcttcttcccacaccaggcattcaaatgaaacagctgtttctctctcgaaagtcccagcctgtctctcttctgggcagccctagtttgtgaatgactacaacgtactaacaccattgcctgtgctgggcactttcactttgcaagatgagagcagaaaacatttactaagagtctgtatgtgaatgggttctagtctggttgctcccaaacctagctgagcgtgagcatcacctacatacctctgccctggcaaaggcctactgaatcagaatctcctagagatggggcaagaaaatcatagtccactaggacccgaggatgcaggatttctaggcttaataaaaatagctggaatatttgcctgcatctatcaca

SEQ ID NO: 197469 - DNA, 297 bp, Homo sapiens
aagctgagggatcatgtggaacaccctgtgcgttagtagacacatcaaaggggtcccatcttggaaggggagttaacctagccccaaaattaactctacacaacacctggctgaataaagcttgaaaataagccttcaaaggagcaaagggatccacaggtcactttagtgtacaacaaaagaaaattcagtactctttaaagaacaacagactccacatactcaacaaacttgtattacaatgttcagtaaataaaggactagacaaagaatcagaaaaacgtgacccatgaacgc

SEQ ID NO: 197470 - DNA, 235 bp, Homo sapiens
ttggctactttgataagtggtattttcattgtaactcttacggttttaatcaccatttccatgctaatgactcccaaatctagtttagcactgaattcttcactgagctttaaactgatattagaatgcctaagcatgaagaggcactaacaatgtcaaaaccaacatgtaaacacatcacctatccccccatactccaggtattcttttcttgttctaacatcatcccaagcaa

SEQ ID NO: 197471 - DNA, 356 bp, Homo sapiens
actgcaagtggcgctccagctgatcctggcttggggctctctgcactgctccaaatcaggcagccaggccaaaagaagatatgtagagtccatggggaacaaagcgaggcaaggtctgctgagcaaggcatggcttagagggaaaagtggggttgtggggagaagctacaaggagacagaataaaataatgaagaggagtgctgccaggcacctggcccagctgaggaagcctctgaggtgcgcatgccaaatctcagcagctccaagcccagctcccagaatagctggaaggaggcacactgccagcgagccacttattacagccagagctggggtcgacgcggccgcgaattta

SEQ ID NO: 197472 - DNA, 585 bp, Homo sapiens
ccccaggactccttgctggggtgatcatgagtgcatatacaatcaagtgtgtgaatctcaagtgtgaagggctccagctgggcctggtgtgccccgtgcgctcagtcagcctcagctgctgctgtcacaggggttcctgcacacttaagtccaggcccagaatgtagtatttgctcagttaaccactgaggaaggagaggagagtcggtagctgaagggaaatgcccaagtcatgtagttgcccttctccccctgatgtgctgagatgtccagggcggggcaagcggccttaccttcaaattcctgttcatcccaccaggctgatgtagctccttggtaaagctaaggcatgtggccagggccagagtggagggggttgcagaagacaacagccctttgttcttgctggtagtggtcccccgccccccgtttctgcagcaaggctctgcccaactcccttcccagggctttcttccatccccagagcacacactcattcaccccattgcctggggacatggctgtgaaccaggcaggccaggtcctagcacagggtctttgagaggggtcttcttgggccccctg

SEQ ID NO: 197473 - DNA, 688 bp, Homo sapiens
atggatgaagaaactgacgctcaggtgacgtcacctgcctaagtttgcacaggtagtaggttatagagctgggatttgactcagttctgtttgtctccaaagccggggtcctgacaatgacgtgattctgcccaaattctttaaattcaaactgtttgattatttaagaacctgtaaaactggccctgtcttacctctcctgttttctctctcattactttgtagcacaaactcagtttcagccaaggtagtctcactatctccaaatctgttgtatttttttccctctcctaaacttttgttcatatgggttcttctgcttggaatacccttccctctactcactgcttgttcatattttatacatctttgaaggactaggtcaaatatttatttatgtatttatttatttattgagacagggtctcatattgttgccaggctggagtgcagtggcacaattgtggctcactgcagcttcaatctcccaggctcaaaagatcctcccacttcagcctcctgagtagctaggtctactgacatgtgtaccacatgtgcccggctaatttttttttttcttttagtagagatgaggtcttgttgttacccaggctgatctcgaactcgtgagctcaaggattcctcctgccttggcttcccaaagtgctgggattacaggcataagcca

SEQ ID NO: 197474 - DNA, 271 bp, Homo sapiens
atcaacaacctaactctgcacatcaagaaactcaaaagagaagagtaaactgaaactgaagctagcaggaggaaggaagtaataaagatcagacctatagagatatctatatacattaggtatctgcaatagagaatagaaagacaataggaaaaccaacaacatgaaaagttggttttttgaaaagagcaaaaaaattgacaaacatttagctaggttaactaagaaaaaaggaggctgggaatggtgactcacacctgtaatcccagca

SEQ ID NO: 197475 - DNA, 348 bp, Homo sapiens
tccaccgggatgatctgtaggaattcaggatctgagttttttattttggcctttacctgcgatggaattgaatttgcatgtagaatggcagctggtgcctaggccgagggatcagagaagtcagcccactgtcaggtctggagaacgacgtctaggcaggtgatgaaattatggaaagaacaaatgtatgcgcaaggatggaggagggaaaacagatgagacacttttgcttctccccaggagcacagcctgcaccgtgaaatgtgctatttccacatattttcacactgaaaatccacggcccttccacctccagtgtcatgggctcgctctaattaattcagttca

SEQ ID NO: 197476 - DNA, 470 bp, Homo sapiens
ttggcttgtcatagattttattgtatatgctttcagcttaattgtgaactagttgagttttagcttccttcactgtctctgtcgggaaatatcataaaaatatactccagcaacaatcaattcaggctaacgtgtttgtttccttttgtatcttgccacccatccagtttcttatttcattagggaggatgcctttatcaccctactgagtaaggctttttttttttttttctttttaagtaaaggtgaaatctgtattcatcaaaaatttttttgtactaccttctcatatgacaaagtgtgctttctaaaataaatatattattgcagttatatgtttcatcattcttagcttttttcttaattttatcatgttaaaatattcatatgtgacagtttgttaataactaagtactgttaattgaactacttattattgttccctatagatataaagcagttcagaaaag

SEQ ID NO: 197477 - DNA, 207 bp, Homo sapiens
agaattttaatgggagaaataaagtatatttgtgtgctgaaaaagtgattcaatcataaggagaaaaatgattatgaaatgggtagttactagactgatgtccttactaggtgtgaggtatggggtctggtgcataagacaatgatcagggagaaacatctatgacagtagttctcaaagtgggaccagcatcatctgggaacttgt

SEQ ID NO: 197478 - DNA, 212 bp, Homo sapiens
tttatagacattgttttttttttccttcatgttaaagtgttagccatctatttctgttttcctaaatgtttttatcagaaatggatggtggcttttgacaaatatctttgaatcatccattgagatgatcatattttttctccccaagcatattaatacggtggattgtattaatagagttcctaattccaagagtcttggaggcccccttc

SEQ ID NO: 197479 - DNA, 222 bp, Homo sapiens
agtgctgggattacaggtgtgagccactgtgcccagcccctctactttcttattctatgaatttgactactctagatacctcataaaagcaggctgaaacaatactgtctttttgtgacaggcttatttcagttagtataatatactcaaggttcatttgtattacagcatgtatcaatttccttcatttttaatatatgtatgtattctgtgtcatgtata

SEQ ID NO: 197480 - DNA, 296 bp, Homo sapiens
aacaagctacaaataaaatgccaacctcttgaagcatggaagagtaattagcaatagtgttgattttaagaatctttaaatacaagatccactagtgacaactaacaatttcctaattgggcagaatttttgagaaccatatttcaagcatttttcttccaacaactgaatcctaacccagtgagtgattagcttttcctctgacacttatgtcaaagaaatgtattttaaaaggagggattaaaagctaaagccagccattcaaaatgcctgtatgggtagtgaatttacactga

SEQ ID NO: 197481 - DNA, 779 bp, Homo sapiens
aaattttatttgcctcatgatgactgtctgccgcttagaagtagacaatataaaatctcatcactatttcacaagaataaaattcaaatcagttatatccaaagtaacttttcaactgggggtggtgtctcacacctgtaatcccagtgcttggggaggccaaattgggaggaccgcttgagcccaggcgtttgagaccagctggacaacatagcaagactcatctctacaaaaaaaaaatttaattagccatgagaggctgggtgcagtgacgcaagcctgtaatcccagcactttgggaggccgaggtgggtggatcacctgagttcaggagttcgcgaccagcctgaataacatggtgaaaccccgtctctactaaatacaaaaaaattagccgggcatggtggcacatgcctgtaatccgagctacttgggaggctgagacaagagaatcacttgtacctgggaggaggaggttgcagtgagccgagatcacggcattgcactccagtctgggcaacaagaacaaaactccatctcaaaaaaaaagttagccatgatggtgcatgtctgtaatcccagctacttgggaagctgaggcagaagggtcacttgagcccaggagttcaaggctgcagtgagccatgatggggccactgcattccagcctgagtgacagagtgaaaccttgcctcttaaatgaataaaaataaagtaagctttcttcaacaagttttcttccaacgccacacactccatcaccatattaatttaaatta

SEQ ID NO: 197482 - DNA, 380 bp, Homo sapiens
  misc_feature (13)..(13): n is a, c, g, or t
  misc_feature (20)..(20): n is a, c, g, or t
gcgaggtgatctnaggatcncatttatccccaacacccagcctgtattttcattttcaatcaattcagtgtatttttaaaaatttcttttaagacctctttttgacttatagattatttagtagtgtgttgattagtttctaagtgtttggatattttcttgctacccttctgttataaatgtctagtttgattcaactatgtccagtaacacactctatatgacttcgatttttgaaaggttgtttgagatttgttttatgaccaggaatgtggtctgtcctggtgtaggtgccatgggtatttgaaaagaatgtatattttgctgttgctaggtagagtgctctatatattttgagtagatcctgttgtctaattgtg

SEQ ID NO: 197483 - DNA, 489 bp, Homo sapiens
gaagtccgtctctagaatggctatctgttagatagcagaaatatttagaatgtatatggcatttctaatatttttacaaaaataattttaaatcatgtaactcgaattttttttaaaaagtctgttttctttttggaaaactggcacaataaaaataacactaatataattccattgtatatgcatgtgcattgaacccagagtgggtatactaaagatagttcatgcaaataacttatgggaagtttggctattttttcatgtatgtttataaatatatttagtcatctactgtgaccttggtagcacagaagcattttgttagctgtatcattaattctaaaaatcaaattcttggcatagtaggctatgagagctttttgttacttggtattttggctaagaaaattatttcttgcactttctatttgtaaagatgttataacacaatgcacccacttaatgcagcttttctttagagaaaaaaga

SEQ ID NO: 197484 - DNA, 441 bp, Homo sapiens
attggcaatttagacacaaccccatggccaaccgaaaccactcactcttcaaagcactgtctgtgtgggcagctacgccccaacacccggcccagtgcacgttgagcaggaagagaagcgagctctcagctcagcgcactttccagaagccaagtgcatcggctgagcacacaacatttaaaatatttagaaaggcacagagtggcatctgtaaatatggcaagaaaagcctggtgaaagctcagctggatcctgagcatgtttgaagccactgcaccccactgttcttacgccctttagtgtagacactgtctacattggctgcttgatctgaaataacttggagaaagaaggctttgtgccaggccaggctcggaggaggtgtgttggagaagagggcacacattagccagcagcagtcagggaagactctgcataagt

SEQ ID NO: 197485 - DNA, 250 bp, Homo sapiens
aggaacccctattagacatccttctaggctctgtctgtaaagatgctgagaggtataattcctagagctttttaatctgtggccaactgcagtcatgagccacacagcccctctgagtgcactgccatggtgtggagaagatttacagcccctcaaagggctccgcctgatattattcaaagcaccaaacacagagcatgggcaaaagcaaacgtgaccagtgggttcctgattgatgggcatcctctag

SEQ ID NO: 197486 - DNA, 648 bp, Homo sapiens
agatatagtcttatagaaaaaaaacccattaattacatattcaaacatactgcatctataaagaatactagagaggagaagagacatcattccaaatgcatgtactaagggggaattagccttttcatggtggtcagagaatagcagaattactaaaggggagttcgtgttttcatggtggtcagagaatgctatcctgagatctggagaatgagtggtaactgactaagtgaggggagcacagcatctgcaaaagtcatagggcactagggagcatggtgaatacaaacatctgaaggacctgggtggctagagggcaagacagagggacagtgtagtgagatggaattaggagctacctagggacaggtcacatagcttggaccttgttggccatgttaggatttatttttattttgaaggcaataggaatcagttgaatagttttaatcatgatgtgagggttatggtgggaataacatcatggttttgaagtatccttggactgaagaaaatggagctgggcaggactatgaaatagatggtgatggttgagatagagagcagcagatcgacttgacagatatttggaaggtaaatggacaggactttttgacagattggacatgaatgtgacacaggagttgt

SEQ ID NO: 197487 - DNA, 528 bp, Homo sapiens
tatggtactatgttgtgctatactatttatatatactgatttcttagaagtcataaagcaactcaatagacgcttttgttaattacagatagggcagtgaaataaactgctaaaaaacaaaaacaaaaaactacccatgatatgaccaatccattttgaaactataacaataagaactttatccatatgcaaaatgacaaaatgagtaatttaattatgttttggtgcctttataaattaaacgaatcacatctaatttctgaaatttcattttaatgagcttttgaataactgaagtgacaaacagctgtaaataacaatataaaataaatgacaaaataaaatgctaagataatgtggaattatactgatgagtaaattaatcactttgaaaaatatagtaacatgtagaaaagtaaaggagaaatcctgtcaactgttacttgaatcattttggtgaatttttggttcataaagttttataattgtatcaatttactatcagcaattttaagcgagtcatgtgat

SEQ ID NO: 197488 - DNA, 874 bp, Homo sapiens
gatggctacgaatgcagcgagatcacttacgtagagggtcctaacactatctctaggacacgtgagagcctgcccttccctctacagtatatgacatgagaactaagatgcggtctctacacaccctcaaacactcagaaggcagacggggggacaagacagatacccaaaagtagagggcaacacaaaagtcccccaccctccataccacaccacccagcagcaccggtaagggaagagccagaggcgcccatgtgagtggccgggcacagcccactcactggcagcctgagttcgagccctgcagatggtggaggaggacttcctgccctgtctcttagcttcagaaaaggacatcagggcatctgctgggtgccctgggaatccaagcgccattgattacatggaggagcaggcccagaaaggccacaggagcctgatgaggactctggctgctcaggggactggtaaggggagacaggtggcaggcccgaaggctgggatggtagagatgagcctcaggtaaaagagaaggctttacagcagagatgaacattggcagagaagagaggtggcttgtcctgggttctcctgagtctctgctgccagacaaatcacacacaaacacttgggtatcctaacctgggagatcattctgtccagggaaagaagggaggggcatgagcgtgtgtctcccagaggttatttggaaatgtctggagatagttttgattgtcaggatcaagggggtggctactggcatctagtgagtagaggccaaacatgctgctaaacttctcacagtacgtagggtggtccccttgcagcataaacgtgtctgcccaagatctcagcagcttgaaatgtcgccaat

SEQ ID NO: 197489 - DNA, 713 bp, Homo sapiens
caaaagcattagcaatggaaataaggcctatagaatcagtcatgtctccataaactttatataaagggccagacagtgaatattttagaccacctggtctctgctataactaaactctgcttatagcatgaaagcagccattgacaatacgtaaatgagtgagcaaggtggttttccggtaaaattttatttacaaaagcagatgggaggccagatttgacctttgggccatagtctaccaacccctggaaaaaacagttgtctttaccagattgaatgttggcagggtaaatggtgacatgttatatgtattctgtactttgttttgacttaataccatttcataattattttatatcagtacgtatagtattgctgttctttttaaaggctatgtaatttttctttttatacaggtgttaatttgataatttgtgaagtttatgaagtttccaattttggggttgtaaactgttttaatgaatatccttatatatgttattttgcaaatgtacaagtatatctgtggaataaattgctgcaagtgttgtaattgtcatgtatgttgcaaatacattctaacagtttgtcactttttttgctttatggcattttttgctgtgaaatatttctttttatgcttagttaaatttattattttttaatgacttttgacatttgttataatgagaaaggcttctgagtataaactt

SEQ ID NO: 197490 - DNA, 863 bp, Homo sapiens
tgtggagtaatacaaatatacccataaatgatgaatgaagagaacatacatgtaagtggcatgtgttccttggggggtcactagagccagtcaaggcaattattttcaaccagctcttcctaaaatcttgactgctgtctgtaatttagtgaacactacatctgaaccaagttctttgaacttcacctgatggcccgatccagtgggtctggagtagggcccaagaaatcatttctaacaagttcccatgagactctgatgctgcaggttgggagaccacactttgagaaccactgttttaaactgagaactaaagcttcccctacccactctgcagagatgagcttcctcttcttttccccaacccttacaaccacctcagttccatcaacagctggctgagttcaaacacagctggataatgaaaacaagttagaagtcctattaaaaaaatctaattatggatgactctcagtttattctattacgagtttttagaagcaattttacagctccaaattagaactgctttacatactaataagacttttcaacaagtgatggtgatgaaggcaactgcatgatgaattaagctgcttttcagagagcattcctagaggatttaccaagacaagagaaatgaaagaaaaatcaatatctatgtggaaggcatttaagagatttttttaaattatattttaaagttggtaaagattttgtgctgggcacactggctcatgcctgtaatcccagaatttggggaggtggaggcgggaggattgcttaaggccagaagttcgagaccagcctgggcaacaaagtgagacccctgcccccacctctaccaaacaaacaagaaaaaa

SEQ ID NO: 197491 - DNA, 915 bp, Homo sapiens
cactgagcacaatgcttgcaaattataaatgacaagtatttgctaacatatttaaaatattttaaatcaattagtctttacataaatgatactagtattcaaatttcaggtaattctttatgcttaattcattgatttgaggagtaatccatcatactttcagagtctggggaaaattatgatgatgttaaaaatgtaagaaattaactcacatctccatatccccactggtctgcctatggtctggtttctgtgctgaccccagtgatctttaaaaatgtaaatctgctcatattacagagagtgtagagcccctattttattagtggcctattacttttaggataaaggctaacactaaactcaggatggccttttccatgctctctctttaacttcctcttgagcctggcttgctgttattcagctagactggctatttttcagatttttaaaggcctatgttagttactgtcccaggacgttgctctgaaatgttctttctgtgactctggcctcctgaactcctgtgcatccttcagatctcagcataaaggtgacccctcaaggcagctgtcctgctccttccctttttctcttcccatctcaatagcgacctttggcatctctagtcataaaaccgtggtctcttacttgaaagcatttatctccaattctaatgaatcaattaattacactggtattatagctccctagaataagtggggatataaagttgtctctctcattaaacaatgatgggcagggattgcatctgtgttttccattgtaaattctaatgcttttccactcctgaaaattttgtaagatatagataagaccatggaactcattcttctgcttaaattcctccagtacagctcctttccggtaccgaatcgagtgtatcatgta

SEQ ID NO: 197492 - DNA, 410 bp, Homo sapiens
ctagtcataaaaccgtggtctcttacttgaaagcatttatctccaattctaatgaatcaattaattacactggtattatagctccctagaataagtggggatataaagttgtctctctcattaaacaatgatgggcagggattgcatctgtgttttccattgtaaattctaatgcttttccactcctgaaaattttgtaagatatagataagaccatggaactcattcttctgcttaaattcctccagtacttgccaatcataattggaaccaaatccagactccttactaaggcctcctttgatgaacagcttcctgttgctttgctaacagcctttcctagtcgtcttctttcttatgacattcctctctcttttacgcctgtcaaattcattacaaagtcagaggta

SEQ ID NO: 197493 - DNA, 521 bp, Homo sapiens
tgttagtttttactcttaaggaggaataatgatcttttattgtaattctatgtaatttctgcttattcacttcaaataaaagtccacatgtggcctgagcgtctatgtagacaaaaagtgcattacctcatgaaaggattgagacaaattgaaagtatttcgggatcaataagataaacctcccagttgggtgctgtttatctttatacttgtaatcccagcactttgggaggctgaagcaggcgtatcacttgagctcaggagtttgagaccagcctatgcaacatggtgaaaccccgtctctacaaaatatacaaaaattagctgggtgtggtgtgtggtggcacatgcctgtagttccagctactagggaggctgaggtgggaggattgcttgaacctaggaggtagaggttgcaatgagctgagattgcaccactacactccagcctgggcagtagagcaaaaccttgtctcaaaaaaaaaagataaacatcccgacaatataagagtataaaaaag

SEQ ID NO: 197494 - DNA, 335 bp, Homo sapiens
tcataaaaaaaaaaaaacggttctgcattgtatcggtgccatagagctcagaggtttgcctttgtactgaagaggcccggggagagtgacatgctcaatgtcacacagcttgagagttcagccaagtgagattgtgactttgaccatatctttgttccagttgattcttctgttggggactggggttgcagctgctaccctgagaggaaaggaggtaccctcagagttaacaaggatccttcagtcagccaaagggccgggctgtcaatctgggcagccccagggtaggaatgcaccatgcctgcagagcgagtgtgggtgcaggtgggtgcccg

SEQ ID NO: 197495 - DNA, 554 bp, Homo sapiens
gagggtggggggatgccctccttccacagggccctgtggcttccaagcctcaacctcctctggtctcttgtctgtggagcctccttcaaacccagggaaacaaaagcacctgccacgggctgctgtttttctaggatcttctagcgaagctctgtaacttcccctgagagccatgaaactgggctggctcccagggtgatgggactccagcgtctttgttctttcttgttctatgcatccatgctctgctccaccgctgccccttcaactctgcccacacatattactccagactggccctgtggtcagagcctggaatgcctgggctgctgggggcttgcatgcaggctgcactggactagaagcattggcgccttcaagactgccctgggaaacatgacctgccctgtttctgtctagtgagtacccatttttccccactcaccggctcacttcccttggctgggtcaattagaaaaagctcttctgttggcctgccctgcagggtggagttcagagggcagctcaagagcccggtgacagctcaaaaaata

SEQ ID NO: 197496 - DNA, 445 bp, Homo sapiens
ccagttcgcaggatgcgggcaaagcacgcgtgagcaccgggcagctcttccttggggccctgggctgacctggcccagcgcagcctctgtgaccatcgcagccctggagttttgcaatgatttcattgacctgtttctctggctcagttcaagaggcatattctctgcaagataaacactcactgtcccttttaaactttgttttattattaaaatctaccctcttctgaggccacacccagtgtctcaagtctctgggccccaacattggtcagagccaggccagacaaaccacggaggcggcatgaggctgcaggcctgtgtggctccccctaatggagtcctggaggctggtgtagaccctgcaacacccagacaagtgggtcttggctgccccccaagctcatgtgaggctccccagctccaccctcagtagaactcaccc

SEQ ID NO: 197497 - DNA, 623 bp, Homo sapiens
tgtataatgacaactgtgtaatgtatccaccattatagtatcatatagaatagtttcactgccctaaaattcccctctgctccacctattcattcctccgttcccccttattcctggcaaccactgatctttttactatctcaacatttggttttgcattttccagaatgtcatatatttagaatcatacaatatctagccttttcagattgattggcctctttcacttaataatgtgcattcaaggttcttctatgtctttgtcttttcttggcttggtaactcatttttgtcattagatagtatttgttgtatgggtataccacagtttgtccattcactttccttacttcaagttttagcaattatgactaaaactactgtaagcatttttcctttcataattgagattttgttggttgtgttgaggaccagtccacagatatctcaatttgtacacaattcttaacatacgtaccaagaatctaaaaagctatgtgttgcagttcttttttaaagtatttggtcttttgtggccattgctttggtgtttagacatgaagtccttgcccatgcctatgtcctgaatggtaatgcctgggtttcttctagggtttttatgg

SEQ ID NO: 197498 - DNA, 444 bp, Homo sapiens
tgaatttatcatgtccaactttcatgagcaaatgtccctacctctattgctttttaatctaaaaggacgcttgctgagcatctctgtggtcccagcacagtatgatgttagcaggactggcctctacgctgtgatgacagtctccttgtctgatcatagcaagcagagaagcatagcttactcaagctgggttcttagcacttgttcctcataagaaagctgatgagcattccactctgacatgtcaaagacagaaaggagctttctttcagcacttgtcttttgtagttccactgacaggactaacttagtgacagaggatcctttagcaagctcccaatgtgggtgattgagcctctccctgtccagggttgaatcatgttattcccttagtaaatctggatgctagccctcatgtaatcttcaggctctgtgacctgagct

SEQ ID NO: 197499 - DNA, 321 bp, Homo sapiens
ctatgtcttcactaactttattatataagaacataaatacatgggattacatttgacaaaatcaggatctaatcagagaaatgctaggaatcttttaggtggggagaggccaagatacagcttgcaatgaagttgtctcccaggtggttttgtctcaagggcaggcctaggtacactctgctggcagtgcaccagctgtaagttaatctatctgtggctcagcagctggttctcaaagtttttggtcttctgctcccattacattttaaatttttttttttcttttttttgagacagagtctcgctttgttacccaggctg

SEQ ID NO: 197500 - DNA, 680 bp, Homo sapiens
cttgtttttccgggtataactggtcccctatctcctaagggcaacaaagcatcctaatcctttactaattcccatacgccatattctcagtgattacatgttaagtcacatctttaaatacttatcctaatcgattcctcaactccagtcctacttccccgaatgcttagcaggcatccaatctatttggatgcctgctacaacatctatgccagaaactgccgaattcctcctttgcagtgactggaatcttcctccccattcgcactaccaacattctatgctttggcttgatctctcacactacaactattgtaacagcctattatctctgcctccaggtaactcctgtctccatattattatcacagtgtttttttaataataggcatcatttaatcaccaagtatttgagtgcctacattcaaatgcataaatgctaaacagaatacaaagtaatttagtaaggttcctatcctcaagaatactgtaaatacctgctttgaaaactttcatttaaaaaataaaataactgggcataaagcagagattgagacctgtagtcccctggtggtccgcagattaaacctagcctacaaagtataggcgcaaataccgttttagattctaattaatgaaaaacacttaaaatccaagtttaaaaatcataaaaagggctg

SEQ ID NO: 197501 - DNA, 525 bp, Homo sapiens
tctccagttaaacccttctcaggcaccacccccccatccaggaaaccactccccaagaggaagaacacgtggaacttcctgaaatgcgcctacatggtgatgacctacctcttcgtatcctacaacaaaggggactggttcactttttcctcccaagtgttactgccactactgtaacttggaactggacatcagggatgatccctgctgttctttctagtgagcctgctccatctcagcttagccttcacaaggcctccatctcccaggcattctaacctctgaagaaagctctctgtcccctggactgcctgtgtggagggtaatgaactgggtcctttaaggaatggcacctgggtgcccagaggcatggccagaaggtgtctgtgggggccatgccttagggggatgcacccagggcggctgagagagcaactgcaggagtttcccctaaaatctctcctccagatcgttctcgaactttccccactacttccataataaaatgtatacttgttgaaaaag

SEQ ID NO: 197502 - DNA, 288 bp, Homo sapiens
ggttacgtcatgtagtttacgcattaactacctcactaaatgcaggagtcacgaggctccacttctttatactgatcctagatcttcctcttaaggccttttcctacccttatgttttgtggtgtgcttacaaggacacacggaaaggttgaagaagcagattcctctcctgccttctcacacagtgttctgtttttttggttgtgttttttttttttttttttttttgagatggagtctggctctgtcatccaggctggagtgcagtggcaggatctcagctcactt

SEQ ID NO: 197503 - DNA, 363 bp, Homo sapiens
cagcggctgcacaggaataagactgaaaagagactgcaaaggggcctaggaaattttggggggaagtaaaaattactctattattaaagtgattgttacagccactgatctgtacattaaaaatttgtgaaattattgcaaataaattaaagcttggtaaaattgattgaaaaaacgttatgggccaggcgcagtggctcatgcctgtaatctcaacagtttgggaggccaaagcaagcggatcactcgaggtcaggagtttgagacctgcctgggcaacacggcgaaaccccatctctaaaaaattagccaggtgtggtggcacactcctgtagtcccatctacttgggaggctgaggtgag

SEQ ID NO: 197504 - DNA, 668 bp, Homo sapiens
gctggaatatgaaaaaactggagtaaaaataagcaaatcaatacttctgaaatgaagccttcattggtagaaaagagtgtaggtcacaaaaatgaattagcagaagttcttgatttctaattattgaagattcctatctagtggtattctaatatgcttaccaaattatgagttgcattactttttaaaaacctaaaaccaagtcaagatttacagagtgaccccagtttattttgtttggtaagttttcagttccagttattaggcaaaacaaaaattgctaatacgtaacaatgctgaaacaggcgattggtagaataaaacaaaagggattcatacagcttttgtactgtcttcttgaaaaagtcatatttggccataaaagctaatacatgctttaggaatggaaatgatttaacctgattttttcaagtaagatttgttcaagaataatgggcttatgttgtcagttgtgggttcaagcagtaattcactttggactgcttctattcaacagtatgctgtctgtacgtaaagagttacatggaatttaattttagcattggaatctatttgagataccattatcttttatattcaaatgaaaaattatgggcctctagaattaagtgttactaacctgatatagatagaataatagctgtatc

SEQ ID NO: 197505 - DNA, 405 bp, Homo sapiens
gggtatatgcacttgttgtttttgatgctaccacatggggatatttgcctcgtctgaactctgtgtattctctgctgcaccttgttgcttctttgcaataaacttcctgaactcaaagctaatactggggggaatcccagaagctgctgagggcagggccatgctgctcagtgttccaccctagctcctgacagcatttccctagaaaactgctgctgggcctctaatggagcaaataaatctgtgtacaactaggcagcaatagtttgtccaaaagtcctggtgtaatctagtccctcaaactgtgcagccttacatggagtacacacacacttgcagccttgaagtactacccactgaggggagaaggcacggcaaggggaaaggttggcacaggatggagca

SEQ ID NO: 197506 - DNA, 689 bp, Homo sapiens
aaattaggattagtcagtacaaccatcaccatctttagcatcctttggtctctttatggggcacggtgacttctggggcctcacttagactaatgcagcattcaagacattacaagaaacacaatgaagaaaacatgcacataaaccaatacaaatactgagaagtgaagaaggaaaaggaaattgaatgcatgaaagaagctattttttaaaaagatgatgttaaaaaagccaaaagccactaaaggaatgaagatttgaccgtccagaggctgaaaaaaaaataaatacaaactaatgatcctagattctcataaaacacaatacggaatgggtcaactgaatttacatgtcagtagaattgcctttttactggtcaacttgtctaaaagatttccaaacatgtgtacacatgcaacaacctagagttggagggctccagtacaataaaagcatgctaggaaaatagacaaatttactttgatgctctataagggaggcatagtataattttctgttttggttataaactatggcctaaaataactcttaaaggctagatcacacaaaaaatttcacagaagtaaaactcgtagtacaacattcacttttctggcaacatttgtccatttctagtggacaaattaccctaccagaggagaggaagatggtccaacacagaaatatta

SEQ ID NO: 197507 - DNA, 206 bp, Homo sapiens
ctgggttcaaatcttaaccctgccacttagtggctctttagtaaagcagtatcctcatttaacttctctcaaatgttactaagaagacaacctcctacacttggagaattatagcaaagatgaaagaaaacgatggtgtcagaccccttatcacaaaggcattcaataaattaccattagccccacaaagcattccctaactaccc

SEQ ID NO: 197508 - DNA, 365 bp, Homo sapiens
aggggagagctgatctcccctatgggctgaagttctcccggcagtgcctggggtgacaggtctcccctggcccagggctccgggctccatcctccagaggcaaaggagacagtaagcctgccatctcgggtcctttcatggtcaccaaaaatgttgtggggaactgaggaccagagagactgatatggagaacaggaggattgtttattttaaggtacgcaccggctcagtggattcacatccaaaaaactaaacattgaacaaagacagaacgtggtttttataagcagatttacagaagcaaaacaaaagcagttaatcatacagtgacaggtcacataatctatagcataacataagttgtg

SEQ ID NO: 197509 - DNA, 469 bp, Homo sapiens
gatgctcaacgcaacattcttttgcagggcccttgtcctcagtttcccttcttttggggtgggctgagagagacagcttattcagcatgaagctgtagtatctacagtttagcaaatgtctgcggagcctttaaagcagtttttatcataataaaaatattttaacttataaccccagaaagagataggcatgggagtctttatacagcacagaaatccagatgagcataatttgaaagtcatttgaattgtaatgagtatttttaatgtaaacaggcaggaggaaaaacttgctgggttctcttgtagcacagacacccagatatatgtcttttgatagtgatattaaagtgtcaagggtgcataggaggctgcagatgtcagcggcatgaatgggcaaggcaatttctgtggttgcaggctggaggttccagcaggaatagaaaggcaatctctgtgctagatggcc

SEQ ID NO: 197510 - DNA, 546 bp, Homo sapiens
aggccagatttttaaaaatcatactttctcaaggatctccacaaactggagggtgtcctggctgtctgtgtgatagcctctttctacaagtgaggcctcaaatgaactgcagctatcctggtgttcctgtgggggcactttgtatgaaaaaagggcatgtactccaaaacatttttgtaggttctttggccaggcgccaaacagtacgaaagagtccaatgtaggatttttcttactgatagcagttattcattgcagtgaaataaaatatgatcccagtagggaatcttgaattctgacctcccatgttctattttgaaataaccactttatgtttctttttttttttttatctgatgatctctttgaggccagcttcagattttggtggtacaacatgaaagattaggaaaagcattaataatctgtgggtggaaaacttattagaaatctgagagtaaagtttgagttaaaagttgtttgaacatggaattgactgggaggccaaagatttttaaaagcagaagattcttaagacctgaggaa

SEQ ID NO: 197511 - DNA, 126 bp, Homo sapiens
accgtgatgtatccccaacaccaaaaacaatgcctagctcatggtaggttctcaataaatatttgttgattaaatgtataatgatagagagtgttgggcgataacatcacggtaccgagctcgatc

SEQ ID NO: 197512 - DNA, 313 bp, Homo sapiens
ccagccaggcgtttcctagcggagcaggggcgggagcttggacggagaagggcacaggccggagcgcggtccgctcccgcgagcctggccccgcctggcggagccccgaggagccaccgcccgcagatcgctagccgggcgcccgcgaggcgcgagccgtgtgcgcaccctcaactttgctgccgccgggggcgcggctcccgcgtgcgtgtgcgagtgtgcctgtcactagcggcctcctgggggcagcagcggaaagggggacgcagagaaaggcagcctcggcgcaccgcggccagggaggcagaggccc

SEQ ID NO: 197513 - DNA, 457 bp, Homo sapiens
cattggtcaaacagtgagtgagcacctactatgcccatgcactgtgctagatgcctgggatgagatggtgcctatggttaaatagagagaacactgaattgagagtcaagagctatgacttccagtctagctcaatcactaattatctctgttcccttgggcaaaacattaaatgtcttctgagcctcatttatttacatgactgttgtataattcaaatgagaagaggcatctgaaagaattctgaaaactgtaacatctggaaaaatttgaggtgcaataaaagaaagaaccacaaacttgcagagtaagacaaataagggatggggtggcaaatctaattagtgagtaatttaaataacagagtgcttttaaagaacttatgttccattactcttgagtacacacagtaacaattacagtgactgactgtacgctcaaacactggccacacaca

SEQ ID NO: 197514 - DNA, 342 bp, Homo sapiens
tgaaaaataagagttagaaaaagggaggaggaagtaagctaataaaaccacaacagatacattatgcaaaaatccaacaagggcttgagctccaaattcccaaaaaagacccatgcactaaatacttaaccaagccattacatttcatcaagcaagcagatgggcagttaagtgtcttttataaaacgctcaagttctgctcctatcacctggttacccctgagcaatcttcccagactttcccactctgaacctcaaatttccttgtctgcagaatggggatgataatagtacttctccacaagactgtggtgaggattaaatgagttagtcaagtgcaca

SEQ ID NO: 197515 - DNA, 692 bp, Homo sapiens
cgctgggcgacctattgccgagcatacactacaatacagtcatttgtgaagtaactaaataaaagtttttcttcacactagactggccccatggggttttaatcactaagaacacatggaaacattaaaaatgtaacctcaactaaatatgtcatcatcactcttctaatctaactggtgttcttttccaaaactgaagctttgaatcttcaatgaatttttttattatccactgacatttgaatgctacacataaaacaaaacctaagatatttgctgtcatttacagcaaaagaagagactatatctaagacatagttcaatctggacaattattctggcatgatcaaaataccagtaagattttcagatgcctaaaagattccaagtattttatacctttagactaacactttatgtattatatgaatgttttgctttggagccataggggcctgaccttgattcccaagtgtcccacttactcagtttactcatctgcagaataaagaaaaataatagtactgatcagtctgtttagaggataatgagataacacagtaaatatgtaaggcccttagtattagtaactatactaaagatgagaaatgctcatgtgtctcttcacttccccaatatagattaactaattgtagccactgtcaaattagatagaataaggtatcttaaac

SEQ ID NO: 197516 - DNA, 844 bp, Homo sapiens
tgtatacttcattatcatttctacacttcaccatcatcatcgtttaaaaaccctttttaatgggccaggtgcagtggctcacgcctttatatcccacataaaactctgtttgaataagtaacatgaataaattcatctcttcatatcatttgactgtttttaatcttgcctttcttatcactacaatacagtcatttgtgaagtaactaaataaaagtttttcttcacactagactggccccatggggttttaatcactaagaacacatggaaacattaaaaatgtaacctcaactaaatatgtcatcatcactcttctaatctaactggtgttcttttccaaaactgaagctttgaatcttcaatgaatttttttattatccactgacatttgaatgctacacataaaacaaaacctaagatatttgctgtcatttacagcaaaagaagagactatatctaagacatagttcaatctggacaattattctggcatgatcaaaataccagtaagattttcagatgcctaaaagattccaagtattttatacctttagactaacactttatgtattatatgaatgttttgctttggagccataggggcctgaccttgattcccaagtgtcccacttactcagtttactcatctgcagaataaagaaaaataatagtactgatcagtctgtttagaggataatgagataacacagtaaatatgtaaggcccttagtattagtaactatactaaagatgagaaatgctcatgtgtctcttcacttccccaatatagattaactaattgtagccactgtcaaattagatagaataaggtatcttaaac

SEQ ID NO: 197517 - DNA, 487 bp, Homo sapiens
atccaaaggcggtgttaatgttttagtgttttcaagtgtctcctatcccaccccttgcagttttcttttaagtagttggtttcatacatattatgaaatgcttttgtatcttgttttatattgcttagtgtgttttctcagtcatgagtcgcttttaattaatcattttttaagtttgcagttttgacagtgaaataaatcttagaattttggcttttgttaatacatttccatatcaaagcaagggaagtttattccagcaaagacttgatgtaaaaccatagtattatatttagtaagctggtgtttgtggtttggcaatttcaacttaggttctggtggggaggggttatcctttattgtattcctgggtcagagggtgaagatgcatgataattagaacttaaggaaaaaaaaaatcaatagtacatgatttccaacctctaagagcttataatcaacagcagggcttacagaagcaggttta

SEQ ID NO: 197518 - DNA, 1461 bp, Homo sapiens
tgtgtaaaccactaggaagtaaagacatagaactactctcacaagtgcttttctggttattgtgacgctgaacttcatggcttgttttaattaagacatcttacaagtgtcaaaatttggaaatatttggacactgtacactctggttatttaaatatctaacagcggttcttgagcattttgagaaacctttgaaaatctgatgaaaggtatgtgccattactctagaaaaatgttcctgtgtacatgcacatcaagtatcacatactgtttcaggctgttcaaagactacaaagtctgttcatgacctaatggtccatgttccctcagttaagagctccagagataaaggatgtggaactcaaaggtaagtacccagagccttgaaaactccatttgtgacttggaagaattctacaatttgaattaactttgtggagagagatatatttttgaaaaattgtgtgtacccaaaaaatttcatatcaaataatattttcctgtagtgcattcaaggatctggttccacagcaaaaaaattgttttggtctcagttcctcaaaatcacatttaaggagcttgagatttatattttctacttaataagtcttacaaaagcaagttaagaaggaaaatggacaatcatttctgcacatatagggtttaataaaacatgtataataaaatatctcatattttaaatttccaccttattggtagctttcatgacaaagggctagggtgctggtggccatacaattaaggtttttggttagttagttagcagaactgactgactcctacctggtgggtgtttcttttgtttgtttgtttggttggttggttttttcccagatggctcaggaggaaggtaaatagcagtcattgtatgtgtgacagagtttgagatagaatgagcatattgaatctcacatcctattcttattactgtcaggcagcgttgacctagcagtataaaactatctgaagcaatgtagtcactcagttctcataaagtttatttcaagtactgtaacaattcatgtttggattagaaaagtcactagaaatttgacttccatatagtaatctatacttttttctctcatttccttcattttttgagccgtaagtgtaaggcattttgctggtattattacaatggttatgaggagtttctttgcttgcccaaggtcacatagctagcaagttaaagtagattcaaatccaggcctgctagataccaaattattatttaagagtacttttcactactcctaaataatgacacagatatgtttgtcttacacatttcactttattgtcaagttattagtatgtttattttcaaaaggtattttttgcaatttctttttattattccgtactttttaaatttacttcattatcacgtcttcctttattctttttaaatagtttttgcttttgttattttgtttt

SEQ ID NO: 197519 - DNA, 388 bp, Homo sapiens
ctgtataatttgttaattcaaaaataattgccttggacacataatcagaaacttggtttaggaatgagttatgtatgaatcaaaatcttaaatgagcataaatcagggacttaaaaatatgatgaagaatgcacatactttttctcttgatgaaggttattggatccaaaaatcaaacttaattaacttagtaacagttaagaacatataacagccttaaatgatgtatcaaattagggccaccatgcacagccctcattttaaaaaggagaaaaaaagtatggcctccatctgtggatgaataagtaaacaaaggctattgggcttaaacaccaacttgattagttctacaaggaatatgctaacaagataccagtctttatgctta

SEQ ID NO: 197520 - DNA, 323 bp, Homo sapiens
cctttaaggtgcccacagaatggtaaaaaatatcctccccactccctagtccttcaaattaccatgtttgtcctagtccttcaaattaccatgtttgtcctcctcctgcttttttctttttgtgttttaaaactaactttttggtaaaaattttcaaacacgtacagaagtacagagaatagtgtaataaaccccccaaatacccatcccattctccagttcagcaatgataaatttttgccactgcttaatatctgcttgatactgaccttttctctctttccttttcttttttttttcagattgcaatagtatttaaatcc

SEQ ID NO: 197521 - DNA, 422 bp, Homo sapiens
tctagagatgatttagagtatatgggaggataagtataggttatatgcaaatactattctattttatatgagggacttgggaattcatgggttttggtatctgtgaagggtcttagaaccagtcctctgaggataccaatggacaaccgtgtgtgtgtgtgtgttcatgcatgtagtatatatgtgtgtctatgtctacatcctctatatcattgctttatacaaaagctctcagattttccatagttccctcgctcattggttcacagaatttggtatgaatgtgtagacaagtttgtattctagttcggagtttttcaaaatgggttatttctcgtcttaatctgctatgtaatgtaatcattcagttttaacaagtcagtaataatttcagaaagactgagccattccatgtagacagc

SEQ ID NO: 197522 - DNA, 398 bp, Homo sapiens
atatgtaatcgactatttatgttattgataaggcatctagtccattgcagactattagtagttaagtcactggggagtcaaaagttatatgtggatttttgactgctccgaggggttggtgtccctaaccccccgcattgtttaagggtcaactgtagatcaaaactgtaacagtctatatcaaaataagctaaaagaagcctgggcaacatggcaaaccccatctctacaaaaaatacaaaaattagctgggcatagtggcacacacctgtaatcctagctacctgggaggctgaggtgggaagattgcttgagcctgggaggcagaggctgcagtgagccaagattgcaccactgcactccagcctgggcaacagagcaagaccttgtctcaaaaa

SEQ ID NO: 197523 - DNA, 1098 bp, Homo sapiens
ctggagatggaactgatcaatttctaactgctgtggaaaattcataagcaaattcatggaatcaagaaaaggagaagggtagttaaacctaagctgctttaatattttatttatttttttaagactagttaagtacggtagtgagaaggggaagagagtagaacaaggagttcaatctgtaactgactgtgaacaattgagataataaaactaccttcagaccatcctaagctcctttaatattaaggtgttattatagtattgaaacttctgattcccatttcaccacatttaccttgaaggaaacagctttactggggtatattttcaagtgtttggagacgctgaagtagtgtatattaatgaaactgaagaataaatttcatttgattataggatgaaagaaatgcaatgttcagctatgtcttagcctaattttcactttcctagtgtacaatgtaaataatagaaattattttgtcatggagttactgttaaataaggttcacccataagtctggaattattattaatatactttttttcaagttgacaagtctgtgcttctttgggtcatatactcaaacatgaacataactttgttatttagagctcagttttggttatggttttcattaaaataattgatctatattcttgctttccaaaattcaatgttaatgtcacttggtacaatgctaaatatatgaaaatgtaatattgattttcatcacaacctacaaagccattaccattcactgctttagctagaaactagtaatcttcattcctgaactctgaggttaaagccgcaagtaatgttccatacctgaatggcagtgttccataaattcttaatgaaaccctggtttatctttttgacctttgacttcttcattgcctttatgtgtgcctttgaaaacacttaacattttccattttaaacggtgttatacagtatatacttcatgtccattttattttctcttctgtgagttccctatggagctttgtgtgtcttattcattgtatcatcattagggcctaacatggtacctggcatgcaatacgtcctcaatacacgtttgttgtatcagt

SEQ ID NO: 197524 - DNA, 301 bp, Homo sapiens
gaccagggtggctgtggcgacaagagcattttgggtgcacgtgcagctgacttggtgggtggcattgagtaggtgagggaaaaggaggcattatgggtgatttgggagagtttgaggacgtgtagaagcctctgggggtagaggtggcggccggggctgccctccttcctccaggttccttccattgcacacctgctgccagagaagtcatgctgaagctggatctgttcaggccaccctcactcaagaatgttcaatggctcccccattgcctgcaggacccagtgcacacccttgaggg

SEQ ID NO: 197525 - DNA, 315 bp, Homo sapiens
ttaagatcctgcagaagaaatagaaatattcaaatattgcaaggtgtaattgtgagacaacttattataatacgtgttaagtttctactggacccatggaagtggattaagaaaaaccgactttagcttgagaaagcaaaacccattgataagatgtgtcttcattgcatctgtctgttctctgggagaagcaaaatctgtgttacttccttgcatacttgtttgtttattcattgtgcacaagaagatatcttccacatcttcacaagctggataagaaatagagaaaatgagatcaaatatttaaatattgca

SEQ ID NO: 197526 - DNA, 518 bp, Homo sapiens
gtgttataaaagtgaaaccaagaactcagcactgtgccaggcacaaagcaagtcataataacaatgttgggtaccattataattataatcaacattattgtggttatcattattactaaaaatgaatgcaccttgacagctctttcttaaagcagaattccaaataatatatgtagaggaaatgatggaaagacaaaaatcactgttaggcaaacattacagcaataactgttgcaggcacaagacactgataaacactaaaagtagtgagcaaaagtatgagaaacaggatatctgcatagtctcaaagtatctctccacaagatatttattacaaaagagaaaacaataattctataatggagtggcagacatcatccttactaacagatcacagttatcaccaccagtaataaaacatatcagcatcacgtgcatcttgatatgacgaacttggaagaacacataacttatgtggtactcttgccaaaaatgcataaccccaatctaatcatgag

SEQ ID NO: 197527 - DNA, 185 bp, Homo sapiens
ccatggggatagaaatccccatggggaggaggatcacccctggttcagaaccacaaatctagctcaatcctttatttcttccataacatcacagttttcaattattttgcttacttgactgttggcttggttttttccctctgacctcccactcaaatgtatgttcattattaaatcttttttta

SEQ ID NO: 197528 - DNA, 467 bp, Homo sapiens
atgtttttctagcaattagtggcacacagaggctggaataggaccatccaaaatgtgaaacgtcatttgagcccttgccattttctttagtcatacaagatgggctttatgttttccaaagcaaagatgtctgttctagttttcccaaaacaagttcatggaaagctgtctgggacctgtgagtgtgctgataatccctaatccaaaggcatacctttgttcctacctatcaccccagttcccctgcaagtaggaaccatgttatagatcaagatgtataactacggaccttagactagatgacttaaaataacaaaccagtacatgcagccccaccttctcaagctatttcccaaggattagggatgctgctttggttttaatgttatgatttctgccagatacagtagctgtacacttgggagcatgatgctttttaaagttgctattattttttaaaaattaga

SEQ ID NO: 197529 - DNA, 657 bp, Homo sapiens
gtcaattttactgtaatttcgatgggacatttgaaatgaatctagggaacaaagtggcatttgtttatgcattataatttctcaagtacagagaaaaacagttctgatgaaaaacaaaaccctcatttaaaaattctcttggcaacatctacatccttaaactactggaacacaatgaataatttctaattatcctgtgtattgatttggtatattttttgctatagccatgtaatttccttgaatcccaaagtgtttcaggctgttgctgaactgaaaagatgaaaaagggatagaaaaatgtttattatattctttgcctcctagatactggtcctctcatatatatccttgatagggaagcctcctcttcccttgtgagggagggtgtagggaaacaggcatttgcatagttaggtggtaagagtgtaaattgcaaggcaagtcagaaagtagtgctctgctctatagagcactataacttactagtgcagaaaaacattattaggatatattgaggcattgtttttcatagggaaaatgggaattagtctaactgtcttttgggattaaatacattgtaatttggctatcttgtggaatgctatacagttgtgacaattagacagatttatttgtattggcaccagcatgaaa

SEQ ID NO: 197530 - DNA, 632 bp, Homo sapiens
gggaccagcgatgggtgcaaagcacaagcacaaggaaaaagatagataaacggagtcataataattaaaattaaaatgtacgtgcttcaaaggacaccaccggccaggcgtggtggtatgcacctgtaatcccagctactcgggaggctgaggcacaagaatcgcttgaacctgggaagcggaggttgcagtgagctgagattgcgccactgcactccagcctgggcaacagtgagactccgtctcaaaaaaaaagaaaaaaaaagataggaaaaatgtttattatattctttgcctcctagatactggtcctctcatatatatccttgatagggaagcctcctcttcccttgtgagggagggtgtagggaaacaggcatttgcatagttaggtggtaagagtgtaaattgcaaggcaagtcagaaagtagtgctctgctctatagagcactataacttactagtgcagaaaaacattattaggatatattgaggcattgtttttcatagggaaaatgggaattagtctaactgtcttttgggattaaatacattgtaatttggctatcttgtggaatgctatacagttgtgacaattagacagatttatttgtattggcaccagcatgaaa

SEQ ID NO: 197531 - DNA, 439 bp, Homo sapiens
ggatgaaactccagaactcatgagagaggtcttgagatataaatttagggtcctcagtgtttaattactatttaaggccttgagactagttcaaatcatcaagggagtgagtgtgagaagagaagaggaagaacgaggaaagacatctaagaagaaatgactagcatgataggaggaaaatcaagagagtgtggaatcctggaagtcaagtgacaaagtgcacaagcaggagaacctcatcaactgtgtctagtactaatagatcaaggaacctggagactgagaacagatcatggggtttggcatcacaggtgttcttgacaagagaagtttcagtggattgaatgaagcaaaagcatgactggagtagacttacaggagaatgaaaggtaaggaactggagacagtgactacagaaaacttatctatggaattttgc

SEQ ID NO: 197532 - DNA, 437 bp, Homo sapiens
cggcagtctttagtggccagcttcactggggatagaaccactatcaggaggggcaaaccagttctatggatggccccagtacggctggatcacactcaaattagaaaggagacagacgagtgacctggggagctctttctaaaagtcacttatgtagctacctcatatgctagcactgtggcatttctctcctgtgtcttgtttgtttctgtagcaaagcatctggcagcagagaaatatggctgccccaactatgtcacaggtcaaaagagtgttaccagactgagggtctagaaatttctgcaatgcaaaacatggctttgaatttcatgttcctggcaatcacaatgaaaacaaatactatatgatctcatgttgttgggaagattttgatttgctccccagagtaaaatttagatttgtgtaaaatttttttg

SEQ ID NO: 197533 - DNA, 254 bp, Homo sapiens
atttctctttgggataatatgttaatttcacatattctagatattttgtatttgttgtgatttaatggtcataaaaaaagtattttttccttttcacctcagacgactcagagctgatgtttgtgtggagaagcactcattccacctccttagagaaagctgctgtgagaacaaggcaccctgactctgtagagggaggagagaaactttggcttagaaacacaatcagtggaaatgtaatgggtcatcttttg

SEQ ID NO: 197534 - DNA, 354 bp, Homo sapiens
tatttcaaaacattttcactggcctagtgctgtgactcacatctgtagtcccagcactttgggaagccaaggtcggaggatcgcttgagcccaggagcaacatgggcagcctgggcaacatggtgaaaccccatctctacaaaacgtacaaaaattagccaggcatggtggctcatgcctatggttccagctactcaggaggctgaggtggaaggtattctttttttgcaatttagtttcaattgtacatttatgtatatgtgtactcggttgtaatccacttggatttcatgataacaatgaaacttactaagtttctaacttggtttgttgtgaatattagatagttggtgt

SEQ ID NO: 197535 - DNA, 516 bp, Homo sapiens
acctgggtcccccatcatgggcctgacttagcagctctggctggggcctgggagcctgcatttctaccatgttctccaaggtgaggaccagccacaccaggccacctggtaccctaacaggcatgcccacagtccacagcacagctcaccattttcttcctcccacgagtcactttttatgtgtactctttgaaacctccagcccttaatccacagagtgagggaagttaagccacctgcctctgttagccagggtctcggcagtctgcagcaggcaccctccggagggcgcggggtgggggtggggagcaaaaaaaaagagtttaatggaggggtctggagaaagcagctgagttgtgggtcccagcctgaggccagcaaggagagggagtgaggccagggggcatttgtgcaatccccaaaacgtggcttacggaaggaacagcccagctggcctcccgggccatgttcctgcctggcctggctccctcggccgcccaccactgggggccagag

SEQ ID NO: 197536 - DNA, 545 bp, Homo sapiens
acagaattgtctttactttggcactcttcccaaatagatacaaagagatggtgttttagggacactgtactcaacactggactcaattgcccgaattactccaagataacattctacactagtccacagacctattctgctaaatttctccacaagaaacgggaccaaattccacttctaaatgaccacaccataaatgagttttccaagaaacgtaagaatggagggaaaaaaaaattgtttctaaaaatgctttataccaaccatgactaatcaggtaggctgtggggagtaacttcttggagagaatacacacacacacaaacacgcacatgaaaacacgctcctacaccccacagacaagacatagaggaaatgagggataaatctcaactagcatttattgagcacctactatgtgacagagatcatattggacttcagggatatatggtggagaaagatctctctgttcctccaataatctcatgggtcttagtcccattttacagatatgaaagccgacatttaagaaacatcctgcc

SEQ ID NO: 197537 - DNA, 376 bp, Homo sapiens
tcagataatggaaagcatgtgcttgccagtgtgagctcatcaacaatgaggtcagaggaggacagtgcctcttgctcgcaagcccagccttcatactgccttttctttcagtctcaggtgcagcctgttgtgggattgttagaggccccttgcatgtggtctgacatgccagccttctgaccatgtgcaacaggactgtgggctactcctgacttcagagatagcatctttgtacagatgccagagatgccagagacacccaggagttgagtctgctgggggacatggacaaggacgtaggtgacaatagtgtatgtgctgtggggaaaggatgactgtgatagcatgtggaaggttctagaattcagagggtaac

SEQ ID NO: 197538 - DNA, 197 bp, Homo sapiens
cggcccttttcgccaaatcgctgctctgccgcgcgcctacgcaaggaaagattcaagggtccctccacttcagggagtggagcccgcgcctcggcacggatcagctgtgcgtctcctttggcctactggctcctctgcttgtgtctatagctagctggacgcatcgtgactttatcttctcatctttcctggcgccc

SEQ ID NO: 197539 - DNA, 246 bp, Homo sapiens
ccagtcagctcatggatgaagatcttccatcaatgcaggcccaacagcaccttctcccaggggctcccaacccatgtgccaagccctacagaaataacgtataagccctccgaaccatgtaggaatcatggtctaaacagacctttttagcttgttaattggaatattttgtggcatccattcttatgctagtccaagaactctggaatctgtagaactgttgaaccaaataaaaggaagaaactc

SEQ ID NO: 197540 - DNA, 777 bp, Homo sapiens
taggaaatgatctctaactaaagccatgaggatagtaaggtactcagaaaagaaactgatctgcacatttatgtatactttgagagtggcatttatatgagtcagcattttgaaaactctagaacaatggcatttccagtcaccagtagttgaattttatgaggtcctttagcagtggagcatagaagaacaagcagctgagttcttactttgcataaactcagaaagattttgttctttggcacttactctgtgtagaggttggcaaaacaggcaggttttatctttagcgtaaaattatccagagtataaactgcctagaaaagggggattgtaaataatctgtgccatcatttctcccgctatatctaattgtctgtgtcacttcttggtttgaaatgctcaaactacccttgcaaaaaaaaaaatactaaactggccctcatctgacatcccagtgagttcccctcccaggacagacgcactggagcagtggcatgtgcagggcaagggcgccctccccagggcagcctggccactgcacgttcccgatggagaatacacacggcgaccttgcagaacagcttgctgtcaccacctcagggatgaaagcattctcatcccttcagagaaccagttagacagcagcagctgggaagtttctactcacttccctttcatgtcaagactcttcctgaatccacatgcagcctttacagtagttagggcgtaaggcacagtggctcccccggccatctggctgcaagctggcgtaag

SEQ ID NO: 197541 - DNA, 430 bp, Homo sapiens
tgctgggattacgggcatgagccaccgcaccccacgccctttgacaacattttatgtggcataatgatggatagcacagtgatgacttctgtgtacttaagaaaaggctagatcatgttcattcagcaaataaatgtgaaatgaatttattaaatatttctatgcaaataataagaaatataaaagtatgattcttaatggtagagtgaagtttttaatatctggaagcttcatttgtgtagaatatttcctttcccaaaagcttcagataaagtaactcttactaaagtaacttcaaggtcagactcagcctctaatccagtaataaccaaaaaaacctaattggcacatttttttctaagacaattgaattttctccctgatgtctttttaatttattgagcagattctgtctttgaccgaaaagggc

SEQ ID NO: 197542 - DNA, 274 bp, Homo sapiens
attactgaaagcattttctgtttgtttccctcctgaaaacattaggatgggtgagctcttggagggatcctggctctgaaggcacctaggtgagaatggacgtgggatagtgtgagggcatggatttgaggctggtggacgggtgaagggatgacttaaaaggtgatttgctactgataaggatcccaaagaggagaaaattagaatccagatgagtacagccttcttcctagctttgccggcttttccttgggaaagaacataatatttacat

SEQ ID NO: 197543 - DNA, 1007 bp, Homo sapiens
gatggtgagtaatatttaaaaacctcattttttaatgttatttactatagtttaatttcatgtactttaagccatccttatgatacatattaaaattcttactttaaatcttgtatatgaagagcttattcagaggaatttaaggcctttttgattttgcttttgttttatgttttcatagtgctgaaatctttaatattccttaatttgaaacttttaaaccttttccgagtttttcaggaaaattaactttaaaagtcttaaagcttttgcccaagttgtctgcagattttctaaaaaagtaaaatggaactttgataatttctaaaatatttatcagagattaaattttaaaaagcttttattctgtattacccaaagcctaatgctttaacttaacttgaaaaaaatttaggaactatttctaatttgaaaaaaatttagaaactatttctcgttagttgaagcagattttgatcttctatctagaacttttttttttctcataacctttatgaagtttgttgatctttgtattgcttggcttttctggtaatagcagatgtttctacctatccctcaagttctagccacaaatcgcctttcttctatgaagccttcctagcaattctactctaaattggtcttagatacctaaacttctataccaattattatgtacctcttattttacctttgttcattttgcctctagaattagattacaaaattcttaaagaagttgccatattttatcatcctcatgtttttaccatactctgggtccagtatgattacagtgatagcatatactgaaaagattgttactgtgcttattggcctagagccagggtgtctaaccttttggcttccctgggccacattggaagaggaagaattgtcttgggccacatgtaaaaatacactaacactaacgatagctgatgagcttaaaacaaaaacaaacaaaaaacaaaaatattggaaaaaaacccaaaaaacaaaaa

SEQ ID NO: 197544 - DNA, 633 bp, Homo sapiens
gccttcctgctgtctgtgctgtacaggtcggtacattttgcttgtgtttgtaggtggccaatgcatctagttgatggtgacgggttctcgggattaaaccacatctgaactaaaaatttccattttattgctttcaagtctgaagaaatggaacttacagtatacgcttctgggaagttgtgactagaataaagctttgctgattttcccacctaatataacacaattaagcaacacatgcttttcaccagtgctagtggtgataacatgtttgtatcatacaagatcacagaaataaaaatttctgtgatttagtgagaataaaaaatctcattaagtggctggacagaaaacacagcctgagctcatataaacatcacaaggggatctgatgtggatttgccacaatacagaagagtgtgcaaagcaatatttaaaaacaaatcacacttagcacagagtccagcgccaccaacagcaaaaagcaaatacgtgaagaattagagtcaatgtctgcacatgttaaaaagcccactcaaaacaaggaacaatgcgcttggtgagtggcagccctaagatgcacgcgaggatctgtccatcccggggatgaaggcacccgccaaggagagctca

SEQ ID NO: 197545 - DNA, 355 bp, Homo sapiens
agactgcatggcttaaacaacagaatttatttctcacagtgctagaggctggcaatctgaggttagagtgccaggatggtgaggttttggtgagggctctcttcctggcttgcaggtgagtaccttcttactgggtcctcgcatggcagagagagaggagagaggagagaggagagagagagagaatatcttcctcttcttataagggccttaatcccaacatgagggaccctcctcatgacatcatctaaccctaattactttccaaagggccccatctcccaccaccatcacattgtggggttgggcttcaacatatgaatttgtgggggacacaaagttccgttgaagccgt

SEQ ID NO: 197546 - DNA, 479 bp, Homo sapiens
atactaccatatgagttaataaaatttaatacacgaaatttaacttaattattataaactggtgttaatatatttgtaaaatgtaggtatttaaagggaaactaagtctattaaagaagacaatgttttaatgttgttgctagcttgtttgcattttctgtcaccattttcacctcattctgtctattaaaaaattctatatatagtgctaaataaatgatgacttggcctatcttattatgtcaactaagaattgcatttgatacttacaacagacaataacaaaatcttatatagaagggatataatcttcctcacctaacaacaaatccagaagtggatagtccagacctggtaagttggccctccaaagcaaccatggacctaggcacctctggtgtcctacactattaatagtgtctgtgtggcttttgttattatgggtgaaatatggctgttctacctccagtatcatgtcc

SEQ ID NO: 197547 - DNA, 296 bp, Homo sapiens
tagaggtgaggaagtggaagacagtgagtattgactaccgtttgaaaagtttgcctatgaagctggtggagtacaggttaaaagtgagcaagcagggatttgaaagtgttaatgttctagggaaggagagagaggagggaatgagagattgaactaaggataaaataccatcatcttgaactttctagagaaatgttttttatgcttcttgtttgctctttttgtaaaaattgttctaaggtattttttagataatgctgaatatcttttttgatacctttatgatatttcagcta

SEQ ID NO: 197548 - DNA, 188 bp, Homo sapiens
ttcagagtttcatccggcagtgatgctgtgcccaaagaaatgggtcagatgatcccccactgtgccagaatgttggggaggaaacacaaggtcaggcgagccagcgtgccctgaaaacccctcaatctcctggcttctctcagtttgcattcattccctcaccctgtgtgactgcccccaagctctct

SEQ ID NO: 197549 - DNA, 355 bp, Homo sapiens
agttttaatcttggggcactggagcttctggacttcatgtggaattgtattggtgaccaccacctgtgaagcaaaagaaaaaaaaccacagcatcagaaagccaaatagcttcatggtttgatctggaaatgtgacagcttctcaaatctgaggcttgccacgacaggaaaacacagtggatctatgtctcaagtcaatgtttcaattatttatttatttatttatttttagacggagtcttgctctgtcgctcagcctggagtgcagtgatgccatctcagctcactgcaagctctgcctcctgggttcatgccattctcctgcttcagcctcccaagtaagctgggacgacag

SEQ ID NO: 197550 - DNA, 422 bp, Homo sapiens
ataagaaaggtgtagcctttctctgaatgagttgtcttccgaatctgcaactttttttgtcttttccagtttcatgacctctggtaaatgatgcctccttactttgattaaaaataaaataacaaggctgggtgtggtggctcacaccttgtaatctcagcactttgggaggccaagacaggtgggtcacctgaagtcagaagttcaagaccagcttggccaacatggtgaaaccccatctctaaaacacaataattagctgggtgtggtggtggatgcctgtaatcccagctactcagaaggctgaggtgagagaatcacttgaatccaggaggtggaggttgcagtgagccgagatcacaccactatactccatcatgagtgacagcaagactctgtctcaaaaaaataaataagtaaat

SEQ ID NO: 197551 - DNA, 612 bp, Homo sapiens
taggggtcaccatggggaaattgaaatggtcgccaatccgaccatttcaataaagcctgggagacagagcgagactccgtctcaaaagaaaaaaaagacagctctcaagtaaatgactcaacagatgcattcctagggaatccaacatgaccatcaaaacttcatcctaccttccatgaagccaatcttgatagggaagagactaggaaaggacaaaaccaacaacagccccacaagcccaaatgtagtttatgttacccctctgctccccaaaaacgggtaaacttttcccctctatattccccgttttttattgttgctgttgcccaggatggagtgcaatggcgcaatctcggctcaccgcaacctcggcctcccgggttcaagtgattctcctgcctccgcctcccaagtagctgggattataggtgtgagccaccgcacccggccagatatagacatacaacttctaggagggacaaaggttggcatatgattcaccagtgttgttccgggtggttggctagatagctgtctaatggaatccattaaggagtaggaaagagcagcaagaaaaatggctattttcactatttttgaaatgtcgccgat

SEQ ID NO: 197552 - DNA, 512 bp, Homo sapiens
tgtgccggagtttatccccttgtcccaaactctgaaggttatgcaaatgcacaccctgccactcatgtttgtatagggcacgtttgtcacttgtttggacagcagttgttgagagtcacactatgacctggcacgtttgtattctttgacccagtaattttccttttaggactttgaccaaaggaaatggatgaaagtttgtataaaacaatggaatgcggctgggtgtggtggctcatgcctgtaatcccagcactttgggaggccaaggcggggggatcacttgaggtcaggagttggagaccagcctggtcaacatggttaaaccccgcttctaccaaaaaaaaatacaaaaagccaggcgtggtggcacgcagctgtaatctcagctgctctggaggctgaggcgggagaatcacttgaaccccgggaggcggaggttgcagtgagctgagatcacgccactgaactccagcctgggtgagagagtgagctcctgtttcaaaaaaata

SEQ ID NO: 197553 - DNA, 684 bp, Homo sapiens
agacagaggttgcagtaagctgagatcacgccactgtaactccagcctggtcgacagagtgagactccatctcaaaaaaaaaaaaatattttcttcaaatgtataacttgtttcattctcttgatgcaatttttaaaatgtattattaagtaagttggcctataatacaagaataactaaaatctgtgtagccccggcaacctacccaagtatgttcacactgttactttatctgatccttttgacaatagcatgcaataagtaggtgaggtgttacccacattttatacctaagagtggaggcttagaagtgtctaatgactttcccaaagtcacaaaactactaattgttagccaggatccaaactcagattttaagactctaaaatctttcattagcttatagtctttatttattcagtacgactttatttcacttctgtttgacaggtactgagctaggtgctgaatatgcaaaactgaatgaccttcttatcttcaaggatctttgtctagtgcgggagccagacatgtacaaaggggctatggactgttggggtgggggtgggaatagggaggtggccaagaagttatggccaggtgataattcgtgaaggtgatattttaaccaagtcttaaagggaaaatagcagtctcttaggtagatacagtgggaaagaatat

SEQ ID NO: 197554 - DNA, 165 bp, Homo sapiens
atgaaaccaacagactgaatgttgacagaaaagcagagagtcaaggataaaacccatgagaacctggcagtccaagactgaaaggaggagaaaccaaccaaaggatagaaattaagtaagcaaaaagataacaggggtctggcagagtcacaggcatcaggaggg

SEQ ID NO: 197555 - DNA, 450 bp, Homo sapiens
agactctgtctcaaaaataaaagaaaaaaaaaatgatgctttggcactaaatttgtcatctgctgttacagtaagtaaatcactagatgtaaatgctaccagatgaacagcctgtcattagttcagaccagtttaacatcaagatctaagaggtaaaatctatcatagccaaattctttacatcattgatatctggctaatgttctgttttagaagaacaaactaatcattagtgttcttataccagatcatcaaattaatttataatagtgaaaaattgaaaatgaatactgtacttataaaaatgcattattgaaagttatattttaagaatatatcataaacatgttcttatatttaagtgaagaaagcagacaaagcagaattatcctaaaaaatatatatatatatatggctgggcacagtggttcacgcctgtaatcctagcac

SEQ ID NO: 197556 - DNA, 422 bp, Homo sapiens
caggccatactgtccccaactcaatgtggctatcttgccgccttgcacacaagctcacctgcaccacgactgcccgttgaccccattctcacagaacaatgtccagaactgacagcaagtatggctcaagaggccaactactagtcaacagagtggaaccggagaagtaagaaaggacatgagtgtacctccctgagccatgggattcttcagagtcagtaaaggatatttccagaaatccagtctcgtccatacaacctcctggtgacacacacactggctccttgtgacccgatcgccaacaggggtaagacctgtgtacccatcagtgctttaacttgtacaatggatcggaccagcccaaagtgttctttaatcaccaggtggcatcttagtcgtgtgaaggtccttgtttgtaggaa

SEQ ID NO: 197557 - DNA, 345 bp, Homo sapiens
aggaatatggagatacttacagaggcaaagactgtcctggcagggacaacagttcaagctcacgggtaagaccactaagccactggatggaaatgtggttggagtctgcctcaaacctcagtggaaaggggcaagttcctgcaaagatgcatgcattcacatggcctttcctgcctggaggtgacagtgagtggtagtacctgcacacagggctctggcagactcaaccaggtagccagtctcagacaaactgtggaggcaaattacggaaggtttgatccctggccctgtcctctgtgactggtccatgaagtcacttttcctgcctggtatgaatgcttcccc

SEQ ID NO: 197558 - DNA, 387 bp, Homo sapiens
gatacagagtctctcttttgcctaggctggagtgcaatggtgtgatcttggcttactgcatcctccacctcccaggcctatgcagtctacctacctcagcctcccaagtagctggaactacatgtgtgcaccaccatgcctggctaatttttgtattttggtagagatgaggttttaccatgttgctcacgctggtctcgaattcctggcctcaagtgaaccacctgcctcggcctcccaaaatacttggattacaggcatgagccaccatgcccagctgtgtctttgatacccttgatgcccctcactttattctatttttcctctttttcatagcatttattacattttgacaaattatataatttttttgtgtttacagtatgt

SEQ ID NO: 197559 - DNA, 585 bp, Homo sapiens
ggagacatttcctcagcaccattcctgctgccgacatatgcttgtatctgatagattcttatatccaagctgaaaacataatgacaaagtaaagtttaatgaaactatgctataagggcaaaaatagtactttacagctgagcttttctctttatttatctggcttgatccagaaaaaatagttctaaatgtttagagattgaatagatgcatgttattccggcctttcatggatgtttttatcttttaataaaatttgggcagcagataattcaaggttgtcttttggcaagaagatgaagtgaataattctgttagtcttactcatagtttgaagggcttggccctttattccagcagcacggggagatattcagtcttgccctgattcactttttaatatcttttgaatatgaattagaatttttaactgagtatttccatgatttggaaagcagaagagtgggaggaagaaagcaactcttcaatatccacttcttttccagctctgattaagcttttcaaatatccaagcctgagagagttccatttctttccaatggactctcacaaagaaagcaaaac

SEQ ID NO: 197560 - DNA, 1226 bp, Homo sapiens
gtactggtctgtggcctgttaggaattggactgcaccccatgaggtgagctttgggcaagcgatcatttctgcctgagctctgcctcctgtcagatcagtggcggcatttgattctcataggagcgcgaaccctgttgtgaactgcacatgtgagggatctaggttgcatgctccttatgagaatctaactgatgatctgaagtagaagagtttcattctgaaaccatttcccacctcctcctgtccgtggaaaaattgtcttccacaaaagtagtccctggtgccaaaaaggttatgggatactcagctccacgttgcacctaaagtagcaaaagactagataaaaaccctgaatatgtacttgtgaaatcctgaatatgtaccttcgtgaaatcagtgacataaacctcctcctgggttacgtgttacagttcacaaacgatctcaagtattctacagttcacctgtagttgtcccttgtacaggtggaagaagagagggatctcagattccctgtagtagcgtccccgcccccagacagatctctcccttcttcatgccctggattgtttcatccatttaaatagttctcttcttgattctgacttgagggatgggcatcctgtgattaggtttggatgtgacagtggaagtttgtcagaaacattttggctcatgggccagatacattggagtccgtccgaaagctcactaggaaatgtagattctcaggtttaacctaactaggctaactatacctaagtatcttagcagaggtttggatgttacagagtttgaagatcgcatttttaggccctgtattcttattctctgtaaggatgatgtcgcccttcaagggtgtaaggattgttattggggagtatatattcagggcagcttgaatctgtgctcccgctcctcacctcattgttcttcggagggggatggaaaatcttagatgttaatcatggtttgtggccctccagaagttaatcttacctgacaaaaccttattccttaatgtttaatttcccttgttaagaatacatttaatttattgaattaaatttaaattaaatttctctcctggggatgggatactcaaaaaaggttgagaaacataatcctataagaattactctggcatagtacctgcctgcattatctgtgtcccctctcccatctttggaaccttaggatgtgatttgcaacattattttaatac

SEQ ID NO: 197561 - DNA, 285 bp, Homo sapiens
cttagcgagctcggtaccccaccactcctatagatcagtgcaactatagtgagagcattttacttagatgttggaggcagaggacagatttcatggtttgaggatacagagatggtcagtataacacctttttgaggaagttggtgctgaaaataatatgggaggtaggattgaaagaatatctttaaaaattttttttcattgtggtccttgtggaacatgaacatctttttaaaataggaagtttgtgagcatttgtatagactgagaggaaaaggagatggt

SEQ ID NO: 197562 - DNA, 904 bp, Homo sapiens
ggtggtcatcgatgccactattcattcaggaagcttctggactagtccagtgaaaaggtaataaaacctgaattaagatagtggaagaagaggagaagaaattaaaagaaattcagtggtaattcagtagtacctggccctttacgaatgaaggtgagtgagatagcaaatgtgaggcttttggtttggatgtctggatagatggttcaggtcattaactgagattgggaaggcaggcgaaaccagtatggatgattgaatttggggtgtcttactggctgcgtcaggagatgttccgtcagatagccacaagtaaaggctggaacttgtggaaggaagagcccgagataggagttactgcatacaggcaggagccaaagccatgagaacgggtgagtctcactaggagagagctaagatggataaggacacaactctgaagggcatcattatttaaggaggaggcagagaaagaagaggtagcaaaagaaactaagaaacagcaatcaggtgggaggaaaaccaaatgagagtagtctgctggaagttaaggggtgatctggcaaaaggggtgcttccaaaggattcagatgctacagggatggaggtgtggtgagaacacaaagtaggcctatgggtttgtgattagtagatcagtgcaactatagtgagagcattttacttagatgttggaggcagaggacagatttcatggtttgaggatacagagatggtcagtataacacctttttgaggaagttggtgctgaaaataatatgggaggtaggattgaaagaatatctttaaaaattttttttcattgtggtccttgtggaacatgaacatctttttaaaataggaagtttgtgagcatttgtatagactgagaggaaaaggagatggt

SEQ ID NO: 197563 - DNA, 681 bp, Homo sapiens
tgggcaccaaaaaataaaagcaatatatgataatcacaaagagaaaatttttaaatgttagaaaaagtttttagcaatgaaacagtattgcttttggaaaggaagatttcatatttaagatgcagtaatttgccttttctaagttgatatgttatagcagtggtttttttcaagcacttacagacagctgataaccacaaattaccttatttcgtcttctagactaccggtgagtttgaaacgaaagtgagactcaaattttgaagtaatttacccaaaatttcactcctgcctcatgttataattaaaaggtgttctcaccttatttatcctaattagtgtgtttcttggaggtagaaccatctacctgcattcatgtctctaataaccattgtagcataggcagttggactcagtctcaaattctcacttgcctttctatgtgaggagtcacaaatttcagaggttgacagaaattgggcagctaagggcataccttttctgatgtagacaatgctagccaatcattttcttgtgtccatatagtctcgaaattggtagattttaagcactttaacaaaagtttggaaatccaaagtctttctctgaaatatttggatttttcaatattggcagccaactgaaaaagtagtggctctttcctgttcaaataaacctcac

SEQ ID NO: 197564 - DNA, 432 bp, Homo sapiens
taggagtgtagaaagtttaatatcaataaaaatgataaatagcaggggtttttgtaataatgccaacaatgtcaatggcaaaagaatgagggttttagattaaatggtctccagctgctttcaactttaccagtacatgatttttaatgagttctacaggtgataagtgctagagaaattcagaggatggagagaaaattgtcagcctgaatagtcagcggtttcttcatggaggaggcagtcttgatctgggtcttaaaaatgaacaggcttcgcagagttaagaggaaagaaggcatttcaggcaggcataatagcactaaacagaaatacaacggtgtattagagcaaaacatattcttggacagtagatacaccaatttaattctaagtttagtgtttgggaaggaaaatggcaggaaacaaacataa

SEQ ID NO: 197565 - DNA, 577 bp, Homo sapiens
ttgtagtggtatttttctgacctcattctccattccacaggttttagctgcaaggctgaggcatccaactcttaataaagaggttatgcatgagtgtgagtgtgcccaatattatctgatgcaaatggtagaagagcttttcttaaaatagtaatctcatcttcaagaatacatttttattctctttaaatgtacaaccattcacattttaggctaaatttgaacaatcttgattcctatgcaatcctaaaggtgtgatggtacaaataaaggcccaggaatctctagttttttccccaaagatataaaaagaggatagaaatgtggtccagcattacataatgttgccaccactccaggaaaagaagtgagagcaccttttcctatgtttcttggctacttgcatgcaccccaccccttttttggtgtgaagtatcttgtccatttttctttgtatattttgaatatgagccattttttgcatttacatgtgattttctcccattttggcttcttttttcactctcaatggtgtctttgatgaagagaagtgcttaattttagtgttttcccattt

SEQ ID NO: 197566 - DNA, 365 bp, Homo sapiens
agagatcttctactgtctgggtaagggccaaattgcaaaaactttaggccttgtgggccaaacgtctctgctgcagccactcagccctgctactgtatcctgaatgtaaccccagacaggaacaaatgggcacagctgtgttccaataaaactttcctggccggcacaaaggctcacgcctgtaatcccagcactttgggaggccgaggcggacggatcatgaggtcaagagatcgagaccatcctggccaatatggtgaaaccccatctctactaaaaatacaaaaaaatcagctgggtgtggtgggtacctgtagtcccagctatagggaggctgaggcaagagaatcacttgaacccggtag

SEQ ID NO: 197567 - DNA, 266 bp, Homo sapiens
tcagcctccaaagtgctgggatcacaggcatgagccaccatgcccggccatgaatttgactttcatgaaagttgaaaatgtgctgctaactccttcattcagtgatcattttgtgaacatgttacattttgctaatcatttgggatacaatagcaagtaagacagtgcagcatagagtttttatttagctgtatgggaaaagatgtctggtggtacaagactgcacagtaagtaaacagtaaattttggtcttggaaaagacaagg

SEQ ID NO: 197568 - DNA, 559 bp, Homo sapiens
accaacatggagaaaccccatctctactaaaaatacaaaattagccaggcctggtggcacacgcctgtaatcccagctactcaggaggctgaggcaggagaatcgcttgaacccaggaggcagaggttgcagtgagccgagatcacgccattgcactccagcctgggcaacaagagcaaaactccgtctaatgaaaaaaaataataatttcctttgtgtgatattgtgaaatacatatttggtctttgtctctgtttcctggtatattccttcaaaaattcttaaagtcttccaaatgataagtgtctttttgtatgccaatgagttgactgatggcaggtcaccagaaagaccaagatgggagtagaaggttggcactttcagccccacccagcaacctttgagaaggggagaggagccgaaggctaagttgatcaatggccaatgatttaatcaatcatgcctatataatggagccattataaaataataataataaactgagttcagagcgcttccagatagctgaaaacctggaggttctgaagggtggcgtgcc

SEQ ID NO: 197569 - DNA, 556 bp, Homo sapiens
atatgtaccatattcatatgtagattcaatgctattaagatgtcagttctttccaatgtatagattcaatgcaattccaatctaaatgaaaatgtttatatggagaggcaaaagaccttgaatagctaacaccatattgaaggagaagaacaaacttggaggacagacactactcaatttcaagacttaccgtaaagctacagtaatggagacagtgtggtattagtgaaagaacaaacggataaaatgagatagggagttcacaaatagaaacacattaatacattcgattaatttttgacaaaaaagtaaaggcattatgatgatgaaacagttttttcaggaagggctgctggaatacctggatatccacatgcaaaaaaaataaatcacagaccttacacccccacccaaattaactcaaaatggatcagcaacataaatgtacaaaaaactataaaatttatagaaggtaatatagaaggaaatacagattatcttgggtttaatgatgacctttagaaaaaacaccaaagttgaagtcaatagaagaaag

SEQ ID NO: 197570 - DNA, 333 bp, Homo sapiens
acagagtggcgacggggtaggggagagtgttacggaagacagagcgcggcggggtaggaaatagtgttatggaagacagaaaaaaaaatctgacatatgtcttttgcacaatttaaactttttaaatgagcatgttctacttacctaataaataagctcaataggtcactaaccaaaaaataaacttctcaagggtcactttcctaaaaatgttcaccactgctgcttctaatttatgaattttttggaccattttaaaaatgagtattttaaagcctcagaagcattctaaatagtgctttaaaagtccccttccccaacacttctcaaact

SEQ ID NO: 197571 - DNA, 782 bp, Homo sapiens
[322 bp omitted]gtaaacgggcttaaaatctatgtcaaactagccacgagaataaaaattatagaatataaaatcgtctgacttttttgtataagcaaagaatgctaccaagaataaacaggcaagaatagaggtgaaatagaatgagggggaaatgagggaccatcgtttgaatctactatgaagtatggtaatcactgttttaagaattccagactattaactactgtgcagttaggaagggaattagttgtagccaaacaaaagccataaatatgaattttaggttgtacggaagaaatcctcttgatcccaaaacataaatgcatgtactgagaagccaagctgcacatggtgtaattttttctgtcttatcctgattaattgacagtcaactgtatgcttctttcctgaaggtgactttacaatctctagacccagacatttctctctgaagtggagtgaaggaagg

SEQ ID NO: 197572 - DNA, 332 bp, Homo sapiens
acaagccgcctatagatggccaactaagagagtaccctgtaacacacacccaccgatgcttcagctgtaaacactcaccccaagacactgacgtggggtcggagcctcacagcctgccgtctgtatgctcccctagaggtttgagaagtgggcaatgaagaagcaagccagtcaccctgttgcacgccctccaagggggacaagggaacctttcctgtttcactaacattcttcacaaacagattttgaaaaacatccattcagctaaaatgcatatatccttatgctaagaaggtggcaagatattttgaaataaaaatttaaaaaacaat

SEQ ID NO: 197573 - DNA, 843 bp, Homo sapiens
cccttaaggaccagcgggaaagataaaagctggggtttagtctgtgctgcgtgaaatatgtcttggcctcacttcctgtcctctgagctgcctgcagccgggcgaggtggtgttgaactgtgttttttgtgacgaagcttacttttaagtttcatccctaaactaagttgacctgtttctttaagacggcttgcaaaatgtgttttcctcaatgtgggatatggaaagaagcagttgctcctgttattttgagctagtacctgacgctatgagaaattctaaaagagcgaatcagatcatgcaacatgaataactatggaggctgagtgatcaagaacagaagttaatattttggtgttacaaactttccacggattaggtgaataagatatttataatttggtgtgttcatctcaagttatggattacgagtgcggggcactagtgctttagattggtaaatgaatcatcaacagtcgccttgaaaatcgaatatttttgtcaccattttcaggacatgagaaaacacgctgagagtttaaagcaattatggtcctcacaaactagatcattctgtccccaagatgtgtactcctacttccataaaaaaactataaaacagcctcaggcaggtccttcaggaggtattccagaagaaggcattgttatcataagagatgactgctccgtgcgtgttattgcccctgaagactttctggtgggacaagatgtggaggtggaagatagtgatgttgatgatcctgaccctgtgtaggtagacctaggccaacatatgtttgtcttactttttagccaaaacgtttaaaaactataaaaaaataa

SEQ ID NO: 197574 - DNA, 635 bp, Homo sapiens
cccttaaggaccagcgggaaagataaaagctggggtttagtctgtgctgcgtgaaatatgtcttggcctcacttcctgtcctctgagctgcctgcagccgggcgaggtggtgttgaactgtgttttttgtgacgaagcttacttttaagtttcatccctaaactaagttgacctgtttctttaagacggcttgcaaaatgtgttttcctcaatgtgggatatggaaagaagcagttgctcctgttattttgagctagtacctgacgctatgagaaattctaaaagagcgaatcagatcatgcaacatgaataactatggaggctgagtgatcaagaacagaagttaatattttggtgttacaaactttccacggattagtgtactcctacttccataaaaaaactataaaacagcctcaggcaggtccttcaggaggtattccagaagaaggcattgttatcataagagatgactgctccgtgcgtgttattgcccctgaagactttctggtgggacaagatgtggaggtggaagatagtgatgttgatgatcctgaccctgtgtaggtagacctaggccaacatatgtttgtcttactttttagccaaaacgtttaaaaactataaaaaaataa

SEQ ID NO: 197575 - DNA, 1472 bp, Homo sapiens
  misc_feature (1104)..(1104): n is a, c, g, or t
  misc_feature (1121)..(1121): n is a, c, g, or t
  misc_feature (1144)..(1144): n is a, c, g, or t
  misc_feature (1157)..(1157): n is a, c, g, or t
  misc_feature (1163)..(1163): n is a, c, g, or t
  misc_feature (1167)..(1167): n is a, c, g, or t
  misc_feature (1171)..(1171): n is a, c, g, or t
  misc_feature (1174)..(1174): n is a, c, g, or t
  misc_feature (1176)..(1177): n is a, c, g, or t
gaagggcaacctcgtgctttctgcagaggagaccggagggcagaaggcagagtccaggcttagactgcagttcctcgcttacctgtgcagtctaattttgagctgcctctttgtagtcttaaaaggcaggagcttcgtgttgtgggtctgctaacccgtacgtttccgtgggcaagtcgtgtgtactcctcgccatggctcagctccaaacacgcttctacactgataacaagaaatatgccgtagatgatgttcccttctcaatccctgctgcctctgaaattgccgaccttagtaacatcatcaataaactactaaaggacaaaaatgagttccacaaacatgtggagtttgatttccttattaagggccagtttctgcgaatgcccttggacaaacacatggaaatggagaacatctcatcagaagaagttgtggaaatagaatacgtggagaagtatactgcaccccagccagagcaatgcatgttccatgatgactggatcagttcaattaaaggggcagaggaatggatcttgactggttcttatgataagacttctcggatctggtccttggaaggaaagtcaataatgacaattgtgggacatacggatgttgtaaaagatgtggcctgggtgaaaaaagatagtttgtcctgcttattattgagtgcttctatggatcagactattctcttatgggagtggaatgtagagagaaacaaagtgaaagccctacactgctgtagaggtcatgctggaagtgtagattctatagctgttgatggctcaggaactaaattttgcagtggctcctgggataagatgctaaagatctggtctacagtccctacagatgaagaagatgaaatggaggagtccacaaatcgaccaagaaagaaacagaagacagaacagttgggactaacaaggactcccatagtgaccctctctggccacatggaggcagtttcctcagttctgtggtcagatgctgaagaaatctgcagtgcatcttgggaccatacaattagagtgtgggatgttgagtctggcagtcttaagtcaactttgacaggaaataaagtgttataattgtatntcctattctccactttngtaaacgtttagcatctggaagnccagataggcatntcagantggngggntcncnngaactaagatgggtcattgagtgatgtgtcctaagcggtcactaatggatgggtgacataagtaaggatacctacaatgaacagaggggatcggacctctatatacactgttgacggggatatacagaagtgaagacacttaaaaatggttctgagatacataggtaaggacaaaggactagaagaagcgacgaggtaaggttaaccacaagagagagaacatagaaatttaaagaacactataagagagtaagtgacaaaactgagaaagagggagaagaagcagagtagggaa

SEQ ID NO: 197576 - DNA, 1056 bp, Homo sapiens
  misc_feature (688)..(688): n is a, c, g, or t
  misc_feature (705)..(705): n is a, c, g, or t
  misc_feature (728)..(728): n is a, c, g, or t
  misc_feature (741)..(741): n is a, c, g, or t
  misc_feature (747)..(747): n is a, c, g, or t
  misc_feature (751)..(751): n is a, c, g, or t
  misc_feature (755)..(755): n is a, c, g, or t
  misc_feature (758)..(758): n is a, c, g, or t
  misc_feature (760)..(761): n is a, c, g, or t
ggtatatccggagtccgacggaggagcagacagcatggtgcacgagtgaagtgaactgaggtgcagtctgcagatgaagacgggtgcagagagacatggtagtctctggagctgaagatcttgactggttcttatgataagacttctcggatctggtccttggaaggaaagtcaataatgacaattgtgggacatacggatgttgtaaaagatgtggcctgggtgaaaaaagatagtttgtcctgcttattattgagtgcttctatggatcagactattctcttatgggagtggaatgtagagagaaacaaagtgaaagccctacactgctgtagaggtcatgctggaagtgtagattctatagctgttgatggctcaggaactaaattttgcagtggctcctgggataagatgctaaagatctggtctacagtccctacagatgaagaagatgaaatggaggagtccacaaatcgaccaagaaagaaacagaagacagaacagttgggactaacaaggactcccatagtgaccctctctggccacatggaggcagtttcctcagttctgtggtcagatgctgaagaaatctgcagtgcatcttgggaccatacaattagagtgtgggatgttgagtctggcagtcttaagtcaactttgacaggaaataaagtgttataattgtatntcctattctccactttngtaaacgtttagcatctggaagnccagataggcatntcagantggngggntcncnngaactaagatgggtcattgagtgatgtgtcctaagcggtcactaatggatgggtgacataagtaaggatacctacaatgaacagaggggatcggacctctatatacactgttgacggggatatacagaagtgaagacacttaaaaatggttctgagatacataggtaaggacaaaggactagaagaagcgacgaggtaaggttaaccacaagagagagaacatagaaatttaaagaacactataagagagtaagtgacaaaactgagaaagagggagaagaagcagagtagggaa

SEQ ID NO: 197577 - DNA, 641 bp, Homo sapiens
ccagcccccattccagccattgtctcttgatggtactactgacacttccccaggctgtcctgtttgtaataaccaccactcttctgtgccagctatgcctgacgttcattcaggtgcactcagactttgagtcctgcttctggttgatcaatccctctccagaactcctaccacctttcctaggaccctgaaccatttattagccacttatgttgtgttgcacggtgacagtttttatcttttaatgttctctcttgtttctccagctaaatgggagcagccttgaaggcagagatcatgcagagatcatttctcatccgactcagtatccctgtgcttgggatagtatctttcatatattaatagttgctgctcagtaaatcttaccactgtgatgtcttttcaattgctgttttaaaagtctttttgcagaagagacagtaataagaggttttgaaaatcttagctgcttttcctatcagagttttatgtatgaattagaaaatcatgtttgttagatatccaactgaatagttatatatgtaattaaagcttcttctaagaaaatggaatgaagttggaatctttctgtggttttcctcaaacaggcataaaaacattgctaagcacaaacagatata

SEQ ID NO: 197578 - DNA, 474 bp, Homo sapiens
ccgaccaacttcaagttgaagttcccatgaacccttctttgggttggatttatttgctggagtgcagtggtgcgatctcggctcactgcaagccccgcctcccaggttcatgccattctcctgcctcagcctcccgaccagctgggactacaggcgtccgccaccacgcctggctaatttatttttgtatttttagtagagacggggtttcaccgtgttagccaggatggtctcgatctcctgacctcgtgatccacccgcctcggcctcccaaagtgctgggattacaggcatgagccactgtgctcagccaaaactcatagccacttttatctttgttttctcttttgattctacccaaatttccagtgagaaagtcctgaattcagtgctgaaattaggtttttacatgtgcttttttctataagtgtgaccttgtaataaaggaagtggtttgttgtccttgataatctc

SEQ ID NO: 197579 - DNA, 556 bp, Homo sapiens
ggcagtgacattttctttagcctggggattgccatgcacagtgtggtgttggagaacattaatactggaggaagccttgagttctacgccatgttctgttacaggctgcatctgtcccggcacacatcatagagcctttcttcccgggcctcagtttctcctttgataaggtggaagaaaggactagatctttcttgtaaggcccttctgggacttaacaacattcctgaatgggcccacccttgtttcccattgatcccccgtgagcctcctttctctggcctctaggcagttgctccagccatgacaagcaggtgtccactgagacctcaagatctgataagcagggtttgacaccagggaaggggcctggaatgaaaattgtttccaaacacccttgtttatgacttccagaaatggttaaagctcttctaatcagccagcacagataggacccctgccgtgaatggagccactgggatgatggtatttggctacgagggctccagagcacaggcctgccctggaggcattagatcgtgactcaggagctgga

SEQ ID NO: 197580 - DNA, 318 bp, Homo sapiens
taagactgtgaaagtatgttgaaagtatgtttagtgcattgtgtatttaacaaaatttacttatagattatgactacatgctaattcttagaatgaacaattatttaataatttcctggcatcctattgcgtagatctgcctttggcagcttaatgataaaaggggtcatttctgcagagatttctggaagcaacttgagtttctcaagggcttggtaagtcttcagcgttcacatcattcctcctgaaaccgcctttcacgccatcagttttgaccatctctccctcagctgtgagccaggcttctgctgccaccat

SEQ ID NO: 197581 - DNA, 475 bp, Homo sapiens
ccaacctctcagatcttatctgtgtcattaagcaatgcatgactgtaattaatttcagatatattgcaaaacagaccattagcaatgccttttgaaggaaattattggacttcctttagtgaatgggtatggaatacttaagattagcagtatttattggcatattgacaatattttctgagtgttaaaatatgttttctgcttcttttgttctaaccattagagaattgctagtaactgattcttgtgtttaggcatttcttcattttgtgatcactaatacaggttttcctgacactctgattcctaccctttctcttgtttgttatttttccattttcctctgcaaagaggtacactttcttttctgatgctctttactttttattcctttctgttttcagttgtgggaccaaagacgattccctatcatgctcaccattgctagttagaaatgtttatgtgatttgaaacg

SEQ ID NO: 197582 - DNA, 267 bp, Homo sapiens
cacagacacacacacatgtacacactcacacacacaacgctggaccaatagagagaactttatcagtaaaatgtaactatttcattacaccagaagctatccgtgtttaaggccctatccccaaagcaagtagagaatgacaattatcttggtaaggaacaagggccttcccacttccatcccctaaattacactaatttctggcgtttccaccttctctgagccagtgcttccatttgggaaataaatatgaaatgatttatccat

SEQ ID NO: 197583 - DNA, 108 bp, Homo sapiens
cacatgcaacccacaccccagcaacaccaaactacttcctactcccaattgcaccaactggatcttttttgccactgtgttttcccatatgtttttccctccacatgg

SEQ ID NO: 197584 - DNA, 374 bp, Homo sapiens
ctttttcttttctttgagggagaaattaggcaaataggcaaaagaaaatatgagaggcggtttccttccttagaagggctgagcagggattacgaaatctcaaatgccaagatcttatgtgcaaaccatgcccaatgctgtaaacattattaagccctaccaaaggctatttacttgaatcctaccaagaaacattaagcattacgaaacttcttttaaaatattgttttgcattataaaatagaatacaacataaaaatatttatgttaaataattataataaactatgcaaaatgagtaataaggaacaatatagcataaagtcatgtatataatgtttacaatatttttataaagtaaataagaggttctt

SEQ ID NO: 197585 - DNA, 301 bp, Homo sapiens
acaggaaacacactgagcaggataaatagaaataatatttataggggcttacagcatgccataccagcctactggcagaccaaacggatgtgctttaggttcatggcacaaggccagaatccagataagtgctattcttccacagagcccagattccaacaccaacatctgtatgttctcttttctaagatgcatcttttagacactctttgggagtatgaaaacaatggcaaaaactaagacaaaaagtggaaagttccactaacatcaaagaattcactgctattatgaagttagtatt

SEQ ID NO: 197586 - DNA, 570 bp, Homo sapiens
tgcaagcctccaagtgttctcttccaagtatggtcacacaggacatacctcatttctccaggaatgcattctgagaacacatatgaagtgttgtctactagggaagctcattagaggctcagtgaccatagcttttattgggggctggtcatgcaggcaccctttgcctagcacatagcaaaattccaggcttgcggaaggaaagcaggtgttcagcacaaaccccattgtttatacagtttagccacagtgagccattcttatcagggaatagtggcaactctcttgaaatccaggttctcagatgccagctaagggccatccttgaaggcaggcctttttaagtataacagtcttgggcctcaaatgtaaactctatatcaccttctcaaggcatttttctgttacttgctttttggtttcttatatgaatctcactttttttaaaaaatacctcatactttttgctgaaacctacaaattttagataatatattgcagtgatttctggatactgctaccccctcctctactgtggggctcattggtattgtttacttctttgtttag

SEQ ID NO: 197587 - DNA, 455 bp, Homo sapiens
ctggtcgatctctagaaggatccccagttgcctcgtaatagtcaaaaagtgaaaaccgaaatgtccatcaactgatagctaaataaacagaatgtggtctacctagacaatggaatactattattcagccagagaaagtaattaaataacaatacaacatggatgaaccttgaaaagattatgctaaatgaaagaagccagctacaaaagaccacgtatagtatgattccatttatataaaatgtccagaataggcaaatccatagagacaaaaagtatattagtggttgccaggggctggggagagggaatgctaagtactgctaatgggtacaaggctcaggggcaatgaaaatgctctagaattagacagcggtgagagctgcacaaatgtgtgaatagagtaagaaccaataaatcatacacttaaatcaaaaagccaggcgtggtggatc

SEQ ID NO: 197588 - DNA, 245 bp, Homo sapiens
agctgcacaagagccacagagggaatgacgccagcgagaagcagagatgcatttcttggaaatgccaaaaattatcaatgtatggggtagatttacatcatgctaagcatggggaaagactgtatgtggtacatctcctaagcttgatacaacgtctctgatgacctctggacatcacacatccataggaaattacctaaacatgaaatgtgcaagtagcaaaaggaaattgcagttctaggatg

SEQ ID NO: 197589 - DNA, 1163 bp, Homo sapiens
ctgggtcacattacatgacacatatcctatactaaaatctacatgaatacagattcggcatgaaagatcccctgcatatatatatatatagtcaaacaggtgtggttataattctctaacccttaaccttctaccatacttgggatatatctgcaatctgtaaacaatatttctgtcatggcaatttttgacaaataggaaggaaggctatttctgtcaagggcaacttaattactaggttttagggcttcatttcataccagtgatggtggtaataatagtaacaccagcaggttcagtgtttgtcatgtgtactcactaagtgtcagagactattctagttccctgcattgctacaaaggtcctatgttaaagggcctataaggtaggtattattgtctcaaagttatagctaaggaaagtaatgttcaaacaagttaatgccacatagctagtgtcagcatcaggttgtctgaattcacagctagagcactacaccccactgctgacaagaaaatgaatccaaagatgctgctggctgtcttggatcacttgttctcaaggaagctagctaccatgttgtgaagacactcaagcagtcctaagagccttccacatggggagagactgagacatcttgccaatagccggtatcaaattgcctacaatgtaagtaagccatcttgacagcagacaccaagccactaccatcgaactaaggcacctcagaattatgacccatacaaaccatgtgaggtgataaatactgttatttaaaaaggaaaacaaggtgggtctttcacttctagcactcagattatggatcctaaatagcattttccaataaaaggaagcagagctcttcaggaaaatagtcaactccaggtatagggcagaaaatgtacaaaacttgtcataacagaaagcaatcaggccatcaatcacttctggagttatgtcccaaggactcagagagagttaatgtgaagaggctcccactaacaaagatggggtaatttgaggagcaataaaaaatgaccacaattggccaggcgcaatggctcacgcctgtaatcccagcactttaggaggccaaggtgggtggatcacaaggtcaggagatcaagaccatcctagccaacacggtgaaaccccgcctctac

SEQ ID NO: 197590 - DNA, 382 bp, Homo sapiens
gcattttgttacggcagcctgagctaatactcctactttgtcctgcatttacttggtcttccagttagttttttagactttgggaatcagagcagtcagttgtcagattttagcttacagttgtcctacctgtgcaactgaaatttcttccattttaaaccagagcagagttttagagtcaaaagaaaccagatcttttagtgcagaagctttcacactgtattagaagtgaggaagttggttttgtgagttgcagccagcagttctcttatgaagtgcattgcctgcagttttgtgaaagttgtattcccagcttgtgtgtgtatatttgcgtgtactagattgagatataaagtatatttttgactgtaggtatggtaaa

SEQ ID NO: 197591 - DNA, 419 bp, Homo sapiens
aaaaatgtaataaattatatgatgcaaaatgaccacatgaatattctaggtaacactaaattaaaatattcaatttatacttcagaaaagtaaaacaactttctttctctaagtaactttgctatctttaaaaatcagctttaatctgtatcactgttcaaacatgggtcataattattagtggatcataattaacatatcataactaactttctattatgaattggaattaaaaaaccttacaaagtaccaaagtgtttaatacatggtaatagcattgttccatgaaggatttttttctttcatgaagcctttgctttagaaacatacagatagggagaggtagaaatgagatatagctagagacagacatacagatgtgtgtgcacatgctcatctgggggtgtgtaccagctcat

SEQ ID NO: 197592 - DNA, 265 bp, Homo sapiens
ggaggctgccgggctgggcaaggggtctgttccagcctgttctgcagctgggacttggccacactgcagcaggttcacagatgaagcccgcaggagcaagaccccaacccatgaaccagaggtgccccaaagagcacctggggcaacaaagggatttccccatggaggaaggaagacccaggggccatgtggggtggacaagcctgggtcccagtgccaaggccgacctgctgctgcaggttcctctgtcttcttagccttgctt

SEQ ID NO: 197593 - DNA, 449 bp, Homo sapiens
gcatcacagtcttcaatcccatttgccatgtgacataaatcacggctttcactggtccgctgcctgcggggtcttcttgaagatctttctggttggctggaatccatctttgctttatctgaggctcgttcactttcagcaggatcttggaaacactgtgagtgtaactccatttgtcttgcccgattttccaccaattcgagcatttgtgtaacaatctgtattttttcatctcccaattcttgactattaattagtgctctctggagaagctgctgtagacgtttcttatggaatgaatcattgctttcttatatttttcatagacatcatcaatttcctttaacgtttgcggagccaggatccgcgaccgtccaagctactgatcgccgtcctgatccattggttgggaaagagattggaaacatcaccacaaaacatgctgcaaa

SEQ ID NO: 197594 - DNA, 510 bp, Homo sapiens
actctagacgatcccccttagcattccttactcatacaagagcggatacattatcataggtatcttacaccgtgtcagcagttattcaaaagccaatctttaaattatgcagcttttctgcctcaactggtcttcatcagctgtttatcaccatatttctattgctaattgcataaatgaagacagatgcaggaaactctggatgtgggatgtcttctttgaaaacgaatgctgctaacgccattttcagaacgtctgctacaaaattccttctataaaatggtagctatcacatatgtgtgtgaatgtatgtgtatatatgtgtgaacacacgcagacacatacacagttggggttgcagctgttcctcacagttgtccgataatctgttaactgaggtagtgtccatacagtttctttgaggcataaaatgattatacactgggcagcaaaactgcagcctatttttctactctgatagtttcatttgtgttacctcttcaagaagaa

SEQ ID NO: 197595 - DNA, 707 bp, Homo sapiens
agggccacgtggctaatgtcagtgagctgtgggagagacagagaccccaggtggggcaggcagatcagcaaatcttggaggacctgctatatggcaggcactggagacatggaggtaaagaacacaatatccatgttctcagggacacactcatatgcccttagcattcacgttcttcacactgacagcttcttaatgcaagcccaccagatactttcataagcactacctctgacttcaggcacttgctgagctgcacacagggcaggccaaaaggaatggaaagtgagccaccaccggggcagcactcactagtgaaagataaataccccagctctctcagccgcttgtagaactctgaggagtgttctgtgcagcttcccagctgcccaccatgaagctctttctcaataagtgaccagcacagcttaattcctgaattaagctgtgtgtgctgtgagactgacacaagacagggttgacaggaagctgtcggaacatttgagtagggaagcagcaagatccactgtacatttaaagaactcccttgagctgttatgtgaagaatggagtacaggaagcaagagtggaaatcaagagaccagtaatgaggtatggacaacaatgtaggcagagaaatggtggtggttttaaccagggagatagctggagagattaggtgtgggcaaatccagagagttgataag

SEQ ID NO: 197596 - DNA, 182 bp, Homo sapiens
atggaactcagcatgtcatttatccgttgtttttcacactttagcatatatcaccatcacccagaaagcttaacacaaataatggaacctgggaattttcatttttagtaacttcaagtaatgctgatgctgctggtctggagagactttaagtcttaatcactgttccagcccacaacact

SEQ ID NO: 197597 - DNA, 563 bp, Homo sapiens
ctgaggtgggaggatcgcttgaggctaggaggtcgaggttgcagtgagctatgattgcaccactgcactccagcctgagtgacagagcaagacccatctcttaaaaatatatataaaaagtaaaactaaagaacttcttgcctaaacctgaattaccgcaatttgctgagtgactttgagaaaaatcagactgtttagttcagtcgggatgaaaagcttgcgattgcttcccacaagaatgggcaatagtgacggctgcaaggtacttttatttgttcatgaaagaacgacaatttttcaaaatgtaattaaacataatagaatgttttaaactactgggcactgaaactggaagaaaaaggaggctttattgaacattcccctttttcagttggttcaaagttcagcactgtggttatcattggtgatgccagaaaacattagtagacttagacaattgctatggcagtttctaaacagagctttttctatacactatttgcaactggagtgcaatattgtatattctgtgttaaagaaataaagtatttttatcatttatt

SEQ ID NO: 197598 - DNA, 363 bp, Homo sapiens
agaagacatctcagtttccaggaccagttcaggatgtaaaagtggtctccttctgtcacccaggctggagtgcagtggcacaatcacagctcactgcagccttgacctcctgggctcaagagatcctcccacctcagcctctctagtagctgggactacagcaaggtttctctgcccagacatgcaggatttcttcagcaaagcaaaagccctgcagattaccagatccatcctctcctaaagccagagggaccatgagacattagtacctgagcatcacctctctccaagtgatttatcaaagctttatttccaatcacatactgagttttgataaaacagttttattctttggttttcttc

SEQ ID NO: 197599 - DNA, 497 bp, Homo sapiens
cagaccagggtcaggggtcattcccaaccatcttagtgtacatcccaggtctcatatgctgttcttcctgaattaagttatttgaacataaactgacttaatcctaggacttcctcttccccctccagcaagcaccactgaattgtgttgccatggcttgaacctgggcgggcgggggttggccggggggtggggtgcggggagggatttagctttaaatcgtgttacttgctgcctagaaacctagatctctcagagcaatgttgagaagtgtaaaattaaagtgaattaaagttggaagtgtaaaaataaagtgtaaaattaaaaggagagaagaggtcctaaatatggtgggcatggaactcctttaagaatttttctaaggttgtctgttgagaggaagtggctgcgtatggtgtgaaaacaaacatgtcaatgctacagtgatacaaacttgacctttagtaaagatgagcttatttgatagtttcaaatat

SEQ ID NO: 197600 - DNA, 567 bp, Homo sapiens
cctaacccctggatgagtatgcccatctctcaccctctgtgacaatccaggaaacatgaaggtgtttccagatgcagagtcggtgggccaaaggggaaggcaggatgatgggtgtttgggagagtgggagacatgttttatttttccttccctccttctctcccttcttccctcctcctctccttgtctgtctctctttctggtgtggggaaaaagtagaagatgctttggaaactgatatggcttcatcctgagttggctgctcccttgctgtgtggtgttgggcaagtcaccccacgtctctgaacctgtttctgcatcctttaaaaaggaataacagtccctgcctttgaagggaggacccgatgaagtaatatacatgaaatgcttagaatagtgcctggcatgtggttctcttccctgggaaaaaattaccctccaatttgctgatactgtctctctctttctctcttttttttctttttgtcaaaaccccccaaacccttaaccaacacctccacccacccaaccttgcctgcccagagatgttgttggagcggtggaggg

SEQ ID NO: 197601 - DNA, 652 bp, Homo sapiens
aactgtatatgttccacttaacatttctacattagcaatgatgtaactctccaacatttccttataaaaaaggcaaacaagaagtgacaactcatgctccaaatattaaaaaatatatttaaacatatgatcaagaagatatgggccgtgagtggtagctcacatctgtaaccccaggattttgggaggctgaggtgagtggatcacgaggtcaggagatcgagaccatcctggctaacatggtaaaccccgtctctactaaaaatacaaaaaaattagccaaccgtggtggcacacacctgtaatcctagctacttgagaggctgaggtgggaggatcgcttgaacccagaggcagaggtggcagtgagctgaggttgcgccactgcactccagcctgggcaacagagcgagactcggtctcaaaaaaaaaaaaagaagtgaatataggataagttggatgtatatagtgtacataggatgtatataggagtatatagtgatgaataaagcagggaaggggactggcctcacagggcaattttcggacaaggtggccaaggaaggcctctctgaggaggccctgaatagaggagggagtgaggcggtccccagcctaattcatccacagccatccgggagatcacagtcaa

SEQ ID NO: 197602 - DNA, 545 bp, Homo sapiens
ggaaaaaaggaagacagcaatggggacggagaaggaaagaaagacagccactggtttccccgtgttcacacacttgttctctttctctctttctgctgactggtctgaggtttagcatttgtatccgcaaaatgtcttttgagtcctcacagacactggctttgagaaacctgctcttgttgtccccacatgacctcattggtcaaccttagtgctgctaacagcaagacaagcagacactgtgtgcattccaacatgaggcagtacaaagtacatagtatcacctaggaactagtcttgccaaaagcagaggggggcagggggagacagagagacacagagagagaaacagagacagtgacagtgagaaatttaacctaagtctaacccagcctttggatctaactttcagttcatgggaaatacaggggatagaggaacaagttaagtgacaccactagaaagcaacaagacaaatccaaaaaaccacactctgaaagacttttaaaaatgtcaattggccgggcgcggtggctcacgcctgt

SEQ ID NO: 197603 - DNA, 528 bp, Homo sapiens
agctattaatgctgatgtagatactgatagagttattgtataatcagtttttagaaaaagagagttttgagttttattgatacaaccgtagtttgcttttgtgcagatgggctgcttctttatagcatttgtgatttgacatttgccgttagtattatctcttgactctatgcagatggcgttacttgacccatgcaagttcatttctgaacctccagatatgtgtctgatgtcaagcagtgtgagttatttggttagattgtcttctgagggaagactgtgtattttttggaacttatttgcattggaaatgattctatcatcctttgaaaatttggtggagaataattagcttgctttaatacagtgattctcgttttttgttctcaaaactcttttgcacttttaaaaattactcagaacctcataatttttctttatgttattgaactctattgatatttgtcatatttgaaattaaaattgaatttttactatattaatttaataaatgtctattaaatcatt

SEQ ID NO: 197604 - DNA, 424 bp, Homo sapiens
agtaggtgacaaaggaggtctagttaccctgcctgatgagaagagttttaaaatgttgctatcacaggatacacattcagtttgagtcaaacagattattgttctagagtattttcatagaatagaaattcaaaggccaggtgtagtggctcatgcctataatcccagcacattgggaggccagggcaggaggatcccttgagcccaagagtttgagaccagcctgggcaatatagtgagatattgtctctaccaaaattcaaaaaaaattagccaggcgtggtggcgcacacctgtagtcctagctacttgggaggctgaggtgggaggattgcttgatctcaggaagttgaagctgcagtaagctctgatcatgccactgcattccaacctggacaacagagctatactctgtctcaaaaaa

SEQ ID NO: 197605 - DNA, 557 bp, Homo sapiens
actccaaacattaataattttttagcactgtgttacattgtgaaaataaccagaaatggtagagaatgtctgaagggaagtatattcccagaaagggaggatgtcaaccaactctggaggatacccacatcagaaaaggacctcctctaagacacagttcccaagtaaacagagggctatgcagtggggctaacaggcagcttttcacagtcctgccatagcctcagagctgacagttgggagcagatgtaaccgcctgctcaggaacctctgaattcagagggctcttcacatccacaaactgcactacagaatctgagagcactgtcagagctccaaagggtgcatggccctgggctggacacagatgcagcaggtgggaatgaactctgctccctagccaccacctgctcctctggtactcaacagtccttcctatccccaccaggtcatggaaactgcagctacctgggttctagtacacttaggagattggaaacttgataaatggaacagaaatgatcattgagaaactaaaataaatcactatattctaa

SEQ ID NO: 197606 - DNA, 457 bp, Homo sapiens
tcaggcctgccagccctgccactggctttgtgattttcgttcctgaattcatagagatggctgccagcaacgagaggtaatctcaggacacacaggcctgggctaggccttggaatattccggaagtcggtggccagagttgtatcaagccagacgggacacatatgggaatacaattacagcaaagccggcaaggctcagtgaggggcagagggcctggccacatgaggagccagtgctgtgggcaggcccgggtctgagtgctggctgtgtgtcctgcacaaccacatctcccagagtgcattcgtcaccatccactccagatgccccttgaacaaatgaatttcacagttgcaaaaggctgaaaaatgctctgtgacctggcacccccttggggaaccacagtgcattaaaggctctgagaagtcctgcagtaaagaaacctgatgaacttttg

SEQ ID NO: 197607 - DNA, 601 bp, Homo sapiens
aaatgaagaggggtgtcaaagaatcagtggataactgaacatgctttgaactttgagattgaaaaagttttgaattgtagtgttgcttctttttttgaagactcacatattcaagccaaatgttaacatcattattcattcaacaagtatttattgatatatactgtgtagcaaacacatttgtagtgctggagattcaatggtgaacaaaccaggaaaaaaaaaatccttattttagacttacagtttaattgggaacttgaataactgtgtgagaaaatacatccaataaataagtaaactaataacatttaataacattttagaatgaaggaaatgaacaaggagatttgatagagagcagttgggtgggattgaggtaggtggagtcagaggttaccagatactatggttatgtctgtcctagaccagaaatcagaagggctagatattcacccaacttctgccaccaatccagctgactggccttcgaaaagggacatctgtagaccgagctggtcatttagactacataattccaggagctttttacagcccatggtaggcagaatggaccctctaaagcagcagtccccaacct

SEQ ID NO: 197608 - DNA, 525 bp, Homo sapiens
actctacacctttgaaataatggctgtccatttcccctcctagccactagttacttttttctatgttctatctttatgaatttgtctattctagatacctcatggaagtggaaacatagaattttttgtgcttttgtgtcagacttatttcacttagcataatgttttcaaggtccatccatgttgtatatagcatgtgtcagaatttccttaaggctgaatactattccattgtatatcacattttgtttatccattctttcgttgatggacatttggctgttgtgaatactattaatactactctgaacatgggtgtacggatattggttagagtcccagctggattatatgtggttatgcttaattttttgaggaactaccacacttttcacagtagctacaccattttacattcccaccggcaatgtacaagggttctaatttcactacatcccctccaatatttggtatctttcctttcttaaaaaaatagccagcctagtgagtgtgaagtggcatctc

SEQ ID NO: 197609 - DNA, 423 bp, Homo sapiens
agactttgaggccattgtgataaaataaatgtattttacatgggtgaagagcatgaatttggggggccggagggtataatgttgtggtttgaatgtgtcccccaaaaagcatgtgttggaaacttaatcatctgtgcaacactgttgggaggttgggcctaatgaaaagtcattaggcaatgaatgtagaatgaatggattacagccattatcacaagtgtgagtttattatctcagttgtgggttgactatgaaagggggagttcaccttgttttactttctctctctctctcacgctctcgtttccttctaacttccaccatgagatggcacagcaagaaggtcctcattagatgctggcaccttgatcttgaactacccagcctccagaactgtgagaaataaatttgttctttataact

SEQ ID NO: 197610 - DNA, 319 bp, Homo sapiens
attcttatagccttcctggggagatttattttttggagacatcgctcacattgtttactcctctaggttaaatgtactaggccatctgttgttaattttgtagttgtattaaattccatcctttggctggattttaagcaccaaaagcaaacttagacagaagcaggagcatttgcaaattacatagctttgagcctaaatggtggtttttataagtgcagttttcaaatgggctgagattctattttgagttttgggatcagtaatttaaacacagggacctctacgagttctctggaaaagcccattttgagaccct

SEQ ID NO: 197611 - DNA, 301 bp, Homo sapiens
gtgagccactgcagccagccattgtaattgtttttctagatgaacaataccagctgttgggtggtcctccctacccactaaggctcactcactggtggtttgtcccttgtgtgtgctgaccttcgtggtaggaatttattgccagatcctagtcaatctggcttttggagatgcccccttccctgtccttagggaccatgtcttatgtgacctgttctgtagtgggagctgtgatcacccataatgctggaaggaagatggttcccagggatggaaagacttcgttaggacataaactaaa

SEQ ID NO: 197612 - DNA, 277 bp, Homo sapiens
tgaggatcaacaggcaggcaaactgccagttacgatggtcactgtgtgccactgagggctttacaatcttattatcagtgagatccacaccaagagtataaataagagagccaacacaataaagttttagctgttttagaaagttctctccaaaagaaaagtgtggaaaaaactgtaacaaaaggtaggtctgtaagaattcacataaaagatgtttattgcagcattattcacaatagcaaagacttggaaccaacctaaatgtccatcaatgata

SEQ ID NO: 197613 - DNA, 1134 bp, Homo sapiens
  misc_feature (933)..(933): n is a, c, g, or t
  misc_feature (1038)..(1038): n is a, c, g, or t
  misc_feature (1054)..(1054): n is a, c, g, or t
  misc_feature (1081)..(1082): n is a, c, g, or t
tgcttgggcagcgactgtcatggcggcggccgcccccaatgccggaggctcggcccctgagacagcgggttccgccgaagctccgctgcagtacagcctgctcctgcagtacctggtgggtgacaagcgtcagccccggctcctggagcctgggagcctgggcgggatcccaagtccagccaagagtgaggagcagaagatgatcgagaaggcgatggaaagctgcgctttcaaggctgcgctggcctgcgtgggaggatttgtcttaggaggtgcatttggggtgtttaccgctggcatcgataccaacgtgggctttgaccctaaggatccttaccgtacaccgactgcaaaagaagtgctgaaagacatggggcagagaggaatgtcctatgccaaaaatttcgccattgtgggagccatgttttcttgtactgagtgtttgatagaatcttaccggggaacatcagactggaagaacagtgtcatcagtggctgcatcacgggaggagctattggtttcagagctggcttaaaggctggggccattggttgtggaggttttgctgctttctctgctgcgattgattattacctccggtgagagtaattgcctgcagggaaggatgatgccagccccggatccgggctgctctctggaggacagtttctgtaccacaccaggccttgcttcagggcctgaagacattcattttccctcatgtcgttggtattctgagggagctgcctggcttctctgcctccagcctttggggtagccacactttgctgctcctggactccagccagccttcacagaggacgtcccgtgccagattctctcacagcagatcgggagacaggatgttgacatataggaattcagctccacaaagcttcaggcctgaccacagctggccctctaggttgttnggtgttgtgggcacagaggtgacagtgtctctgcaggcactcaggaagctgttctaccttggaactccatgcaactatccgtctcgaataccagggcagggcaangcggactgatgccgtncaaccaattatctcacttgtttgtgtnntgtcatccttgtttttttttaaaaatacactcccctcccccaccgccaaaaa

SEQ ID NO: 197614 - DNA, 1030 bp, Homo sapiens
  misc_feature (829)..(829): n is a, c, g, or t
  misc_feature (934)..(934): n is a, c, g, or t
  misc_feature (950)..(950): n is a, c, g, or t
  misc_feature (977)..(978): n is a, c, g, or t
tgcttgggcagcgactgtcatggcggcggccgcccccaatgccggaggctcggcccctgagacagcgggttccgccgaagctccgctgcagtacagcctgctcctgcagtacctggtgggtgacaagcgtcagccccggctcctggagcctgggagcctgggcgggatcccaagtccagccaagagtgaggagcagaagatgatcgagaaggcgatggaaagctgcgctttcaaggctgcgctggcctgcgtgggaggatttgtcttaggaggtgcatttggggtgtttaccgctggcatcgataccaacgtgggctttgaccctaaggatccttaccgtacaccgactgcaaaagaagtgctgaaagacatggggcagagaggaatgtcctatgccaaaaatttcgccattgtgggagccatgttttcttgtactgagtgtttgatagaatcttaccggggaacatcagactggaagaacagtgtcatcagtggctgcatcacgggaggagctattggtttcagagctggcttaaaggctggggccattggttgtggaggttttgctgctttctctgctgcgattgattattacctccggtgagagtaattgcctgcagggaaggatgatgccagccccggatccgggctgctctctggaggacagtttctgtaccacactttgctgctcctggactccagccagccttcacagaggacgtcccgtgccagattctctcacagcagatcgggagacaggatgttgacatataggaattcagctccacaaagcttcaggcctgaccacagctggccctctaggttgttnggtgttgtgggcacagaggtgacagtgtctctgcaggcactcaggaagctgttctaccttggaactccatgcaactatccgtctcgaataccagggcagggcaangcggactgatgccgtncaaccaattatctcacttgtttgtgtnntgtcatccttgtttttttttaaaaatacactcccctcccccaccgccaaaaa

SEQ ID NO: 197615 - DNA, 576 bp, Homo sapiens
ttgtcacctgtgcttttaatgccatatgcaaaaaatcatgccaaatcaatgcatgaagttttcccctatgtttccttctagaaattttatactttttggtattatagctagttctttaatccagttttagtagatttttgtgtatagtgtaaagttagggtccaacttcgttcttttgcatataaatatctaatttttccaaaatcatttgttgaagaggctgtcctttccccattaagtggtcttggcaccctcaccaaagatcatttgactatatatgtgaagatttatttccaagatttatattctattctatttttctatatctttgggcaatcaagcttaagcttgattgcctgattaaaaaaaaataactattgcccgggcatggtggctcacgccagtaatcccagcactttgggaggcagaggcaggaggattgcttgagcccaggagtttgagacccacctggacaacatggtgagaccctgtctctaaaaaaacaaataaaacaaaagggatctttcttttgaagcatcactgatcaatcatcttgtagttaggttaaattatctt

SEQ ID NO: 197616 - DNA, 300 bp, Homo sapiens
gaaaatcactgatggctgatgatttgggactgggggcagtttctaattgtgagggagctgtgacttcatccagccccagctttcccatccaggcccactctgctcttggaggtgctttctgcatttccagtgtaaatggatgaaaggtagtcttggctgctacccctgtgaacacatgtcatgactgctttgctgtcactgggggctagaagttttcttggctctttcttcaaagctctcttaagccgtgtaccaggtgcttggcctgaggatgccctgtggcgtgaagggacacccaga

SEQ ID NO: 197617 - DNA, 391 bp, Homo sapiens
ggaaacatcctaggcaggcaatcatctgactgcttttttggggcaggtgatgccctgggaaattgggagggagggagagagggaggtaggctattctagaaactgggagagcaggtgaggtaggattgggaggaccaggggtcagggtgcccattggtccctaattgtgaacggagagagcattggtctaggaggcaggcagctcggttataagaccttgggaactcttgatttagaatccaagatcctttttagatctaagattttataaaattaagatatcccctaagatcaaatgcaacgtggagtcctgaattggatcctagaacagaagaaggacatttgtggaaaaactagtgaaatccaaataaagtctgtagttttgttaata

SEQ ID NO: 197618 - DNA, 473 bp, Homo sapiens
gtaaatgttttattaaaacagaatgtggtacactttctttcatctgacaataatagctaagtaaagcttgtaggaactatatgttgcctaggctgctggggaactccaaagtactccacagctcaatcacagcacttattcaatcgtgggtgttggcattttatgatgacttataagttattataattaagagtggaatgattacattatgtgcgtacttgcttccatgttatatttctgctttattaatgctcatcacactttaatccctatgaggtgaggatctttgtagatctgcctgttaatgtggttattatttctccctccccatttccatgagggcagggatgttttctgattaattcttatccaatattggcactgggtctggcacacataaaataataaatacttattgatgaaatgactgcataaacattttggaaatttgtggcaattaatctttttttttt

SEQ ID NO: 197619 - DNA, 620 bp, Homo sapiens
ctccctctatagcttttcctgaatcccataaatatggatggggctattttacttatcctggctatcaagaggaaccccaaatccaggatggaagagcttgatatttccaacgtgctggtgtccgagcagttcatgaaaacgttggacggagtgtatgccgttcacccgcagctggacgtggtattcaaggcagtacaaggcctctctcccaagaaaaccatcttcttgttgacaaaccccatgaaactgatccagagctatgcagaccaacacaaaatcacgatcgtggacttcttcaagagcttgaaccctactgggacaatgaagatgtctgtggatgagttccagaaagcgatgatagagcaaaacaaggtccccctgaaccagtaccaggtcagggaggtgataaagaagctcgatgagaagacaggcatggtgaacttcagtttcttgaacacgatgaagccatagcaacaagtctggtctagaaagaagtctcggcgagaggagtcctcgcaagtcggatggtggcagggaggagagcaagaggtggctgaaatctcgatggacagatgctgtggcaggggctgggcacaagcaaataaagtctggcttggttc

SEQ ID NO: 197620 - DNA, 1345 bp, Homo sapiens
gccaggtctgcagttggagcccattgtgtgaggcagtctgtgaaggaagtgtgagaaccaccctcatgaggaaagctgtagaggaagagtgaggaatgcgacagactccctgaaagcaaaggtggaaaaagaattcacgtggtgaagtcagtgactaatcagtgatgtaactttcctctctggaatgggccctgctcaaagaaaaggtagtgacatgattcaagactgagaacacaggaacattatgacatatcttgaagtaacatctggaagtgtgacgctcgtctcctacctgggtcctgaccgcagaatgaattgtgacatacgacggagtacaaaacctaggtgaaattatgccatatacctgagacagatcaaaggaataataacaactttatacctggagccaggatgtgcagaatggtgactctcattcctgaacatttccaccagtgctattgtgacatacaccttggtccagctcctcagtgatttaataatcctgcctaattatagcctgcatatgacattttgacatatacctggacctagaaccttggtgatttgactctcctgttgtagagggtcctcagaaaaaactataacatatctatgggcccatcatctaggtaatgtgatgttccccatttgtctgaacctcctttcagtgaagagtgtggcatttctaaacactgcatccaaatgacatgactctcttgcctgggccatttcaacaggaggccttgtgacatatctctgagcccatcattttggtgatatgactctcctcacctgcctggacattgtccacaagaggcattatgcgatagagctgggactggcaccaaagttttctgacttttcggttagtgccctgctgacaaagagaacgttgtaatacttctggcttagaatgtaggtgatgtgtttgttctatctcttttataaccaaagacgggatggtgacatataactaggcacagctaataggcatgataatgactctcttatgtggacccagccaatagaagaaatgttgcctcttataactaggtttagggacatgagtgatgtagaatctccttctggtaaaaaggtcacagaagattgcaacactcacacatattttttaacacccttgtgttgaatagagggtgtcacaaagcacctagcacacagaataaattgtgagtattgtatgcacacccagctgacagcaaggaatttcaccatcacaggtggatgaaggcatctgtcctacatgaaaacaggacatgtgtggtattctaaatctaatccccagaattttatttcttcaagactgtgatataaatctttgccagtt

SEQ ID NO: 197621 - DNA, 396 bp, Homo sapiens
cctcttaactgtagctaagatatgagagtatctttctctcaagatggtcactgtaggaggctgattaaaaacactttgacttcgtcagacagaagggagtattgtatcttgcatgtcatcaattaattaaacttttcagcatcatccaagaatagccttaacaatgcgtttattattaaagaggacactcatgtggaatgagatgcatgtgaggctacagtgcattgccaaaccatctatttctggggttaagactatattaaaattccagttttatgactttaagctatgtgcttctcaaacatctgctttaaatttgtcagtactttcgtaatttagcctaataaagttgcatagttcttaattcctagggaaagaatagtgtcagggggagca

SEQ ID NO: 197622 - DNA, 437 bp, Homo sapiens
agtgtgtgaatgtgccgagttctccacgtcagctgagcgacctggcccctctcaggctctgcaaggcttctcgctgaagacctcttttcaagtgttatttcaaatggttttgttttcagttttcaggagcatctttttaatttcctctgccaaatggcattcatccccataggaaaggtaatgttagcatcaggaaatgtagtttggccggtgaaaggttgattgctatggggtattcttcctgagctccgaaagttggttctaatgtgttggggtctactgtgaagggcatggcctctggattctcctgcactctgatttctttctttttcattttactaaaaatgccttttctgtttcactaactcagaaagagcaagaatcttccctgtgacttttcaatttttaaatgactaatggaatgtgtctgtgtaatt

SEQ ID NO: 197623 - DNA, 340 bp, Homo sapiens
ccaacttccctcaagctcaggaaagatttcctcaggtaacagttttcccccacaacaggcaggcagccctcttaagcgtccatttcctgctgctgctcctgctgtagctgctgctgctcctgctcctgctcctgctcctgctgctgctcctgctttagctgctgctgctgtggcggcggcggccggtggggcggcaccaagccattctcagaagccctctgtgcctcttattaaagctagcaggcgccgtccagctgccgggcgccccaccagattcgtaaaaatagccccagccattcaggtccggacaggctccactggcctaaaggccaccaacgtg

SEQ ID NO: 197624 - DNA, 338 bp, Homo sapiens
aaaatgctttgcagcccacactacctagatccccagaccctcagtggattcctgatttcctcctattgatctctgcacgggctgttactgtgaccaggcctcgcatctgttcccttatgaccagatggttagaacctgatgcctcctaactggtcctgtaccaccggaacagagctgaaggttctaagccaggggtgtccaatgttttggcttccctgggccttaagaggaagaagaagaatggtcttgggccacacataaaatacactaacactaacaatagctgatgagcttaaaaaatatcattaaaaaaatctcataatgttttaagaaagttt

SEQ ID NO: 197625 - DNA, 515 bp, Homo sapiens
gagagatgacttaacactaaccactgacagttcactcaacacaccaggtttcctgacagggaacccaaacctaaaagggcctaagtgtaagtgcttaaatttagttaattatcgcacagaggtcaggcctgatttaagggacccctttcaaaacaagacaacagctattcatagatggctcctcccaggtaattgaaggaaaaaaacataatgggtattcagtggtcgatggggaagctgtcgcagaagtcgagtcagaaagactgcccaataatcggtccgctcaaacatgtgaattgtttgcaataaatcaagccttagaacatttacaaaatcaagaaggaactatttatactaattccaagtatgccttcagggtagcccatacctttagaaaaatttggactaaacgaagtctcatcagtagcaagggccaagaccttgtccacagttaattaatcacacaggtactggataaccttcatttgccacctccccccccccccaaaaaaaaa

SEQ ID NO: 197626 - DNA, 381 bp, Homo sapiens
tatcccagagaaatgaaaacttatgttcacacaaaaacctatatacagatgttcacagcaactttattcataatagccaaaaatgtctttcagtgggtgatggttaaacacaaactgtggtacagttataataccacagagtactactcagcaatgaaaaagaacacagtattgatacacccaagaacttggattaatcttgctgactggaaaaaagccaatctcaagtggttatacactatatgactacatttatataccatttttgaaataacaatgttttagaagttggagaacagatgagtggttgtcaggggttacggactggagctgggagattgatgtccacatcctggttgtggtattgtgctatcgttttgt

SEQ ID NO: 197627 - DNA, 473 bp, Homo sapiens
agtctgacccaaaattttaatttataattttagcatctatctaatacagtttgggaagcatctcatgaaagctacaattgccagaagacttgttacagtttaatgcatgttaactaaaatgtgtacatattttagtgttcatgataaatacagtttcgaccttttttgagatggagtctcactctgtcacccaggctagagtgcagttgcacaatctcagctcattgccacccccacctcccaggttcaagtaattcttatgcattagccaaccaagtagctggcattacaggcgcctgccaccatgcccagctaatttttgtatttttagtagagacagggtttcaccatgttggccagtctggtctcgaactcctgacctcaagtgatcctcctgcctcagcctcccaaagtgctggtattacaggcatgagccacagcacctggcctctttttgtttttttctaatcatt

SEQ ID NO: 197628 - DNA, 248 bp, Homo sapiens
tccctttgtgatatagtggttctgtctgtggggacactgccagtggtggccaccacctcctgcatctgaagattactgtttggaagagagctctttttactggatgtctggtgtcatccaagactcagggagactggctatgggtagcagaaatggaaggaatcagagatatctttgcaaaaggagcaactgctacaataattaattgtgaggcctctggcttttcagaggaaccagaagtataagtg

SEQ ID NO: 197629 - DNA, 236 bp, Homo sapiens
atatttgagtaggtttgcgtagacaaatgtttttatttctcttgtgtaaatacctacgggtggaatacctgggtcacatggtaggtgtatgttgagctttataagaaactccaaacttttccgaaggaactgtgccattttggattaccaaaagcaatgtatgggttcccattgttccacttcctcactgacactttttagtatcagccttttaattttagccattctagtggcac

SEQ ID NO: 197630 - DNA, 428 bp, Homo sapiens
atggaataagattacaaatgggatagcacatagaagaagggaatgacattgcaatgcagcaaacacagtattgaggatacatacctctacaaaaatgttgtgtagaaaataacctggtttaaagaaagaaaagaaaagaaaagaagccaggcacggtggttcacacctgtaatcctagcactttgggaggctgaggtgggtggatcacctgaggtcgggagttcaagaccagcctgaccaacatagagaaaccccatctcgactaaaaatagaaaattaaccgggcatggtggtgcatgcctgaaatcccagctacttgggaggctaaggcaggagaatcacttgaacctgggaggtagaggatgcagtgagccaaaatcacgccactgcactccagcctgggcaacaagagcaaaactctatctcca

SEQ ID NO: 197631 - DNA, 213 bp, Homo sapiens
tcctttttagcacttaatatactgtattttagatttttatttatatggtttttagtagcaggctttcaagatggtgcccaatgatccttgcctccttggagtggcccccttatgtactcccttcctactttgttccaggattgatttgtgtgatagaacatggtagaaatttgatatgtcccttctgagattcggttttaaaagtctgccagt

SEQ ID NO: 197632 - DNA, 200 bp, Homo sapiens
gaggagagagagggggatgcccgatggggggcagctctgagttcagggaggggactagatgcagaaagcagcaagggtgtcagccctggtcactagaatggccgggaaggggtcagaagaagggcagggatgagggcagttggttggctgtggggacagttatgaggactcggaggagaggactgccccaggtgctccac

SEQ ID NO: 197633 - DNA, 443 bp, Homo sapiens
tattttgagatagtctcgctctgtcattcaggccggagtgcagtgatgaaatcatggttcactcactcgcagccgtgacctcccaggctcaagtgatcctccgagctcagcctcccaagtagctgggaccacaggggcatgccacgccagctaatttttaagttttttttgtagagacaggggtctcaccatgttgctgaggttggtcttgaactcctgggctcaagcaatcctcttgcctcagcttcccaaagtgctgggattacagacataagccattacgcctggcaaacaatttttttgagacaaggccttgctttgttgcccaggaggagtacagtggctattcacaggtatgatcctagtgcactgtagcctcaaacgcctgggctcaattgaccctctcgcctcagtctttctagtagctagtattgtaggtgcac

SEQ ID NO: 197634 - DNA, 610 bp, Homo sapiens
  misc_feature (495)..(495): n is a, c, g, or t
agaatgagaggatggacttacgtgaaagaaatcagcagtcgtagtcacttgagttgtcatcatccatcaggtccaatctagcagggagggaatagcttgagagacttgagactgaggcacagatctctgtagaacatgggatttatcctggcaaatacagtgatcaaatttaggagattggctttgatataataccattatttaccatataatctatcttcacatttcaccagttgtctcaaaaatgtcctttataagatccacaccaacaccacatattttatttagttatatatttttagtcttatttaatttgagataattcagcctgtcttttttttttctgagatactgccttgctctgtcacccaggctaaagtacagtggtatggtcatagctcactgcagccttgacctccagggatcaactgatccacctgcctcagcctcctgagtggctgagaccacagacacattccaccacgcctggctttncttttcttttcttttctttttttttagacagagtcttgccctgttacccagtctggagtgtggtagcgcgatctcagatcactgaaggctccccttcccgggttcaagcattctc

SEQ ID NO: 197635 - DNA, 606 bp, Homo sapiens
aagatttgatcccttcctaggtcttctgcatcctattttaatatgctaccacttactttagaaattctcatatctggattttatgatgattggtctggtgctccacagacctcaccagaaactttaacgctacgtgccttgggctttcttgctggaaaatatcctgtgtagaacactctgtctgcctctaggtaagtgtcattttcggggagggaatctccctgaggacttctgccatttcagatgagaaagcccagaattattcttacagcataagatgccacatagtggttatgatatgaatataagaaatgacttagaggagatgcggggggggtgctgctgcaaatatacattcaattgcttgagtaaaaatcaaggcaagaaaggtgggcttaaattatagaaaggaaaatgtggggtggatttctgaaaaatgtgagtggcttgtaggatttcgccgtgggaagtttttaatcagaaaaattgaatacttgatgaacatctcttacctggtcaattgcaactatcttccaaatagactttttgtcattagcattcaccatgactgcctcttccccacctcacacacacacaacagatatg

SEQ ID NO: 197636 - DNA, 711 bp, Homo sapiens
gggaaatgtgaattcacctggacttttgaaatatgctattttgaagacatcaaaaccccctggaagtttgccgacaaagcattcagatggaggcagacggcgatatacagcaaacctagttcccactatgaaaaatcctatttaactgaagaaaaggcaaacgattccaatgttttggaaagatattaagtgtttctcaaatttgagaagggctctttgtgctccacctttgagccaggtgccctttaccttataacacgacaccactgatgaaattgtgcagtaaagatggaaaacacaacaccactgatgaaatcccctgtgcagtaaagatggaaaaatccagtgcccgaccagtgaatgctgctccacccgacaagacagcagcaaaagcgcgtggctactctttctgccttttccctcccatgctcgcccaacatgcatcaccgcacagaccttcaacgacagtaaattattcatccggcatctgacgtctctctcccaaagagacacatattcagaacttcagacattccatctctgataaatcattcatatccttttatccgccacttttaaatgattataaaaatacctggtggtagtaaactgtggctctcatacatattgagaaacagaaatgcagttaccttttaccaaaattccctgaattatttagaaaaatgggagttactccaggaaactataatc

SEQ ID NO: 197637 - DNA, 382 bp, Homo sapiens
gaaaactggagtgagttggggagttatttgggtttatctttcaagatcatgaatattacaaaatgactttatagtatttagttgggacaaaaagtatttaaaataaatatcaaaggcctagcatgaaaataataggtaaatttaggctttgggctaactacatctaaattttgtcataatgtgttcctgatattttacatttttcactataaaaactatagcctttcatacctcaaaattataagctataggccaggcgcggtagctcatgcctgtaatcccagcactttgggaggccgaggcaggctgatcacctgaggtcaggagttcaagaccagcctagccaacatgatgaaaccccatttctactaaaaatacaaaa

SEQ ID NO: 197638 - DNA, 295 bp, Homo sapiens
ctgagagatggtggctgctcgcaccatggcctggatctgctgcagggtccttttctgtgtgggccctacttgaagctggcctcctcctatgtcacctagagtgtgggccaaagcaacatacctagatgtggaaagtggtgttgtcagaactggaagaggctcatcaggcagtgtgcttccttctttctggtgaggatgcaagatgaaacagtttgtctgttaccttggaggggacacacctgcattcccctaaacacttggccattgttcacccataaaactttacttcaatgcc

SEQ ID NO: 197639 - DNA, 577 bp, Homo sapiens
gaaagatgaaggaatttcataacatgaaataatgattacagttctggtcaaacttgtcaattcagatttcaccaattgagaattagtaagtaatttctctgatacaggcctgaagtttaccttagtaaacactttacttccatatggtaaaaattagattttgggaggaatgcttacctcctaaatatattcaatctaatatttgagggacacatgggaatatatttatgattcatctgctttttaaacataagcctttgttaactgtaagttcttgaactttataaggctgctgttatttaaatgagcacagctcctgatctgcaaacagcagagcgcagggctacagcttgggggatgccagccgactcagggtggtcctatggactgaacaatctcttgctgctgtactggagggcctgggagcttttccatcagcctcggcctgaggtgtgcactcttctcctgcccaccccaggaataaatgagattcctggttaaaaaggaccagagcagtcattttacagttgaggaaactgttgctctgagaagtgagggatttattcatgactacact

SEQ ID NO: 197640 - DNA, 360 bp, Homo sapiens
ggaattccccaagttctggacccaccacaggaactttttatttcttgggctcatctgtctattctaattgtgcttaacatatcacagattcagttttgttatgagattctcaatggggcagccccctgctcagtcctgaaatggctggcattccactatgaggacaaaccacgatcctctggccactggagtgacaagctggcttcccaccactccgtgctcccatgctcacacttgcctcccagcctgttactcgaaccttccgaattctgtactgtgagactcttcctccaaagctctcatggctaattcgttaaccatcttcaagtgcaagtttttcgtcgacgcggccgcgaattt

SEQ ID NO: 197641 - DNA, 532 bp, Homo sapiens
ggtcgactactactactaaattcgcggccgcgtcgaccccgtcctgtggtctgcctcagtttccctctatgacttggctatctgatggatgcaaaacaggcacagagctactgctgtggtttgaacagttgtcccctccaagtgtcatggtgaaatttaatctccaatatgggcgtattgagaggtggggcctctaggaggtgactgggtcatgatggctctgctctcatgaatggattaatccattaacaggttatcgcaggagtgggactggtgactaaagaggaaatgagacctaagctagcctccttgccatgtgatactctgcaccaccttgagactctgcagagagtacccaccaacaaggaagctctcaccagatgcgcccccttgaccttggacttctccacctccagaacagtacaaaataaatttcatttctcataaattactcagtttcagaaatcctgtttaagcaacagaaaatggactaagctactgccctgctgatcagccagccacctgtacatgt

SEQ ID NO: 197642 - DNA, 376 bp, Homo sapiens
tcatttgttgctatcaaatgtactatatcgcagaaaattaaaatatccagtgttggtaagagtatatggccatgaggctgggtgcggtggctcacacctgtaatcccagcactttgggagactgaggcaggcggatcaactgaggtcaggagtttgagaccagcctgaccaacatggcaaaacctcatctctgctaaaattacacacacacacactaaatagctgggcgtggtggcacatgcctgtagtcccagctactcaaaaagctgaggcaggagaattgcttgaacctgggaggcagagattgcagtgcaccgagattgcgccactgcactccagcctgaacgagagagcgagactctgtctcaaaaaaaaa

SEQ ID NO: 197643 - DNA, 288 bp, Homo sapiens
ttggtcttcctgcagggcaaagccaacttctcggagcagaattccgattaagaagtgtttgcgacaaaattcatttgtgactgaatattcaggcatatctttgtgaggaaggaaaataactcatgttattgaaaatcagatgatcactttataattgagacagatataccaaacaactaccatcaacttcttccaccactaggagggattcaggaatacagtcttgctacagaaatgaggtgtgttgtatcctcaaggagcattcagtaaggggactattctgtgtag

SEQ ID NO: 197644 - DNA, 121 bp, Homo sapiens
tcaaatttttattactttaaatcagggtttccccaccgtggcaagcctgacatatcagctgggacccttctttgtggcggggtggtcctgtggattgtagaatattcagcggcatccctag

SEQ ID NO: 197645 - DNA, 259 bp, Homo sapiens
cttaaaggaagtgattcccaataagaggagggccatcttgttaaacttccttcttgaacttttatctgcctccttttttcttgatcttcattgtaccttttacttaaaatcacatttgattggtgactctttttcagaactgatgtgtatcattggtaccaattgtgacaatagataccttgctccaagttggggcacaccctagtctctctttcccttaacgttaatttatttttctgttctccatagccttttccat

SEQ ID NO: 197646 - DNA, 389 bp, Homo sapiens
tagaagttaaagtgtgggttctgatttcagactgcctgggtttgttgggttactatgagaattaaatgaattcatacattgtaagtatttaaagtagtgtcttccatacagtgacactaattatatttaagttgttattcgtattattattattgttaatctagtacagtgctttgatacttcattcaaaatcattgccagatgtaacagaagatggctgaataaggaatcaggcaattctaccatagcgttttctcacagacactctagcaatttttaaaactaaatgggattatcccagtatactagtctaataagtctaccaaaaaccaagaaaccaaaaattgttcttatcaaactgtatgctgtctcttcttttaaaaacacag

SEQ ID NO: 197647 - DNA, 273 bp, Homo sapiens
ccctttctagttggctggatgtatttccatgtctgtggcctctgcttataagcttttgatttgcaaaagtgtcaagtctgaagatgaagcttagccatgtgaaataaggcacttaacaattcctcattgaaaaatcacagaaatgtttttttcaaagatacattttaccctcttatctatatttatttcctcagaaaacaaaaaagaaagaaataggctgagtgtggtggctcacgcctgtaatcccagcactttgggaggttgaagcgggca

SEQ ID NO: 197648 - DNA, 167 bp, Homo sapiens
caagtttagtttacatttgtttcctaaaattaatctgaggtgcctttctcaacttctctttatcatcatccatcttctcatgtcacacactcgaagtaactggtttaacacgttgttttgtctcaggaagccaaaaggacaactcaaaatttaattgaggcaccacg

SEQ ID NO: 197649 - DNA, 664 bp, Homo sapiens
ctggaggggctgcaggtgccttggagtctagacagcgggtgtcatccatggggtgaagtccctggagcgggaacttaaacatgaaggtggaatgtgaacagacaatgaagagagagggtatgccacgtggaggtgcaggttttgtgaggaaggaattttctttgctaggaaagtggtgggggtggataggctgagctgcaggtatggagaacagccaagacaaacctattactagaagaggggttgatgctggttgaggaagttccagaatgtctggggggaatttgatcttattcttcttggacttcagcgagctgatctgtaagggccttcccagggaacagggatggggtatttgacgactgtactaggctgaaggacagaactggctttcctgtggaccgggtgtcaagcacggcagtaggccaggggctttcaggctgccccattaaatcctacctcatccatacatgggacctgttcctttctgagtacctggacacccaggtcatgaacatgataggcctctctgataatagatgtgtcttaaaagagccttcaatgctaaagatcagactttgctggggagaaaatggagcacgtggaaggtgtaaggagtggtttggaaagaaaatgtggggcttcctgaggctcttcaaattga

SEQ ID NO: 197650 - DNA, 482 bp, Homo sapiens
tgcaacacaaattccttgggatcatagtggggattatatgaaaaaaaagattttcttgttcactaagtttggggagctctgggtttatcgactacagtatttctaagaaagaaatatcatttgcagtattctcctgaatggtttggtcacagagttccctctcaccccaacccctccgatttcaacatttttttaaaaagggatttcttagctgagggcagtggctcacttctcttatcctagcattttgagaggctgaggtaggaggatcgcttgaggccaggaattcgaggccagcctgggttacatagtgagaccctgtctgtacagaaaaaatgaaatgattagcccggcgtggtggcatgcacctatagtcccagctactctggaggctgaggagggaggattacttgagcccaggggtttgaggctgcagtgagctatgactgggtcactgcactctagcctgggtgaaagagcga

SEQ ID NO: 197651 - DNA, 351 bp, Homo sapiens
ggttcctacagcgtctgctagcagccacattctctctaggactcagatcaagttcttgaatctgaactgaaggtaaacgtgcaaggcatgagccctgttgtcctcctcaatccaggctcttttcgtcagcaccaatgcaaaaatctctcctccctccccttccagtcaatagcgctctgcccctctattgtcacacgtgctcagacatgtctgaacaccaagttaaactcagtctgcaaacacacacacacacacacacacgtacttctatgcctaaggtaaaaagaaagagccaaaggaaaggattgtagaatgttttgctcagaaagtcaagaggaaggcgatccatgc

SEQ ID NO: 197652 - DNA, 580 bp, Homo sapiens
tatcatgtagccagtgtgagttttagagactaacagcaaaaggaagttggttgggaagagggcaaggatagacgttggaagctattgtagtgataagttgagaaattgcgagggcctcaaagaaatggagaagggggcccgatttataagatattaataaggcaaatacccagaaggtataatggcagattaaatgtcgatacacttaggcatagctggaaatgtacagagagcaggtgaatatcccattgtcaggagagcaagctgatttgctggcagaggattgaaagtcagccacctgtgggaatagtggaagccttaggtgaggtaaggtccgctcccagagagtgctggggtaggggcccaggggaactagagagagccttggggagacactgaccttaaggggaagtggaagaatgattgatgctacagaatgtaaggaggggtccaagaagtagaaggagagaagcaacggagaatgagtgctcattcatatctaatgccatacagcagtgctgtccagtaggaataaaatacatgctgcatagataatggtaaactttccaggtgctgcttt

SEQ ID NO: 197653 - DNA, 151 bp, Homo sapiens
tctagaggatcctcggattggcgacatttcaagtttggcaaaaacaatgctacatattgcttaggaatagatatacacgtggcaaccacatgaaaaaaaaaggcatgggaatgacaaacacttttttttttttttttgagacagagtctca

SEQ ID NO: 197654 - DNA, 312 bp, Homo sapiens
tacttttccacgcgtcaaagtaacaggttcacaggattaaggcatggacgtttttaaggggccatttttctgcctaccacaaatgtatatctttaactgcatgtcattacaatgattttttcataaaagataaatgaggtccttataactacagagtcttctattcttccactcttcctctgccctctcccactttcttatatgttactgaaagtgagtttcttacatcaagtgtaaatccattgcacagttaattctaaggcctttagtgtccctaattcctcttctttcggaggttactatagaccgcgt

SEQ ID NO: 197655 - DNA, 432 bp, Homo sapiens
agcagcttccccggacctgggctatcgtgagctcacattcttcctccacccactgaagattgctccctgttggttttgctgggtaaacgcaaatcccattatcagccttctcctccccggctgctgctggagcccccggtacagagttacctgcttagcaagctcctgataagtccttggaggccccatctcgtgagactttggggcgaatcttccctccccttctcattttacacttgttgcaaggtgagggttagagataccggctggggtgttattctttcctattactggtttcccagataagataggcaaaccttcaggacttagaagcactcgatctcaaggctccgtggagaagagaagccacccagtgcccctttatctatatcccctgaccccaagtgtggtcagcatgggctattacaggat

SEQ ID NO: 197656 - DNA, 1949 bp, Homo sapiens
gtctcagagtaaatagcagcgcagggcgatctcaatgtaaattgcgcttgtcagaaacacacccccctccctcactttctctcctcctccccacaccatcccagtctgtaggtagctaagcgggggggggagaaagaaagcaaaagaggaggggggaggggctctccaaccaatggcgtgcaggaggcttggctaaccttagcctcccattttctctccccccgattcagggctctgaccagtcagtcgcctttgattatcagttgccagcagcccttcttttggctccttgacacgagctccatataaggcagcgatctccatagaaacgtgtcagtttcaatagtagtgtcaaagttcactatatacagacattcgcgcagatccccctttcggaaacattgctctgcgagtcctcccgtttaaacgcattcaatttttgggtctctctctctctctctctctctcttcttctcttctctctctctctctctctcctctctctctctcctctttctcccccctctctccctcctctcctctctctctcctctcttctctgaacctctcttctctttctcttttcttacatattctactagttgttttccccttcttcttctcctttctctcctttttctccctcctccttgtctcttttactccattcctgcagaagagagagggctaaacttaaagaaaaaaaaaaggaggaggaggaggaggaggcacccccttcgtattcttcttatcgttattttatacatatatgattttttttggagggagggtgttggttgccggctgaagagcacttatttaaaatactaaaaaaagaacatttttgggcgatctccagggtttttttaactagctctgtgtgttatagcagaagaagcagaagaaggagcaagaaagaggaaaagaagaggattatttattcgacctactttggatgtctctctcgcttttcctttttcctttttttggcaattattttcttctgatttttattttttctatttcgctgtgatttcgtcgccggcgtgaattatcccgtatttttctcccccttccgtcacctcccgaaagaagaaggcagcgagagcccggcgccaccggcacaacaaaaagagcaaagtgtgtgatcttcctcgccggctgcctcccgctctccagcgctgccttcctgaatggctggctgcgtccggccctggacctggccccccgacacccgcgcgccctgatcgccggcggcagcctcgcccagcgccctgctcggctcaccgcgctccccgcactcccgagcccggcgagggctcccgccgggacagcggcggcgccgcgggcggccccggcctccgctcgcgctccggctgcggccccgactcctgctcggactccggcccgggtcccggctcctccagcggcgctcgccgcagcagctccggcggcagctccagcggcgcctgcagccgcgacctcctcctcctccgccgccgccgccgcctccgccctcgccggcttcctctatgtcggctcagcccgcgcgctgcgcgtagcccgagcggccggcgggcgggcgcccggcgcgggtgagcgactgtgtgtgcgagtgtgtgtgtgcgcgggggtgcgggcgaggcggagggcgagtgtgtgcgcgcgccgtggcccatgcccgccgcccccggcgctgcgccccgcgccgctcccggctgccgcctgtgccatttctgattttgcaacttggggaagaagaaaaaagcgagagaagggagcttgctcgccggggggtggggaggggggaaggagagcgcggcccccccaggaacggagcgcggggggagcgggcgaggggagcaggggtgttggggggggagcctgagagcctgggggggctgcaaaaagagagaaagaaaacagcaggaaccacaacaaaacgccag

SEQ ID NO: 197657 - DNA, 174 bp, Homo sapiens
aaattttaatcatgctgaagaattataaaaggatagaatacacctactgaaacagaaatgaccactttaaaaatagaaattttcctgcttcaaaatatggaagatatattctaaaagcaatcatcatttaatacatatagtactattattaaatcagagaagggtgtacttttg

SEQ ID NO: 197658 - DNA, 533 bp, Homo sapiens
gggcctatggtgattccatgtgtgctaaatgtgttagtgacaggatcaagcatgctttccttatcaaggagcagaaaatcattgtgaaagtgttgaaagcacaagcagggagtcagaaagctaaataaaagatgaagcttttttgagtaataaaaattaaaagactttttaaaaaaattagaaggcaggaacccagatgggaagtgtcttcctaatgctcttggccttggagggtcctttctgtgtgttcaattgacaaaatctaaaaatgcgctagcttggcaaagagaaatgtttatagggtctagctctagtatcagaaaggaaagcagaggaagggtggatttggaactgatagacaataaattgataattggcacttaaagagtagtgtaggccaggcgcagtggctcacgcctgtcatccccgcttcccaagctcctactcgccaaattatctttaagaactctgatcctcaaatgctcagggagactaatttgtgtaataataaaactctggtctcccccaaaaaa

SEQ ID NO: 197659 - DNA, 405 bp, Homo sapiens
tggtacaataatatttgttgaactaacacaagaattatctctattttgaagatgcccacatttccagagcatccctttttacaattgctagagatttttcttaagggtggaaattatttcaagcaatgaatttaaatacagcttcaagattcacctttggatgctatctagtataatcaatccacctaaaatcaagccatccttcctcttgacttaaggtacagaatcacctccaaattcattcatttaaaacaaattccaataataattataattgtatgttgacaatgaatgacaatttaattaccaatagaagatttcataagcatagaccagggtttctcaaattggggtgataaccctggggatttgtgaatatattctaatggatccccaagttctaca

SEQ ID NO: 197660 - DNA, 581 bp, Homo sapiens
gcaatctctaagtatcctgagagctcccagatctgcacttctctgataggccaagctgggtctggctacagacgttcaggacacctggctagtgctggggtgaaggagggtcagtgctgctgctgcctcagggccctgttcttggggaaggggtcacagctggagccacagaccctctatgtcatggttgagccactctggagagaacatcttctggttttgggggtggagatgggggagtgtgtgtgatttcatctttcctaaaaatgggaaagaaatcacatgacaggaaaggatggtctaacttcaagggcttgcccaccaataccaggaagactctgactgcctcctactaagcccaccttcccctatctcagcattgctaagcacccctctgcattcatggactgatggcagatggggcaccgtagaatcactggtacctacatagctgtcactttgtcggcattcttatgccatttttttcttccaccccacccctcttatgcaatttttatccattcgtttattaatccactcgatacatgagaagtatccactgtctatttctcgatacatga

SEQ ID NO: 197661 - DNA, 423 bp, Homo sapiens
ctggttgaagaggaaagaacaagacagagcttttattttttttagatgggattccctttccttgttactttctccattttcattcatgggaaatggtatgcctcgtcgaagaaaatgctctaaatataagagaagaaagtagaataaaatgagtcactgggagatcagggatttctgtctgggaatatttatctttttaaggctgtcagagtgcatgtttctgcttgttgttagaatcctgatcattggtcacatggcttctgttttattaatagtgggctgtacttttctggaggatagattggcttctaatagctgcttaaatccatgtggaaactaagcaaagcagggaagaaggagcagcagtctgtagttacaggcttccgtgggtagcagagtgattgaatagaacagcgctgccat

SEQ ID NO: 197662 - DNA, 519 bp, Homo sapiens
gcaggctctctttgtctctatttcttatctgtctcctaaactgtatgtctctgtagcaccacatccagctgttaagtttcattaattgctggctgatgactccattttttaaaaataatgtgctggtgcataaattgcttcacactctgatccaattaaatttgggtgtcttggcagggccaggctttgagggtttctctgaccacagaaggactcatcttagagttatctcttcacctgctttgtctggtaatacagctggcttatagttttgcttgttgctctcatggagctaccagcctctccttaattgcttattaccaaaatctccatggtccttgagagttcctttaggattgaacttacccgcactttgttccaaataaattcaatttcttcgggggaagtttctgcatcttatgttattttgacttgcctcttcatctggcaaaatctctgaaccactgctctggagatgacagcaggcaaaatcacccacttctcttggaataccatgtt

SEQ ID NO: 197663 - DNA, 193 bp, Homo sapiens
gatgaaaaattctaatgtatatagagtcccagaaggagaggaaatgacagaagcaacacttgaatactgaattacagaccgacaattttccaggactgataaaagacatcaaattacaaatctgaaatctttacatacccaataatatatgtaagagagaaaaaaatcagcattattgtaatcaaagtacaga

SEQ ID NO: 197664 - DNA, 497 bp, Homo sapiens
tatattaaaatatccttaagttcagaaattatttactcagctctagcctactaataagcccaacaaaggtattcttcatctctgttaccgggtttttaatctctggcatttattttggttctctcttagagtttccacttttctgtttacattgcttacctattcttgcatgctgtctttttttaaaaaattttttttatctcttacagtccttagtctgttaatcatagttgttttaaattcccagtctgataattccaacatccctgtcacagctgagtctggttctgacgcttgctctgtctcttcatactgtgtgttttgctttttagtatgccttgtaattttttcttgatagctggacatgatgtcctgggtaaaaggaaccacaaaaaatagtaatgtggtggtaaggtgtgtgtgtgtggtaagcattctctagtcctttggttagatctcagtctctgagtgagcctgtgaccccagattgtgaactt

SEQ ID NO: 197665 - DNA, 824 bp, Homo sapiens
cagcctatcatgagggacacatttctaataattacttctttttctccaaactgtggagcatatacacagacatattagaattttagaaatcccatacaattttggaacatatattaatatcattcactaaaatataacctgaagataattaaatattattttttattttgacagtacttcccatgtaactaaacatgtcaaataatcctatttacctctcttttcaatgcttcaggggccctctgtagcactgcaaagttagagatcagaaaagtctattttaaagctgaaatttgattgtgggaagcctattaaatatgttaaagatttacaagaatttacattcccatgacttcttataatcttttaccaatcattcaactggtttgctcagagagagaggggccagaagtccgactggtaagaattcttaccctattgccggcatgtcaggtttctgggttcctgtcccttagcagcccttgcaactctgctcaactgtatgcaaacaaacacattgccatgaattaagaatattcacaaatagtttacaaattttggagaaattaggtagagagagaaatatgactcaaattctttttatgaaagtatactcaacacatgtaaagtatcaggaatcctaatttccaaaaatttagcttaaggttagaaagttgatgtgctccatcaatttctgcaggcctgacaaaagtagtctaggaattcaagataaatgaaacaaatagtgacttgctagatatgcataggaaacaaaatggctattaatagaactaaataaaagccttccactggaaactaaaaaa

SEQ ID NO: 197666 - DNA, 406 bp, Homo sapiens
gactaggcttaagtgccagcgaagtatccaaattcctgatcctttccccagctgttactttgttaacccctgccttcctgcagaacactgacttggccttttcctgctgagggtctgagacagccgtgctataattaatgaacgaatgtctccccagccagactgtaagctcaccaaggacctctccccaccctcactggtctcatttacacattataactgcacctgggacagagtagacattcaataaaatatgctagatggcctgagatggataaattacctctctatcctaaaactccacatatgcacagaatttcagggtgttcacagttcccttagtattcatgaatgctgggtaagaaccactgtccttaaaagaccttgggggttatctctgagggga

SEQ ID NO: 197667 - DNA, 323 bp, Homo sapiens
cttcccacctcccccacagtgagggcactggtatgttggagtgaagagccacgcaagacctctgtgaatgggcagagatgggccagtgacgcaacacagtaaagtgtattttggttataggcatcgtctctaaacttatgtaaacattattaaaaaatggaaggacaacgatgaaatgatggccaaaaatatagaaaaggataccttgcatgtcctgtgaaatgcaaaggaattctaaagtgtcattatgagttacctcatggaagaaagcaaaaggtgaatctatctagagtttgtggttctgactcactgtgggggatgtt

SEQ ID NO: 197668 - DNA, 113 bp, Homo sapiens
cttaagatgtcagaaaaatttaaaacagttctttcaaataaggtctattacaatgttgatgataaagttgtctggaaaggaacattactctaggaaaattaaaatactaaaaa

SEQ ID NO: 197669 - DNA, 504 bp, Homo sapiens
attgggtctcactatgtttcctagggtggtctcaaactcctgggctcaagccatccacctgccttggcctcccaagctgctagatttgtccatttctgatacagttgttaaaatctccaactgcgatagtagattaatctgtttctctttgtagttctgtcagtttttgtttgatgtattttgatgcttagctgtagatttttttgtagtgttccacactttgtcttttatcatttgtatttatttatttttattttttgtagatatgggggtctcactatgttgcctaggctggtctcgaacccctgaccttaagtgatcctcctgcctcagcctctcaaagtactgggattacaggcatgagccaaccatttcccagtcattttaattgagcattttatattaatcaatttttctctttctactttattacacttctctttttacattctttagtggttgccctatagttttcatttacatttataactaatccaagtctgc

SEQ ID NO: 197670 - DNA, 459 bp, Homo sapiens
cagagtctcactgtgttgcccaggctgaagtgcagtggcatgatttcggcttactgcaacctctgcctcctgggttcaagtgattttcatgcttcagcctcctgagtagctggaactataggtgcctgccaccatgcctggctaattttggtatttttagtagagacagggtttcactatattggccaggttggtcttgaactcctgacctcaagtgatctgcctacctctgcctcccaaaggttcccaagcaagttactcctttatctttttcagctcccccaactaactgtgagctcatggggcagttttttttttcttttaagggatgggacccaggctggggtgcagtgagtattcacaggtgtgatcatatgtgctgcagccttgaactcctgggctcaacgatcttcctccctcagcctcccagggcaacatagtgagacctcatctctatta

SEQ ID NO: 197671 - DNA, 446 bp, Homo sapiens
agcatttgcgggtggagtggttacttgagagcacaccattcgttacaaggggtctttatatgtaaagcagaaacatttttgttttgcttttcagttggagtgagcacgaggaattgattcttttttttctccaaagttaaaagagcaaacccagagactaccaaaatgttaggtttgtttatcatttccaagttgaaataaagcgtaatgtgaatactcagcactctatctttccctgattaaagtgatcctgccctttgaattgctacacaggatactgttctgtacagctcactcacacggctgtaataagtcacaacagtttggcacctcgcccaacaaaatacaaactctcctgaagtcttgagctttcccatggcaacatcacagtcaccaacacagcaaacaatcactccaatccctgctcccgctttccttttctaaca

SEQ ID NO: 197672 - DNA, 1250 bp, Homo sapiens
gtgaaagccaacatcctcttcatgggatataaaagactgcacaatctgactggtttttttttgttgttgttttgggggacacacaaatatgcataattttgagaaactctatgttaaacagttttttaaattctctttttgcatcaagtctgaaatgtgtgagtagtgatttctgttccattggtttttttgttgttgtttatttttctgtatattccattctgtttttactactatagctttgaaatatagttacatatgtaaggcatatgcagtgccaatataccttttcaggatttggctattttggattggctttttctttttatttggcaggacagatttgctgctggtattattctcacttgacagctattttcttcaggacttggacaatgtcacacagttagttcccttctggcctgcaaattttcttgagaaattcactcattacctcataagactatgcttataaataacatatcacttttatcttgcaactcacaatattctcttgtctgtgacttttaaaattgtgcttatatatgttcttgttgtaaatatctttgtgtgtattctagtttctttgttaacctttttaatttttacatcagtttttcttataatttttcagttccttttttatattttttacctccacaatatctgttttttgatatttttaatatttttgttatcccaatttttatgatttttaatagttgtctgtgtttctatttcattcatggagtattattcaatttatgttaactttttaaaattaattttttaatggttgctttctgaaaattttataatatctgatagagctatgttgccctaaaattttgtatgcattgtaatctttaattgaaatttgaacattaaaaacaagctacctgtcacagtgtctataatgtagctttgtcctggcaaagtctgaaaccatttgtcttagctagagatcctgagagtctttcaaacatgttcttaggatgtgtcttgtctgaaatgttctagttgttttttagttaaaagactttattcatgtttcttcttaatagtcatcacttgccacaactgttccctgtctgtagtacagtctctttcctgctgtaacatttacctttgatctcagcagactcaaaatgtcattccaaagtataccactgttaatttcagcactttatgtcattggagacagaaaccagtgtccgccaaagcacctaataaagccagaaataaagatg

SEQ ID NO: 197673 - DNA, 419 bp, Homo sapiens
aaatatttgttgaataaatggattaacatttttaaaaggtcaattatgcaagcaattcctttttgaaagtttgtaatttagaaagtttcaactatgttgaaatatgtgcgtgtgtgcaatagctttaaaaagcaataggcggggcgcagtggctcacgcctgtaatcccagcactttaggaggtggaggcgggtggatcacgaggtcaggagatcgagaccatcctggccaacacggtgaaaccccgtctctactaaaaatacaaaaaaattagccgggcgtggtggcaggcgcctgtagtcccagctgctcaggtggctgaggcaggagaatggcatgaacctgggaggcggagcttgcagtgagccgagatcgcaccactgcactccagcctgggcaacagagcgagactccatctc

SEQ ID NO: 197674 - DNA, 478 bp, Homo sapiens
aaatttaagggatatgtgttatatcataaaagaattgtatcacaaagcattaagacaatgcacagaaaactttgccaatagctgatagagcagaagggattgtataattaaataagaactaacacctattttgtaactggaaattgcattgtcagagtccctttccttttatcactagatgctaagaatctagccatgtaaaaactcccaaaacatccaaattcaaaaaaactggaatctaacgtggtaatgcagttgtcaagaacacgcaatagtctttgggcttttacaaagcactgaaaactaaatgttgcatttgtgcccttatcttccacaacttctttcttggcagcttttcttggctcacttcagacacacagaatttcaagtaatcagggaaagttgggacagaaacttcctctgtctttccatggccttttctttttcctttacggatctgtgatcctatgctttctct

SEQ ID NO: 197675 - DNA, 251 bp, Homo sapiens
gctttcatgtgaaggatagattgggaagaaagagcatggcatgacccgtgaggaagctattgcaatagttcaatcctgaggaaagtgaggatgggaactaagtagcaggtgtggagagagagaggaccatgtgggcaggagaggcagcgtgcaggtggaatcagcagtacttggagaaagagttcttgaaagttgtggaacacagagaggagtctggaaagattcctgggactgttgtggctggagggctt

SEQ ID NO: 197676 - DNA, 772 bp, Homo sapiens
ccaggctgatctcaaaactcttgatctcaagcagtcctcccacttcagccctccagagtgctgggattacaggcatgagccaccaccccagcttgggacatgacatttttgagagaacaatatgtgcaaagacagggaattataaaatgtcattatgtgtttggggtagaagcagaaggtagtggaagcgggaaatgacagtagatgaggattgaaagtttagatggaaataagtcatgaaagtacttgaatgccccattaaaataagtgttttggcaaaggagagctgtcaaagggtttttaatattttaacaacagctttgttacgatgtaattcatatatcataagatttacccctttaaagtgtgtacaattcagtgggggtttaagagtgtattcaggtcgggcgccatggcttatccctgtaatctcagcactttgagaggccgaggtgggtggatcacctgaggtcaggagtttgagaccagcctggccaacatggtgaaaccccgtctctactaagaacacaaaaaagtagctaggtatggtggcatgtggctgtaatcccacctacttgggaggcagagacaggagaatcacttgaatctgagaggtggaagttgcagtgagccgagattgtgccactgcactccagcctgggtgacagagtgaaactccatctcaaaaaaataaataaaataaaagtatattcatagttgtgcaaccatcaccacaatgtaattttagaacatttttatcatgtcaaaaaga

SEQ ID NO: 197677 - DNA, 552 bp, Homo sapiens
tactcactccccgcttcccaaccaccccacaacacacatacccagtgcatacacacagcctccctcaccatcagcatcccccatcagtgcagtacattttttgcaattaatgagccaaggttgacacattattatcaaccaaagtctagagtttacattagggttcactctttgtgttgtagattctatgttttgacaaatgtatagtgacatgtacccaccattctagtagcatatgggtagtttcattgcccgagcagtcatctgtgcttcacctattcatccttctatctccctgagcgcctggcaagcactgatctttttactgccttcatagttttgcctttttcagaatgtcatataattggaatcatatagcaggtaggcttttcagattggtgtctttcacttagtaatatgtacttaaatttctccatatcttttcatggcttgatagcttatttccttttagtactaaataatatttcattgtctggatgtatcacagttttttcatccatctactgaaggacagcttggttgcttccactt

SEQ ID NO: 197678 - DNA, 324 bp, Homo sapiens
cgcctgtgatcccacactttgggaggccgaggcgggtggatcttttgagctcaggagttcaagaaaatggtaggccacttcatcctggccttcaaagataaacactgtttacaatttggttcaccgcttccagagtttttctctatgcctgtatgtgttttatttatttacttaaaaatttttttaaacaaatgcaattctatgttgttactttctttttcaatttaatgtttcttggatacttttccatataagtacatatatatctttttattgaatacatagagtaaattgtatggatgtggcgggatttattttgtcctt

SEQ ID NO: 197679 - DNA, 139 bp, Homo sapiens
accttgggcaagtcacttaaggtctctaggcctcagattccccatctataaaatggggatagtgataacagtacctacctccattggtggttgggacgatgaatgagattgtgtcaagcactgagctgctgctggaaca

SEQ ID NO: 197680 - DNA, 373 bp, Homo sapiens
ttgtttgtcatatgtttgactatctgaaggggacagaatgctttggtgagaaactacggaacagaatcttagcaccaagagtttggagtaaaacaaagttacccagaattaggatttttaccattccttcagaaaatgcataaatgtctctggaagacttctgaagtcttttaaagccagaatcagcaaaggatgaagagaatataaaggggataatgtccttgaaattttctgcctcgtttcccatcaaattaaatctataataatacctcccattgaattttccttcctgaattgaaatttctcaaagtcaagtcccggtcttgcacatttaaggagtgattgtgtgtatgtgtgtgtgtatgtgtatgtg

SEQ ID NO: 197681 - DNA, 640 bp, Homo sapiens
ccacagaccagggtgcggggtggggatgattttgggatgaaactgtttcacttcagatcatcaggcattagattctcataaggagcacgcaacctagattcctcgcatgtgcagttcacaataggctttgcactcctgtgagaacctaatgctgccactgatatgacaggaggcggagctcaggcagtaatgctcgcttgcctgccgctcacctcctgctgtgtggcctggttcctaacaaggcacggactggtacagtctgcagcctgagggttggggacccttggcatagggaatagaatgctcaggagaaggtggtatcctgtactgctcttaggcatgacaccacctgtgagactgctgaaggcgttaatttctggccagctgaaggtagcattgccagaaggaggagctgggcagattgcaattggtgttgtggatagaggcaaaggatcataaatgatcgtcagaagggagctggtggattatggaatgtgaaatgggacagggcaacatttcatatctcaggctatgaatgacagagggacttggaacctgaacatgtttatatataatttattaagttcttaccatgtgccaggtactattctttgcatttttaatgctaagcttatttaat

SEQ ID NO: 197682 - DNA, 556 bp, Homo sapiens
tctctgatagccttggcaggaaagtgaagtcctgaggaagacattgtctagtttcagtcatgtgctctttcctgaacgagacatgttgttaggggtgggtagtactctggtcaggcttgggtttcttgtatgtctcaggaccagagactctccttaaaggaaaggatctgtgtgaaagtacctgtgtctgttacaaggatgtatagaactagaaggagagtcaacagttgagaggctagttaggaggtagttatgatagcttaggtgaggactgaagtgggtttgaattaggtcactgtgaagacagagtttaggaaaactttatgtaaaatgcatagaacttggtgactgactaaaagtgggagatgaagtaagggaaggctactgtgtgttgggctactttgtacatggtgatgccattactattaaccaacatgggaattcagaaaaagaacactttggggaagtggactgcagatgataagtagaattttgacatgagattgtccaaaaagagattaaaaggagctagaaaaaaaaaaggggggtgtgtgta

SEQ ID NO: 197683 - DNA, 894 bp, Homo sapiens
  misc_feature (100)..(100): n is a, c, g, or t
  misc_feature (886)..(886): n is a, c, g, or t
tccatgctaatttggtactaaaaaagattttgaggatttatacactcctgtgaatggatctatagtgattgtcagagcagggaaaatcacctttgcaganaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcgggtcttggtccaacaacttcaagggttctgccagcccactggtgtataccccttattgagaaaaccatggcaaaatggggaaaccttcccggtactggggccaatttctatatcagggccagnactgggcc

SEQ ID NO: 197684 - DNA, 829 bp, Homo sapiens
tcagaagcttgttcttaagtagttggaagccctccctaggggagtagatgttcagaagaggatatgcagactcaggtcacatgaaatgaataagccatttctttcacataggaaaacagaaatcaggtttgatttggtatattcaggaaaaactctagttctttcaaggcagcaactgacacaacttttggaaaaacaagagctgatttctgagcaatctaggccagccctggcaaggctgacctatgagaactccaactgagcactgtgagctgagagccttctgcagcccatgggcgccaggcagctgcttttcctacattgcttctcccacccaccctgagaggtggcttgccattagacttgcagtgcctaattaaggccttcaggagcagagatggaatgtactagactgtgagttcaggtttttctgactctagagcctgtgctggagagaactgtaacctaacaggctatatagtccagagggggacacgtggactctgacatcacaactttctgtgaaccatgccctctacagacgtgctctgctatgaatgaagcctttcttctctacccatgaattctacagcattgtgaacatacctctattataacatgactgaataatgtctcattttttacgtgaactgatttttttataagattatgaacttcttgaatggaagaaccatgtctcattgttccctataccttcactgcctagcccagtgcctgagagacagtccctcaagtctccattccttcctcatcctctgagaggttgcgatcacttcacccaaagattacagcctaattctggaacgga

SEQ ID NO: 197685 - DNA, 787 bp, Homo sapiens
acctgttgaagccaaccaggcactgtgctcccttctgttatgggaagtgcaagatgcagtaatttattcttctgaggaagtgtcttgtcattgcccagaccagtgaacttctaaaaatttactgacatggaaaagctcctgaattcttcctaagttttacctcccacccactggatcagatatgtcttaccaaggctttgaacatcctagcctcgtggagaagaagcctcttctcctggttctgttagcatgatgttatgaaaggaaattaaattttgggaccccaaactcattttgccaaagggaaaaatcaagctgagaactgggtcatgcaaacctgcctcccccttttggttcctaaataagatggctacaagaggaaaagctacatgcctcccccatattttgctcacaaggaaattcctagtgagcaatgcaaagtgatagcttatctttacaggtgcagtcacccaggcccaccacacgcaaatgcatatctaattgttcccctgccccattttgtctgtgttatgtagaatgcagattccctacgtttttcttctgccccgtttatgtcatcttatgtaaaaacatgcagattcatggagccagacaaaggcatgactatcttttcccacccacccccttacctgaaaattgtgtacttctcaatatcctgccctttcccctttaaatttgaagccctcaaaaatcatcttcagagaaagatgtctgtctcctgggtgcgtgtccttaactttggcaaataaatctaaaatgattgaga

SEQ ID NO: 197686 - DNA, 194 bp, Homo sapiens
aagtgtgctggcagtagtattgaactcaaggaatgaactcaagtatcctagggtctatattcattggttatatgttacatttttatttctttatggttctgttttccactctatttttgaacaaactctttttaaagacacatggtacttgttatacttgttctctgaataaaaatttaaaaatctgtaatgga

SEQ ID NO: 197687 - DNA, 817 bp, Homo sapiens
  misc_feature (30)..(30): n is a, c, g, or t
tagttttagactaccttgcccaggccaatnatagttacctttttctggggcatatgctgctaacacattttatactccgaaaaaagtacaacctgcactccagcctgggcaacaacagctagactccgtctcaaaaaaaaaaaaaaagccttctatctttgaatttacagagtaaaacagttgctgaacacggagcgatgaagatgagtgcctgtaacagtgttagctttttccagtattgatgattcccccgcccctcttttttttgtttgtttttttgtttttgttttttgctatccaccatttttctcttccccctccttcctagccttcgtgtttcattttaggactttggctcttataggggacttgaaccaaatgttacttaaaacctggaacaagttgaactggaaccatatttactcgactttgaatcaaatctaagtgcttaaaaatgtccttggcaaaccactttcatctgaaacagtatattttctgaaaagttttgagcctggacatctgattctctgactcttatgactgtggattataagttcacatgttgaccatctaatatgaggcaggcatggactaggtgccaggtataatacagaggtgaagaggacatggtacctgccctttagcgcccctcattggtgggggagggagcacacctggacatatcacagtacaaggtgtagcagatttctccactggggtgcaaagtagacaccactgaaatgtcactcagtagatgtcatttcagttgggttttgagataagcagaagttaagaacatgaaggaatattttcatgt

SEQ ID NO: 197688 - DNA, 493 bp, Homo sapiens
agcacattagagccccagcatgtctcttctgtactggttactggagatgaaagcaattagaaaattattctgtttaggagagtggacagcaccaacagcttcctcctcaccatgtgcctgcataggtaacaaataagcaatattctgccccttcctgaccactgggcaaagattaatgccatgcattgaaagttatttttaaatgtcctcaattagctataatatttttaacaaagcttgtaaggtttaggtaatgtgtagggtataagatggcagactcattactgtactttcacagagaaacaaaaaggaataaatccacaactgagaaagaataggaggatttaccaataaataaatgacagcaactttctggatgataggaagaagatggaacattgttaatggataaagtagttggggaaaaggaaaccctcagtctggaatgtgcaacgaggaccttggagaagttccatgttcataatcagcagtt

SEQ ID NO: 197689 - DNA, 526 bp, Homo sapiens
atatactataatgtttaagagtatgggctctggagtaacatctggttagaagttgaaggcaatccctctatacctcagtttgttcttttttataatagggttaaaattaaaattaggaacagggggttgtcaacaagtgggtaaagaaaatgtggtatatatacaccatggaataatactcagtcataaaaaggaatgaaataatgtcttttgcagcaactcgaatgcagctggaggcgattattctaagtgaagtaactcaggaatggaaaaccaaatatcctttgttctcacttataagtgggagctaagctatgaggatgcaaaggcataaaaatgatataatggacttcgaggactcaaggagggagaagggtgggagggggtaagggataaaagactacacattgggtatagtgtacactgcttgggtgatgggtgcaccaaaatctcagaaatcaccactgaagaacttatccatgtaaccgaaaagcacctgtactccaaaaactattgaaataaaaat

SEQ ID NO: 197690 - DNA, 557 bp, Homo sapiens
gtgattttagtactttgggtatatgtattaccattacttttaggagatacaaactgatttaggggcaaaatgatatgatgtttataacttaactctcaaatggtatcgcaaaaaaatgtattttatagaaaaagcaaaatatacattttcaaatctaggtggaaggtaaaaatgggtgttcattatagaatgcattctatgtttctgtgtctcagagcattttcataataaaattagtaaaaactttctaaatagacagcttttttctttttttgagacaaagtcttgctcttgtctcccatgctggagtgcaatggtgcaatctcagctcactgcaacctccacctcctggattcacgcgattctcttgcctcagctcttgcctcagcctcccgagtagctgagactacaggtgcctgccaccacacccagctaatttttgtatttttagtagagacggggtttctccatgttggccaggctggtctcaaactcctgacctcagatgatccacccatctcagcctcctaaagtgctgggattacaggcgtgagcca

SEQ ID NO: 197691 - DNA, 485 bp, Homo sapiens
tttttttttatttaaagatgggtaaaataaaagaaaatgttaagggggaaaatagaaattttttactggaattggtgaaatctaagactatcatatttattccaggaaaaacaaaccactaattggtggaatattttcagatctttgggcactttgcccctgaccaccatcctcaaggtcagaatcaggaagaaacagctcaaggttattggagaaagtaaagatgttttcaaagcagtatagtgaccacctctggcttccattcgtaaatttgtcttacattccatcagcctccttactctcctgggcttatcttctttggatcttttttccccagtgcctgcttctccgcgatcgaagtgtgcacacttcgatcgcggagaatttggcagtccgattgggggggggtcccttcagagacccacaggccggtggcttcggcgcggagtgcccaggttcccggtgcagcttgtggctcgtgtcca

SEQ ID NO: 197692 - DNA, 559 bp, Homo sapiens
tagcacagggtgcatggctggcactcagtaaacgttagctaaatgtatagatgagtgagtgagtggatgaatgtttttactttggatctttttttcaattaagcaagaagttttcagagtaattcgggtcctattagaattttaatagagtataggctcaaataactttcctcctttcaaggatataacctaatttgtgtctgacaagtagagaagattgtagatttcgtttccttttttgcctgttggaaaccgaacattttttcgtttgtttaattgtgtaccacaaaatgtggaagattgatgtctctggataacatttatttggcagaatatcttgacatcggatggcttttcctcaccaggctccaaaatgttaggaaacagagatatgctgcaactccaaaggtgaatctgtatggagaatgttgaaggcagtgttttctgagacaccctgcaaccctctgctgcgttacgcagtactgagccctccagagaggtgcatgtaatggatggatgtgctccctggagttaataaataactatcttcacctggtcc

SEQ ID NO: 197693 - DNA, 957 bp, Homo sapiens
gacaaagcgaaaggcaaggcagcatgagccgatcacccctcaatcccagccaactccgatcagtgggctcccaggatgccctggcccccttgcctccacctgctccccagaatccctccacccactcttgggaccctttgtgtggatctctgccttggggcctcagctgtcttctggctctgcagcatgtcttggtcatggcttctctgctctgtgtctcccacctgctcctgctttgcagtctctccccaggaggactctcttactccccttctcagctcctggcctccagcttcttttcatgtggtatgtctaccatcctgcaaacttggatgggcagcaggctgcctcttgtccaggctccatccttagagttccttatccctgctctggtgctgaccagccagaagctaccccgggccatccagacacctggaaactcctccctcatgctgcacctttgtaggggacctagctgccatggcctggggcactggaacacttctctccaggaggtgtccggggcagtggtagtatctgggctgctgcagggcatgatggggctgctggggagtcccggccacgtgttcccccactgtgggcccctggtgctggctcccagcctggttgtggcagggctctctgcccacagggaggtagcccagttctgcttcacacactgggggttggccttgctcacctgggctcctgccagtttcatgtgtgcccctggaggcgagcttcaacgtcatcaactcacactcctctccctgtcttccggctccttttcggcaactgtctgccccaaccaaggccaccatggattcgggctgcttcaccccatgctggaccccagcagtggctcccttagtggggtactctgagttgggcttggaatctccccaggtgctcgatcttcaccacatccattccgttgagagggtgccgggttaccag

SEQ ID NO: 197694 - DNA, 649 bp, Homo sapiens
ctgagatgctcctggaaaggagttttgggaggaacccatacttagaattaggaagaccaggctgaggccagtttgattgagcagaatgttttctctccatcctctcctctcttctaccaggtgtccggggcagtggtagtatctgggctgctgcagggcatgatggggctgctggggagtcccggccacgtgttcccccactgtgggcccctggtgctggctcccagcctggttgtggcagggctctctgcccacagggaggtagcccagttctgcttcacacactgggggttggccttgctgtacgtgagtcctgagaggcgtgggatggtgcccagtgggggtgtatggggggactaggggagggcagaactgctggtcctatcagattcagcagcgactggaatagggacatattttatatttggaatccaagacttttccttgattcatctggtctccttgaatttcacactgttttctgctgtcccccaaggtcacttcctattccttccatgggagtttccttctctggtatcaccccccgctcttatgatattctgcccactcccacctcctttcccatcctacgctcctcacggtctctgcttctgccctccgcctctcaggttatcctggctccgccgcc

SEQ ID NO: 197695 - DNA, 394 bp, Homo sapiens
ctgagatgctcctggaaaggagttttgggaggaacccatacttagaattaggaagaccaggctgaggccagtttgattgagcagaatgttttctctccatcctctcctctcttctaccaggtgtccggggcagtggtagtatctgggctgctgcagggcatgatggggctgctggggagtcccggccacgtgttcccccactgtgggcccctggtgctggctcccagcctggttgtggcagggctctctgcccacagggaggtagcccagttctgcttcacacactgggggttggccttgctgtacgtgagtcctgagaggcgtgggatggtgcccagtgggggtgtatgctcggtcctcgcccctctctctacccctcacctctccttccccg

SEQ ID NO: 197696 - DNA, 988 bp, Homo sapiens
gacaaagcgaaaggcaaggcagcatgagccgatcacccctcaatcccagccaactccgatcagtgggctcccaggatgccctggcccccttgcctccacctgctccccagaatccctccacccactcttgggaccctttgtgtggatctctgccttggggcctcagctgtcttctggctctgcagcatgtcttggtcatggcttctctgctctgtgtctcccacctgctcctgctttgcagtctctccccaggaggactctcttactccccttctcagctcctggcctccagcttcttttcatgtggtatgtctaccatcctgcaaacttggatgggcagcaggctgcctcttgtccaggctccatccttagagttccttatccctgctctggtgctgaccagccagaagctaccccgggccatccagacacctggaaactcctccctcatgctgcacctttgtaggggacctagctgccatggcctggggcactggaacacttctctccaggaggtgtccggggcagtggtagtatctgggctgctgcagggcatgatggggctgctggggagtcccggccacgtgttcccccactgtgggcccctggtgctggctcccagcctggttgtggcagggctctctgcccacagggaggtagcccagttctgcttcacacactgggggttggccttgctggttatcctgctcatggtggtctgttctcagcacctgggctcctgccagtttcatgtgtgcccctggaggcgagcttcaacgtcatcaactcacactcctctccctgtcttccggctccttttcggcaactgtctgccccaaccaaggccaccatggattcgggctgcttcaccccatgctggaccccagcagtggctcccttagtggggtactctgagttgggcttggaatctccccaggtgctcgatcttcaccacatccattccgttgagagggtgccgggttaccag

SEQ ID NO: 197697 - DNA, 447 bp, Homo sapiens
ggttatcctgctcatggtggtctgttctcagcacctgggctcctgccagtttcatgtgtgcccctggaggcgagcttcaacgtcatcaactcacactcctctccctgtcttccggctcctttcggtatgtgtgggtctgggcagggcagtagaggtcagaagggctggccctggagtgctcactccatcccctaccttttggcttctgtctacccctgcaaggctggctcagaaggttctgggggaggagttcttttctcagtctcgcccctcaggtgctgatcccagtggcctgtgtgtggattgtttctgcctttgtgggattcagtgttatcccccaggaactgtctgcccccaccaaggcaccatggatttggctgcctcacccaggtaggttttctcctagtcctccattctcttgttcaaataaaggtatctatttgaact

SEQ ID NO: 197698 - DNA, 670 bp, Homo sapiens
tttgagatggagtttcgctcgttgctccagctggagtgcaatggcacgatctcggctcactgcaacctctgcatcccaggttcaagtgattctcctgccttagactcccaagtagctgggactataggcgcccaccaccactcctggctaattttgtaaaaaacaaagctgaaaacagtagcaagctctgcaaacagtaacagccttcaaacactgcctgatcaacaggctctacccacagtagcaggatgtacaaacagctgaaggctctgcaaacatgcacaggctgccatgaagagcggcagatgatacaaagacactctagcctacccaatcacttcaagagaatgtcttcagtaggtaattgtaacaataacaacaaaaagcagaacttgggctccatgccttcaacaggcaacagaatctggtagatttcaataattttattttgctttttacagtattttttttttagaattaccttcatttcatgatactggttttccagttagaggagtgatataaaatttcctttaaaaataaatgcatgttgctgggtgcagtggctcacccctgtaataccagcactttgggaggccaaggcaggcggatcacctgaggtcgggagttcgagaccagcctgaccaacacggtgaaaccccgtctctac

SEQ ID NO: 197699 - DNA, 468 bp, Homo sapiens
gctgtgtgttactgtggttgtgtgtcattgtggttgtgtttgtcagggtgatgttgtgtgtccatggaactgtgtgtctaatagattgcgtgtatgcaatattgtctctcactgtgcttgaatgtgtcactgttgcgattgtatcactgtgatctagtgagtgtgttgggaccaattggttgtgggatgagtgtcactgtattgattgtatgtcactgatactgtgtgtgtcagggtgatgttgtgtgttcaagggactgtgcatacctcatggagattgcatgtgcctgggcagcactgtgtgtgcctgtggttgtgggtctggggagtgctatgtgtcctgggactgtctgtgtcactaagttgtttttttgttttgttttgttttgttttttgagacggagttttgctcttgttgtccaggctggagtgcagtggcagcgaccttggctcattgcaacctccacc

SEQ ID NO: 197700 - DNA, 390 bp, Homo sapiens
cagttcaagtgcaaaaagtcattaacaacagaagtaaaacttctccaaagtgttccatctttagtggagatgacagcatgtgaaaaagcctccatacgaaaatcaacacatccaattcacaccagatacagaacaggggagaagaacaagtttagcattctgcaccttgatgatccaactggaattttcaatctgtgaacgatgagaaacagtagaacgtggtttatcagttagtgtgtaatctgttctggttccttttcaataaagaacctaagtggctataccagtgataagagattatcaaccaggtcagcagcttcttaaactcaagaagaggccaggggaaaggctgtgagacttggatgaaaaatattttctatttttccctta

SEQ ID NO: 197701 - DNA, 434 bp, Homo sapiens
aggcaaaagtggttaaagagaaagaatgaagttgaaacctgaacaataagcacaggtgagcaaaggggaaagttaggcctgccctgggaatgaaaaccaagactacaacttggtgaatacaatgaataaaatgtttacaataaacctgtgacaaaagcaaattaaagttattcaggttagaaatgatccctggctatttacagaagcaaattcaaatctgtgccagaggacagttacaatttaggtcctcaagattctcacaaattaagttcaattaagtaagaacactcaatcctaaccaccaaacacacaaagaaacaagggattgtttggtgaaatgatcagaaaaagtaatacatataggcctccaagaccccagatatttagtaacaatatatgaaatatttaaggaaatagaacatgaaatttttaaa

SEQ ID NO: 197702 - DNA, 591 bp, Homo sapiens
agaacagcagaaaagctagtggcagtggcttggaacacacctttcctcaacacgaagccaagggtcaaatgaaagaaaaaatgtgaatacatttatatgtctggccagtgattaaaaaaatgttgctctttttaatatctcatcaacatcaatgattacattcttttctggtgcaaatgtagtaagtggttaatttgaaagtataaaaatgtgtaaggaagaaaaataaccaagagtgataccatttaaacgatattacttagcgctggtatatttctttctattttcttttccattaagatatttaccaagcacatttgaatgtataattttatattttgccatttatccttaacattataacagaggcacacaaggcgttttgcatcttgttttttttccatttattgtgatatctttgacatcttgtcacattggcatatgtagacttacctcattctttttaatagctgtatggtatgaacataacacagtttttttaatgaacacaatgttatttcatagtcttctttaccattgagatatttaccaagcatatttaaatatttaattttatatttttccatttat

SEQ ID NO: 197703 - DNA, 159 bp, Homo sapiens
tctgtctagtctcaccaggccaaaatcaaggtcaaagccatgggatcgactcttgagactgtgggggcagaattctcttctaagctcattcagattgttgtcagaattcatttctttctcctggtccccatattttcaaaatacagcatgtgaaattac

SEQ ID NO: 197704 - DNA, 448 bp, Homo sapiens
aaaaaaaaaaaaaaatctctgggctgtggcctgcctcagcctcccttcttccagagggaggcaaggaagatcagctagctggttctggaagaaaccgcgcacttcatatcggctcagactcagctgctggttttcctacaatgctgcttctttacaaagctgcttaattttccaaggggctgaaattgcaaagctagtttccatattgacttacgaaatgaaaggagaacttgggagaaaaggtgaaggaggtaacttaataataaccgtcaggtgcatgagaggtaattttatgcaggcaggaggccaaaattttttccatttatattgggaataggataaaaggaaacaggcacacacttctgcaggaggaatttaaataagacaggctctgcttatagggctgatagcagggctggccttgggcaaccctaggaatgaaatgaag

SEQ ID NO: 197705 - DNA, 122 bp, Homo sapiens
agttttaaactcctaacatcaaccaatctgtagattcttactaagagaagcatttggtactaaaagccatattatctctgttctctcacttacttctaagccaattaagcaaaagaggagtt

SEQ ID NO: 197706 - DNA, 146 bp, Homo sapiens
gtagatataggtacttagactgtgatgcaaatcatcttccttaccttgagtcatggtcaaaaaagtatgaaaaccactaaactaaactaacttttttccttcttttgacagtgtaagaaatatcaggtcaggagaagtttagtaat

SEQ ID NO: 197707 - DNA, 488 bp, Homo sapiens
cacccagtcctcttttgtctttttaaatctcaaatagtaactcagtctttccctgagtttcataactttgatacttctgaatattacaggtcagttattttgtagaatgacctcctatttggatttgcctgatgtttcgtcatgattaaaagcagttatgtttttagcaggagtatcacatacgtgattctgtgttttttgtttgcatcctatcaggtggtacatgatttcagtttttccttgaccacttggttaaggtgtgtcctttaggtttctccactgtgaggttaatctttttttctctttatagtcagtatggattttgtgggggaagtacttcgcctataaacatcttgttccttgcgccttttcctcactaattttagcattcattgatgtttcttggcctaatttatgaccaggattgatggcaagtagtgattttctaatttcaccttttctttcacattcatcagttgacgttccgc

SEQ ID NO: 197708 - DNA, 356 bp, Homo sapiens
tttatgaagctgccccttttgtgcagagtagtctggcattctataagaaagatacaagccagaaaacaataccatttcaattaaagctggtgtctatgaatggcagtctgcatactaccttcaaagggaacaccacaagaggtgagaaaagataacatgagtcactgggattgacgagactgacacggaagactgaacaaatacaatggatttagttaatgctaaagtagtttgctttcaagctttcctcttttagttcaatctgcgtcactttgactttccttaaagttgtgtgggagaaaaggaggaataaaatgttgccaaaaaaaaaaaaaaaacccccccaaaaaaaaacc

SEQ ID NO: 197709 - DNA, 212 bp, Homo sapiens
cagtggtattacagttgtgagccaccatgcttgggccagtattcttgatgaaacaatttaccaaatgataaaggcttgattctgtgtttctctggttagtcttgcaagagggaatacgcaaggcaaggtaggctaaaactgagtttgtggctgatttacaatttacacttatttcctcaaggttcttaccatattgccttctgaggagttcc

SEQ ID NO: 197710 - DNA, 639 bp, Homo sapiens
accgtttcttctgtgcccacaaggtggtcagcgccctgctcaatgagcacaatgagggacctcaaaagtcctgggcagctgatgcttctgatctctgctctctgggcctcagttccctggcagagagtcccatggaattaatcaccattccctgagcctgtttggcaggcactggactggtctctgaggtgagaggtgagttggccacagcctggaaagccaggaaactctggagctccaagaagccacctgagtgagccaaggactgggacagaggaaggggacgtgaaggggagcctgactcccacacttgcttcctcctgggtaaatcatcacacctcgcctggcttcagttcctcattttaaaaaggggctgatacaacctacctcgtaagattctagtaaaggttgagttaggtaatataaaatagcagagtacctgggacatagggacacaataaagtgacaccaatcagtgaaagctactatcataggtttaacttactactacagagtgatcatgttaggaccaaaaaaagcagaaggatgtgggagacgccaccccgcccctgccggcaaagacgatcagtggcacatgttggagaatggagggaggaatatagataactgtgttctaga

SEQ ID NO: 197711 - DNA, 384 bp, Homo sapiens
aaaatgagaatcttggtacatggagtggtgaattaagaatggaaacagagcagaaagacccaggagatcagaataggccaacaaggaaacagtatgtgtgcatggtaaggagttaatttggtttgagaagacatcagattcagtactaagaaaaagaggataggaaatatgggatgagaagataagggcttcttcttctaatgatcacaataatgaataatactgatcaggtgagaatgcaacattattgttgctttttgttatagctgaaagaagtgtgatatattaaatcaggagataagaaatatagggagatggagagtgtaattgagaatgattgcaggagaattctatctctttggaagaagaaaaataatgaagttt

SEQ ID NO: 197712 - DNA, 510 bp, Homo sapiens
aacatggcaatttaaaaatgctaagaattttaaaacaaaacttccaggaaaaatgtatcctgcaagttgctgaacttgtgccagaaagtggttaaacaattataaagcacagaacaataacaaaaaagtaaaacttctaaaacaataagcaaatttttaaaactcattaacttgtttttctttctgatgatatgcagacttaaaaatactgagacttttaagtaaaaatctgttagcataatgtaactttaaaaactgtaaaatctgtgtctgggttaggaacaaagtgaaaaaatgctaaaacaatagtaaaaacaaattcttaaaactggcattactttttcccaatgaaagtcctaaaagtaattatgcattatgtagtcttatgaaaagaggctatagatggaatatataaggcattagattcagttaaataaaattaggttaagataagttcagttgttagattatatggtaagatcaaatcagtaataaaagcgtgaataatct

SEQ ID NO: 197713 - DNA, 921 bp, Homo sapiens
ccaagaaggtgaaagatctccacaaggagagctacaaaacattgctaaaagaaatcagagatgacacaaccaaatggaaaaggatttcatgctcatagattggaagaattaatatcattaaaatggccatactgcccaaagcaatctacagattcagtgctattcatatcaaattatgatattcaatgctattcacatcaagtgctattcatatcaaaatgtcatttttcaccaaattagaaaaaaattctaaaattcattagaaccaaaaaagagtatgaacagccaagccaatcctaagcaaaaagaacaaagccaaaggtatcacattacctgacttcaaactatactacaaggctacagcaaccaaaacagcatggtactagtacaaaaatagacatgtagaccactggaagagaatagagaacttagagatacagctgcacacctccaaccaactgatctataggagactgatctataggagtggtgcaccactcctatagatcagtatttttttttcttttttgagacggagtcttgctctgttgcccaagctggactgcagtggtgcgatctcagctcaccacaacctccacctcccgggttcaagcaactctctgccttagcctccccagtaactgggatcacaggtgctcaccaccatgcccggctaattttcatatttttagtagagacagggtttcgccatgatggcgaggctgatcttgaattcctgaccttaggtgatccacctgaccttggcctaccagagttctggaattacaggcgtgaactactgcgcctggcctcaaattgttttttcctgatctctgttcttaataatgttgtgtctgagcacactgtgccccgccttttgtatggtcttgtgtgacggtcttagggaaaaccagctatttg

SEQ ID NO: 197714 - DNA, 251 bp, Homo sapiens
aaacttcattgatattgagggatttcaatccagttttgataatatagcagccaaatctatccacatcactaaagccaatcagccagactgtcattcttactctgatgctatttagaatgtgcaatgagccaccggattccacttcctaaaaactaatttccctagagcttctgctctcttattttatcaatgcccctgaggtcagaaactatgattttgtctctcctgaacagcacaatgtctcattaaaa

SEQ ID NO: 197715 - DNA, 231 bp, Homo sapiens
aaaacgtgaaggtggaaggaaaaacagaacagaccctaagaagaaagttcacaaacctagagaggagagagatgctagaggtggctatcaggaatatgagaaaatgagaggtaggggagggagaagcaggcagtgataacaaaaaaaaaaggatttttcaggttttgctggatgttaagaatgttcccctttacattttcttgagagactacaggaaagttttaatttgct

SEQ ID NO: 197716 - DNA, 445 bp, Homo sapiens
aagaagaacaacgttttcataataccaactttcaacttgctagaaagtgacagagtttatcatcggcaaaagaaaagtaatatggatcaaccgaatagaaatgagagtgcagaaacaggcccccacatatatggccaattgatttataaaaaattgacaaggcaactcaaatgaggaaaggaaaagttttcaacaaatggtgctggaaaaactggtgatctgcacataacttaaaaaaaactctcatttggaggatcagaaaatcaaaaaaggacattgattctaactatgtcctatataaatctaattcaaactggatcactaaaactagactgaaaaaaacataggatgtcaggtatggtggctcacatttataatcctacgagttcaagaccagcctgggcaatagagtgagacctcatctctgcaaaaaatttttaaaaat

SEQ ID NO: 197717 - DNA, 511 bp, Homo sapiens
tcaaggtcacacagctagtaggtggtagaaggtggtaaactccttggatgctattatgacataatagctgaaagaatgaagatttggtgtcagactagattttaatcacctatttgcaaggcgatgcagggaaacgtgacttaacaactctgaatctcaatttctttgtttataaaatggagataatatttcctacttggatgggttattgcaaggcttaaaagggagaaaacatatcaaatagccaacatcttgcccattacataaaaggggcttaaatgaaaacaaattcctttcgttatcattgacccatccttatgctacaggcatatgagtcaggaaaaatggaaggcacaattccttcacttaagcatctcagcatgctttttttttttttttttttttttaagacaagtttccctctgttgcccaggttggagtgcagtggtacaacctcggctcactgcaacctccaccacctgcgttcaagtgattctcctgcctcagcctc

SEQ ID NO: 197718 - DNA, 274 bp, Homo sapiens
gctttgtagtactttttttctttctttttttcttgttgccttcctttgtgatttgatcacttttgaaatgatatactttgattcctttctcttaatcttatctactacaggtttctacttagtggttactatgaggcttacataaaatattttatagctataccatcctattttaagccaacaacttcaaacacatacaaaactctacacttttacttctcccctccctcacatttcagtcaattgatgttacaatttacatactttttatatt

SEQ ID NO: 197719 - DNA, 488 bp, Homo sapiens
tgcatgggtactcaaagtatggttgctactgaatgcgtattgcttttgcatcgtcatgaagttgagaaagtctacgttggaatctacagcttgtgtaaaccagcttgtgcagcttgttgctgttctttgaacaataagatattagcaaaacttatcttgaaaacaagataaaccatcacaaattgggtattgtgtgtataaaattttacatttgtacatttaaaaaatatccggtgtttggctttttaaaaaaataaatggtacctaaatagttcttaatttccccttatgggtagtctcctagctgttaaatgtacatttatttactcattcatttttttatttgacagctatttgttttgaatttacttttggcacagcactgggctttgtaatgaatactgtacaacagatcaaaatcttatagaagattttaataaagattttataaagattttaataaagattaagtctttaagatttaaaaa

SEQ ID NO: 197720 - DNA, 453 bp, Homo sapiens
aaaagccagacagtcagtatttcaggctttggcccacgcagcccctattgcaaatactcagctctgccattgcagccaaaagcagctgtaaacaatacataaacaaatgggtgtaactatgttccaacagaacaaagccagtacccacagactgccaacccctgctccagaacactgaaaaccaacacgtgaagtctcctttcttgcttttcccagacaacttaaactatactcagacttagtcactaatctctggaagtttctgtgtatatggaatacaatatcctgcttcctcactcattccctcagagaatggattcttttacttataaaaccctaaatgatgttggatatgatggttttttgtctatctgtttacatttgtttcaaaatatttcagacatagcttcttggccttttggcttaagatcaagtgtagtaaaatatttcaga

SEQ ID NO: 197721 - DNA, 357 bp, Homo sapiens
gcaggtatacactgtccagtctgccacggcgcctgccactctctgctgtcctcacactgcagcagcacatccattgccgtaaatcttaagtgtggcccctgtggacaattgagtttgcaatctgtgttgtgtgatttttaaattgcagggaggaagatcatccaggctgtctgtggaaagttgagcaaatcaagtgtgaacgcagaccaataatttctgacagtcaaaccataaatatgaagagggaccacagagaagctggattagcagacttgtatactctgattttgtcaagcactggaagaccaatttagggtgaccatatcatttgtcatccaagctgatgggacgaatttg

SEQ ID NO: 197722 - DNA, 591 bp, Homo sapiens
atgtaactccttacattttctccagcatctttcttcattcagctgtatcatttagggatataaacatctcttgtggatgatatgtacactctgatattcagcactattcaaccatcttccatcttcctcacttgtacttaatctctttccaccctccattcagtctggacatcctgggatccctgctctgacccattttaagtccgtcgcattaatctttctctaacctcccattctgttgactccaccaattgcttcaaatccttttccaacaaagctttctgggcagcaccaaatactccagttcttatttgctatattcaactccatatttcatactcaaatttctcagtctagaaattgttcttttctttctttctctctctctcatgtcttcgtatccctctccaccatatcaaccccatcagcatacaatcattactgttatttatcccatttgatttaggcaaataaaaagaaaaaggggtccttaaaaggttttttgcagttccaagtaatttcttgtctagcataaaatccctggctcttaaacccaaactgacagtctttaatatgcaaatccaagccaag

SEQ ID NO: 197723 - DNA, 162 bp, Homo sapiens
cagagtcgagtgttagagtgcaggatccacagcggggagaggctgggcggagttgggggtagaattgataaaattttcttaaaatcaagtagcacaataaatgcctgaaaatagccaagaaagctatagaaaagaaagagtaatgaagaggttcttgcctta

SEQ ID NO: 197724 - DNA, 163 bp, Homo sapiens
ctctctcttctttgtttttccttttacctccttattgaggtattattgacatttacaatgcggtaagtttcaaacgatgtatgcaaaagatagttaatatgtccttcaccaccctctgtctcctcttgcccatttatcacccctctctgccacccttctctgc

SEQ ID NO: 197725 - DNA, 415 bp, Homo sapiens
ctagggctgctgaaggccaaattgaagtggtttctgagaccagaacttaagactcgtatgtggcatggtcttgcaaatgggaaacctagaagctggaggcttgaaaacaaaaaataaattaattgattaatttaaaaaaatcaaatggacaaacaagtaatgcctgggtttgtgagctgagggacctggggtctagcgaggtataaagtacaaatgttgtttcctggtgatccctcaccctcagcagccaggactctcaagcaggcttggttcacccagctctgctgcttgacaagctcattcctacctccgtgatgcatttcttctccccacattaaccataaggtccacaaacataagaatcacgactttcaattgcttttggcagcactcaggatgatactgtatgttatat

SEQ ID NO: 197726 - DNA, 436 bp, Homo sapiens
tttccccacaggatcctctagctagaatatccaagggtcatggagagaaatacccagttaaaatatcagacatgaaaaagcgataccattagagacactaaaaagaccattaggtaatagtactagcttttgtattctgagatccaacagcagcagtcacttccctccaccgctatgtgtatcccaggaccaccctgggcagggagggctgaggttagggagcagccatggatgctctgatgctggccctgggcctcgggggtgacagtgatgaggaactgggtgcacacatgagtggggcagccgggcctggccagagaagcagcacacacgtgcacagatgtgtttacccacatacacatgtgcacgcacgtgcacaaacacattgcaggcaggcatgttgacgcctcaggcagcggaggaccctgactctggg

SEQ ID NO: 197727 - DNA, 223 bp, Homo sapiens
atgactctccatatgaacatatatgtgaaagtttatatatgtttatatatgtgctgcattctatttgattagtctactttttcacattgatactcatgccaatttgttttaactctgtagctttgtaatgtgttttgaaatcaagaactgtaattcctccaacattgttccttttttaaagatcgttgggtactttgttgtctgtctcttgatatttcttata

SEQ ID NO: 197728 - DNA, 552 bp, Homo sapiens
tattagtgaagtttaacatttctatattggtcattcatatttctttgtgaattatctgttcatgtcctatgtcccatttacatgttcattttcttaatactgattcatataggcattgtttatacactaagaagatgcttaaccctctgttatgatgtgattattttcttcattttgttttttgtattttgcattaattttttgtaagtttcttacctccaatattcactcattttctgttctcttaggatgaaagacacattcacatttcaggtagagactacacttcattttatttcctttggattctgttttcatgattataaatcactgataacaatgatttacatcatacttccctctgctgctgctcctcttcattccagttaccacccctcgtgtattagtacctctgtgatttaggttctcctcaagagctgattatgttggtgcaactcatgccattgctttggaactgtttccctatctgtagaagggggaagatgggactaatatccagaatatacaaggagctcaaaggactcaacagta

SEQ ID NO: 197729 - DNA, 360 bp, Homo sapiens
tgcaaaccttctcatctactctcccccaaaccccactactcacaattttccttaaccccacccagaacagagagtttaaataaaggcccacacagctcctggcaagacctccattacccgcatccccagccacataaactcaatactgcccatttatcctctacaatggcctaacatgcaaagatatagtataacctattgttccccttccactcagatagcatcaagacaaattccatcaagcctcacatccctctgtcaccatgagaaagacaggtttccttattgtagacctttaattctggaaggctttgcacatcgatttgttaattttccaaaagttccccacccccttcactg

SEQ ID NO: 197730 - DNA, 384 bp, Homo sapiens
tgtcaaaggaggtggtcggactagatgatttctaagacctcttccagttctgatttcagctgtagaaaaagcatagtgggatcactgtatagggagagattcttccaatatccataaatttatatctttaaaaaattcaataaattatttgcagcatatttttcaaattgtacataacaagcatgtgttctttttataaaggaaaaagtaaacattttaaaattgaaaaaatttatactccaaatgcagccatatgcttcaactaaatgtgagaccacccaccccttcctacccaaagaaaggtgttttctttgtctcatgcaggacttacatttgaaaaagagtttctaatctggcaatacacatactttaaaaatcatcatt

SEQ ID NO: 197731 - DNA, 413 bp, Homo sapiens
cagttttgcctctaactagctgtgtgatcttgactaagtccttcatccctctgggtctcagtttccccatgtgtaaaatgagatgggtggacagataatttctaaggcccttttcagctccaatattcaaggtctgaacctctggctttcaggaagcgttttcctccatagagaactgttattctagtccactagatggcactctaacaccacatttcaaatatactatgaattaatgttttttaactctgccacattattcctaaattaccatcataagacaaccctcctcatctcttaccaagtggcttcttgaagaaccatgattcggccttcattagagctatttccatagtgaagctgattatcgtgaactctcttgtgttaaataaatgcaaactctgaataaatac

SEQ ID NO: 197732 - DNA, 197 bp, Homo sapiens
agcctttgaggaccagaagtcttgaggcgataggttctactcgtgaatcctttgaatgcaaggaacagaaatcctagaaactgggaactagaaaaatcagcagctggagctagtctggagatcctaagtgtcatatgatctgtctgacatctgcatctgacagagtgctctgatcttctgtgccggctggctcttta

SEQ ID NO: 197733 - DNA, 359 bp, Homo sapiens
actgtatgtcccttgaaaatttttaatattctgtagtattccacattttgcaaaccttttatctaggaacttaaaacttctaaaagacttccatcaatatcgtatctctaataaataccaggccctaggaatccaacatccaaaattcaaaggaaaagaaaaaacaaaagcactgatcatgagaatgaaatactcgaaaacattctgaggatcaagcatcactgagttttaatacttctgaatttcaggaagggacagttcaacacagacaactttacctgaatcgtgtgtggaagaaacctgaccacagtgaaagagaataactaaactcttctaacctaatgtgattcttaaagcag

SEQ ID NO: 197734 - DNA, 802 bp, Homo sapiens
accggcttagaggaccgggaatgggtaattggaggctggagccgctccactgtggttcgcctcgctgcaactggtggtgaccgcgaccgagatggcagtgcggcgggagcggcaccaaccccttcctcaggtcggtgcaccactgcgtgacctccaggcagccacagcctggaaaagcactcggttaccaccttgctcaacacctgtgcccagagcatccacaaggcctgcctctcggctgcttagccaggactgcagggatggcccgcagcctcatcggggccaaggacgcatgcctcctgtcagacacttctaggtgttggcatccatggagagcctggagttaggactcgtcactgtgtcccccactccatgaaactgggcctgctgtcctgttaggatgctgtaagcccccgggcctgggctgtcctttctgacacactgtcccattccttggcctggttcatccccagcttcctggcaaagttctgctccctgaagcaggaagaggctgagattaatgccaacgaagtggggcccgtgggcctgggaagactgtgtggctggctgagggtgggcagtaagctggccaccccacccccgacatggacatggctgtgctatggcggaaggggtggtgtgggcatggccacagcactcgagacagccctccgaggaggagggcgagcctggctggaccccctgtctgcggtgctgtgtcagggcaggagaggacagcctcttgcccccaggagtgtgcagtgtgggcaagagacagagtgatcatgtgtttggaacgcag

SEQ ID NO: 197735 - DNA, 743 bp, Homo sapiens
cctcacaaccagcccttgccatgccacaggtcatgaccagaaccagaaacaagagcgtaccaggctcagtggctcacacctataaccccagtactttggaaggccaacacaggaggatcacctgagcccagagttctagaccagtcttggcaacctagtaagacctcatctctacaaaaatcagaagacttagctcggcgtggtggcacatgcctgtggtcgcagcttctcaggaggctgaagcaggaagatcatttgtgcttgggagtttgaggtcacattgagccataatcatgccactgcactccagcctaggcaacagagtgagactctgtctcaaaaacaaacaaaaaaacagaacaacaagagctggataaagaatagaaataattgaaggatgtgtataataaaacaagcatgtacattttgaacctgatagtattttgaaatgtttaaatggaatctgaagtgagtacatggtccacaaatagaagcatgacccctaaaaataagaaatgttgcttctaaaatcaaactgggtccttgccaaaagggctatacttctgcacctcctgagcagatactgattgagggcctccgccatgccaggctcactgctggccatggggaccataagtgagagcaggaccctggtcttgttcctcatgacatttatattgttgagaaaactgttggtttggtggtgtgagtccctccagaaatcatttagtagatacagaata

SEQ ID NO: 197736 - DNA, 234 bp, Homo sapiens
agtttgcaggccagggggacaacaaggctcaactctgtggtggtgtgggaggactcacacaccttacacttttctatctccagcaccctgcaagacacctggaagtaacatgctggctagacacgtttgttgattgaccacgtgtttgctaatccaacaatccaataaatatgaagaagaaagctctggaataataagaataattttatttcaaaactagctctgcttcttgac

SEQ ID NO: 197737 - DNA, 749 bp, Homo sapiens
attccctcttctctctctctcataccccactccccagtacaatcaggacccaagtcctactgagccccctcaaatatgcactgccccactatcctcatttataagatgatggttctggcttcttgggcacagatctgagttcatcttttccaaggtcgcagattctaaacagcggtagcttctttctgctcatcacgccctctactgaatccccaccacaaatgtcaactttacacataacacttctttagtatatttcctttcttactcttcgaaatgactgtttcccacttctctttgtacaaacatcctacacacctcccccaacaactagcatctttgttcactattgatatccttgcctcagagttcacagagaaagagaagccaccagagaggaactgcctatgattcccaccacgaaatcatgaaatctaccaaattaccttcatttacacccccattctcagtgtctcctctgtactatggacagtgtcctagtcctgtcaaagactagttcctccccaccatgctttgaattccaccatctgagccttctcaaggttccctccttcctttatctcactccttcctgcaattttccctcttcagtacagcattcccataagcacacagacctgttgtattatctctcccattaaaagactctccttacactctattccttgttaggacaaaatttctcaaaagtcatattctcaacacctccacctcacattccctcccaa

SEQ ID NO: 197738 - DNA, 575 bp, Homo sapiens
cagggcgtatatatgctgtctcactctccaagtttatcacccttctactttttcacttgttttgtgttggtattgatacagtggagagtgagaaattgacatgtcagagagaaagagagagtgagagagtagaattgctggagcagtgttcttcagtaagctgtagcaaatgggaaacagtacagaagtgtagggcactggcaacaggtaacagcaaggatatatcttctctagtgtaagagaaaagagagagtatggagtacagaggctgataggtgttagatgtggaatgtggcatttctctttcagtggtttctgtcattgaaaaaggaaggaaggtcatcagttgagaccaaagataggagaagtgtcagagatttgtggggaatgcctaagaaaatggttagttttggaggagagtggctaagggaagggcttagggaagtgtgatttgatttctgcacgatgtcaagagcccacttgagttttggttattaaagtaagaccagtttgaatgggttagggtttttttctaaccatattcaacagcacaggttcaggcatagattaggttg

SEQ ID NO: 197739 - DNA, 242 bp, Homo sapiens
tggtcaaaaagctcaattgctcacccctgacaatttttccctttgctagaatagaaagcataacaattatttttctgaaatataaattacaatcaggtggtgtttagttctgctactttaaaaactttctactggtcaggaaagtagtcttatattattaattgaatacacatgaaaaaaaaataccctaacaccttcccatgctttttactggaatggaaatctagatcaaacttgggtgt

SEQ ID NO: 197740 - DNA, 286 bp, Homo sapiens
tttttactattgtttgacggttgttataataaagtcaattaagatttcaaaagacattatatgcatgggccaccttctcttttcatatgcaacaagaagtaaaatgggaaccctctttcaaaccagcaactgctcacaactaatagtggtatgagtaggtatttgtatttccactgagcatatgtgtataaatgttcattcattcatctcaccaacagttattgtgtacaattttcttctgtggatgtaagcaaagttcattaggctgatggtcaaacaataaata

SEQ ID NO: 197741 - DNA, 299 bp, Homo sapiens
tctctccagagctggggaacaaagcccaaaggagaggcttaggaggggctttcctagaagaagctggggttgtactgaggtctctagctgtgccctccaaaccaggcctccgtatggaaaatgcatacgaagttgtgatgtaaattttagtcctgccatcctgctagtcagaggggaaagtgtgtgccttaatctctggaatcatatcctgccattggcacacagttagggatttgctgacatgaatgaaggtctttagttaaacctgagttaataactggaaggtctaacgtgtagtc

SEQ ID NO: 197742 - DNA, 436 bp, Homo sapiens
cattaagtgctcattaattattaaatgctcattagtcttcccaatcctatgaatctgatattgtcttctctattttatagataataaaattgaaaatcagaaagtttaatgcgatgttagaattacacagtaaaggccaggcgtggtggctcacgcctgtaatctcagcactgtgggaggccaaggcaggtggatcacctgaggtcatgagtttgagaccagcctggccaacatggtgaaaccctgtctctactaaaaatacaaaaaaattagccgggtgtggtggcacatggcctgtagtcccagctactcgggaggctaaggcatgagaatcgcttgaacctgggaggcggaggttgcagtgagccgagattgtaccactgcacttcagcctgggcaaaagagtgagactccatctcaaaaaaataaaaaataa

SEQ ID NO: 197743 - DNA, 121 bp, Homo sapiens
aggatataaaaagaggccttgggtctgatgggtttgagaattactggcatggacagcctcattagttcctgtcttaagacagaggataataaaagttaaaggctcagacttaatcaaaggg

SEQ ID NO: 197744 - DNA, 234 bp, Homo sapiens
tcataccaaattcagaaaatctttggctgacagtctggtatcaagctcttctgtaagtatcctattatggtcggtaagtgtaaaaattgatattttcacatagatttcaactataattctgtagagctaaccatagatgcctaatgccaatgaataaacaatgttactactttacttggaatattactggttagaaacaacgatttaattctaattgtagatatcaataataat

SEQ ID NO: 197745 - DNA, 305 bp, Homo sapiens
gaatcgagctcgctaccaatgcttttaccgcaccctgccaattgaacatatttttaaactactgttattgacttttcccattaaattcagcctgttctcatttaacgtatgttcccagaaagatgaattttgtactgcacttttttagttgactcatcttcatccaaacttaccacccttataattacaaaggcaggcttcacctggaaatggtgtaataaaccattgaagaatcctaaaccttactattaaaagtattttgccctcatcaatccataatcgatgtgtttttagtttccccacat

SEQ ID NO: 197746 - DNA, 322 bp, Homo sapiens
ccttttccgaatctccagaattttgccctttctctaaaccacgcttttcttttctccctcctgtctcctttctaaactcccaggaataataagaactgatgaacactcacaattatttatgtattggcaggtgttttgttttctcaaagtaaagaggatgtgagttaaacatagtgtagttccccatgaagaagaaaaacaacaacaaaaccccctcccaaaccttaataaaactccttttttatgctagtacgttgttatcaaactgtgttctagtaggtcagtgattcttaatagagaaaaaaaagattctccactttgg

SEQ ID NO: 197747 - DNA, 540 bp, Homo sapiens
ctccgcagtccagctttaatatttcatgtttcccaaaatgtgtcatgtaccatgcagaatagaggggaattggtgtgtgctacgtaaggaaatggtttaagagatgtcctctgagcaggagccgtcatggcaggacttctgcaagccttgactgtctttctgcacatggtcactcccctcagagtggtcaccgttggcagctctttctaagtttatttgtgtggagctagatgttttggatcttagctctatagccaaaacaagaatctgggaaacttggcccggatagaaggcatctgctagttccctgactggactctggggactcttagatgagggatcattctttcattcttctccagggtgtctgaaagttgttgtgagggtagataagcagactttttactatagacagagtcccagctcctagaatgtccctcctggcctgccctaggcaactagctcagcctggggccattttgactcagagctgttaggctattcaaaatgaacagggctgagcaaaatcaacagggcaag

SEQ ID NO: 197748 - DNA, 556 bp, Homo sapiens
gctcttcactttcttgcttcagcctggctcttcctttcaggcactaactccctggcatcccctcaacgtgcgactatcttctctccatacacaacctcttccctggcctaaagagaagtcttccttgctccttactgccacttccagatcactttccctttatctgccttaaaaatgcacaatggctcacatctgtaatcccaacattttggggggccaagcgggaggatcacttgagcccaggagcctgggcaacaaggcaagactctgtctcagaaaaaaaaaaaacaaaaaaaacccacaacatttactaacttagccatttttaagtgttctgtgacattaagtacattcgcactgttggaaaacagatctgtgagtttttcatcttgcgtatctgaaactctatgcctgttggacaacagctccccttttccccctcctactagcccctggtaaccaccattatttctgtttctaccaatttgactactttagataacatcatgtaagtggaatcataccatgtctgttttttgtgacagacttatttcac

SEQ ID NO: 197749 - DNA, 622 bp, Homo sapiens
ggataaaacttcctgtactggtagggaaagtaataaagttacaaactccttgccttttttcttgcagtttgtcttttgtttgataaggtattgtactgttgacacttcttgggctctgtgcacctacatagataaaatgaatctactcgcttcatttgacacccctccaactgcttctgttgtttaacccaacagaaaaccaacaaccaaagaaacttttacaggtggaaaaggactttggagggttttcctcgtctcagcaaattaaccctattaactagggaggtaggagataaagatagattctcttacacattaacttcccaggtaagagagggaaggcacagaggagatgctagaaaccttaagtaaggtggtaactataaaaaagtgctttttcagtcactctctttttttgttgtgttatccaagagacttctaatcatttgcctcgcatcagtcttatgaaagatttacattgttgctgctttatggctacaatgagtcgataccaaaaattaattgcataataatagcatcacacgttgtaaagagctttgcagcatgtaaagcattcacctacctcatttcatttgatccatctaacaactgtattagggag

SEQ ID NO: 197750 - DNA, 671 bp, Homo sapiens
gacaataaaggaatcgatgtatttgttttgtaactcaaagttaaagtccaaatttagaaaatagatttgaaagcataacgggtcaatttctgttgtgcctctgaagaagaaagttgagaaagaacgaagagggcttagatgctggtgggtgtctgcaaaaaagcccagacaatgcctggaataataaagaagcagagaacttccagggaggaagggaacagtctctaagatggagcaggacctggggaagtcttgcttctccactgaagaacatggaccaagaccagggcagaagggatggcagcttccccgtagagcagtgaggacggatgacgacatgaagactggactgctcattctcaccttcccttcacagtccctggcactttttaagctccttggaaattagaggcaatctaggagaaagggggatagaagcagaccttatttctgttacaatgtgaatgggagcttcaaattgaagataaaatgttatggaaaaagtgaaattatatatatattttgcacatcgtagcttggtggctttaggtttctgtgcatcaaaggaaggaattgtgtcttcctcattgtcatactctggtattggagattgtgcaacatatatagtaggtatgcaataaacagctgttaacagaatgaatcaatacttt

SEQ ID NO: 197751 - DNA, 635 bp, Homo sapiens
gtagttaaggaggtgatcggggagtgtgttagaggctgagctgggtgctttggcacacaggtaggtctcctaattgacagggggtgagtgtccgctatgcgcctagctgtgctccagcacacctagcagtggacttccaaggagagagcttcagtagggcagtcacccaggagctgagggtgctacaacttctttttcaggaaatataacaagatattgagaattgtgtttatcagaacatgttttttgaaaaatggagtaggatcctagtaggacctctgagaagcctgctcctgtagcagccaatggtcctttaagctttaagctgctttcatttctgatggctgctttaagaaattatcacaaactggatggcttaacatggtggaaatttattctctctcagttctgaaggccagaagtctaaaatccaggtaacaccagcattggttccctctgggggctctcaaggggattctgttccacgcctctgcgagcttctggtggctcaggcgttctttggctcttgctagcaatgattctagtctctgcttctatctccacatgacctttttcttcgtgtgtgtgtgtctgttttctttttttatttttattttattggttttttttgagac

SEQ ID NO: 197752 - DNA, 730 bp, Homo sapiens
aatgggttctaaatactagttttctgaataatggatgaatgaatggatgaaagatgaatatgtaggtggagcaacagatggataaatagaagatgatagctaggtgtggtggcacatgactgtaatcccagcacattgggaggccaagataggaggagcacttgagaccagcctgggcaagatggtgagactcccgcctctacaaaaaatataaaaattagccaggcatggtggtgcatacctacagtcccagctacttggaaggctaaggcaagagattgcttgggcccagaagttcgaggctgcagtgagctatgactgtgccactgcactcagccttgatgacaaagtgagacctcatctcaaaaaaaaagaggggacagattaagggagaagagttgggaaatgaattcatacgaaaacggtggatactgacttaaaattcagggtttggtgtgatatttagttttaaattctcatacacaacatccttgtgggtgatttagactgagagtctcagtgaaatgagttttcagtcaggatgattaagttgggccacagaatcagtttcccagagaggtctaaaacctgacagaaaatatgtcttgtttttgtctctgctatttggcagaaaaatccctgatgttatgaaagtccaggtattaaattaataaatttttattaagatactgccattgtccccaatgagtatataaaccacaatttcaac

SEQ ID NO: 197753 - DNA, 676 bp, Homo sapiens
aatgggttctaaatactagttttctgaataatggatgaatgaatggatgaaagatgaatatgtaggtggagcaacagatggataaatagaagatgatagctaggtgtggtggcacatgactgtaatcccagcacattgggaggccaagataggaggagcacttgagaccagcctgggcaagatggtgagactcccgcctctacaaaaaatataaaaattagccaggcatggtggtgcatacctacagtcccagctacttggaaggctaaggcaagagattgcttgggcccagaagttcgaggctgcagtgagctatgactgtgccactgcactcagccttgatgacaaagtgagacctcatctcaaaaaaaaagaggggacagattaagggagaagagttgggaaatgaattcataaaattctcatacacaacatccttgtgggtgatttagactgagagtctcagtgaaatgagttttcagtcaggatgattaagttgggccacagaatcagtttcccagagaggtctaaaacctgacagaaaatatgtcttgtttttgtctctgctatttggcagaaaaatccctgatgttatgaaagtccaggtattaaattaataaatttttattaagatactgccattgtccccaatgagtatataaaccacaatttcaac

SEQ ID NO: 197754 - DNA, 361 bp, Homo sapiens
ctgacttgccatgttaaagtttattttattcccagtgaatacaagtatcaactgaagtaatgttttatcggaattttgataaaggtggtatctgacttgccatgttaaaataaagtttattttattcccactgaatacaagtatcaactgaagtactgttttatcaggattttgataaaggtggttaacttgtaaatttttaggtttagtttgtttgtgtgtatagtagtacataataagtaagatacgtggctgggcgcggtggctcacacctgtaatcccagcaccttgggagactgaggtgggtggatcacctgtggtcaggagtttgagaccagcctggtgaaaccccatctctact

SEQ ID NO: 197755 - DNA, 549 bp, Homo sapiens
aggactccagggtccagcttatctaccctggagtggccagaacagacacaggcccatgaaaaatttgacctttgacattccaccaacttctagagagatcaccatgaagatgaaaagttagccaccaacttggggactgcagttttgctcacctttatccaacattcattaccaggttaagcacggtttctaccaagaaatgatagaaaggaggttataaggcaagctccgctggagagcagcaggtgcccctagaaatgccacctgtagagagcgtgtcacacaccactgacacagggagacggaaccactgctggcatcggcaaaaatctctgtctctggccaccagcgctgcagggactgatgtgctctaggtccctgcgagaggagttctcccacctgccatgcctagggaagggtggggttcaagaaggctctagcaacatccacacaacatgcaccacctaaaagaaaacgttggtccaatggaacatgcaccaccactccataaggaggctgtggacaagctcagaatggaccaagattcca

SEQ ID NO: 197756 - DNA, 603 bp, Homo sapiens
tgtctaggagttcctcgatacttggaagcaagtaaaatcttttggctttaaaaacaatcgttctttttattactctatacttatttggcaggtaaagaaaatgttacagtgtttcacataacatctctatgagacccttaccaccataaatgataaaatcatgaatgcttgacaatattttacaacaatcctggcataaaatttttctgggagagtccaatgccactgggcaggggaaaatctataaaaagtacctattattaagaaaagttggaaaaacttccttttgatgcctttctctacaaaaagtaaagctgaggctgggcacagtggttcaagactatgatctcagcactttgggaggccgaggcgggcagatcacctgaggtcaggagttcaagaccagcctggccaacatggcgaaaccacctctctactaaaaatacaaaaattagctgggtctggtggcgcatgcctgtaatcccaggtactcgggaggctgaggtagtagaatcgcttgaaccagggaggcggaggttgcaatgagctgagatagcgccactgcactccagcctgggagataagagtgtgactccatctcaa

SEQ ID NO: 197757 - DNA, 602 bp, Homo sapiens
ccagatgatttagtgtcctgagtgggcctgtagcccttgaagggaagttgtcacttgagttgacttggtaagtagactctcagctccctgaatgcaagagctgagcagataaataggcatttaatatcctaaattgagtgaccttgaaattattcttcgattaagtgagaatcttggtaagcctgaatatagacacctaatggtctatgacacctttaggtggggaaaaactaaacaactctgaggataggttttttgttgctgtttttgtttttttaaatccatccccacatccttagcatccaaaggtgtgcatattaaaatgtcttcgttggccacgtgcagtggctcatgcctgtaatcccagcactttggaaggctgaggcaggaggatcgcttgagcccaggagtttgataccagcctgggcaacacaggaagaccatatctctacaaataactttttaaaaattagccatgtgtggtggtgtgtgcctgtggtcccagctacttaggaggctgaggcaggaggatcacctgagcccagaaggttaggccatgcataccagttgggtgacagagcgagaccttgtctttaaaaaaa

SEQ ID NO: 197758 - DNA, 467 bp, Homo sapiens
gcggggcagacactggcttagctcactgagacggcgtcagtgtgggggttgtatgtgatggtgcagctttgacatgggaaaagggaaaagtctgggctgagagcccgagacaggaaagaccatggtcaggtattttgggcaggtgtctaggcagctaggggggtgacacaacactaagactggagccacgggctggggccccatcacatggagccttccttgtaggccacatggaagatgttgtattttatctcgaaagcagtattaagacattaaaggatttttaacaggtcagtgctataatcagatttaaaaaatattttgtctgctgtatggagtagaaaagtgtatgctaagttattgaaatcacctaggagatgatgataacttggattttgatgatcacagttgaaagaacgttggaacttgagacagagtttctcactttttaatgtcatggcacacgc

SEQ ID NO: 197759 - DNA, 498 bp, Homo sapiens
gtgcaaggtaagtaccattataaggagtataagtaggaaataaagctaagaaagagatcaactgagagacacaagcaagatcaaaggcctctctcactttctacaacattcaaaacacatttgtacaacaggtactaaaccaactatatatgaggttttttccagggtagaggccagtacatatatagatgatactttattacaatgtactgaaggtgtccctcaatcttccactactacatatgtatatacatataagaaatataataagtgaaaagaaacaatcagtaggtaaacaatttaacttcgaaatttgagtaggtgttcatttaaatgggttttcatcggctgggcgaggtggctcgcacctgtaatcccagcactttaggaggctgaggtgggcggatcgcttgagcccaggagttctgggctgtagtgcgctatgccgatcgggtgtccgcactaagttcggcaccaacatggtgaaacccttgtctg

SEQ ID NO: 197760 - DNA, 208 bp, Homo sapiens
agagctgcagtaaacaaagcaacatggaactggtacaaaaacaaactcatagaccaatgcaacagaatagacagtccagaaataatgtcactcacctacaaccatctgatctttaacaaaggtgacaatagaaatgtggaaccaattccctatgtaataaatggtggtggaataactagcaagcactatgtagaagattgaaactgga

SEQ ID NO: 197761 - DNA, 363 bp, Homo sapiens
ggaacaagcaaagtttcaggagagtactgtgaatgtgggtcatgtcagtaaagtgtagggacttgggcaggagcggctggacttgaagagcaggttggtggagaccaggtcatttatcctaagaagtttgccctgtagcatgtagattaaatatcccacgttggctgctggcaactgaactgggcttcctgtttctgtgtttggtttgaccatcacagtgttgaagaactgttgaagtgaataccttgcagtttgctacagtttcccccggtctcccacattactctggcctccttacctcatgtaggttgcctgaccctctgagacctgtgtttgctgttcctgcggaccggctcgagtatg

SEQ ID NO: 197762 - DNA, 409 bp, Homo sapiens
ccgtgaaggtgatggatgtcactcctgtgattatgttacattatctaagaattgtcctagtgggccctaacaagagattcttttgctggccttgaagaagtaggctgacatatcatgagtggacctgggagagggccacatgcaaggaacagagggggcctgtagatgccgagagcagccctggctgacagccagcaagaaagcagggacctgcattctacagctgcaagaaactgaattctgccagcaaccccctgagctttgaagaggatctcaagacccagaaagaaatgcagccagccaacatcttgatagcacccttgtgagactccgagcagaggaccaagctaggccatcttcagactcctgccccgcagaaactgtgagataataaatgtgtgttgtttta

SEQ ID NO: 197763 - DNA, 336 bp, Homo sapiens
cgttaataaacatttattgagcacctactttgtgctaggcactggggctacagccatggacagaagagacaagacttatgtccgggggccaagtgtctgtctggtggggacacataaaccaggagagtgctaggtttcaagaagcatcaaggaggcgggaaagcaggagatggctcaggggtacctcagacctcaggccctcctgcccccatgtctccttgactcaggaatcttggtccctgcctggactatggggccaccagttgtctgactggtcacactactaagggtagcaactcccttctacaagtagggaaactgaggcccagagtagga

SEQ ID NO: 197764 - DNA, 363 bp, Homo sapiens
acgccatcacagttcctactctataactcagggaaaataggaattctatcattagtcaaaggtattatattgattagaattatagtagctgctattacaattgaaatccaaatatcattaccttaacacaatataagtttatttctcactcatataataatccattgctggtgttccttgatgactggggagctttcctccaaatagtggtttagggacacagagttctatctttcagctttgccattccatatgattaagattctacttccgtctggacagaacatccttttcttaaaaaccaagccctgagtgccatattgcttctattcacaccacactgaagaaaattcatctgataga

SEQ ID NO: 197765 - DNA, 409 bp, Homo sapiens
gttttgttataacagcctgcatggattaagacactgtttttctccctttttacgtccccctgaaagatctcctctacttctgtggctttaattcctctacatatgtggatgactcctaaacttacgtctccaacccagtccttcctcttaactctactattatgtgtctagctgcctgcctaacctgtctaattccatgtatcacaggcatctcaaattcaacttgaccaaacccagattcctgatctgccttttctagctctgattctcttcatcatatttcaagttgcagaaaaggggagcaccatttacccagttactgaagcctgaaacctggcatcctcttccttccccaaacatgccatttcagcacatttttctttttctttttcttttttttttttttttt

SEQ ID NO: 197766 - DNA, 403 bp, Homo sapiens
tgactggagagtgaattctgctggtgggaagacggaaattagaacaaaggattgtttctaaacagaatgcctgcacgcagatatgaagatgaggggagtaaatgccttcagcaaaatgaggtcctcatgatactatactgaacactattcatgcatccattccttagaactactctatcaagtaggtactgtttttcatctctcctctgcaagtgagaaaagtgagggactgtgaggttaggtagcaagttccaagtcacaagccacgctggtgttagagatggggcagaccccagccctggaagctgcactgattaaattgcctctttattcatcttagatccccttatgcttttcagtctctaggcaccagtgatggaattggggatcacaggaaagaaag

SEQ ID NO: 197767 - DNA, 308 bp, Homo sapiens
tagagagtttttaatcagacatctttgaatttataactggagttgaacttgagcttatgaacaatttttccaggtttacacaaaaaccagaaagcttaaaaaacagaatgaaatgaatcatttccatttttgatacacatgaacatttttgatgcacaaaaataagaaacatgtttaaatgtcatatgaactagcatttttaaagatcacttcttgtgtgccaggcactctgctcatcagtttatatgcattctttcatttgacttctcaataattattattgttatttataataaataacaaaactg

SEQ ID NO: 197768 - DNA, 461 bp, Homo sapiens
  misc_feature (454)..(454): n is a, c, g, or t
caaaatgtggattatttagtatccttttaaatgcaaattttgataccagtgcatgtaaaagctctacctttttatcaagtcagggtctcactatgttgcccagactagccttgaactcctgcactcaagcaattctcctgtaacagcctctcaagtagcaggcactgcaggtatgcaccaccacacctggctaagttttgtattttcagcagagacagggtttcaccatgttgcccaggctgttaatttaaatctgttttggtctgaactttcaggcttggtctatgtgactatgaataataatacctctcttcttttcttcattaggttcttttcccagccttttttggtctttaaagcaatgaagttatcagcaaggcaagaggaaaatgtatctaattctgtgcttctaggtgtttcgaatactgaatagagcttgcactagaagcattanatatcga

SEQ ID NO: 197769 - DNA, 636 bp, Homo sapiens
gtgaagtgattcatggaggtggggggaagctgatatctttctctgctttgactgctcccaccatctatggcagagcgtctgtatggatgtaccatcctcgcagaaggaacccaacagaagtcacttggagaatgaatccaatgatttcattgtttaataaatgagattacatgaggcaagctctgtaaagtgtctatcacagtccttttaattatagttaacatttccggagtgtcaggccctccatgtatggatgtgcaggttgggcactgcacaaggacactgtgtctaaggggctgcatttctagcacagacaccatatacttgtatttattataacaatttcccaataggtggcagtaaagtgtcttgttctaataaactcagaaaatatgacaactttctgacatggaagtaaagagtcttaagcacatttttctctaattgtcacaaagacaccacatgggctaatagtcctgttgaaggtttacatgaagctctaaaggttatacaggtattaacttcctcaaccctcaccctaacctttagaggttgacaacttttgctaaccattttatagatgaaaacattcagctataggaggtgaaataatttatttaacgtcatacatagtgg

SEQ ID NO: 197770 - DNA, 518 bp, Homo sapiens
aaaatcctatttactcacccttcacaattcagcccaaatgccaaagtccttgtgaagatttttctaatacccttcctcagtcctccaaagatttagagttgttcctctgttatagcctctgttgtattttcccatgtattatgactggatgtttacatgttagctccctgaaagcagaggccatttcattcaactctaacagcttctagcactgtgctatgaatacagtggatactcattcacgttgaaatgcagcaaggattttttaaaaacaacttttgaccagagaaggggctcctagacagacaggcttcctgaatcaaggcatctcccacctcattttcataggacagcgaagaatatggaatcccacatcagaaaatccaagttcattccccgtcatcagcataggaagcattggcaaatcatctaatttctctgtctcagtgccttcatctatgtccatggaaaatgggcataaaaatcaagccatgggcaggcgcagtggctcacacctg

SEQ ID NO: 197771 - DNA, 429 bp, Homo sapiens
tcattattgtgccaaacatccagtattatatctgggtaaccccaaacaattcgattgccttcataatattttctctagcttaaattgttttctatcttctatagcaggaatccccaacccctgggccatggactggtaccagtctatggcctgttaggaatggggctgcacagcaggagatgagcagcgagagaagcttcacctatacttatagcctctccccattgcttgcattactgcctgagccccacctcctgtcagatcagcagcagcattagattctcgcaggagtccaaaccctacggtgaactatacacgtgagggatctagtttgcacactccttataagaatctaggccaggcgtggtggctcacacctgtaatcccagcattttgggaggccgaggcgggtggatcatgaggtcagga

SEQ ID NO: 197772 - DNA, 327 bp, Homo sapiens
tcccagcatgatttgttgaagactatcctttccctatcttagtacccttgttgaaaatcatttgaccatatatgcaagggtttatttccaggctctctagtctgttccattggtctgtatgtctgtctttcttttttcaggaaagtacagtgttcaaactacacagtcttgattactgtggctttgttttaaattttgaaatcaggaagtgagaagcctctaagtttgttctttttcaagatggttttggctattaggagttcctacagattccatatgaattttaggatgggttttatcttcctttcttttttattttttttattt

SEQ ID NO: 197773 - DNA, 355 bp, Homo sapiens
gcaggtgtgtcttcagcactcaggcatagattttattgtgtttaaacaccatggtgaggactgaggactctggagcttctaggttcacagccctgctctgccaccttcaggtgtgtgaccctggacaagtcactgaacctctctgtgcctctgttacttcatctgtaacatttgcatgagagtagctcctatctggtagggttattacacaagttaaatgagacaatgcaggtatctggccccagctccctccctgacctctgctcctagacctctttcttgtttggttccatccaaccacaccagcttccttgctgtgggtcaaacacaccaagctcattcatgcctctgggcc

SEQ ID NO: 197774 - DNA, 305 bp, Homo sapiens
tgcaaagcagaaaaacttggaaatgtacaatatgcttcaagctcccaaattttcagagtaaaatgaaatttcctcctccgaataagaatgagactctgtgaaaagagtatgaactccatggttggacctcccctgccaagagaacctcaatccaagtctacaggattcagccaagcccttacttttagctacaggggaaaaaaatccacaaagtggaaacattttgtccacatctctaaattagcattagcaggcgccaacaaagccttagctatgcttcatttctgagagtgaaagaaggcact

SEQ ID NO: 197775 - DNA, 202 bp, Homo sapiens
gagtcttctaggtgctaaagcaaagaaaataattgtggttcataatgaaattcaaagtatacaaaagataaaaacaaaagcctgccacccggtaggttttgaaggcgatgaggcactcacagttcagctgacatccatccatacgatgagggccagtgtccactctagatccctaagctctgtaggttttgaaggcgacaag

SEQ ID NO: 197776 - DNA, 563 bp, Homo sapiens
agagaatcagtgttcttacagatgtgacccatctcagagagatgtttcaccttcctgctttttaagattcaggtagaaatataaatgcaggaaatcaacttgggtattgaatctactttttaaaaggtcaaatgccaaagccatcattttttatacccaattgccttgttggcttcatgagacacatacttgctcagtgactaccctaacctatgctacctctgtaggtacttactcactctttgcctaatgtcaaactcttcaatctacctggtatgccagcctgagacctagcctgctcccattctgacttctacccagtatggcctcagctcacttggtacttgtgtctggtcctttctctatattctgctattatctgtgaccttggtcctaattctttcaactgagtaacatctcagttgcaaatttcataaagcttaaaaatgtaaataaaagtcataccatccacacacttttcacccttaagacactgggaacacaaaagggcaaactaaacctaaagcaaacagaggaaagaaaataataaagattaagcagaa

SEQ ID NO: 197777 - DNA, 235 bp, Homo sapiens
gagaaggaaagaagctgcataacacagtgtttttctcaactgtgcccctagaggtgatagggcaagaacgagcagtagtcctggattcaacgtccgtaaaaatcagtcgactgaagaacaccatcaaatctttgaaacaacagaagaaacaagtggaacatcagctggaagaagtaacgtgatttcgtttcctcgcgacatgactgctgggtttggggggcactcagacatagag

SEQ ID NO: 197778 - DNA, 375 bp, Homo sapiens
acatcatacaccataaatatgtataatttttatttgtcgatgaaaaaaattaattaaaattaatggataaagacacatgcagaaaaaaaagaaactaaaaagagagagaactccctgggactcagacccaagagtacagtacaggctgtaattccttaacttctccaaaattctcctacctgccatggcaggtagacaccctatacaatgcgcatccaaagaagggagctgctgagtcaatggaaggtaacagatgagccccctttaaagattggtgtgggtgggaagactggcaagccaccgctacagctgcagaggctgccaaagcctctgaaaagggaatgtgaatcctgccccctcgatgtcactgttgct

SEQ ID NO: 197779 - DNA, 594 bp, Homo sapiens
tgtgtcagactaaagaaaagtagtagttaacaggaaactctgttgaactgttctttaaaatgttttcagaaagttctgattaatctgttataggttagctaccaggttgccaaaccatactaggtatattgtaccacaggccagttgagttttctgtagcaggtgaaatagaaaactgattccaacaaagaaattgctagaatattaaaccttcaaaggacttcagaggtcatgttcactgacctctttaatacctgaggaaattcttaagttaatgatatgaagtcagagagttatcaactaacagtgctcagaccaaaactgggatgcctgactccctatccaaatgtgctttacactcatcatgatacagatgtaaaaccaggtattttctattttcttctgctaacgaattgataggatgtttctaatataagtattgctacgatcgttctttttgaaaattattaattttacacagtgaaagcatgtttttccaagttaattatctgaagtaatggaccatttatttcaaatgattggtacataatatttaacatttccaatatccatatctccacaatagaaacttgg

SEQ ID NO: 197780 - DNA, 376 bp, Homo sapiens
tctatctcggctcactgcaacctctgcctcctgggttcaggtgattctcctgcctgaccctcccgagtagctgggattacaggcgccctccaccatgcctggctaattttttttatttttagtagagatgaggtttctccatgttggccaggctggtctcaaactcctgacctcaggtggtccacccgcatcggcctcccaaagtgctgggattataggcgtgagccactgcgcacagcccaacatcacaacttttaaccctggtcttcctctattgtgtcagtaagagcatttttaaaaatcagaagtttgagcatgaataagaattttgctccaagtgatactatcaagaaagtaaaaaagcctactcaaaagg

SEQ ID NO: 197781 - DNA, 541 bp, Homo sapiens
acagccctggagaaaagtctgtttacacttggaaagcttcaagtcaactcaaataaagacagccttgagaatgagatcttccagggaaccaacagaaaggtcaaatgctgacaactctctggaaataggcctttgaaggcactccatccctattctgccccctccagtggctgctggttttctctgtaattgaaggctgcatatcttcaagactaccatggagaccaggggataagggtatgtatggaaatagggcaaattaaaacatcataaaactcattgttcttatgaagattcagacatttttcttgagcaaacacttctcgagttgctgcaagcctttggttaacttccagagtcctgaaaagttgattctgacagtttttgccactgttctcattgcttgtacggaggtgggaatttttgaagatccttactccctcattttcacagatgtcactctcttattttatttaattttaattaatttagatttaaatttaaatagccacatgtgactagtggctactgtattggacag

SEQ ID NO: 197782 - DNA, 897 bp, Homo sapiens
ttttggacagagtctcaccctgtcacccaggctagagtgcaatggcacgatctcgcctcactgcaacctctgcctcctgggttcgagtgattctcctgcctcagtctcctgagtagctgattacaggtgcgtggcaccatgcctggttcgttgtttttttttgctacttttagtagacatgaggtttcaccatgttggccaggcttgtctcaaactgctgacctcaagtaatccacctgcttcggactcccaaagtgctgggattacaggcgtgagccaccatgccttgccaagtcttaatgtttctttacaagagagtgaggggaagctccctgtactcaatgagacgtgctagcctccacaggccatgttcactccaaggacactcatgggctactgaagccagcactgagtcgacagacccccttcctctgctaatgctccccacttctcagtccacctccaggggaaccgacctccatcaggacaaactcagcagggatctgcagcctaaggtcaccctggctaaaaaaagctcaaccatgacacatgcagttgttgaagctgccttaaatactgcagaggcagactgaaaagcccctttcaaaaggaagagaaagcatctgtgggcagggggagttcagcgtggctgctctgagccaactctgtaactgctgaagacaaacagcggcactttgctgttctaaggccctggaatgactcagccatgcagctggggcaaacacactcatccgctgcccgcctgcctggctccttagacctctgaataccagggaaaggttggaaccacctaggttgggatcaggaggtccaaagcccacctatgcagggaaacacgaactcctattctagggcagggcaggcagtctcacctcc

SEQ ID NO: 197783 - DNA, 157 bp, Homo sapiens
catgaggtgactggggaagggagacctctcctggcagcatttctaggacccaacaagatctggaggtgccggctctggttccatctctaatcccctgctgtggcctggccagtgtactgcccggagctggaaaccaataaacctgtgatttgccccc

SEQ ID NO: 197784 - DNA, 432 bp, Homo sapiens
gtaggtgggaagcttggacaagccccaaatgcctcagggacctttctgtattttttttttgagacaggctcttactctgtcgcctggactggcatgatctaggctcactgcaacctccacccccctggctcaagtgatcctcccacctcagcctcctgagtagctggggctataggcatgcgtcaccatgcccaactaatttttttgttttttggtagagacagggtttcaccatgttgcccaggctggtcttgaactcctggactcaagtgatccacctctcttggcctcccaaactgctgggattataaatatgagccaccatggccagctgatttttttgtttgtttgtttgagatggagtctcactctgtcactcaggctggagtgcagtggagtgatctcggctcactgcaacctccacctcctggg

SEQ ID NO: 197785 - DNA, 494 bp, Homo sapiens
cagcgtatgctgtcggtcgacctagcaggatcccccagcaagaatggcattcagcctgctttcaatgcctatggctgggcgattgtgtcccagacattctaggctcagtactttcataaaggcacacatgcagagaggggcgaggacctgccggtgagctttatgcatgtatgaggcattctcagtggatgtgggccatgctagaagatgtacacaggaagattatttgattctaattcatgccacttgatatactgtaagatgcacatagactttagttgccaataaaattggctggcaacctgggactgcttcaggtcagacaccaaggaggtggtacttctgttccattttatagtgttagccccagaccattgaagaaaaccaggactcagttgaataattactttgggggtcttaactgaacaactggttggagggcatgagggaaggtgagggcatttgagggtaggatggagacctgagcaagccag

SEQ ID NO: 197786 - DNA, 142 bp, Homo sapiens
tcagaacaaagaaaaacaaaaccaagttaagttacagctttctgccaggaccctggcactatggggggtgggaaaccaagcagaacaaggtagtttcactgaattgagatgacagaggtgggagttttcaggctgaggtggg

SEQ ID NO: 197787 - DNA, 449 bp, Homo sapiens
caggagctctgtgagcccgtgctcaggtgcacacaacagaagtactccgctgacgcccacccctttcactcagctctcggttcagtcatcgccaagcaactgagagcctttgtgaagaggcttcctgccctcttcatcttccacagacacgctcttcttccttaagcccaggcatacacagacacagtgaatgcacacacaaagacacacaccagtgtgcacactgctctggaatccacaggttctataaatatctagaaatgatatctgaaagtgcattgttatatgcgctggtctgtgatggttacggtgatggtgattcctccttccggaggatggcgcggctgcagccagagggagattaggtggcggaggcttcgatgaccatttacattttacgagtacttattttgagtgtgtatttggaaaaattaaatttgtatatcaag

SEQ ID NO: 197788 - DNA, 328 bp, Homo sapiens
ggaaggtccagttgctgccatctggccacctctgcatggagcccccaacagctgtgcctcagaacagatccgaagtgactttcaggggagctggacacatgtacgctggtgcctgctgtccccaccctttggcactgctgctctttctttttctgagatggagtctcgctctgtcgcccaggctggagcgcagtggtgtgatctcggctcaccgcaagctccgcctcccgggttcacgccattctcctgcctcagcctcccaagtagctggggctacaggcacccgccaccacacccggctaattttttttgtatttttagtagagac

SEQ ID NO: 197789 - DNA, 508 bp, Homo sapiens
tgtggcaccctgtctggctccttacgtgttcttcaggcttgaaggcctcttttcacgtgcaccggcatccactcaggtgcctgcttccagaagcttcccagcacccactctgctgacagccaagggcacaggactttgatctcttctgctgcccttgctgggttttgccttgcggcttaggtctttctatttctctctctatccctcactgtcggtaacgcctaagaaccaagtttacttaatggtgtgtgtgtgtgtgtgcgcgcgcgcgtccgtgtgcgtgctcatgtgtgcgtgtgcgtgtgtgtgtgcgtgtctttctttgtgtatgtgtgtgtgtcgtatctggcacacggacctgtgattaccagcccgcgtgaagccaacaaatgccctgagttagaatgcaaactttcaccaaagcttgcaggagctcgtaggaggtgaactcaaggtagttaacccggtcatctcatggtaattagaaactctgcttggcaggtttaga

SEQ ID NO: 197790 - DNA, 413 bp, Homo sapiens
ggagaacgagagttctttatttattgccatgaatctttgagacttgctgtgtgttttctaatgtatgctcaaagtgtaagttacaatagaaaatagaaaattggctgggtaccatggctcacagctgtaatcaatcccagcactttgggaggcggaggcgggtggatcgcttgagcccgggagtttgagacaagcctgggcaacatggcaagagaccatctctacaaaaaatacagaaagtagctgggcatgatggtgcatgcctgtagtcccagctacttgggaggctgaaatgggaggatcacctgagcccgggaggttgaggctacagtaagctgagaggctcactaccctccagcctgggtgacagagaccctgtctcaacaaataaaaaatagaaaaaaagaaacaga

SEQ ID NO: 197791 - DNA, 582 bp, Homo sapiens
attccttggagtttcttacatgtcccagtaataaactgggagccaggagtgtaacagaatacactgagagagagtagcttatatgtagcacactgaaaggaatagtccccaaatctctaaggatcaaactttactgatattgtatctcttagaaatggggtgttatatgggtaactaagtttttgctccattacgaaacccagaatcctttctgatcttgatctaatgaaattatttattcagcaaatgttaagtatttgctaatcctagattctgtaattggttctttggttaagacaaaacaaaaaccttgtacctcagaaactttaaatgcacccaggaagcaacacagagaatataggtgctatgagagatatacacctaggatggcgtggatgcaacccagcaagggaaagggaccaagtcacagtaggctgtgaagaaaaagtgcccaaactgagggctgaaggatgaaacgtagttagcagatgactgatacagggaagggaaagtgcttttctgctagaaaagcagcagcatatgtgagggtctaggtggagaaagagcatgaccctccaggac

SEQ ID NO: 197792 - DNA, 330 bp, Homo sapiens
gataaaatacagtgaccaaatagggtttattccaggtatccaaggttggtttaacatttgaaaaccaatgtcatgtaccacattagcaagagaaagcatatgatcagctcaatagatgcagaaaaaacatttaacaaagtttaacatgccttgctgatgaaaactcagcaaactaggaaaataagggaacttctcaatatgataaagggtatctgtgaaaaaccaatagctgaaatcatagttaatgctgaaagactgaatgctttccctatataatatttagaacaagtcaagatatctgctattcccaattgtgttcagcattgttct

SEQ ID NO: 197793 - DNA, 116 bp, Homo sapiens
tcttttaatttccagttttcatgcattaccaactcatgattttttttccacccttaaatatgaaacttgcactgcttttaacctaccacattaccaaggtcagaaacagaaccact

SEQ ID NO: 197794 - DNA, 719 bp, Homo sapiens
gggctgccctgtgccttgtaggatgtttagtaacatccccggtctccgttcattcactgatgccagcagcaccctccacacccctccccagctgggacaatccaaactgtccccagacatggccaagcttgtccagggggatgaagcctctctggatgagaagcactgacctggacagtgcggcacaggtttgtgctgtgtgcttgttcgccatggcctgcatatcccagctctgtcccgatggcatggagcacggcggtgtaccctccacccggagttgtcaggatgattaggacgccccatgctcccaaggctttccgcgaggctgtcatgactacacaaacatcctgcaaagatgcagctttcagcccctgcagcaccccgatccattgcccctcagaccctgctcaggggcaatccacccctagtgagggcggaggaggtgggggaggcgctggatatgaagccactgtgtaacacacaaagcactattcagaaatcagtgttactatctctccctggatggcacagagtggattaaggagcaaagacaaattgctgggctcttgcgactctgacctctgggtcatatttgcttctctgcgaacaatgcagattgtcctcctgcaagctgtttacagctgagaataagcagacggcgaagcagttagtctccttcaaccttggctgttgcatccttaaccaatggtaacaccttc

SEQ ID NO: 197795 - DNA, 562 bp, Homo sapiens
cttttgtttttgctcatcctgttttactaccaccttgcctgctgctggtgagcgtataataaatatttttttgaatgaacaaatgatttagctctatcagatgggtagaacttctatcctagagactgaagtaaaagcagcctttcggcgagagaggatggctttgttttcagcattaatccagtgcctggagattattacccagctcaagtgtctgttctctgcaaagcgactggtggcctgtcttccttttccctctagggacatagtactctttgaaatggccctttccccctggtttctttgctttctgacatattagtataacttctaatgggcgccttctaaaacacaagtcagattgtcccactctcctttaaatttgcagtggctccttaagaacacagccttaagggcatggtgtctcacgcctgtaatcccagcattttgggaggctgaggcaggaggatagcttaagcccaggagttcaagaccagcctgggcaaagtggcaagacccacccgttcctacaaaaaaaaaaaaaaaaaaaagcaaaaaaccc

SEQ ID NO: 197796 - DNA, 359 bp, Homo sapiens
ccgaagtatcgtgaaaggcatacacttattgctattattcatatacaaacatacgttgacatctagtgggcaccatccttccctttggacaaggtggaactacttatgatgctatcaaacaataggagaaaacaaatgaagcagtagatggccacaattgctaatagcccgaaccagttcataacagcaaccataggagtgaggccaactctcctccagtccatggtttcttcctggtagcagtggttataagtaggacattacagatcgtgaaatcttggtttatttttattggctatggtgactccatttggaggagcagctggtcctgggctcccagagttttccagctgggggac

SEQ ID NO: 197797 - DNA, 485 bp, Homo sapiens
ttatagagaattttatgattctgggttttattgttgttattggtaattggatgatataaaaatttttcagtgattttgtcttcttgctaattagaaatagtgatgaaagtatctttttgtattacaaggcttttttttcctttaaacaattgtacacattttgtattttttttttttgcttttctccatacagacctttatgagaatggattcattgtatcccgtaatttgctattatagtatgtaatgaaaatgagatattcatcattgaaaatcacagcaaaaggcaatgtattcctcattgatagatagcagttgttgataaatgctaaatatgaatacattttacttcatctaaggatttatgtagagaaaataaataatatttagccactgaagaaagtttccactgtaatgtaagggactcatcactccaagtctcagaggaaaagcaggcctgtgagatgatttattataaatataaa

SEQ ID NO: 197798 - DNA, 256 bp, Homo sapiens
ccccaggcttattcatgcatctcccccgttctgtgacaatggtggactgctaaccaccactacagccctcgcagtcaaatgcaagctttagagtcaaacgtagggatagtctgttatcacagcttcatgagaacttcttggacagtccagaaattaatatgaaggaaaatgaccttcccatgattcctccatagggtgaggggtggtggggagtctcctccccatcctttcacagcacatggcttgagcttctggt

SEQ ID NO: 197799 - DNA, 122 bp, Homo sapiens
tagaaatattcatctctatgaaagcatattatggttataactgaaaaccttgttattaaatataatattagttaaaatattaaacataatgttattctgaatgtatttgtaaaatatttcct

SEQ ID NO: 197800 - DNA, 613 bp, Homo sapiens
cccaggcggctttcccagggccaccacaaggacagtcatctaacttgcccccaagtgatttgggccaacccatggccactgcagaagtgactgacagcgtgttgtagaaatcccaccacaccaaaagcgggggcggaagagttccccactccctgatagtgggctgctggctagagaaggctgtggccctgacagcctgacattctgctgcccccaaagcatgggggcaagacactgtcccctgagcctgtgacctgctgcatcctcacctcctgggtgggggtccaagccacgttccctctctgaagataacaacaattgcccacagcctggaccgcatgtttgcagtgggtcatggagtttctgaacagcatggcctagtggacagaatcggaacacaaggtgtcttgaggtgaagtctgtggagcctccactatgtgtgcaggagaaaaaaaaacaatcagtatggacaagactttcatgacttgccctggaccaaagattaaaaacaacctggacagaggtctttgttgaagccagcctgaacaatggcagaaatgtcctttctaatgacatcactatgaagagcaccacctgtgtgagtaccagggtg

SEQ ID NO: 197801 - DNA, 1020 bp, Homo sapiens
tgtgaatctccgcataaaggtggagcctgcatgacctaaacacctcccattaggcctcacctttcaaccctgttgcattgggattaagtttctaaaacttgctttttggaagacacgttcagaccatagcaatattgaactaatttcttcctttgaaaaatctgcctttttggttctagctctatcctctgtggtttcaaggatatgtttaaatatttcatatgttatcaaggctaattatttataaagatttatgcaggagcatttaccatgggaatggttttaatttagatcataatgaaatagttatttcaagccagtttcctttctgtatttatatatgtttaggtgtgttaagactggattgaaagtctcatttggtgtatatatacacgtacaaattcatatgtatgtaactatgtttttttaaacattgattgcagtttacagcatttattcatatattcattcattatgtttgctgagtattttctgtttccctccattagaatgcaagagacaggtgcctagaacagtggctcatagtaaatatttgttaaatgaataaaattgatttaatatcttgagaacttttctgtgtgatgtattggctaccagaattatcactgagaggttaggttgtattaaagattgattacacagctgattagtagacgaattattactagaatccaattattctcaatattgctctgctgaattcattgctgcagaatgtaatctttgaaaaattctaacatatacttaatatttttggtgaaaattaaaaattgaagtatatcatacaaacagaaatgtgcacacatcttgaaagtacagcttgatgaacttttccagagtattggtccatgtaattatcacactgatcaatatcgataaagaacatttcctccctcatgtgaccttcctgtctttacccagatgacttttgtctccataggttagatttgccagaagtgtgtattaatcaaaagcgtacttatagtaagtactcttttg

SEQ ID NO: 197802 - DNA, 435 bp, Homo sapiens
tcggtgacatggtttcctgagcatgtgcgtcagcccttggagatgtccagcgtaagtcaaagcctttgttccctacgataaccttgagagatgactcagtagagaagaaggcaggctgtggggtgggggaaatggtcagtgcagctacaaatgagagcctgttcctggctcaaggggaggacaaggcagaaaaacaacaacagtaattaccattccctgttgtttccctggaccgacctcccctcgtcctccacccggatgatcctgaggcctaactctcctctctgtcctcaccctgcacccattcttccccaccatctgttttattatttttttaattccactttatggagaaatataacttacataaaataaaacacaccaattttgagtgtagagttcaataaattttgataaaatgcttatcaaatccta

SEQ ID NO: 197803 - DNA, 1058 bp, Homo sapiens
gacggaattctcctaaattcgaagcttggaattctcctaaattcgaagcctgaggcagaatggttgaagcaaaaagaggagatttgttgtcttatgggtctgaagggtcctgaatagtgtggtgtcaggcacagtatctctttatcaaacaatatctctttaatctctgagcttggccgggcacagtggctcacgtctgtaatcccagcactttgggaggccgaggcgggcggatcattaggtcaagagctggagaccatcctggccaacatggtgaaaccccgtctctactaaaaatacaaaaattagccgggtgtggtggcgcgtgcctgtagtcccagctactcaggaggctgaggcaggagaattgcttgaacctgggaggcagaggttgcagtgagccaagatcacaccactgcactccagcctggcgacagcgagactccatctaaaaaataaaatatctgagcttggctttcctctgagctggcttcattcgcggaaggctgttccctcctgatgggtgcagggatggctgccagtagctctagaaatgggatgcagtcttaaccaccctagtgggaagagagctcctctttcctgagagttccatctcagggcgtaggaccggctgtggctggctctgtaaccttcctgtccctgaccgatcattgtaacagaggttgtgggacggggcacctatccactcctagaacctttggggaggacagcggggagtcaaggtaaagtgaagaggcctatccaggctcctggggtgagagagattgggtgaccaaggctggtccacccaggggaagacaggaagagaagtgggccattctggcctcagacctcttcgtcctttcccagaccccacgccaaggcagagctccctgtgggatgagtttctcacttgacctgaaatctctacttgtggggctgctgcaagtgcacaggcttcaggaaaggtggaccacaccccctgtgccccaggctccttcccgagggtgtgcagcccaccatccagataggggtggatggtgcccaagtcgtggggg

SEQ ID NO: 197804 - DNA, 435 bp, Homo sapiens
caggagaatcgcttgaacctcggaggcagaggttgtggtgagctgagatcacgccactgcactccagcctgggctacgagagtgaaaattcttctcaaaacaaacaaacacacaagcacactaaagttccacactttcagttaactatatgtgggcatggtctttgggccccgcagagtgcagttgtgcacacagctatctatctgtttggctccacgtcttacctttctgatggatgaacctaagtctagagtttaatggagataaagcatcaagatggcacacagtatcaagaaacagtatgcagagactgtgtaaggaaatactcctttttacaaataaagtatactatatttggatgattatgtaactttaccattcaaagatggagttacaagaaaccttttgtgttatggcaacacgaaactggctttt

SEQ ID NO: 197805 - DNA, 589 bp, Homo sapiens
atggtgcacaaggagcaacatgagaacacttcgaatgaggaattacaaaccaggacggtggaaacaccgcacacacgcacacacactacaaaacgcaccgtgtttacccacttaggaagtgaggaaacagtgtagcgggaagtcagggaccccgaacggagggaccggctgaagccaaggcagaggttgtggtgagctgagatcacgccactgcactccagcctgggctacgagagtgaaaattcttctcaaaacaaacaaacacacaagcacactaaagttccacactttcagttaactatatgtgggcatggtctttgggccccgcagagtgcagttgtgcacacagctatctatctgtttggctccacgtcttacctttctgatggatgaacctaagtctagagtttaatggagataaagcatcaagatggcacacagtatcaagaaacagtatgcagagactgtgtaaggaaatactcctttttacaaataaagtatactatatttggatgattatgtaactttaccattcaaagatggagttacaagaaaccttttgtgttatggcaacacgaaactggctttt

SEQ ID NO: 197806 - DNA, 458 bp, Homo sapiens
tacaataacttggagagcaggatgctgtcagccccatttcacagaaaagccaactgaagctcagagacatttaagttgtttgcctaagcccacacacctagtaccagctgcctgactccaagcttcagctcttttgagtcaactctgctgagaaaggagtgggaataaagccatctcctgggggaagggagggtgtttctggaatgcgaagtattttaagctccttcctagctcttttctacagactcctacctctatctttgtctgaaaatagtcaggagtttattcctggatttcagaggacaatttctacaaattaggtttgcctctgaataatgcacctaagggatcacactcccaactcaggacatagacaatacggggtgacccagaagccacacttggtgtagcaaagagagaaggacatcatctctgttagacaataaaaggctaaagtg

SEQ ID NO: 197807 - DNA, 317 bp, Homo sapiens
tctgttccctccctactaatgtcccacctgcaagtctagaagagtgtcacttgctgtctattttactacctacaggggcttccctaccttggctctactgtgatatagtaatgtgccaggccgtgttgtaagcgcttgatgagtattaatcttgatcttaactctgttttgactttctccttgccttctctaaatggcctttcctgttatcagtcagttggggtccagcagataaacgtgaatgttatttcaagccagatgaaatttgaaagtcaaatcaatcccaaggccactctaatgactatgaaagaattaca

SEQ ID NO: 197808 - DNA, 547 bp, Homo sapiens
gccttccctttgtgggtaactcgacctttctctctggctgcccttaacactttttccttcatttcaaccttggtgaatctgccaattatgtgtcttggggttgctcttctcaaggagtatctttgtggtgttctctgtattttctgaatttgaatgttgggcctctcctactattctaagtcaccatcacctgtgcatatcctttctagcacccataggttgtaattatgtgcttccttgcttacttgtttattgtctgtattttccactagacggtaagctccccaagggcaggcactgtgtttccattcaccactgtaagtttaattgcaagcacggatcttgacatatactgtgcactcaataaataatgtgccaaatgaagtgaaaggtggcaagacacatgggtctctgcctgacacacagctgctgtggggatgctcaggtgcacacctcattggtatcttctcatgcaaagctgcgtgcacatctgagaagggtatctgagaacactgctggtgcaggttctaaatgccacaggctggat

SEQ ID NO: 197809 - DNA, 435 bp, Homo sapiens
gcgctatgccggtcgcttccagtcaaccccggtcgcttccagtcaaccccgcaccagttggcccagctgggaaatgcggtcaccgtgaggattaagttagtaaaatggtacacagtgccttaaacagtgaccggctggccgtgtcaaattaccaggccgagaccagcctggagccgcggcctccactcccgcctagtgcagtcccgggccctcccacaaggaggtccggcccccggggttgccttccagccagttggggcttttgcccattttcctatcgcctgccaccaagctgctgctacgtatcccggctggaatctgactacccctccagcaaagtggtggggggcgggcccgggtcagggaggccacatcaccagcttcctgcaggaacttctagaaggcgagcagcccggaaaatggcatgggcggccg

SEQ ID NO: 197810 - DNA, 659 bp, Homo sapiens
acagcatagagatagatataagaataacaggcctgatgcagtgtctcttgcctataatcccagcaatttggggggctgagacagaaggattcctttaggccaagagtttgagaccagcctgggcaacatagcaagacttaatctctacaaaaaattaaaacataagccaggtgtggtgatgggcatctgtagtcccacctcctgagtagctgggattacagtggcgcaccaccacgcctggctaatttttgtatttttagtagagaaggggtttcaccatgttggctaggctactctcgaactcctgaccttaggtgatccacctgccttggcctcccaaagtgctgggattataagcatgagccaccatgcccacctgtaaatatttttattattttctaaaaatctgctcatagtatctcacaaattatctgttcctatgtaagggcagatcaaacaaaaactttaaagagtcatttttttttttttactcctaagccatataaaatactcataaaattatgattatagagtactattttattttaccttgatttattattacatagagtctgtgaaattcttcattacttttgaaatactatttaattaaactttagtgttctgacaaagaaagaatgagggggagttcttttctg

SEQ ID NO: 197811 - DNA, 525 bp, Homo sapiens
tcacaaccagaatgaatataaagtaagccaatgtacaaagaagagtgacttaaagcaggatctcacatgagacaagagagagtccaagacagaaaattccccatttgcagttatgtgttccagactggagaacaggctgaagtttcataagaagacctggtgagccaaggactagattgagtcatatgaaatcactgatagtagacaacttctggaatacaagaatggcaatgtcatatggtttaacctaatagttggctgggaatggtcaagacaagcttcttgaagaacataaagaaggtggggcttgcactagcttgggcttggataagtaagaatatataagtaggcttgggagaggaagtatggaggcaggaagcaggtgacagggttgggtggagctggggaggcacaagtggtgggtcaggaccacccatcatagttccaaaggggcgttttggggtggagaagacagatgctgcttccctgctgcccatttcgtattaaaatgttttcctcattatg

SEQ ID NO: 197812 - DNA, 689 bp, Homo sapiens
cgacccctgcaagactgagaactggccagaattgcccacttgctagactagcaagagagcgaagtcccagtgggtacccccgacgaaggacacccgttccttaccccccacccagaggcacccttcctcctccaaacacaagatgctgctccagcaggggcagggaccatgtcagcctcccacaagacacacacgggaaagccctgcttgtgagggcgccacacccagggcaggaatcagaatgaagacacgactccacagtgagcacggggctcgggacaggacccagcgtggcagaccagccagagaagctttcacactgcaaacagcccgctccacctacaccccgactgggctccacgactccccgcaagtgccctgccacctcaggcacctgcccccacgcccactcagcgtcaccccctcggcggttcatctccagaaggcttggaattgatgacgtttccgcaccacgaggggcttttgcgattctgcgtcactgaacttgcatctcatccccacgatccgacataagcttgccaaggacaggacctcgtggcacccgggacaggggccaccccatcctacatgtgacaaagctgtccctccgtggagctggcgtctctgatttcctcggcctgagggaggcagtgaagatgaaggaaggagggagggcgccttggtggtgg

SEQ ID NO: 197813 - DNA, 856 bp, Homo sapiens
ttgaaccccaagtttttaggtgaatctctccagggccccaccccgtgcccccagaccttcctccggttcccagagattctggcgccaagccatccgtggctctcatgagattatcctggggaaatttagaagaattttgtggcccgtccccagctgtgctgataatttttaacaccctaaatgctactacccataccttttggtaaatacccggaaagactggctgggcccggtggctcactccctagtctctactataaaaaaaaaaaaaaatacaaaaaattagccgggcgtggtggtgcatggctgtaatctcagctacttgggcagggaccatgtcagcctcccacaagacacacacgggaaagccctgcttgtgagggcgccacacccagggcaggaatcagaatgaagacacgactccacagtgagcacggggctcgggacaggacccagcgtggcagaccagccagagaagctttcacactgcaaacagcccgctccacctacaccccgactgggctccacgactccccgcaagtgccctgccacctcaggcacctgcccccacgcccactcagcgtcaccccctcggcggttcatctccagaaggcttggaattgatgacgtttccgcaccacgaggggcttttgcgattctgcgtcactgaacttgcatctcatccccacgatccgacataagcttgccaaggacaggacctcgtggcacccgggacaggggccaccccatcctacatgtgacaaagctgtccctccgtggagctggcgtctctgatttcctcggcctgagggaggcagtgaagatgaaggaaggagggagggcgccttggtggtgg

SEQ ID NO: 197814 - DNA, 576 bp, Homo sapiens
ggtggagccaggcagggaggcattgggaggatttagccccttgtaatacctatcatctttgcccttccttctcttttacggactactgatgatgcagtcagtgacagtgctgtgagtggggtgcagtgcctcacacctgtaatctcagcattttgggaggccaaggtgggaggattgcttgaggccaggaattcaagcccactctgggcaataagcaagaccccatctctataagaagtttaaaaatcagcctggcatagtgttgtgttcctgtaatcccatatactcaggaggcctaggtgggaggatatccggagcccacgaggttgaggctgcagtgagctgttatcatgtcactgcactccagcctggatgacagagtgagaccttgtctcacaaaaaacaaacaaacaaacaaagaaacggccgtgtaaacacagcctcaatcacccattctttccaccagcttgcacccttagctcagaccaggggtccacacagaaggcagggattctagtgatgaggaggttggaatgatagagctggagaaagggcaatatctggcagagagggaaa

SEQ ID NO: 197815 - DNA, 742 bp, Homo sapiens
tacaagtgggtgttgctggaggctggagtttggtctgatgttggcctgaaatacttttctctcagagagcaagttagccttatatctgactacaagtaggacaaggagtgaatagagcaagcaagcacaccagcgttccactactttccttgagtttttcagcgctctgctttttttattttggtatttttttttctattttaatttattctttctttcttcttttcttccttcctccctccctcccttccttccgagtttcactcttggttgcccaggctggagtgcagtggtgtgatctcagctcactgcatcctctgcctcccaggttcaagcgattctccttcctcaacctcccgagtagctgggattacaagcacccgccaccatgcccagctaatttttgtatttttggtagataatggatttttgccatgttagccaggcttgtcttggactcctggcctcaagtgatttactcaccccggcctcccaaagtccttggattacaggcatgagccaccttgcctggctggatttttcatctttcttttagctctttatttgggagtgtaaatttgaaaaataaaagaggtttatgcaaaacaggcaatgaaacaagaagaattgggtttggagttttatatctacttctattgttaaattacagtataagccaacacaagttatttccactgtaggttttggtatccttgtgtgtaaaataaaataaaaagctgat

SEQ ID NO: 197816 - DNA, 132 bp, Homo sapiens
cctcagtggatatagaagtgctaatatctctttgagattgtgatggtgattcttaggataaatactcagaagggagattgctgaatcatacggtagttttgtttttaattttttcaggaacccacatatttt

SEQ ID NO: 197817 - DNA, 389 bp, Homo sapiens
tggaaacctctgcatcatgagagccaagtggaggaagaagcgaatgcgcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctg

SEQ ID NO: 197818 - DNA, 366 bp, Homo sapiens
actagcctatcgctgcaggggcgccacgccggagttctacggagcatatagaagtaacatggactgccaattccggggattagggtatgtaagtgtgctgtgtggtcagcagtgtgcaagggcatgctgaatcttagagcgaaagcgtatgatcactgcgcccgcatcgataaagggatggccatggctagggtttctagatagttgggtggttgttgaaatggtcgccaatccgcggattggcgcccatttcaagggaaacaagcagggtacagcagcaataggataaggaggcagaggagcatatatttacacaggtggtttgggaaggcctctctgagtaggtgacttttaaatggaaatcta

SEQ ID NO: 197819 - DNA, 599 bp, Homo sapiens
ttggtctagaaagtttttaggtacaattctgtgtggctaacaaggcaccagttagcatattttgagcttgaaattgtcctaataaattctctaaaaacagcaaataagcataatagcgttaaggtaggtgtcagtgagtttctatgccaaggtaggaataatgttttaggtaccaaagccttttgtccccattttccatcatatgaacaggattccctgttatttaggcaatgatctattatattacccttttcctataggtgtgagtggtggtccagatggagaagttcaatagttctgattgcagatcctatgcaggagagataataatctttgtctcctgggttaagctaaggctggcaaagagacaaatgtcccaagccttctaacaaccagtggcatagtttatgttgtcctggatgctggtctggttgccaaatatggggaaggaaatgaggggctatataggaggcaagccagaggcttatatcctacgtggtaatggtcatgaagggaaaagaaaaaagaagcaaaaagcagcccaagaaatcacttattttctaacaaagagcagcctgaaagatcgagctgcagacata

SEQ ID NO: 197820 - DNA, 481 bp, Homo sapiens
acagctgctgcttcttgaagtaagcgtcagcaggatgttttgggatttttacattgctgattatcaattttggttgaggtggcagtgacagatttctggcgtgttctttgtagaggatcttggttgaagaccggaggtccagtcacaagtaacaagccactagccagcagcttcaggaaaaccacccttttgcctctgtggtgctcagtgagggtgatcagaatggtcccaggggtgatgctggctcacagttttctcatgtgctgactgaacggtttttttgccgtggctcaacagcttttgaggcacatcttcagtaggataatatctaggcattttgcgatgtttaaccacctgggtaccaccgttcttgtcaccaccaactggttttgtaatagttgcaagaacttctttttcttttcaaccttggattcagcagctgagtgcttcctcttgtacatggcctttctggaatacatgg

SEQ ID NO: 197821 - DNA, 702 bp, Homo sapiens
cgaatatttttgactgaaaaattaatagcttttgaattcatacacagcaggttttcttttgcaaagaagtccaatatcgctgcacagcacttctataaccatttatttagagtccaagtcaaacctttgacagctagagcagcgctacaagccaatataaagaactccaagatgtaaaccaacaataggccgtctgtgtgaggtttgccattgtcaaatacatagattgtttggattagtttatgtaaatgtactgttgtattaccctttgaaaaaaaaaaagatcacatttgtgtatgaaaagtggttcccttcacaggcagcattataaattccttatcctttaacttacatgtaagaagtaaaaattggtgcctgacaagcagatattgtgtgacactctgttgtcggagtgaacctgccttcttttcatttattggaaaatagaaaattttattaaagataccatcttataaatcaggaattattaaaatatgtataggtgaggcattgggaaattaattataaaaggtagacgtgtaatgttttgcataaattttcacttctttgccaaaaagaaaaaaaaaagggcacacacatacagcaaacccttgatgctttcaactttaagggcccagagctatctggtgactgattctcatgtgcaaaatattccctgcagtctgtaattaatttattccg

SEQ ID NO: 197822 - DNA, 416 bp, Homo sapiens
gtgctgtttcccagagttctaggagagaccagagatggctcttagcaactgctgctgctctgaattgttattgaacacttctgcctcatacttcctgccagctgaagagatgggggagggaatgttgaggaataaacaagacagagccttccagctcttgcctgttcccttgcctttagtttgattgatggattgttaagttagggatggaaggggaggtagggaggagggcaggcgcctgtctgagtgtcctgagcttagtgcttatgtcgccactctgacaggcaagaaaaaaggaatttacaaaccacagatggcaacgatctatctgtgctgactttgtcagggcttacgaccaggagtttaaggtgagactccttcttttcccccaaatcatataaaataaccaagcaacc

SEQ ID NO: 197823 - DNA, 421 bp, Homo sapiens
ttggatgaaatcaaataatttagtaacagtttgaatgaatttcataatctgttttcagagtctactgctcatttaaattcagcctcccacccccatcagttagggctcatacccacagtgtatcataactacatcaattattatagagtacagtgtttccagagcttttaaagcacaggtagtaggtttccagtaaattattttgtgctgctgaatgaaatatggccttaagagtacataaattgctgattgtctttttaaatgacattttcttcaactcactgaggttaagaccagtgatggacactgatctttttcataaccttttcaaaaatgtagccagacaagataggctgttctgtttggaaagggggcggggaccttgattctgtttgaaactattaaaaaggcctcttgtgca

SEQ ID NO: 197824 - DNA, 1264 bp, Homo sapiens
atatatatatatatatatcttcccttttcattgcaatttgcttattatattatttgcttattatatcaacttgcttattatattgatttgtttattatatcatttgcttattatatctgcatcgccatttacatgggataaaggttgtttatccctaaaggcattgtgtatgtgtcttttcttctccccttgcacgtttcctgcacagaacaggaggaatagaaaaaaaaaaaggagaggggaggggaggaaaagggaggggagaggaggggaggggaaaagagaaaatcaaaatggaccaatgactagtgtttggaacactaaaccccaaattaagtcttaaaatgactgaacattctgagataaaagtgacacacacccatccccaccccaaaagcaaaaaggacaatgtaagtgacagacagaaaagaatgtggagactgtgacatggaatcccttaatttctaagatcgctcattgttctgttggaaacagagggttaggtaagtgtctaagacagagccagtgcacaagtgagtggtagagagagtgataaagcatctcctattttgaatgagatcttctgtctcttctcatacatatcccaatccacaacagcgaaaaagtaatacgtagattcattcattcagtgactcagcaaatagtaagtgccatgcattttccaaaacattaataatacaattgggagcaaagcagacaaatgtcccttgccctgatgggagaacacaggcattaaataaaataagtagatcaaaatatagtatatactaagtgatgagaattgttatgggaataagtaaagcaggtaaaaaggaatgaaggccctctgtgaaggaggatgctgtttaaaataaggcgaaggcaggcatcttgagacagttgcatttcaacaatggcctgaaggaagtgaagggcacctgagagaaacatgttccaagtagaggaatcaagcacaaagctcctgaggcaaggcttgtggacttgtagcaaaaaaggccaatatggatggaccacaacagggaggagagcctgcaggtaaaattggagacatagtgggagctggccattttaagaatttagacttttatcatgagtgaaaggaaaagaactgaaggagttgggtgtggtgtttataggatgtacacaacaaagtcatcgcttagctgctgtgttagaagtaaaccataagtgagccaaaggcagaagcagagagaccaggtatcaggctgtcaaaaagaaaaaa

SEQ ID NO: 197825 - DNA, 569 bp, Homo sapiens
gaaaacttcacactgcagcatatgggaccaggatcctggacacagcaaatgtcagccccaacccccatgtcccccagatctgtatttccagcataaacacaggctggttggaggaaacaggctgcatttagacacatcaaaggaacttgaatgccagaaagaaaatagagtcctatggctattagagagggaagacatccaagaaaattgtcatcagagactgtatccagttgagcaaactcgtctttcaacttagtaagggactggaagttccatgaaggacagcgattgtctaattcttttcctttgcacccaaaagagcctggcacatgcagctggtcaatgtgctgaagagaaggaaagatagtctttcaggactatacggagaatttcgtcaagggtcatccaggaatgaaaggcttccggcttcaggaaagaattttctatggtagtttcatcacacactttttactaccaaatcctcagatactcataaacagtaaacattaaagctcactctatttttttttatttttctaaaattaaaaacactatgcagtgcccttaat

SEQ ID NO: 197826 - DNA, 253 bp, Homo sapiens
caccgtgttggccaggctggtctcaaactcctgacttcaagtgatccacccgcctcggcctcccaaagtgctgggattacaagcatgagccaccgtgcctggcctctttcccctttttattagtcatcttggaaatgtattcctggacctgcagcagattatatgaaaaagtaacagccaaataatattgataatgatgggacttgccatcaagctttaaaatcttctaattaattctttttttttttttttt

SEQ ID NO: 197827 - DNA, 405 bp, Homo sapiens
ctctgtatatacatttcacaacttttacctatttcacaacttaagtgcctgagatgatagtttcattctctaagtctacttaaatatgaagcatgcatttacaattagcaattacaaatcattttctacttttcttttttcacaaaaataaaaccaattataggtaaataaattacctttcctaccacaacccatagtgattatatatgtaaaccaatcacgcttctgaaacaggagacgcaagaaacattttcccaaacactacaagactaataaaaaaaagtcacagcaattccttatcactgaatttcaagattaaatacagaaagacaaagccttaaactatgaatatgcctgtaccattgttgcttcacatttctttttcttaagaatgatatacaaatt

SEQ ID NO: 197828 - DNA, 501 bp, Homo sapiens
atgccagagtcttacttcaaggagcccacagacagtaagaaaggcagacaagtcaatcagcaatcaccatgtagtgtgctgagtgtaataataggaagtacataggtacaaggagctgtgggtgcacttgacctagcctggaactgagaggagagaagggaagaggtattgaatgaccaacagttgatagttttacccaaaccttgaaggacaaatagaaatcaagccaagtgaagacaatggagaagatgctgcagagagaaagaaaagcatgtgcaggcgggtcacagtggttcatgcttataatcctaaatttttgggaggccaaggaaggaggatcacttgagctcaggagtttgaggctgcagtgagctatgatggcaccactgcactccagtatggacaacagagcaagactctgtctctgaaaaagaaagaaagaaggaaagaaagaaaagaaaagaaagaaagagtgaaagaaagaaaaagaagaagaaaaac

SEQ ID NO: 197829 - DNA, 238 bp, Homo sapiens
cagaaataagaggtagagttgactggtaacacccttttctgaatgctctgatggcattgctgagaatccccagacagccccagggatcctgttcagggcgcccatggtggagcaagctcagtgaatgcccagtcacagctgggcctggacagggtgggattcctggctcctttatttaaaagggcccccaacttagaggtaaagaaagaagtcgatgaagtcccttttgcattttgca

SEQ ID NO: 197830 - DNA, 518 bp, Homo sapiens
cagccttgctttagacttctgttgtggtggcaaagcaagacattaggacctgtacaaacccaaaaggatcctggggaaaacttaacctcaagaaaccagagttggttacatgatccaacactcctcacttacagactttttagccaatctcggaggctcagcgttttgacttcctgtacagggatagcaggtttcccatacagaagtgaactaagatgaaagcagtgctatgaccagtaccccagataaagacagtgtggtactatgcactctgctagaggtggccccacctcattcgcctggtcaacagacagataatttaattcaccactgtaaaaagcagtggttctcaaaatggggtccccagatcagcaacactagcatctcctggaagcttgttagaaattcaaattctcaggccccacccaagacctactaaatcagaatctctgggagtggagtccagcaatctatattttaacaagctctctaggtgattcttgcgtaaagtttgactc

SEQ ID NO: 197831 - DNA, 416 bp, Homo sapiens
gggaaatgttggtcctcaaaccacacgctgtcacatatttaatttgttagatagttaacatagtagctgtctgacttaagagaagttgtgaaagttgacagagtaaacagagtcttgtacctaatgaatttctatggcatcttcttcatcccctcagtgaccctcacaaccttccagagatagttgtcagtggagaagcattcagagtaggaaattaaaatgaactttgctgttcttcttttagttgctgtgtatttgattatccctaaaaatgtcagaccactctcagaaagtcattatacttttctaaccatttaaattaatatattaaagaggtcttttttgttaatatttgtggtcactattgcaatgcataccattattctgaaggtcctactcaattcagtaaggcaaaa

SEQ ID NO: 197832 - DNA, 139 bp, Homo sapiens
tagaaataaaggctgaatacagacttaaaaccaggaatccagactaaacactcaaacatggagtccatcgtggccccagggcctttgcgcttggcattctctccatctggaacactctgcccattgtgttagttgttct

SEQ ID NO: 197833 - DNA, 496 bp, Homo sapiens
atattatgcaatacttgccatagttttctaaaagctgaactcagaatgttaatgaaattaaaatgggaaagctattttgcttagaagatattttgttataaacatttcttaaatgaagaggctctagaaatatttattttatagaatttaaaatatagccatcactaataaaggcaggcataattccaacgatttcataacacatcagttattaaatctaattaatatataaatgtaactaatatgtaatttaatataaccctaattcaatgtttaaccaactgaagctggttaaactatgaagaagaatcttcaaattgaccatttctttccaagcggtaaaggtgatacgggattttgtctatacatatagagcaaaggagaattaagccaagatttagaattttaggcaaaaagtgtttatagtatcattaagtggttacatatgtaattttactgttataaatatgactgagtcaatttttttttcaaagat

SEQ ID NO: 197834 - DNA, 412 bp, Homo sapiens
gagacagcttgctttctctctctttgctctctgccatgtgagggagcaacaggaagacagccatctgcaaaccagcaagctgactttcagcagatgctgcttctcctggcaccttgatcttggacttcctggcctctagaactatgagaaagaaatgtttaagatttccagtctgcaaaccagcaaatgggccctcaccagacactgcctgtcctggcaccttgatcttggacttctcagcctccagaaatgtgagaaagaaatgttttaagtttcccagtctatgagaatttgttagaacagaacaaactgactaagacactcactaacatggtatattaccaatctcttaaattttgccagtctgataggtgaagttactcatctttatacagccatttcttcttcaaaa

SEQ ID NO: 197835 - DNA, 160 bp, Homo sapiens
cagctactattgctgcacaggaaacaccccaaaacttagtggcacaaaatagacatttatgatactcttggatatagaattctctgctggtcaagaattcagacgggacatagtaaggatagtttgtctctttgcacaacgtctgggacctcagctaggg

SEQ ID NO: 197836 - DNA, 332 bp, Homo sapiens
aaacatgacagagtggaaggaagatctgcttcggagtgagtctggactccacatatactcattgtgtagcctttggtaagacacttaacttctttacaactttcccatgactgttcatttgtaaatgcgaatggaaatttacacactgcggagttggtatgaagattgtgactaatccaggtgaaattttctggcatatagtgagttctcaataaacattagccatcagaattagttgttcttgttaatgtggcggccacctgcttctcttgcatccctaggcttgggtacttttgagaacagattaggtactaaataaaggctggctgact

SEQ ID NO: 197837 - DNA, 659 bp, Homo sapiens
aacagcttttgccagagagacttgatccaaggaaacagcaaagcagataggaccagtttgttgaagtgagtttggttcctataacttcattaattggatgtgtcagcattttgaagtcttccaggaagaatctacatggtttaaaatgcaaatgtactttaattcacaggcttaaagaggttctgtatttggagacatttctgatgatcgtttgacatctttctattgaaatagctctagtcaactggataaggagatcagggcctgaactgtaagcccatgaaatgtttatttacagacaaaccaaatacagcttatatatccttttagaggcaacatgaaaaatgcaatccagtaagaatcactgtcttgttttaggaattttgaggtaaagattgttgtgtcatgttaattaattgccagttgagccaggagttttgaaataatgctttcacaggctttggactcaataatttaaattttgggctgtaagtcagccgcttgcatggactgtttaatgtcctttacacacaaccagtggggtatgtattatatctattatggagatttagatcttctgactgttgaagctagaaaacaacaaagcatttttagtctggtcagcgtaattttttagggaatatttactgcattgcgtc

SEQ ID NO: 197838 - DNA, 443 bp, Homo sapiens
ccagcccctctccacaagccggtgaccccatgactgcaggggctgccgccgccagcaagtgagctcagctcagcccgggcgtcccctccgcaacgaggcccggatccctgcttggctcccggagcccggactgtgccttccgcaaaacggctgcgctctagaaagtggcctccacagtgcacttcccggcagcatggagtcggcagtggcagcgtttctatccggctctgcggggctgggtgtgaacgggactctcccatcccgctgtcctccaggagccggacctctcaccccgaagactttgccgaagacgcggccccctggtcaggggcagaaaacagatccaggccgccccgctcctgctgggtggtggagaaggtggagggcgggcaggtgctaagtgctactgtgaaaataaaaatcatcataataaagaacgaatg

SEQ ID NO: 197839 - DNA, 1052 bp, Homo sapiens
cctcacagccctgagtgagggtgtgcagcctccttgggcaagaggatgcgggctctgggaggctgcgtcgcacatctccagtccccactgcagggcctctcaccggctggggcagtgacccctggtcggaagcacctcagtgctgctcatgattgcagaggtggcctcaccagatagagggtcctggagggcgtgggggcttggtctctgactgccagcaaaagaagccgacatagaggcagcaggcgacaaacactgaggcaactgacttgcccgaatttaaccctcaggttttttaaataaaatgcaagtgcaggggcttgggctcgggactcctggagccccgtggggctgagcgtggatggtgctcggtgtccagctacactcccaaaccgcatcccgagcgtttgcggggcggaggggcccagggcgacggttccagaacagacccaggcggctccggtcagcagcagccccgctgctttccaacagcgcggggacccccatccccgccagccccatctcactgtccctctcaggtcagaggagaccgtagaggaccgcgtggcaccaggagctgccaggaaccagggcgacctagaagaaaccgggaacctggcgtcccgcggggacgcagccccaggaaaggggctgccgccgccagcaagtgagctcagctcagcccgggcgtcccctccgcaacgaggcccggatccctgcttggctcccggagcccggactgtgccttccgcaaaacggctgcgctctagaaagtggcctccacagtgcacttcccggcagcatggagtcggcagtggcagcgtttctatccggctctgcggggctgggtgtgaacgggactctcccatcccgctgtcctccaggagccggacctctcaccccgaagactttgccgaagacgcggccccctggtcaggggcagaaaacagatccaggccgccccgctcctgctgggtggtggagaaggtggagggcgggcaggtgctaagtgctactgtgaaaataaaaatcatcataataaagaacgaatg

SEQ ID NO: 197840 - DNA, 135 bp, Homo sapiens
gacagagtgagactccgcctccaaaaaaaaaagaaaactcaaaaaaatttttaagaaagaaaaaatcacccataatcatagtaaaatgttcctacaattttgatatttttggaaagaaacgtttttaacgctttg

SEQ ID NO: 197841 - DNA, 648 bp, Homo sapiens
catatgttcctgattcttataactgtatgtgtagtcaaccgtttttgctccaaaaggaaatttaatctggttaacaccaaaatgtgactccaactgccttttcttagttctcactctcaatgacctccatgcagcacttgatagcatcaacccttatgtacttttggaagcgcttttgtccgtaaatgcagaaactacatgattcttcctcttatcttcccggctctcttggatttgctttgccctacactgatcttcccttctccctcttggtcttccgcaggagctcaaataccaagcctcactcctacctttctgtaagtttttctttcttataatgatgattttcattacaaagctcttcttacacgatttaaaagcatattgttcatttaataagcaaaacagcttccttgtgtgttaggtattttgtcctgtctttcctctacaccatgaagcctctgttgaggtgtttatttccacaaaggcaggtgagagacaagcagagttaagaatatggtttgggctgggcgtggtagctcaaacatgtaatcccagcaccgtgggaggccgaggcaggcggatcacctgaggtcaggagttcgagaccagcatggccaaaatggtgaaagcctgtctctactgaaa

SEQ ID NO: 197842 - DNA, 478 bp, Homo sapiens
cttcaagaagtcttagatagtcctgccattagtagggatctcagatgggagggcaccaatgaatcagtgtagttgagtaccacttttgggagaaaatagaaacttggacactctaaatgatagtttaaggacgttgtttgttttgttttgttttttgtatgggaaaagttggcttagactctttagttcagcccttcaagttgatgtgtaatttaagattgtttaggaagttaaaaaatctaaagccctgtggatatagttcattcagtgcagtaattatctttcagatgccaagtacagcattaattctttagctttagcatggcactgattttcttaacacttcatgatcacgtggagcagactgtgctttacagcacaacagagcgtcagccatgtgctgaagattcttcgtggtagtggtttagatccaccctgaatagattatcttcatttatttaattattaagtagcttgc

SEQ ID NO: 197843 - DNA, 295 bp, Homo sapiens
ccccaggcctggtggggaaatgggagggagcttgccactggagggccctggggtgggggctgagcagcgagtctctcccagcccccaggtcctcacgcaggaggcagctgggaaccacccacgctcatctggtgtctctcacgcctccactgggggtcccaacatcagagccaaggcacacagtgaagccggtgttccggagagcccagctgtccccaccccaccccggctcctcagttcctccagccgagacctccccacctgcctccaagcaggagggactaaggctagactc

SEQ ID NO: 197844 - DNA, 541 bp, Homo sapiens
cgccaaaggagaatcactcagtattgatttattggttcctatagtacatccacatctaaaacatcttggggtcaaatgtgttttagaattcagaagtttttaaattttagaaatacagtacatgtactgtatattatgaaacatctcaccagagtgtgaggaaacaccctgcagtcaaatccgttaatgtttctgtagcaaaatataaaaaattcataccaagcagaatttgaaaacaaccccacaaaactacgaatatctgctatattcttacaccagtttaggtcaggttttgctaaaaaattaccttgcactaaacataagaaaatgtttcagtttttgaaactacccggatttcagaagtacatataaaagactatgaagttgtactcaaagattatttgtggccaggtgtggtggcttgtgcctgtaatcctaggtacttgggaggctgaggtgggaagacagctcagggccaggagtttgagaccagcctgggcaacatagcaagaccccatctcaaaaaataaatttaaaagta

SEQ ID NO: 197845 - DNA, 265 bp, Homo sapiens
tcagtgttgatgtatgtgttgtagtttatactgtgaaggcacttgagagaaacgctcaagaactgtgtaaggtgagcagtgggctgtgatgggagtgtgggcaactccagtgttaagggatgggtgaaataggaggagcccaggaggagtctgcctaggaaagatcagggaataacattataggcatccataggcatagcagtgggaaagcagcaaagaggcctggtattttaaatactgaaaaggacctatggttaagggaaag

SEQ ID NO: 197846 - DNA, 788 bp, Homo sapiens
gacagtacactccttggcaaaaactggaagaaaaagattgttatcaagcctcaaatccaaaactgacaatatcatagtgtttaaaactggaggtggggggagaaagacacacacaggcctccatactagacagcacacttcggagttgttttcaaaggaaacataacctcctcctcttgcctctcccacccctggttcctatcagcaaatgactcctaagtcacctgtcagtgtacccctgcaatccctctttcatcccagccactgcgactgagaattttaaagaagggggagaaatcagagagtccccagtcggtcacgttggttactcgggcacacacccccacggcttccctgtccagggcaacaccttcagaactgcaaggtcgccagaaatgtcaccataaatgctacttacttgggatcggccactctctatttaggccaaatactaagtcctgaattttgaaactgcatactcaatgcctcagaagcatttgaaactgaacgtttacaactatgtaggtgcaaaagttgcacatggagcgttcatcactaatctctccacatgacccaatttggcctccaaagcggaaactgtccacaaggatggctgtcatggctaccttagatcagttcacctttaggaacaaaggcccgtattccacaggtagagaggacacgaatactcctaggagcagtgctcagggatgtgaaaggcacagccaggagagatgcacctgaaggctgctgtggttcccaggtggcagcacgcggccatgccatca

SEQ ID NO: 197847 - DNA, 1038 bp, Homo sapiens
attacatagtgcattctgttagttgcttcctttgtgtagaagggaatttgcttgtgtggaaataatccagatttaagtaaggcaaaataatataccaattaagatcacaggttttagcatcagacctgggtttcaggaataagactattcaataactggatgaccttggacagcctactcactctattaataatctattaaacagtgccttgccaggtgtggctcacacctataatcccagcactttgggaggccgaggcaggtgtatcacttgaagtctggagtttgagatcagcctggccaacatggcaaaaccccatctctaccaaaaatgcagaaattggccaggtttggtcatgcacacctgtagtcccagctactcaagaggctgaggcaccagaatcacttgagcctgggagacagaggttgcagtgagctgagattgcagcactgcactccagactgggcaacagagcgagaccctgtctcaaaaaaagaaaaaaaaaattaaaacgagccttaaaactgttagggattgtgttacagaattaattcaaatatatataaagtgctttacctcggtttatagcacatggagtgcagtcagtttatggtagttaataacttctaaagcaatccagttaggggacgtattgaattcaggcacatattgacattgattatttagtgagtgaaggaatgaatctatgacagtagttctcttaagtttaatgtgggggacttaattaaaagttagggtccggctgctgtggctcatgcctgtaatcctaacaatttgggaggcttgggtgggcagatcacttgagcccaggagtttgagaccagcctgggcaatacggcaaaaccctgtctcaaaaaataaaaatattagctgggtggggtagcatgttcctgtagtcgcagctacctgggaggctaaggttggaagatcacttgagcccagaaggtcaaggctgtggtgagccatgatcgcacgactgcactctagcctgagcaacagagcgagaccctgtctta

SEQ ID NO: 197848 - DNA, 316 bp, Homo sapiens
tggcatctccatggggacaatgcccgcaggcacccccatttcacagataaggaaagcgaggcccaggggtgaaatcagttgcccagggtgacacagccaggaagcagaggagctgggatttgaatggaagcttaattcaggagcccgtgagcctccccagcccctcccaatggtgacagctccttttctgcttcactctgagcacctcatgtgtgcccagccctgggctgggacacagcagtgaccgagacagcccattcctgccctcatgggggtcccaggtcaggcacagtggctcacacctgtaatcccagca

SEQ ID NO: 197849 - DNA, 832 bp, Homo sapiens
agcaatggtatatgcaacatgagagtgtgcagtagtatagagagtgacactggaggatataggtcctgtcacatctattgcataaagatgcagtgtggtgagaatgtctgggaactcgctgtttgtgaatcgccacaaaaaaagcacaaactaccaatgacagtatatattatgttcatttacttacacgcatgcaaaaggccataatgttggtagatgaattaatagaaaacaagccccccccaaaaaataagcaagtaatttctgtaacatcgagttctgtcccaacagtatctgctctgaatttggactgatgtagctactttccctctctgcctccttctctcccctgttcctgccctctcagacaccactgctacgagaagagtcttcctgcagcatgattcccatcaccacacctttcccctcccctccttcctccagcacttcagtggctccctattacctgtgggataatggccaagttccttgttcttcccttcctctgtgttctcaaagctttttctcctcctttccaatcagttttcttcactgtccataaggattcacgagcattttctcttcccgctagacataagctcctcaaggacaagacctaagtcttgcccagttctgccttctctgcagtgccttggtcttgtactcactagtccctgctaagcatctactatgggctgggtgcttaggatacagtattatggcagagctagtccctgctgtcctggagcttatagtctagtgcttaaaaatgttcatccaataaatactaaaacttggccaggcgcagtggctcacacctgtaatcctagca

SEQ ID NO: 197850 - DNA, 625 bp, Homo sapiens
tgggggagcctccctgtggagtgacgtctccatgccatgaaattgccagccctgggaagtcatgaggaagaacactccaggcagagggcacagtcaccgcacagctctcaggcaggaacaggtttgccttgtggaaggctgctggggaggagaggggagcgggattggagaagggtgctccaagagccagaaaagctagtcaggaggccacagtgaggggtgcaaactcagttccaggagtgacaacaagccctctggaaacctcccagatgtcccaaggtccacccctggcccactctcactctcctctctccttgtcgcccagcctcactctgggaaggctggggaggattcctaaatctggtctgaactcctgaggctgaagccagagctggtgtggcccccaagtcatatctcagggtgggagagagtccttccatcaaggaggcaacgctatgagggcagctcagtgctcagcccacccctctaaccctcatgggcgggccctcaatcagaaaccacaaattccaggctcagtcagggaaggcctggatcctccacttccggctcctcccggaagtcagcttaaagaaatgatgcggaggaatgatcactgaagagactc

SEQ ID NO: 197851 - DNA, 598 bp, Homo sapiens
tgtaatactctgcaactactaaaatcctatagtatcatggttattgacatgtaactcttttaatggctttctttcctaagctaagaaaaatacaaacatgattccacataatgtatttcaaatatttgtatacatttttctacttttctatattttccacacatctatatataatttgtgtgtgtgtgtgtgtatgcatgcatgtaaataaaatatacctctaagtcttgtaaccttaagatggtggggcaaaatatttttattttctgttgttgattatttaaaatttagctacattaaattttttctgatttagtaaacatacataaggcctatttatagttgaatggcagtcttacaaaacctaagcaaccttagtttacattatctgtgggaaaagcatttttagtagaatgcttgcacatcttcctacattcctgtaatcaaacagtatttatcatcaactatgttggtgactctcactttgacataggctgaaccagaaatcctaggaaaaactgatgatagaaagctaaggggaaggacaggaagccgggaaacccttccagtagggagagtggatcctctagaggcagcc

SEQ ID NO: 197852 - DNA, 847 bp, Homo sapiens
tgtaatactctgcaactactaaaatcctatagtatcatggttattgacatgtaactcttttaatggctttctttcctaagctaagaaaaatacaaacatgattccacataatgtatttcaaatatttgtatacatttttctacttttctatattttccacacatctatatataatttgtgtgtgtgtgtgtgtatgcatgcatgtaaataaaatatacctctaagtcttgtaaccttaagatggtggggcaaaatatttttattttctgttgttgattatttaaaatttagctacattaaattttttctgatttagtaaacatacataaggcctatttatagttgaatggcagtcttacaaaacctaagcaaccttagtttacattatctgtgggaaaagcatttttagtagaatgcttgcacatcttcctacattcctgtaatcaaacagtatttatcatcaactatgttggtgactctcactttgacataggctgaaccagaaatcctaggaaaaactgatgatagaaagctaaggggaaggacaggaagccgggaaacccttagacagacatgttgaacgccgacgttccaggtctccaaggagatctctgagtccacggaggtccccaagaaggtcaagcagtagaagtcatcactcgggagggccatgggtcttctagttttgacacgagacttacgacagacgacgaaagaacgccagcgactagagcgtgaagccacagaaagggagaaagaacggcgaagatcccgaagtattgcccgggggttagaacgcaggcgcagcgaagtagggaaacggcctacgacacgtcgccgctccgac

SEQ ID NO: 197853 - DNA, 1092 bp, Homo sapiens
tgtaatactctgcaactactaaaatcctatagtatcatggttattgacatgtaactcttttaatggctttctttcctaagctaagaaaaatacaaacatgattccacataatgtatttcaaatatttgtatacatttttctacttttctatattttccacacatctatatataatttgtgtgtgtgtgtgtgtatgcatgcatgtaaataaaatatacctctaagtcttgtaaccttaagatggtggggcaaaatatttttattttctgttgttgattatttaaaatttagctacattaaattttttctgatttagtaaacatacataaggcctatttatagttgaatggcagtcttacaaaacctaagcaaccttagtttacattatctgtgggaaaagcatttttagtagaatgcttgcacatcttcctacattcctgtaatcaaacagtatttatcatcaactatgttggtgactctcactttgacataggctgaaccagaaatcctaggaaaaactgatgatagaaagctaaggggaaggacaggaagccgggaaaccctgggaaaggagggattatattacacatgttatgggaactagtttgtatatgcggggcacagagcatacacttagataagaagggggtcataaaaccagaaaggcaataaatagaatgttatgagcatgaactctagatgcagactgtttaggttcaatcccacctctgcttcttactacatttattaccttaagcaagtcacttaacttctccctgccgtttctgccccatctgtataatggggataacagaccctaccttagagggttgtcacactaatgaattctgagaatagtgcctggtactacagttaagtgctcattagttgtccacactcatcatcgtcattactcctattactatgacgtgaagagttgtgctgctaggacaggagcagcaacttttcaacaccaatcacttttttagatggcctcctttctagccttgttagttgcccaaattctgaaaaaaaaaacaagaactaagactctagaaggagatccgagaggcagacatgtgtgtctgtgtg

SEQ ID NO: 197854 - DNA, 376 bp, Homo sapiens
ctgatatttatacgaagaaacaaatgaaagtgttccacagtgaggcctcctactctactctgccagattggtgactggaatttggaattttgtttacaaataaaacttaagttgcaatattctttagagggcttctgttggattactctgtagtgaaatgttacacggtatcttgtgagagcagcagtagaaagaggtcctgagatcaaggacagcctgtgatgctttatttccgtgggaaccaccattcttggttacttatagtatcagtaaattaagagtatttgctttctagcgtcctttgtcagtgacacgatttccaactgaataattaattgacttcaccgttgctttgaaagtgaggtctttggtgcat

SEQ ID NO: 197855 - DNA, 431 bp, Homo sapiens
gctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaatttcttggtggaaagatgggaaggaattgcttggggcacatcatgcaattacacagttttatccagatgatgaagttacagcaataatcgcttccttcagcataaccagtgtgcagcgttcagacaatgggtcgtatatctgtaagatgaaaataaacaatgaagagatcgtgtctgatcccatctacatcgaagtacaaggacttcctcactttactaagcagcagcagcagtacgggtcgggagat

SEQ ID NO: 197856 - DNA, 94 bp, Homo sapiens
ctgggattacaggcgtgagccaccgagtccaccctattgtcattcttaaatagttttattatttccaataaattttgttctgctgaagcaagag

SEQ ID NO: 197857 - DNA, 287 bp, Homo sapiens
acatttcaaaagtaaaggcggaattagacaatgctgtaatcatagttggtgatcaacagagtttataagcatacctctttcagcaattgatagaacatccacacagaaaatcagtaaaaacgtaggtaaagagctaaacaactctaccaactatcttgacctaactgatacttctagaaacaccacactcattggccaggcacggtggctcatgcctataatgataacactttgggaggccgaggtagtaggatcatttgagcccaggagtttgagaccagcctggg

SEQ ID NO: 197858 - DNA, 521 bp, Homo sapiens
tgaattaggaggtggttctagttttaatttttgaggcacctccatactgttttccgtaatggctacaccaatttacattccaatcaacagtatatgtgagttcccttttctctatccccaacatttgttatctttctttttttgataatagccatcttaacaggtgtaaggtaatatctcattgtagtttgttttgccttcctctgatgattagtgatgttgagcacctttttatatatctgttggtcactgtatgtcttctttgaaaaaagtgaatattcagagctttttgccgattttaattgggttatttgttttttaattttttttcataataaaagctctcaacaaaataggcataggagaaatgtatctcaacataataaaggtcattaattaaaagtccacagataacttcatactcaatggtgaaaagctaaaagtttttcctctaaggttaagaactcttgccagttttatttaacatagtgctagaagtcctagccagagcaatcaggcaa

SEQ ID NO: 197859 - DNA, 312 bp, Homo sapiens
taaggagtctatacaggtaggattagaaatagagatgggaggccaggtgcggtggctcacgcttgtcatcctagcactttgggagtccaaggcgggtggatcagctgaggtgggagaatcgcttgagcccatgaggcagaggttgcggtgagcagagatcttgccactgcactccagcttttgtgccagagtgagaccccgtctcaaaaaaacaaaccaacaaaactcccaggtaggtcttttgtaactcttcctctgtccccaattcaacatgctgccctccacccctaagcctgtctagatctactaact

SEQ ID NO: 197860 - DNA, 494 bp, Homo sapiens
tgcatatgctgtctcaggggtagcagaggcagaagaaaatccacatataagtagaccaatgcagtttaaacccttgttcaaaggtcagctgtgtaatgtttagtaacacctttgtgaactaaaattcgaaagtcaatggttagaagagacaaatgactccaaatattggtgtggcatgattgattaaaagttattttgcaagatgtgttctggagagaattgccccagagctaaaataaattctaagctatcttcactctcaggactaaggcatgaaatgaaacactataaaatctgtatcaaaaaaatgttttgttcttaatatactacttaagtcttctagttaacgaaaatcacaattttaaagagtggaattgtcagtatgattctggtttataacttggtttttgttaatttgtttatttttataaaattcaattgttaggttcatagaaatattggactacaatttatttatagtgagacagcctcaa

SEQ ID NO: 197861 - DNA, 538 bp, Homo sapiens
tgcctcccagccttgccctcgtcggcccctggagcgcagcgccgcagctgcagccgcagtcccggggagccttgcgtcctctgcctggtcctgggatcctgcagaccccaataaacagatggcaaagtagaggatggttagagattttcagagacagtaagagtggaagaagaagccgagaaagtagcagggagagaaaagtaactagacacatttcgagaaaaagcacagtatccagagagatgaaggacagccaggtagggagaggggcagcaaaggaggaggctcctcagacagagagtgggggagagcagaagggatttggagccagggcagacagggcagtgtggtaccgggacagcaagagggggcagccgatgacaaggagaagcagagggagaaccacagcacggggaggcctgggatctgggggtgccaaagagtggggacaacggtgtgtaacagggaagagggaatttaacagggagtgctgaaatggggaagaaagagccagaaatatgtggagactgggacaatg

SEQ ID NO: 197862 - DNA, 623 bp, Homo sapiens
gtttctgtaaagctgtcactctgataagaataagtgactatttaaaatctttttaagattttaagatcggtggtctatgtaaagccaattatacttgatctttatttattgtttttcaaattatccatcagtaacaatctgaaaaatatagacttcacacagctaacccaggttaaagaaacttgaggagctgtatctagtgtagttggaaatgaaaatctggaaatttaggatgaatagttgtaacattgttaaggataagagcccctttgaaaatctgttgaaagctacagaccttgtgcccaggaaaattacacactactcccaatgctgcatacaatttcagagaacaaagggacccccagaagcccatccatgaatcatggagcctaagttaagaacctctgattcagacaacagttaaagccactaaaacagatgtgaccatgcagagaacatgtgttgggactagcggagatggattatagagcccaaggaaaccccaacagtgaaagagcaggcagaggagctggcagacaaggaagatctgggcagttgtgagacagccaagcaaggggcaaagacaagagatgagctgttgagtgaggcctgttcgaaagagg

SEQ ID NO: 197863 - DNA, 765 bp, Homo sapiens
tatggctcagctataatactacgcgatattctctcccatcttcagaatgtttgcttcacttcaagtaaaagacagtaactaaaaattctctttccatcatctgttaccttaaaacagcctaactcacaaaacttcacaacgcaagcccaggtattatggaacccaccaagaatagcaagttcagtgttggctgccatttctaagtggacagtgttaattccctccacttagttgaggggcggagagaggtgttgaaggaaagagatgagatgacaagtctgaagtggcttcatcacaaagcatccatggctgtgatatgtagctgtgtcatccatggcaacattcgcctgaatggagattgtattatggacattgttctgggatgcctgaggctgatgacatgggacatgccggaaatttatgtatttcctacataaatatgcagctgaacatatttatgtaggaaaattaaagaccagactggtcaatcactggtaagccgtcaatgccccctcaatgattacccttgtcattcgtgccagccaaaacacacccagtccacaatagagacgcaagtaacttttcaaactgcaactgaccgctagaaattgattttagtagttgcctctatcctgtgatattttagaaatcaggttatcatgcataattagctctcctgccccaatcatctgtgccacattctattatcactatcggagaggtctatgacaatcaagaaaaggaaaaaaacacaggcatctgtct

SEQ ID NO: 197864 - DNA, 232 bp, Homo sapiens
tacttgggagaaatgtatttgagaacatttaattaccagactcttttaagcttaattagcacatatcacacatatcccaaatacttgtgtgttttttttctttctctctctctctctttttttttttttttaaagagacagagtctcattctgttgcccaggttagagtgcagtggcacgatcatagctcacttgaactcctgggctcaagtgatcctcccacctcagcctc

SEQ ID NO: 197865 - DNA, 529 bp, Homo sapiens
acatgtcctgtagaggattaaatctctatgtagaaaataaaaaaacccaagctttacttcttttagaaactatttcagtagtaagggagagtaaaatgaggaaaaattttatgttttaattttggtggccatatattggtgatgggttttatatttgcagttctgtatgctaagtgtacctagaaaaaaatagatgaaacgcattcacaaaaaatagcaacactttttctatggggaccaagagaaatgctatgctgggagggcctgagggatccagtctggagcccagagctagtgtatctgtatctgtattccagaaataatatctttttattactctttctttttttttccaaatggctacatcttctccctttatcagcagtagcaagatttgagaacatagggatggcaacagtattttcagaacagaaaattaaaacaagctgtatttttgttcccaatttatgagtctattttgatgggaagttgaacaaataaaaaggaaatcatcaaagttacgtttatt

SEQ ID NO: 197866 - DNA, 872 bp, Homo sapiens
actttggaagctgatcttggagcaccagtcaagcccttagctggctgcagccacagccaacaacaagactgcaacctcctgggggatcctgagccagaatcccctggctaaattgctccttgattcttaacccacagaaattgtgcttaacaccatgcagaagctgccaaggcttatggtttgcacactctggagcagtggccctagctgtacctgggctccagttagccaaggctgaagctggaacaccctgtatgtcaggagcaatgtcccaaggctgcacagaactatgttgactcctgacatggtggaaacaacaacaacagcaacaacaacaacagcaacaacaacaacaacttaaatgctgaggagtgaaagtgcctggtagaagtagcctcttaccctatgctaatggatttcttcaacagggggaaataaaactctcttaaatgttacatctttttgtttctaagaatagacagaaacaatactgctctgaattacacttcggatgactaagccaagtgcttactctcttcagtaatattatctctgtggtttgcagcaacactcttacattgtatgtaaagaggggtagcagccatggcattctcaaaagaaagaaaatgcaatatgaagatcatcagtcttggtgccaataccataacaggttgttggggactggagctggtctgagagcctttggatagcaccaaggtgtggccttggccagataccttcagttgtcctaggaccttattctgatcccatgtgacagctagacctccatgaatggaaactgaattgaaacaaagccaacattcccaacacccaagggtgatgggggattgacaaagtcctccccagcaaac

SEQ ID NO: 197867 - DNA, 580 bp, Homo sapiens
aaggaaaagaaaatgcgtcatcccaggactgcagaagcctgtgatgaattatccacagggctgctcccaagagcccgagcagagggctttttcggcagagttcctgcatccagcctaccgatgccctggaagaggaattcttaccccccttccccaaattaataaaatccaccaagccagagagcaggaatgcagcattgcaggacagcagtagctgccgggtgttccctcagcctgccctcgggcttccctataccggtctatttttatcctccctgagaattatggctctctgtgagtctgatttaaaatgaaaatgtgtcactcaatttgaaatgctgtgcagcggctaagaaatatgtccattgttatgcacataaagccctgtgataaatgcactgcccaggaagagaggcttttccacccgtcacccagctcctaggtctcatgcctgtgcagtcatctgtctccctctccagagagtcagcagctttgtgtcctggagaaattgtgaagcaaatactgcttaccccgaaaagtgtgtgtgtggtggggggaatgtacaaatgttgatattata

SEQ ID NO: 197868 - DNA, 487 bp, Homo sapiens
aagccgccagcagaaccagcaccattattgttaaatgtaacagaccagatacttccaggagccactccaagtgctgaaggaaaacggaagaggaataaatcagtgagcaacatggagaaagccagtatagagcctcctgaggaggaagaggaagagaggcctgtggtcaatggaaatggagtagtagtaacaccagaatccagtgaacatgaagacaaaagtgcaggtgcctcaggggagatgccctcccagccttatcctgcaccagtgtacagtcagcctgaggagctgaaggagcagatggatgacacaaagccaactaaacctgaagacaatgaggaaccagacccattgcctgataactgggaaatggcctatacagagaagggcgaagtctacttcattgaccataacacaaagacaacatcatggctggatccacgacttgcgaaaaaggctaaacctccagaagagtgcaaagaaaatg

SEQ ID NO: 197869 - DNA, 729 bp, Homo sapiens
gtatttttagtagagagaaggtttcgccctgttggccaggctggtctcaaactcctgtgctcaagcagtcctcctgcctcagccacccaaagtgctgggatcataggcacgagccaccgcaccgcacccagcattgtttttctttatgttatggagccaacatgttgttgttctctcagaggcagtggaagcctgtcagactttctgtgagaagtggcatttattactgtctggtagattcctatttctgtataaaaagaagaaaaacatgtgaatacgatacaggaccaggccccacatcctgataacatgcagtgcctcttcaccagccatgccttttgcctcaccctttctgttgctatgttctctatcctgcgttggacaaagagtgtcaggcgaggttttctaggcatctccatcaaaatgagaaggaaaaacctccatctctcagcacttattaacctaaaagataaagttgcactttctacttttcttaggtggggattacatgagccccaccagtcatcacggacacatcgtttgtacctatcagatgtatcagtagagatggggacattaatttgtgtaggggtgtcagcagtgctctggggagaaagagatattggcatacacagtggtctggagcatgtcttcacaaaatagtgtttgtggggagccagagattcctaaaagaacagtgaatagcacagtctcattaaaaaaaaaaaa

SEQ ID NO: 197870 - DNA, 535 bp, Homo sapiens
ataaaaagaaaaatccagctcaaattttggaaatgcaaaagactccagtaagtttatttcatatatgaatatactttcttggtgaggatatgttgaatagaagacattttataggccacagagttgttaaacccttgggcagttcagaaaaaaaaaacaccaaaaatattaaaacatgtgagtgtgttatagactttattttttagagcagttttaggttcataataaaattaagcagaagctgtagaaatttgctatatatccacctaactcttgctcccctccccttgacagcctttctcattgtcagcatcatgaaccacagtggtacctttgttaatagtgatgaacctacattgacacatcataactcaaagtccagagtttatattagggttcattcttagtggtatacattctatgggtttggacaaatatataatgacatatatctaccattgtagtatcgtacggggatgttcattgccctaaatatcctctgtgctccacctgttcatctctacctcctcccagt

SEQ ID NO: 197871 - DNA, 146 bp, Homo sapiens
ctttcagataaacagcctagctgacaggaattctaagtgaactcagctaccttcctgggtagcaaaaatagtttttataatagttttataatacattgaagtggttgatctaacggcatctgaccctgagctgcatccttgggtca

SEQ ID NO: 197872 - DNA, 399 bp, Homo sapiens
agagctggagtagaagggactctggttgtggggtaacagcttagatgccagtgtggagacaggaaggatgataacgtgtggtccactaagagcagccatatcccttgaatgtactccatgtgttagttactatttacagagttattcaggctcctaacatcagatttttctagatcaaagtagaaataagaggaacgtcaagaagataatcaacacgtagcatgcagaatcattattttaaaaggactaagacagttgtgtggtgtgattgttgtaccaccttctctttggctgttagaaagaactgagtagcgttacacatgaaaatgtgaaatctgattttcttatttctaaacttttaaaagctccatatctactgatacaaaccagagaatgtgg

SEQ ID NO: 197873 - DNA, 166 bp, Homo sapiens
ttgattatctgtttctacccttcatcattttttttccttcccttcatctcacccctgcagatgggtaaggagattcaggactcttatctctttttactgatgtgtcgatatcggtcgcatagtaaaatgcacagagaagaaaagaggagcccttttttgtgtggta

SEQ ID NO: 197874 - DNA, 398 bp, Homo sapiens
agtcatcttaattatattatcattggttacactattctttttaatttattttagtttttctttttagagacagagtctccctctgttacctaggctggagtgcagtggtgtgatcataactcactgtaccctccaactgttggactcaagcagtcctcccacctcagcctcccaagtattggcactacaggcacatgccaccatgcccatttaatttttaaaaattttttgtagagatggggtcttgttatgttgcccaggtgggggtctctaactcctagccccgagtgatcctcctgccttggcctctccaaatgttgggattacaagtgtgaactactgtccctggcctggttatattattctataatagatggttagcctggcccctgaggtgt

SEQ ID NO: 197875 - DNA, 521 bp, Homo sapiens
ttactgactgctgtgtcttgcatgtagaccctgcaggaaggctctcgtaggccaattattctctttgggtggcttgaagaagttacttaccttgcctgctgttgagcagagcaccaaggtgccattagacacgtgagcctggtctaagcagccatggccagggtaggggatggttacatggaacaagtcatggcgactttcgcacaggaagggcctatgactgctttactcagaaggggatagctcaatttgcaagcatcttgagattttacagcctgaccagtatacgtggaatttagaaacaaacaaacaaaaaaacctgagctgttttcctcctgtggatggctttgggtttcatctgtttggattgcttccagacactgagcaaatactgtgctcgattggaaacgtctgttgtggtggcaaaatgggagagttgttgcagtgccacacatacctgttacagctgggttagggagggagactggtttctacttctttttagtgctttgcttacaggg

SEQ ID NO: 197876 - DNA, 260 bp, Homo sapiens
ttattggctgtttatctacttttgcaaagcgcgtgttcaaatcctttttttttccaacggctaatacgtatttttgaggttaatctaggctaatcactgctgatttgtgtttatgtatttatatgcctttaacagactaccgccctaagcagtgaaagaaacccaaagggagccgaatggcttgcatacagaaaggctgggcagttgctgggcgcggctcgcgggtaggctctaagcctcgagcagtgattggctgaaga

SEQ ID NO: 197877 - DNA, 728 bp, Homo sapiens
ctgaggtcaggagttcgagaccagtctagccaacataatgaaaccctgtctctactaaaaatacaaaaacaattagctgggcatggtgacgcgtgcctgtaatcccagctactcaggaggctgaggcaggagaatcgcttgaacccaggaggtggactccagcctgggcaacaagagcaaaaactctgtctcagtaaaaaaaacaaaaacaaaataagattatcattaactcagtattagataacaaagatatcttcattgtattttcctggaaattaaatcaaattaacaaatgaacattatcataacccagacttcctttgtgcaagcgcctgatttactttaggcatcataactctgttaaaggtttaagtagatagtcttccttgattctgactcttcccccacgcaactgctgggagtttaccctgcctttgggagaaaaataaggccatgggaataactatattccatagagagtttatatcataaatccttctaataaactcatttattatttcaataaaggggtaattacaatcctcctaaacaatggcaaatctaagaacaggacctaaagaaataatataaacctctattacctaggtttatgtcacagattttataataccatggattaaagttctttatgagaatacatgtgtaatctcttttcatatggtgggaaggctataatataggttttattcctgtgatgatcatgttat

SEQ ID NO: 197878 - DNA, 603 bp, Homo sapiens
aatagatgttggagaatggtaaatgaagagctggcagtctcttgagtgaggcatgcagctctagagtacgattgggaagccactggccatacgtggctggagagcactcggaatggagcgagtccaaattgagacgtgctgtgaaagtacaatacacactagattccaaggacttagtgtaaaacatatcaattatcacgttaacaattttaaatttagaggataaatcaaaacgataatacgtatatgttgagttatatcaaatatatatatatttgtttgttttgagagggagtctctctgtcacccaggctggagtgcagtggcatgatcttggctcactgcaacctccatctcctgggttcaagtgattctcctgcctcagtctcctcagtagctgggattacatgcgcctgccatcacgccaggctaacttttggattttagtggagacgaggtttcaccatgttgggcaggctggtcatgaactcctgacctcaagtgatccaccagcctcggcctcccaaagtgttgggattacaggcgtgagccaccatgcctggccaagttatatcaagtatattaataaaattaagttcacct

SEQ ID NO: 197879 - DNA, 344 bp, Homo sapiens
agcaatccaaagggaaatatgagggccaagaacccaagacatgagagatgctagaaaacacattgaatcgcaagcaaattagtgggaagaggaaaataatggtgcagagcaatagcattttaaaactgcaatttgtgttttgcttttataagatgtctgggtcatggtacacaggaagactactgtaaaatcaagagttgattgaacaggcactaacagataacctcgtaatatttatctctactacccttatctatactgatctgtgaaaaggagacctgcggtaataggagaggcaaagaatggatccattgttggcattgctgtactcattaacgctaaat

SEQ ID NO: 197880 - DNA, 497 bp, Homo sapiens
tgaatgttgtgtctccctcacattcatattgaagtcctaaccccttaactcctaatgtgatggtgggattattgagaggtgattagatcatgagagtagagccctcatgaatgagattagtgcccttaagaagaggtacaaaagagatattctctccctctaccatgtaaggacacagcgagaaggcatctgtctgcaaaccaggaagtgggctctcactcagaccttggacttcccagcctctagaactgtgagaaataaatatttatcatttaagcaaatccagtttctggtattctgttatagcaacccatattgactacagtagaatttacatttatattgtgtgagactacatcttctttcaaatggatagccagggccatttattaaaattttaaaaagtaagaagtttttatgctactagaaacataatatatgctcatggtagaaaaacacaagaaaaagaacagaaaaaaattcacctatatttctac

SEQ ID NO: 197881 - DNA, 197 bp, Homo sapiens
ccatattcttttttctttctcttctttagactgaataattccaactgtttatcttcgagttcactatttcttctgcttctgcctactcaaatctgttgaacttctctggtcaattttaaattttatctattgtacttttcaactccagaatttctatttgtttcctttttataatttctgtctctgttgatatactc

SEQ ID NO: 197882 - DNA, 244 bp, Homo sapiens
tgagaagggcgggcagagcaggggattttgaagacagagaaactgaaaaggtgaagcagcaatgatgtgttagagtccaaaccagagctcaggcctcctgattccagcaagctttttctacctcccataccaacctccagtccaagtgaacatctgggtggagtgacagttgacacgtaagagattagtaaaggccgggcacgatggcctacacctgtcatcccagcactttgggaggccaagg

SEQ ID NO: 197883 - DNA, 343 bp, Homo sapiens
catacatgagaagctccgagaaggcaggacaagcattatcatccccatttatacatggggaaactggggttctgaaagatgtgaataacttgcctgagttctcacagctaataaatgagtccatctggactagacctgtttaggttcattcattcattcattctttcagccatccagcaaatgtttatcaaagggcatagttctctccagtatagccttctggttcttattttgataatcagaaatgattgaaggcaggccggatcaaaagaactccgcagcccatccctgcctcaaaataatgtgattccacatgttccattcctttctgtgtgagagaact

SEQ ID NO: 197884 - DNA, 2604 bp, Homo sapiens
  misc_feature (155)..(155): n is a, c, g, or t
  misc_feature (1937)..(1937): n is a, c, g, or t
aatacccagctagttgcaaaaccttcttttattgctgcaataggaccttttcatgtgtctaaagcataatttattcagtgagtaccctgctgttggccatggaagatagtagtctttttcactattgcaaacaatgtttcaataaataacaaaanttttttcacacctaaaacagcaggtattttatatagcatttataattgtaaataagatcactattttcttctctctttctctctttttcctccttctctcactaattattgctgatattaaaagattaattcttgtagtctgcctgtgaatagccactgcactccagcctgggcaacatagcaagctatgcctctgtttaaaaacaaaactaaaaactactcataatcttactcaaaatgactagtttacattttggtctttatttgcatatatacctacatttttagaataagattctactttacacagtattcctgttgtgaattctgtcattgccaaccttcttgaagattcttactagtttccattttcttccactgattctcttgagttttctagatctatattcttatcatctgataacgaggatgatcttgcctctttcttttaagtagtcttactttttatttctttttcttgtttaactgcactggctgacccgaaatgaggctaaatgatactgaggacagttggtatcagtgtctcacttctttctagagtggaaatggttctttgtgtggtttatttttgcctgatggtgactgttggtttgtaattgatcttaactgaggagtaacaaacatggtaaaacatttaacacagaatctttcaaataataaatacacaacaaatgtttttgttattattatatttttgtcatggtaaagaggtatactttaatttcctgtcattaagatttatttttaaattgagaatggatgttgaattttgactcctgcctttcttaaggggatatctatttaaataattacttatatttttcttaaactgttaatagaatgatatattagcattgatatagttgtctttcttggactgcaaaaccaattttgtcaaaagtttgttacccttttgaaataatgctaggttttattttctagtattttattagagtatgtgcatctattttcatgagttaaactgtcctctatcatgatttttcagagatagctttgttaagatttgaaatcaaggttatgctagctttgcaaaatgaattggaagttttctttttccatcctccatctcccttaccaccccttccccagtatgttctgttccaagaaattttgaaggagcttacatgtgaaattgccctggaaaagaatctttaaaatataaatatacatacaaatatatatatatgtatatatatatacacacacacacaatattttccatttattctataattagtacaacttttagactttcttctcagtttgaattaattttggcaattgtactttcaaagaaaatcattctgattccattgagtttattggcatagagctgcaaacagcctctgattctgaaatagctcttctggatcagtgattatataccttttttgttttgtatcactgagtgcttgtgctctctctcttatttctgactgaagttgctaaaaatttaattagttgatagaaccagttagtgtacaaattagtgttggattactaattattttaatttattatttccttttaaatataaaagaacttgcagctgtaagttcttctctaacagtaggtataactgaatcctagatgtgttcatatgtaatatttttgttactggtgtgttctaaatatctgtggtggttgttttgaattatgcttttgcccaaaggttactcggtgaagactgtttcttaaatttcaattggattggctctttgttcatattttgttattaangtctaattttattgcattttaggtagattttgtgacctaaattatacccaattttggaaatttgtagtttttgtgtgtgtatgcatggcatatgtacaactaatttttgtaactattatatgggcacttaagagtatcttcacaatgtataattaatatatcatgattaggagaaagtgtgtttatgatgttattcaaatattttctttctttttttttttttttgagatggaatctcactctgttgcccaggctggagtgcagtggcgcaatctcggctcaccacaacctccgcctcctgggttcatgccattctcctgcctcagcctcccaagtagctgggactacaggcgcccgccaccacacctggctaagtttttgtgtttttagtagagacggggtttcaccgtgttagccaggatggtctggatctcctgacctcgtgatatgcctgcctcggcctcctaaagtgctgggattacaggcgtgaaccactgtgccgggcctcaaatattttctctctctatatatttatttttgttctcttgattaaagttgttaggaatgtgttaatttcttccactgtgattgtgttttgtattttcttgcattatgccatggaaattgctggtttcctaggtcaaaacaattaaatattgtcagttac

SEQ ID NO: 197885 - DNA, 406 bp, Homo sapiens
cgacaaggagttcgagtgtaacaacagcgagagcggctacctgtactgctgcggtacctgctcagcctcccaagtagctgggactacaggcgcccgccaccacacctggctaagtttttgtgtttttagtagagacggggtttcaccgtgttagccaggatggtctggatctcctgacctcgtgatatgcctgcctcggcctcctaaagtgctgggattacaggcgtgaaccactgtgccgggcctcaaatattttctctctctatatatttatttttgttctcttgattaaagttgttaggaatgtgttaatttcttccactgtgattgtgttttgtattttcttgcattatgccatggaaattgctggtttcctaggtcaaaacaattaaatattgtcagttac

SEQ ID NO: 197886 - DNA, 449 bp, Homo sapiens
cataggctccagccaaagaagctcctccacccaaaataagggagagatccaaagggaggcgatacaatgacgtgaaaccatagaggtaagaagcaaggactcctaatacttgactctatgctaaactgttctgatgggctccagtttcttcaattctcaccaacacttgtttttgtccatttaaaaaattacagccatcctagtggttgtgatgtggtatctcattcctggttcctatacctgaaacatcctttctttccttgcctatattcacctattgaaaaactatttttcaaatagtacctcctctatgaagccttttcttgatcaccctaactaaaagtgattgcttcttttttaaattctgcaaacattgcatatatatttctggtggtgtgtgtatttcccttatatcacatttctttgtatatttgttttacaattacact

SEQ ID NO: 197887 - DNA, 551 bp, Homo sapiens
gtcatttggatctctttacttttgaatggaagtttacaaaaagcttacccagagcttcaagtcacagagcagtctgggtcagttattacccttacacataatcacctttcaaagcatgaagtaatacaagggtaatgttcatttgtctgaaagctctggttataagaaacattcagacagggcttaacttctgctactattgccagtgagggacagcccaataccagtgcgcatgtgcccaaggccctgaacactagtttggaagccaggaggacacatctgtagcttgtaagatgaggcgtgcatagtagataccatctgctaacaacagcttggttgatgtaggatggcgatacagcggtgaggtctatgtgactgtttgacatgctgaggttgctgaaagtgaactggctgtgagggctgggagactgtctagaacacacttagttgtgccatttgaggtcctgcttgtcctctctttgcttctttcacatcattatcatgagcagtcaatagctgttcagtacacggcactaagaaataccaggagt

SEQ ID NO: 197888 - DNA, 464 bp, Homo sapiens
tgaacactatgcaagtactcattaaaaacatcccaaaatgctggaggaaatgccgtggaattaaggaatgactcttttgtggtagaaaatttttatttcagagtatagacactgcttgtgctgggtctcttaattttactggatattataattttcttggactgttagattttctcagtgcaacatttctgagagcaaatatgttctgctcaattaaatactttctaaagctagataaatgccttccagtaagcacattaacattcaatatgttatattttaccagaggtaaaacatttatattctaaaacattatattctaaatttttttaccccagggaaaataaaatgccaaaaatctcaactaccacacatagctttgtaataagatcaatgggcaaatggaatcagcttcagtttgcactaatcctacatatatgtattaaggatatgtgtaatgaact

SEQ ID NO: 197889 - DNA, 581 bp, Homo sapiens
gggaatgctgaccttcccgtgcgctgtccttggtacttccctctcatcagctccctcggtaccagctgttgtagagaatttcctcagctctcttggagactcccagaatgtgcttttgagcagtcaccccacacacctgctttccttatccgcagatacctcccgccatgttttcctgcctttcttccctccaggttcaccctctcttgcttaaagccttctgcttccagccactcaggggcagttcttccccatcctctgcaccaccacagggctccgtctcaaggtttggggcccttttccattaccacaaattccaccaactcttccctgccctcaagagttcaattttgattctggctttgtgcttttacccacaccctctgttccagaaaccttggccagtctccccatgggttcctctctctgtcaccctagtctccatccctgaaccagtatgctttcttccagctgtcacccactgccagccacaccctggtgggccaccttgccactgtcagcctgcatcactttatgtcaccaactcagctcacagcccaccagcctcttctattacccag

SEQ ID NO: 197890 - DNA, 130 bp, Homo sapiens
tcacacacagtaactgcatccatggcccagagaacaattgtagcacacaaggagcagggctgtggctaaagtgttggcatctggagctaatagttctaaaaatgatataaggtagaggtagaaaaacaac

SEQ ID NO: 197891 - DNA, 673 bp, Homo sapiens
ttgtgcccaaacttagctgccgcacactacagtgataggaaactgccaacagttttttgtcaaacccactacagtggatcccacaatgggctgagacctcgtctagagtcatcaggttttccaggatgtgcagatggcctggaaacttggccaagaggtagggatcagcactctttagtaagctgtatatccaccaaatgctgtgacacaaggaatgggcctcaaaatgtttcaggccagcacagctttgtctttgcaagtcatttttcagtggcagttaaatattgtggcaaagccaaggtacagactcacgtgcattaaaatatgcttatgagtaataataccataagtatttccatgtgcattaggtgtcaagaacttcacacacatcatttcattcccttatcatggcactcagtctggtgggtattactgtatctgtttcacaataggaaacccagtatctgagatgttcagtgcctttcccagttacccagttggtaagtgggaaagtcaggacatgaattttcagtgattttattaaaaaggcaggatgatacagtgatttaaaggcctaattctagacccaggttgcttagattcaagtcccagctctgccatactctgttagtataactttggccaagtcactatgcctcagtttcctcatctg

SEQ ID NO: 197892 - DNA, 189 bp, Homo sapiens
cggtgctggcaagttgttgaaaatgtacacccacaccctgctggtagcagtgtaaattggtacaatcctttaccagagcaatttgatactgcactcaagaaccttaaaatgttcacaccccttgatccagtaacttaaaggaaatatattttaagaaaataagtcaaggccgggtgtggtggctcatgc

SEQ ID NO: 197893 - DNA, 250 bp, Homo sapiens
ccttgctgtgtggttttgggcaagtttcttaacctctctgtgctgtagtttcctcatttgcaaaatgtgtataataacaattgtaatgcttattagggttgttatgagtatttcatagcatctggtataaagtaaaagcactaaattgatgctagttataaataataatagctattattattatgtaatattgggaaaccagatgattataccaggactttgtggttgacgtctgggttgagacctatat

SEQ ID NO: 197894 - DNA, 193 bp, Homo sapiens
ctcagtccttgcaatccggattgaaactaaggagtctctcctagtgattggccaagagaaaattccctagtctggtgttcactgttatctcctttccaggctactgaaccaaaccatccttggttcccaaaaagtgaaataaaagcacaaatattttctttttaggtaataaagggcatcatagatttgaaca

SEQ ID NO: 197895 - DNA, 377 bp, Homo sapiens
tgtttctgagaacttatccatttcctctagattttctaatttgtttgcacagaggtgttcataatagtctctgaatatcttttgtatttctgtgggattgggtgtaatgtcatttgtcatttttgattgtgcttatttgggtcttctctttttttgttaatctaactagtagtctatcaatcttatttattctttcaaaaaacaaactctgtttcatttatctttgtatggacttttgcatctcaatttctttcagttgttctctgattttagtaatctcttttcttctgctagcttttaaagccatacttatgttggggttccccctcccatatagacactttaacatttgtcctcctctcaaggccccaggaata

SEQ ID NO: 197896 - DNA, 355 bp, Homo sapiens
caaaattcaaaattttgacattatcaaatgtcagtgagtttcaaaggttttaaattggagcagtcaatttgaagaacaacctcacagtaacattaaagaaaaaaaagaaaaaaaaaaggaaaaaaagaagtaccaggcttcaatacctgccccagggaaatgtgataatgtgcataatgaggcatacaaaaagacgttaaatgtctcattccattattgaaccattaaaaaaaaaactcacttccaatacataaagtgccacatagactatattatatattgtatatatttactatactttattatgcacctgtcaaaaagacaaagagacattctcatgagtactgacataaaa

SEQ ID NO: 197897 - DNA, 1546 bp, Homo sapiens
ctgacgtcagcgggagagtattatggtctgtcgtgcgctggctgctgcttttctgctcctggaagcggccaaggggggaagcggcgagtcaacatggagctttcagcggtgggggagcgggtgttcgcggccgaagccctcctgaagcggcgcatacggaaaggacgcatggaatacctcgtgaaatggaagggatggtcgcagaagtacagcacatgggaaccggaggaaaacatcctggatgctcgcttgctcgcagcctttgaggaaagggaaagagagatggagctctatggccccaaaaagcgtggacccaagcccaaaaccttcctcctcaaagcgcaggccaaggcaaaggccaaaacttacgagtttcgaagtgactcagccaggggcatccggatcccctaccctggccgctcgccccaggacctggcctccacttcccgggcccgggagggccttcgaaacatgggtttgtccccgccagcgagcagcaccagcaccagcagcacctgccgcgcagaggcccctcgggaccgggaccgagaccgggatagggaccgggagcgggatcgagaaagggagagggagcgagagagggagcgggaacgtgagagggaacgagagcggggtaccagcagagtggatgacaagcccagctcaccgggggacagctcgaagaagcgaggccccaagccccggaaggagctcccggacccctcacagaggcccttaggcgaacccagcgccggcctcggagagtacctcaagggcaggaagctggacgacaccccttccggggcaggaaagtttccagccggccacagtgtgatccagctggcccgaagacaggactcggacctggtgcagtgtggtgtgaccagccctagctcagctgaggccacgggcaaactggctgtggacaccttcccggccagggtgataaagcacagggctgccttcctggaggccaaaggccagggtgccctagatcccaatggcacccgggtccgacatggctcaggcccccccagctctgtggggggcctgtaccgggacatgggggcccaggggggaaggccctccctcatcgccaggatccctgtggccagaatcctgggggacccggaggaagagtcctggagcccctccctgactaacctggagaaggtggtggtcacggacgtgacctcaaactttttgaccgtcaccattaaggaaagtaacacggaccaaggcttttttaaagagaaaagatgaatgctgggtgggtgtgtccaggaggagagcaggggagagagtgagcgtgagcttggcatagtgatttttatttctgggtgggatgtggccttttggctggtcccgtccctgatgtcacccccaccccaccagcccctttcatccctccttcctccccctcagtttttgttggaaagattatctctagagttatattttctattagatgtaaatatgttatttaagaaaaatatctaaatatatatatttcaactcgaagttgttttatttaaaggagagagac

SEQ ID NO: 197898 - DNA, 572 bp, Homo sapiens
gacccacgcgtcggggcaggaggggccccatctcattgtgctttagttggggcagcccgaatgagctggggcaggaggggcccccttgccccagagctctagggaagttgggccctgggtacaggtttctgagagtgtctggaggggcttggcctgcccacctcacccctcctcccttctcccacagcccaatgccagactcctggcaccaaggcccggcccagatttgctctctcttcccattggccaggcaggccaacaaaaggttggctccccaatcagaaaaaagggggggtggggtcagtctgttttccttttttctattttttttttttttaaggtaaagaagtctattagggaaaaaagtattaacttgaataagcttttcgtgtgtgatgttgaaggttaaaacgtccccagcaggcagggacaggaggtttctccccaggaccacaccaggaaatgcactttagggaggggtgtgtgtgtggtacacgcagatcgtgtgtatgtcatgtggataaaatctccccgttccctcgttcctttccttactccgcagaaagaaaaga

SEQ ID NO: 197899 - DNA, 1517 bp, Homo sapiens
ggccttgggaccagtttccagaatgtcgggtcaccctgcggcattcccgcagcaggcggcaggcgcccagccctagctcggcgtctaggaagcagcgctgcgggacgcccgcccggctccgggaccgcgggagggacgcatggaatacctcgtgaaatggaagggatggtcgcagaagtacagcacatgggaaccggaggaaaacatcctggatgctcgcttgctcgcagcctttgaggaaagggaaagagagatggagctctatggccccaaaaagcgtggacccaagcccaaaaccttcctcctcaaagcgcaggccaaggcaaaggccaaaacttacgagtttcgaagtgactcagccaggggcatccggatcccctaccctggccgctcgccccaggacctggcctccacttcccgggcccgggagggccttcgaaacatgggtttgtccccgccagcgagcagcaccagcaccagcagcacctgccgcgcagaggcccctcgggaccgggaccgagaccgggatagggaccgggagcgggatcgagaaagggagagggagcgagagagggagcgggaacgtgagagggaacgagagcggggtaccagcagagtggatgacaagcccagctcaccgggggacagctcgaagaagcgaggccccaagccccggaaggagctcccggacccctcacagaggcccttaggcgaacccagcgccggcctcggagagtacctcaagggcaggaagctggacgacaccccttccggggcaggaaagtttccagccggccacagtgtgatccagctggcccgaagacaggactcggacctggtgcagtgtggtgtgaccagccctagctcagctgaggccacgggcaaactggctgtggacaccttcccggccagggtgataaagcacagggctgccttcctggaggccaaaggccagggtgccctagatcccaatggcacccgggtccgacatggctcaggcccccccagctctgtggggggcctgtaccgggacatgggggcccaggggggaaggccctccctcatcgccaggatccctgtggccagaatcctgggggacccggaggaagagtcctggagcccctccctgactaacctggagaaggtggtggtcacggacgtgacctcaaactttttgaccgtcaccattaaggaaagtaacacggaccaaggcttttttaaagagaaaagatgaatgctgggtgggtgtgtccaggaggagagcaggggagagagtgagcgtgagcttggcatagtgatttttatttctgggtgggatgtggccttttggctggtcccgtccctgatgtcacccccaccccaccagcccctttcatccctccttcctccccctcagtttttgttggaaagattatctctagagttatattttctattagatgtaaatatgttatttaagaaaaatatctaaatatatatatttcaactcgaagttgttttatttaaaggagagagac

SEQ ID NO: 197900 - DNA, 2088 bp, Homo sapiens
ctgacgtcagcgggagagtattatggtctgtcgtgcgctggctgctgcttttctgctcctggaagcggccaaggggggaagcggcgagtcaacatggagctttcagcggtgggggagcgggtgttcgcggccgaagccctcctgaagcggcgcatacggaaaggacgcatggaatacctcgtgaaatggaagggatggtcgcagaagtacagcacatgggaaccggaggaaaacatcctggatgctcgcttgctcgcagcctttgaggaaagggaaagagagatggagctctatggccccaaaaagcgtggacccaagcccaaaaccttcctcctcaaagcgcaggccaaggcaaaggccaaaacttacgagtttcgaagtgactcagccaggggcatccggatcccctaccctggccgctcgccccaggacctggcctccacttcccgggcccgggagggccttcgaaacatgggtttgtccccgccagcgagcagcaccagcaccagcagcacctgccgcgcagaggcccctcgggaccgggaccgagaccgggatagggaccgggagcgggatcgagaaagggagagggagcgagagagggagcgggaacgtgagagggaacgagagcggggtaccagcagagtggatgacaagcccagctcaccgggggacagctcgaagaagcgaggccccaagccccggaaggagctcccggacccctcacagaggcccttaggcgaacccagcgccggcctcggagagtacctcaagggcaggaagctggacgacaccccttccggggcaggaaagtttccagccggccacagtgtgatccagctggcccgaagacaggactcggacctggtgcagtgtggtgtgaccagccctagctcagctgaggccacgggcaaactggctgtggacaccttcccggccagggtgataaagcacagggctgccttcctggaggccaaaggccagggtgccctagatcccaatggcacccgggtccgacatggctcaggcccccccagctctgtggggggcctgtaccgggacatgggggcccaggggggaaggccctccctcatcgccaggatccctgtggccagaatcctgggggacccggaggaagagtcctggagcccctccctgactaacctggagaaggtggtggtcacggacgtgacctcaaactttttgaccgtcaccattaaggaaagtaacacggaccaaggcttttttaaagagaaaagatgaatgctgggtgggtgtgtccaggaggagagcaggggagagagtgagcgtgagcttggcatagtgatttttatttctgggtgggatgtggccttttggctggtcccgtccctgatgtcacccccaccccaccagcccctttcatccctccttcctccccctcagtttttgttggaaagattatctctagagttatattttctattagatgtaaatatgttatttaagaaaaatatctaaatatatatatttcaactcgaagttgttttatttaaaggagagagactctcattgtgctttagttggggcagcccgaatgagctggggcaggaggggcccccttgccccagagctctagggaagttgggccctgggtacaggtttctgagagtgtctggaggggcttggcctgcccacctcacccctcctcccttctcccacagcccaatgccagactcctggcaccaaggcccggcccagatttgctctctcttcccattggccaggcaggccaacaaaaggttggctccccaatcagaaaaaagggggggtggggtcagtctgttttccttttttctattttttttttttttaaggtaaagaagtctattagggaaaaaagtattaacttgaataagcttttcgtgtgtgatgttgaaggttaaaacgtccccagcaggcagggacaggaggtttctccccaggaccacaccaggaaatgcactttagggaggggtgtgtgtgtggtacacgcagatcgtgtgtatgtcatgtggataaaatctccccgttccctcgttcctttccttactccgcagaaagaaaaga

SEQ ID NO: 197901 - DNA, 1474 bp, Homo sapiens
cactggacccggcgacgtcccccagcttcccgcgctggcgtttctcgcaggatgtccgccgcccacgttgggaagagcggtggacaggaaggacgcatggaatacctcgtgaaatggaagggatggtcgcagaagtacagcacatgggaaccggaggaaaacatcctggatgctcgcttgctcgcagcctttgaggaaagggaaagagagatggagctctatggccccaaaaagcgtggacccaagcccaaaaccttcctcctcaaagcgcaggccaaggcaaaggccaaaacttacgagtttcgaagtgactcagccaggggcatccggatcccctaccctggccgctcgccccaggacctggcctccacttcccgggcccgggagggccttcgaaacatgggtttgtccccgccagcgagcagcaccagcaccagcagcacctgccgcgcagaggcccctcgggaccgggaccgagaccgggatagggaccgggagcgggatcgagaaagggagagggagcgagagagggagcgggaacgtgagagggaacgagagcggggtaccagcagagtggatgacaagcccagctcaccgggggacagctcgaagaagcgaggccccaagccccggaaggagctcccggacccctcacagaggcccttaggcgaacccagcgccggcctcggagagtacctcaagggcaggaagctggacgacaccccttccggggcaggaaagtttccagccggccacagtgtgatccagctggcccgaagacaggactcggacctggtgcagtgtggtgtgaccagccctagctcagctgaggccacgggcaaactggctgtggacaccttcccggccagggtgataaagcacagggctgccttcctggaggccaaaggccagggtgccctagatcccaatggcacccgggtccgacatggctcaggcccccccagctctgtggggggcctgtaccgggacatgggggcccaggggggaaggccctccctcatcgccaggatccctgtggccagaatcctgggggacccggaggaagagtcctggagcccctccctgactaacctggagaaggtggtggtcacggacgtgacctcaaactttttgaccgtcaccattaaggaaagtaacacggaccaaggcttttttaaagagaaaagatgaatgctgggtgggtgtgtccaggaggagagcaggggagagagtgagcgtgagcttggcatagtgatttttatttctgggtgggatgtggccttttggctggtcccgtccctgatgtcacccccaccccaccagcccctttcatccctccttcctccccctcagtttttgttggaaagattatctctagagttatattttctattagatgtaaatatgttatttaagaaaaatatctaaatatatatatttcaactcgaagttgttttatttaaaggagagagac

SEQ ID NO: 197902 - DNA, 659 bp, Homo sapiens
ggaagggcggggctttaactgtttatttgggttgagagatcctagattggtaccttaataatcatcttaagttaatttacatgttgtggaatcccaagtgactagaaggcatatagtaggtattcaataaatgttcatttactgggaattaaagaagacagcccatccaaatatagtgattaataatgtaggcttggaattcttggaaaatctgtcaaataagggagtggacataggatgaaatggaaaatatgttaacattccttctctccaaacatttattaatatattagattcacagaaatctaatgaaaataatacagatgacaggagtcaggtaaacctgatttcaagtcctgtctcttctacttacaagctctgtgatcactgggaaatttcttaaattctcagtcatacaattatagggttgcttgaagattaaataattttcagtgaatattagcttttaccattgccatcatcatcatgactgttcatcgtgataattgttaaagttctaaaatgtctttataacaggcttatcacatgctttgtgtaatattcttcctttctatgcctgactttggtatgtatctcagtgacaaaaggaattttttgtttattccctggcagtaactgggccatgtttaggactaaag

SEQ ID NO: 197903 - DNA, 622 bp, Homo sapiens
cagcgttgtccatttcacaatgtgaggatacagcaagaagtgtcatcttggaagcagagagcaaacactcatcagacattaaatctgacagcaccttgatcctggacttcccagcctctagaaatcgtatgcaatggtatgaggaactgttccacattaaaggagactaagaagaccataacaactcgatgcaatgtgtgattctggactggatcttgcattggaggagaaacatgctataaaaggtttactgccatatttagaagagatagatagcatttccagcttccactcctctcattttaatgggcaacaagaaaaggaactaccaggagtaaggttcaaattttaatacacagaagaggtgtatctaaaggtttaatgaaaattgaagggtcagaagtacattcatgtccagggatcaccaatgaggaaatgtgcagcagagctgataatattgtgtaggagaacagacaaggaactcttctactgatgaccaaggtgcttcccaaccactgccactgtctgcattcgagtttcgttttacctctggacatttgctttggctgctgccacttggaatgactgccacagctaaatcgagtgatatttttaaccctat

SEQ ID NO: 197904 - DNA, 554 bp, Homo sapiens
ggttatagcacactggagaaatagtaccaatagtccgtgaaatttgtggctactttttttcccctaacctttaaaaaataatcattgagttcagaggtacaagccactgtggcagcctctgaaattccaagagagaatatagctacctctagggcagttgttcttcagtaagtttgaggggagaagtcctggcagtcagcatattctctgaggaaggtaatgatacactattagattttttacttatattttatgaatagtgatttctagataaagctatctatttaattactctaagtttaggttgattagaaacattaactctgctttatgtcataaaatcattaagtgtaagtatacatacatgttcatgggggtgaaagtaaataatctccaagcatcgtctgttaacattaacactaaaatcactaattcaataatgtttatctttttttccccaaagcccaggtatcaggcttaattaatatttatctttttttttttttgagacggatcactccagcctgggcaacaaagcaagacccagaatcttg

SEQ ID NO: 197905 - DNA, 632 bp, Homo sapiens
ttgcctaatagcatccatgtgtatgtttaacccacattgcttattatacaataaaggtatatctagtaaaaactacagactttgaaacatgttgtgcaccatggttatgaaacgtctggcttacaaaaaatatataaactgcttactatgtgaccgacacttgttaattaaaaatataatccttaaatgacaattatttttattcttctgtatgtgtttacttatcctgtttcctactttgttctacttaatttaaaataacatttaatttggggatagtttatcccagaaaaaaaaaagtgttacacagtttatactccacgatttaaatataaacacaaaatcttagacatctccagcaatataaaccccttatctgagacagttaatttgaatagttgatgtttctttcattatactttgataaacctgtgaaaacaaaatgctacagtaattactgttactactccctttaaaaatgtaaagtagttaaattttcctagacaacaagcaaggacaagttacagagaacttgaataaaagtagcaacgtggtcatgttgaatgtcaatctaaaaaaagaggtgtctaatctggagactgctctctctcgcctttttaaattccaagagt

SEQ ID NO: 197906 - DNA, 644 bp, Homo sapiens
acctcacctccaccatctcctcacctggaggctcactccactctctcaattcctctacctgctgcctcaagccccctgagactgatcattctccgcaccgcagctggggtcacctcccaaaagcatagatcacacctgttgcttccctgctcaactctctcccaggatttcctgttctcacccaaagtccaaacgtctcactgggacttccaggacctctcttcgtctcttcctgtgcccttgcttacccctgacccagctttcctgggcccctcattgtctcaaactggccaagctctgccgggggtggggttcatgatcaaaagcaatggagccggcagcgcatactgggccaatggtcttgcatttgctgtcgggtgagtcacctgacaactcatcacccaagtcctgacctgcacaagggggagagtaacggttcctccccagagaagcgtctggaggagcaaatgagtggatgatgtcaccgggcacagtggctcacgcctgtaatctcagcattttgggaggctgaggtgggcggatcacctaaggccaggagttcaagtttgcttcggcctctcagaaagtgctgagattacaggtgtgagccactgtgcccagcctctgtgaatatatcaaaatca

SEQ ID NO: 197907 - DNA, 747 bp, Homo sapiens
acctcacctccaccatctcctcacctggaggctcactccactctctcaattcctctacctgctgcctcaagccccctgagactgatcattctccgcaccgcagctggggtcacctcccaaaagcatagatcacacctgttgcttccctgctcaactctctcccaggatttcctgttctcacccaaagtccaaacgtctcactgggacttccaggacctctcttcgtctcttcctgtgcccttgcttacccctgacccagctttcctgggcccctcattgtctcaaactggccaagctctgccgggggtggggttcatgatcaaaagcaatggagccggcagcgcatactgggccaatggtcttgcatttgctgtcgggtgagtcacctgacaactcatcacccaagtcctgacctgcacaagggggagagtaacggttcctccccagagaagcgtctggaggagcaaatgagtggatgatgtcaccgggcacagtggctcacgcctgtaatctcagcattttgggaggctgaggtgggcggatcacctaaggccaggagttcaagaccagcctggccaacatggtgaaaccccatctctactaaaaatacaaaaattaggctgggcgcggtggctcatgcctgtaatcccagcattttgggaggccgaggcgggcggatcacctgaggtcgggagttcgagaccagcctgaccaacatggagaaagcctatctctactaaaaataca

SEQ ID NO: 197908 - DNA, 606 bp, Homo sapiens
ttgtttactgcagtgatctagaggatccgaaatagcgcagaacttcacatttatcgattgaggacttctggagtgctttccagctcttccatgattgccccggttcactcctgaccagctttcctgggcccctcattgtctcaaactggccaagctctgccgggggtggggttcatgatcaaaagcaatggagccggcagcgcatactgggccaatggtcttgcatttgctgtcgggtgagtcacctgacaactcatcacccaagtcctgacctgcacaagggggagagtaacggttcctccccagagaagcgtctggaggagcaaatgagtggatgatgtcaccgggcacagtggctcacgcctgtaatctcagcattttgggaggctgaggtgggcggatcacctaaggccaggagttcaagaccagcctggccaacatggtgaaaccccatctctactaaaaatacaaaaattaggctgggcgcggtggctcatgcctgtaatcccagcattttgggaggccgaggcgggcggatcacctgaggtcgggagttcgagaccagcctgaccaacatggagaaagcctatctctactaaaaataca

SEQ ID NO: 197909 - DNA, 322 bp, Homo sapiens
aatccaggaggcggagacttcagtgcaccgagatcacgccattgcactccagcctaagcaacaagagcaaaactccctctcatatataaataaataaaattcaaaaaattgtttcagtcagtaagggaaatgtctctttctggaagtattccagctaataatgaagagggaatgagacaggcacagtggcactcacgcctgtaatcctagcactttgagaggctgaggcacgagagtcgcttgaacccggaagtggagggtgcagtgagcctagatcgtgccatcacactccagcctgagacagagtgaaactctgtctcag

SEQ ID NO: 197910 - DNA, 262 bp, Homo sapiens
ttgtcagcgatggtgaactaggtaggtaattatgacaagtgaaaaaagtgaggtttcagacaaattgatgtagctttctttaaattacttaagtcctctaacataaatgaactagttcttttctcatgttgaataattcttttaattactttaagaatagcttgaaaagcagtattataagtttcagtgtgtttagtaagtttcttagctatttctttagcctttctccttcccattaaggtacctacctatttcacaatcg

SEQ ID NO: 197911 - DNA, 297 bp, Homo sapiens
cccagggaaagcccaagaggaaatgtattgaaatagtgataaggagcaagtaattttttctaacattgatgacagtcataaaaagccaaagtctgacaaggagacatgactagcaactgcaatggctggacagaccaaaaagaatttatgaggaagaaaaccaaaatgaatcattttccaaatccagagataaagagaaaaaagaagaactttgatgattaggtatagccagaatgtcccgtcaaaaaaaataagcattcctttggggaaaagctgctgccactatgagatacactt

SEQ ID NO: 197912 - DNA, 203 bp, Homo sapiens
tgttaggattataggcatcagccaccacccatgacctagatcacaattgcagatagagacacatgtcctctgtgttgccagcattagttgtgtctgggtgtaccctgacttatatgcacttgcacgggaactccgttagcaagcagcaggctgcctggataggatggtctgaaccaggagatgccccccacccatcagccagg

SEQ ID NO: 197913 - DNA, 678 bp, Homo sapiens
gagtttgaatctggacatgactccttaattgtgtggggttaggcaaatgactcaatttctttaagatttggttttcccatttctaaagatggagatactacagtttattctacacagaattgtgacagaaaccaactgagagaatgcctgtaaagctttttgcactatgactggctaccaaaaatacttaggttaagctattattattagaattattagcaagtcctttttattaagactaaactgcctcatttagctaaaacctattaatcttattgggccctcagaattcacaaaggacaaactgactctactgtatggcaacaaagtctaacacactaatcaggtctaggtctctcaacaattcctcatatgacaaagttttctaatataatattattcatggtaccctactcttctgtgcattaatggctattgtcattttttaaaatgtgattctgtaaataaaattcagcacttttgataaggtgcaacaatgccagagtacagtggaactatcaatttgtaggattcatatgccatatctttgttactgacaaataagtttactttaaaagttagccatgagagatctattgcatctgggaagatggagtagatatatttccaaattcctcccactatatgtactaagtacaattaacgaccctggacatt

SEQ ID NO: 197914 - DNA, 648 bp, Homo sapiens
ccgcagtggcaagacttgcaggaactcaagttgcaacgaccagaatgggcaattcccctctggctagggctggtctaaatgctccctccatgggtgccacctgagttctgcctggtattgctttctgctgcaacaaggcagcactgagtttcaatgcaaagttcttcagtcactgtgttctccctctcctaagctcagattctctctccacaccacatggtcgttgccaggggatggaggaggggtggtgttggcaattcaagactgtctttcctaccctcttcagtgcctctttcactgatatgaagttataaccagatattttgattgctcgtctgatttttggttcttatgaaggtgctttattgtgtggatagttgttcaatttggtgttcctgcagggaggatgatcagtgaaggcttctattcagccatcttgctctgcttcctcttctcatttactgaataactttcttacagagtttgacctaaagatgcaattaatgattagttcagattgtgaagctgaaagctgatgctggtgtcaccttctaaaattaagcttctggttataattaagagctgcagccttggagcattgagtattatctgtggcttggttgctaacagggagaacttcaggatgct

SEQ ID NO: 197915 - DNA, 200 bp, Homo sapiens
tttattttatttttcatttatttacatattttttgagataaggtcttgctctgtcacccaggcaacagctaaagaatgaacagcaccccacttgccaacagattgaaaagaatgggtacagtaggcaactgacatttactatcaaataaaatattgttgaccattaatggtcatgaaatatggagaagtagaaaaaaaaa

SEQ ID NO: 197916 - DNA, 484 bp, Homo sapiens
ccatgctaatcgtggatcatgtgttatttcatttattccttacagtcaccttattttatgcatgaggaaactgagagctcagggagagacgagggaaactgcaacccaagtctatggttgtttggatcatggatatgtctccagattaaataaaacttccaaatgatcgatgccctatctgctttattatttctgggatcctgagtacttttatgcttggaaatatgtcctgctgtcgagcaggccacaccccaatctaagccagctgccagcaaactgagcaggaatgctcctgtagaatcaacagtctgaaaaccctcacctgagactaaacatgtgcttggcaatatcatcatgaagagaggtaaatgctggcaggctggtgataactatcatttctttccccagaggagaggtagttttggtctcttggagagatgacactgatagagagggaatttaatgttgaaaatgtctgaagagg

SEQ ID NO: 197917 - DNA, 604 bp, Homo sapiens
gctttttccttccgaaacatttcttaaatgtatattctttcctctgctttggctcagtattaccttttgcttggacaacttggttttcgacctccacttttgaaccattctcaatcccatcatctaatcattcagctgccatcctataatcattcagtttttatcaacaactattcttacaaaatgtcaatatgactctgtcagtctcaagggtcatttatttcttcatgacttcctactacttatgagtagtagatgtaagcttcttaacagtatatatgtttccttgtcagcactcttgctactaaaccagtttaactgggcctcatctccaccttgtatttcatgtccagcagcaataccgtgcttgctgggtgccggaacacgctactctgtgtccccacttcttgccttagctcatgctaacttaatgtgagttcagcttaggagtccttccctcaggagcctttgctttctcagtgaggtgcgttgagaagcccgctttctgagtctccatggtcccctcacctctaggcgctcatcgctattgctgccttcactacattgtatatgctaagtactcatttatttgcctttctctccc

SEQ ID NO: 197918 - DNA, 455 bp, Homo sapiens
aactagagttgagttgggtcgattattaacaatacagaaaagttactttatctctaaggtcgttcaccacatggttctttcataggcagctcctggttaggttttaatttaccaaaagttaatttatgtaaaacttgtacagaaacatttttttcaccatcaaaaaccccagtccttgacccacctgcccctcttacatcctggcatacagagggttaggtccaaacaagttgtaacaatagacactgaacccagccaagctgtcagcatcaggaacggctgggcatgttatgactgttattctaacagaaccctgtataggcttgaaaataacatggaagtggatgattttaggcatggaattctttccaggcagcattgccaggtgaacagataagtcatatgcatccacaaataacagccatttaagaccctgtataatccccccacccagc

SEQ ID NO: 197919 - DNA, 369 bp, Homo sapiens
tctttcctgagcactgtatcccaaatatttatcgtaagttcccccttcttccctacctacttggaatttccatttggatgtcagtcatctcacactcaacatgtttaaaactagattcttattttcctttcctaaacctattcctcaaatcatttctcctttcagctgatggaaattcaaatttccatttacttattccccaaaagttggtgtcatcttcaacttctctctctctgttggaccttatatccagtccatcgatgagtcttatcccttctaccatcaaaatatattcagaatctgaccactttcaccctctccactgctgccacccttatctattccgccatcttatcccaccttgattgc

SEQ ID NO: 197920 - DNA, 534 bp, Homo sapiens
tgaatacttctctatggcagtatcttttagagttattatggaccctgtaattctgttctcaaagacgtttaaccactagaggtagacaccaaaaatgttttatttgtctcatttgggactctaattcagtgaagttggctgtttggagtctgagactggatctgtttttttattttgttttgttgttgttttgtttgttttcagcctgggcaacagagtgagatcctatctcaaaaacaaacaaacaaaaaaggaacttgtttcctagcaagaagcagatgaggctggtgaataagcataccacataagtaagtaatccactaacttagggaatttcgtgaccagtcactcagcacgccctgttgcgaaggggacggctgaccaataggatcatctcagagtcaccctcacacaacttggcttagcctagttggcaaaagtgtctcttcagagacctaccctcctggaattgaaataaaatgaaaatttgtgatgacgatcagctactgtcagtgtgacttaggtgtagaaatt

SEQ ID NO: 197921 - DNA, 378 bp, Homo sapiens
cgtcttactctccccttacccacctatccattcctgatctttgcttgtgacaagataacctgtgtagggactgcttcctacgtgaagtggtccccagaaggaagcagattggaaggtcctagaaataggaggtgcagacatgcactgagcaggagccgctggcatctttgctggtgactttgagaccccttcctcaggcacttgtctttgaatggtggtcttacctgcaattttgctgtgagctctggagtgcagagagccccccatcttggtctatctcatatgtatgacggtgaccctcaaacttcagcatggtgagtccccccaaggaaaagtgattgcctctggggtgtagtgggggacagaactggacaactg

SEQ ID NO: 197922 - DNA, 614 bp, Homo sapiens
cagggacctgtcttcaggtgttggctagagtgaacagtaaattcttttggcagtctggagtttgtttttcaggcagacgctttaaggggtcagacgccttaataatcccttttttaagggtcatcctagggatgtggtcttgaactgttataaattatgttcatgtttgtttaagtcttttaatggagaagtgggtggacagggatggacaaaatgatttgtgctgaaaatttgcagcttttataggccaaggcttcagtagacaacagagcttacaggaggccaactcaaatttggtcaaggagagaatccttgtcagtaatttcagctctgatagtgtatcagagtatacccagaaagataagattgtggacttcctgctactctccctttaggaggaagaatgtgtgagaatgaacaaggaaacgaataaatggggttgttatacattgcagtaagtgcctttaaggaaatgaatggataatgagatagaatgattagaagagacattttagataaagaaatcagtaaggtttgtctgagttgacatttgagttgagaccaaagtttgagaaagattcagccctgtaaagaactagtagaagcatgtttca

SEQ ID NO: 197923 - DNA, 596 bp, Homo sapiens
cagagacaactgatgcaagtttatcactatcatgagacctcttccatagaaaaaccatcatcacattaactgcttgatttctttcatccaattcatggaatcaaaataaagcttttgaaagttaactctgttcaaagtaaaacatctcatattactgtgtatgttgtgaattgtttaaaaacatgtaacactgaagataaaatttttgttttagtgatgatgagaatacaaatattggttaagtagactgtcatggtaaaaacaatattcccactaagctaaaacaaaaaaaggataaaacaaaaaatatacttgaaatgattatggtgtatacattactcataactatatgcaaaaagactataatattttaccaactgaaagatacgctgtagatgtggaaatgtacaaatatacatagtaactgaactataaaatctgtgatcaagatgacaatttacatattaaatacatataaatgacagcatgtgatttctgttacatgtcaatgatatttttggaaatgtttgagcctttgaagaactacttcataaatcaacttatgtgtcctacaatggtatcaagttttataaatg

SEQ ID NO: 197924 - DNA, 266 bp, Homo sapiens
ggaggattaaaggagcaaagacttatttcttggttgcactaaaagtctgttatgcgttggctgtgagtctgtttcacgctgtctgcgatctggaacccaggctgctgtggtggttccatatggaaagttcccggtgaccaccgaggaggaagagagtgtggcaaaatgaagttacttccctgacgtcctcagtccacgaaagtcatgtggccacaccacattcaagtgggcaagaaatcaaaccacatgatctgaaagagaccttt

SEQ ID NO: 197925 - DNA, 411 bp, Homo sapiens
atcgctatttgtgcatgtaaacacacacacacacatctccaataaaactccactgaattgtaacatgcaactgtaataaagtgattaaaagagaatgacatagcaatataaagagcaaaaactatgtgaaagtcaatgaaaaaaattaatccttcagagcttccattagtcatcagaatcatcttaaaataaatctttaaatttgtgatagatttgaacatttgaagcagccagaaatcagacttatcagacttgaatgatatataatttcatgctctttgccccataacctcctacaactactgtatgatacataattctttctaataaattaaacataagtttatctgataaatctgaaatatccttaaaattaaagtggagattctagatcaaagcgtggcggggatc

SEQ ID NO: 197926 - DNA, 602 bp, Homo sapiens
aattttatatgcctgttacatttgtggtaggagtttagctagattttgctggaaaactacagcttatttataaagtacacacattattttaatcgtacaaaaatgtgtaaaatatcttactcaccatgtaacatgggcaccccaaagtacatgagtttcttaagaagacatatgaaatcttcaaggctataaagaggacaggaaatgactcacttcccaatgactccaggtagattaaatacgcccccccttttttttaagacagtgtctcactctgtcatccaggctggagtgcagtggcacgatgttggcccattgcaacctccacctcctgggttcaaccaattctcctgcctcagcctcctcagtagctgggattcctggtgcatgccaccatgcctagctaatttttgtatttttagtagagactgggtttcaccatgttggccaggctagtctcgaactcctggcctcaagtgaggccaggcctcccaaagtgcctgggattacaggcgtgagccaccatgcctggcctgaacgtcttattatttaaaagtgtgttggggtggtggtggggccttattcctaatacttaaaatcat

SEQ ID NO: 197927 - DNA, 498 bp, Homo sapiens
tatacacatagctctctttttatgaagtggaatggcttagtgattaatatttctgtctgaggtgggggtgctttcttaaggttattagtagaaatggtgtttggagttgtttagtttctgccatgggtataagtgagttgtctcttaaactgactttgcacactggaaaaataaaatgaaaggcaggcctggctgagagaccagagcttctgtgccctttgatgtatcatttgagccctttggactaagaaaatgaacttcaacttccccgtcctctgcttcacaatttagttatatctagcccttctgccaaagagagtagtgtgtccttctgcctttttgctctatattctctcaagactcctgaaagctttttctagtatttctcccttcttttcggctcttcagattccttttacccactgtttctttccctggcctgctagtgggctcttttccccactcacctcctctctgccttgttttcccctcagcttc

SEQ ID NO: 197928 - DNA, 595 bp, Homo sapiens
aatttatccagaccaggtgctgtggctcactcctgtaatctcagcactttgggaggctgaggtggcagcatcacttgaggcctggagtttgaaatcagcctggagaacacagtgagaccttttccctataaacaatagtaacaaagggttaagaaatatatagcctttctgtggtggtgtcacaggtagggtagctgtgttagctcagtctgctcttgtgtggattcactgaaagacacgcccagctccgagcccctgtggtccctccgaggctgctgggccagccccctggcggctccccttcccttgtggctggaggatggactgtgggtgcctgctgctctcccaggcctcatcaccccatggccttgggctcagtttctggggctgcccttgtggacgggctcctgttttggcccccagttcttcattcagccatgacagtgagtgccggctgcacacgcagcagttgtgagccccaaggcccagacgggagcacagtggacacagccccagcctctgggaccgtggcccggtggggagatggaggaggcaggagagccgtctgataggggtgaacagctgagaaaatagg

SEQ ID NO: 197929 - DNA, 191 bp, Homo sapiens
cccaaccctcccacctccatctctagtcaaatgctggtgtgctttctagcactaaataatagtttgcatttcctggaattttatcttggtgaactcacatggcatatactctttttggtaaggcttcttatacttcgcatgtttattttgagactcatgcatgttttggcgtgtatcaagactacgtttct

SEQ ID NO: 197930 - DNA, 521 bp, Homo sapiens
atatcatttctattttctagctgaggaaatggaggctcaaaaggttatacagtttgcaccactaagctaatagatttgaattcagcctgaactacacagcctgggtactgactgccttccgatcccacagagtgaggacatcccaattcacagcatccttgaagaagaagatgaagatggtaaagacaaaaataatcatgatagtaaaacactagctaacatttggtgagtacttattataagccaggctctgtaccaagtcccttatatagattaacccagttcatccatacaactcacaactctagtagtaggcaccaacattatcctccttttgaataaggaaccagaggcacagaaaaatcaattaacttgtccaagttgcaagagcccaagtttcaacacagggagcttgccctcttcagcggcctctcctgtcttctcgggatggggagttcactgtcttacaccgtcagaaggctgcattcagaaagctgctctttccattgaactgaaatgag

SEQ ID NO: 197931 - DNA, 275 bp, Homo sapiens
tagggaagaaagtgctcagcaccctttggagaaggcccaggcaccagagcagaatttacaatccaccacaggaagcaagaccctcatctcatctcctgtgtttgcaacttcctccaactccaccccagctgggacagcctcaaagaccccagtcctcctgacgccagaactctgaggagttctattgtttaggtggttttcggttttgattatttaatacagtcatttctggttttatattcacagctttggtcagctgggatagggtttttctt

SEQ ID NO: 197932 - DNA, 378 bp, Homo sapiens
ccacctcacatttctagttctccagagcaaaaggactagctctgcctctcatttcttgactgtggcagacagcccctgctccctactggcgtggccagatttccgggggcctctctgtagactgcggtgtggggtgcatttcaaccgtgaccttgccctcgttctatctccttccaacctctttggttatagccatagtactcctcactctgtcttttactcttctttccttcctttcctttcttcaactttctttcttcccattgcctccctccctcctttcccttcttctctaccttttgagcttcattgattatcctttaaattaatcaaatttaaattaatcaaaattaaatgatgcttgttgcaagtaactta

SEQ ID NO: 197933 - DNA, 540 bp, Homo sapiens
cttctttttattccctagcttatgtttcattccctcttgtcttgatgactttattatagctatttaaaaaaataatgcgtgttagaaccttttatatgttgagtataaataataaattagtagaataaaatcattgtagattaataaattttattaattttgctagggattcattgagctttcttaatttgaagttttatagcgttgtttcttttaatattgcctttcccttattctctctcatctccatctaggactctgatgagatatttgtagacccctcattctgttctccatgtctgtgaagttctttcatattgtccttccctttgtctttctcagccacattctggatagtttttttcagatctatcttccagttcactggttttctcttcagctttgtcatatcctgtccatttggattataatttagttactatagttttcatttctaggtgttttatttgattattttcaaaacctgctttttcatattcactttttccttagtcatattttaaaatatttcttataaac

SEQ ID NO: 197934 - DNA, 424 bp, Homo sapiens
attcccaaagcctctgtggatatattttaacactgtagacataggtgtgagcctctcgaaaccaaggtagattacatcactagcctactaaaacccccccaccaaatttctaacagcaaaaattctgaaccaataataagaagcacttcataacatggcccagaatgattttctcagtcttagctttttctgcctcccagcaacacaaggccccattttaaacaggccttgcacttccacttcaccttacagggcttgttatctgggtctcctcctccccctataagaccctttaaaatacatctcatccttccaaggccaaactcaatgttgccatctccagcaatgtgttacatatagccttgatgttgcttttaacaattctatcggccaggcgcagtggctcacgcctgtaatcccagta

SEQ ID NO: 197935 - DNA, 908 bp, Homo sapiens
atgctttcactgcttatagaccagaagtaattaacaaacacctactatgtgctagacaccctacaggggatacctctggatgacttacagggacagcaccaaaatacaagtaccatgcttgcaccgcatgtcaggcactgtatcatgacctaaagaaaaggagaggcaaatagacaaaccaaagtcctgcctctaatgaagtgtaatctagctagtagactagatttggattttcggacagcagaatgtgacttgatagttgaaggtaaatgcaaatcagagttgaggacaagagaaaggtccaaatcattatgtttttggtacttcaggacctttctcatctccctaaacaacagaagattcaatggtgtactcactttttttttgctgaggcaggagaatcgcttgaacccaggaggcggaggctgtggtgagccgagatggcgccactgcactccagcctggacaacaagagtgaaactccatctcaaaaaataaataaataaataaataaataaaaggacaacatagtgaaataaggacactacaaggtttagttgaacagcctgggcttgtcagaggaactacaaaatgggcatcataataataatccctatttcacaaacttattgtgaggaacaaggtgtgataacatctataaaagacctattcttcgctcatgggaatatgaagaattacgcatcttttgccttattctgaattagaattaaattagataactaggtaccatcattaacctagtgagactgtatcatacttccttttgttttttgaagaaaacaagctgattcatagttttctcccacaaagaaccctgctgccaatactaaccgaaaaaaatggggtaaatcttgcctgtagcactagtctataagctctctctcctg

SEQ ID NO: 197936 - DNA, 801 bp, Homo sapiens
ctgtggcctatgactgcttggcaatgtgtcctgtggtcacagcagagttgagcctaggtcagggacagtggtaggacccacccctgcaggtgtcatactgggcatttgatctgggatgtctttgtccatgccttggtaaaggggcagtctgtcagattagggaaactgaggcaggattggtgtggctccatatctgccagtagtcactaagtgacctggggcccaactcttggccagaagtcctgaagccgcctgccctgcagatgccttgggtgtggcctgcttggcccttttaaaactcttaaatgaggttccagccttaaaggaccacagcttcacagccggctccagggtcctctggagagagggagggatgcggccgcgctgggccttctctccttccgcctcgcgttggcagtcctgctggggttccttcccttgcccgcgaggcatctgatcctgagagtccggctctcaagctgcgactgggaatgggccccagcagcctccctgcgctcctcggaacaaatgcaggcacgaagaggattctgcgagctgccgcgggtggagagccgtgtttatattggtgccgcttcatacacacatcatgttttgaacttgactccaaggcctttgcggggaggcacctttctctcccccaaggggtctttgctggtggattcacggtgcctgcccagagggatgtgtgggacttagtgtggggagggagcccatgcttgatgaactcggcctgagtgggccctgatcagtgcgtcgtagaggcccgcatgctgagtctca

SEQ ID NO: 197937 - DNA, 782 bp, Homo sapiens
taacaagggtctcctctggcatatgcaaaaagactaagaagatgcttttgcataaactcaaagttacaaaggatagtttccggtgccaataaaattctgctactcactgaataaactaatctgtcaaagaattagcaacaacctaatcagactcaggcaaactctagttgaaactcgggtaaaattaggaaaaatactaaatgagattgaaactggaccacaaaaccacttctttgaaacaaaaaaaaaatcactgtaacataaacaggcacaggagtatggagcagactcgtacagattaagtcttaatttaaatgactgattcatttaaaaagaaaaagaaaataccaataaactactacctttgtcactcatctacaatgtgctaggcactgacctgggtgtaaaatatttctgaaacagtgttccaatgtccattctccagtttgctgggtgttatgaggcagctattcctaaagcaatagcagtggcagcttcctagtcctgaatagtagctatatactgtttttaaaacagtttactggttccattggtggcctcacacataaaagctcccaaagaaggtcagttctacaacaatgttctaagcatcattattgctcctctagcctctctaaaaatcatttctaagcacctacatctcatattgtttccctttctgcttaaaatccctagtgctgccgggcgtggtggcacatgcctgtaatcccagctactagggaggctgaggcaggagaaacgcttgaacctgggaggcggag

SEQ ID NO: 197938 - DNA, 835 bp, Homo sapiens
ctggctaagctctgttcctgctttcatatactgtaaggttcttctgaacagctgtctggtagcccctgaacaccactcaacactagtgcagtactcaagtgactatcacacaaatccgtgtctggggatctcttcacacccagagctcagcatcaacatgccatgtctcttatatctagccatgctccagacctttagagaaaaaataaaccttattttcaatttaaagtaaaatatacccacataaaaaccttgtcctaaaactagataattttatttcataacaggctcaaactgcttatcaagcatgcatttgctccaacagccactcatcagcttcaacactgtcctcatgttaacttcccttccaaagggaaaaaggatgtgatccacagtatttttccaaaggaaaattaatgaacttccccgaaattaaaacaaatataacttaatacacaaaaactcggccaggcacggtggttcactcctgtaatcccagtactatagggggccgaggcagctattcctaaagcaatagcagtggcagcttcctagtcctgaatagtagctatatactgtttttaaaacagtttactggttccattggtggcctcacacataaaagctcccaaagaaggtcagttctacaacaatgttctaagcatcattattgctcctctagcctctctaaaaatcatttctaagcacctacatctcatattgtttccctttctgcttaaaatccctagtgctgccgggcgtggtggcacatgcctgtaatcccagctactagggaggctgaggcaggagaaacgcttgaacctgggaggcggag

SEQ ID NO: 197939 - DNA, 280 bp, Homo sapiens
aattagggaaagagaaggaggtagaaggtaaacttactcgaattctgcaagatcagaatatataaagtgaacctagtcactacaggcgttgctcaaattccattctgagacttagtcactaatattcggcattttttgtgattattttatagacatgatgtcattgtttcagtgttttactaatcaccaatgacacaactgccagagagcatttattccccattcattccaacaaatgtttactgagcatttactttgcccaaaaaacagggtggtacat

SEQ ID NO: 197940 - DNA, 417 bp, Homo sapiens
taaaatttattgtggtgatgcttatacaactctgaatataaaatgtaaacttcacactttacatatgtgaatggtatgcgaataatattgttaaaaatcagtattgtttttaaaaattcaaatatacaaaagattataaacttgcacctgttcatataatggattttttagaaattatacatgtctctgctttaaaatgttttaaactataaacagaatgctagtttatttaccaaatggaaatggttgctagtcatcagtattttctgagaggcccaatctttctagcatctaggtccctgaagatagctagaaagtgtgcagaggttgagagtaagatcacagggtctagtcatgtgttgagggggcatatttccaggccctcatgaagcccagtgacttttccctgtgtccaga

SEQ ID NO: 197941 - DNA, 408 bp, Homo sapiens
cagtggcacaatcacggctcactgcagcctcgaccttccaggacttatgtgagccttctgcctcagcctcttgagtagctgggagtacaggtgtatgccacaattcctggctatttttggtatatttttgtaggtatggggtttcaccatgttgcctaggttggttttaaattcctgggcttgagcaatctgcctgcctcagccttctgaagtactgggattacaggtgtgaggcaccatacccaactaaattctttactgttttaatgcagttggactccttcatatcacatctaagagaacatattgtagcacatcaggtgaggaagtgtttgctttaggcctccacacagaatcacagtcatctgctaaaaagatccattgcatgacccctacctctacccttgt

SEQ ID NO: 197942 - DNA, 453 bp, Homo sapiens
aatctttggagagcatgtatatattatagttgactgtatagttatgtatgtattgttgggtcttgaaagtgaaattatagattcaaagtcatttatccacttaattttttaatgcttggggagtatttgttttcagtgaattttcattataatatttaattctgtttcttttcaaaggcaataatggataaaacaatgactgcaaatttcccatttctcctacaagagcataatagtgttaatgacctttttcccactcaggcaggggaataatgcccaaagctatttacattgcacacgcaacttacttcatttctctgttagtggaatgtggggttttgcatatgctatgagaactaaaattagcatttagacgtccatgttaaccatgttaacatgtagtaaaacatttcaattctataaaataattaatttattaaaatgtatctcaga

SEQ ID NO: 197943 - DNA, 1140 bp, Homo sapiens
agacaggagaatcgcttgaacctgggaggtggacattgcagtgagccgagatcgcgccattgcactccaacctaggcaacaagagtgaaactccaactaaaaaaaaaaaaagtgtccttgagaatatctttggattgatttcacctgtctatactttgcctgcttgcccttttgtgtgtataatcaataacagacttttcaaagatcaggaatgaacttttgttttttccactttttggtctctgtgaatctaaggaatgaactcttaactagagtcttgtccatatcttggtaaagatgccctctgcccttttcagttaggccgcaatgtaacaaactcagtccatgactgaatttaatctaaccagcccagtatttccttcctgggatccaccagcaccaaatataataaaacttcaatttggaagtcgggcaccacggtgcacacctgtagtcccttcggtggctgggtcaggagtactgcttgagtccgggagttcaaggccagcctgggcaatataattgggacggcaccctgtctcaaaacaaaacaaaataaaatcaccttcaagttggtcttttcttaacaactttattttttctttctccaatacctcatcttgagcattcttcttttgattaataatagcatactggtgtttggatccccttcacaaccagaaagataaaaaaagcctctcagggtagatataggaaaacttcaaatcatttcaaatagggttcctgaaatttcttggagaaaataataagctatattagaaattcagagaaaggaagaattcagagaccttggctctcggtctggcttcactaccaaatcacttaagttatttagataatcacaggccattagttttccctacttcagagaaatgctgagaccgatgttcatttaattcactggataaaaactatccaaaagtaagactatttatctttttttatcttttttttttttaagatggaatttcgttcctgttgcccaggctggagtgcaatggcacaatctcggctcactgcaacctctacctcctgggttcaagcgattctcctgcctgggcttcccaagtagctgggattataggcacgcaccaccacacccagctaatttttgtattt

SEQ ID NO: 197944 - DNA, 417 bp, Homo sapiens
tctcggctcactgcaagctccgcctcccaggttcacgccattctcctgcctcagcctcccgagtagctgggactacaggtgcccgccaccacgcccggctaatgttttgtatttttagtagagacggggtttcaccgtgttagccaggatggtctcgatctcctgaccttgcaatccgcccgcctcagcctcctaaagtgctgggattacaggcgtgagccaccgcgcctggccgagactccatcttaaaaaaaaaaaaaggaaatttttatcaccctataaagaaattttggggctgggcatggtggcttacgcctgtaatcccagtactttgggaggccaaggcagatggagcgcatgagcctaggagtttgaaatcagcctgggcagcataacagcaccctgtctctgaaaaaa

SEQ ID NO: 197945 - DNA, 841 bp, Homo sapiens
gttttgcactaagatagtggcaagcccagaaaatgattgggctcagtgtctccatctaccatcatcttcacagaaatgttaggtttcacatttctttcctttcttctataccctttcgctatcttacatctcagtttattctgtttcaagcattagtgtgtgtgtgtgtgtgtgtgcgcgcgcgtgtgtgtgcgtgtgtgtgtatgttttgagacagagtctagctctgttgcttaggctggaatgcagtggcacaacctcagctcactgcaacctccacctcctgggctcaggcaattcccctgtctcagcctcccgagtagctgggattacaggcatataccaacacatttggctaatttttgtattttcagtagagttgaggtttcaccatgttggacaggttggtctcgaattcctggtcaagtgagccgcctgccttggcctcccaaagttttgggatttcacgcgtgaaccaccgtgcccaaccccaagcggtagttttttccccacgtgtacacactgataccctatttaacttcttttctaaatttggcttagttgttatggtaaaatctttcttttttgtttgccattttgcacacaaagaacctcaaacaaccctaatcataaatgagaaaatttaatatacactcatactagtttacttgtacgaaggatgaaatagtcatacatttaatgtaaatgagacaaaatatagtaacagcttgtgtcaagggtctccaagatcaccctgattcagtgatttgctagaaggactcacagaactcagaagatagttatacacactgtgatttattatagtgaaactttattaagc

SEQ ID NO: 197946 - DNA, 629 bp, Homo sapiens
tccataaatccaagcaagacaatttgttaaggcttagcatgcaatcaggcatccaaaattccatgaaaaccagaaggcagggtgaggaaggaacaggaaccaggcagcagttctgtgcagtggcaccaagtgacagcaagaaggcagcagtactaccaaggcaagattacacccagccaaaaaaccaccagtctgcagggcagccaattgacactccaggcagagccattcagagctgaagagaaagcactaaaaaaaagtgcagccacttctgtgattaaagacaatgcccatggtactaaagtaccgtcttggagacactggtcatagttgttaaagcttccagccctcccagagaacatctctatgaaaaaaatactggtacagcagccccaggcccaccttctggaggttcaacttttaattttagttgtttcaagtgctgtggaaaagactagacctgatccctcagttcttcatattgccttatgaacactggccagaagggaagcacatccctcccttttgttaatttcctccaatattgctaagacaaggaatttcaaaatgttcaacaaatattaagaaacaaaaaagaaatgaataaagaaaataagatgggcaaaaat

SEQ ID NO: 197947 - DNA, 706 bp, Homo sapiens
catccaaatggctttgaaacaagttattgtagagcatgcttcctaccgttgtgttttgagtgagaacttccagcagctgggatttcgagctagtttgttatctgagttcctcatccaaacccccttagagagaaggggagaaggagggaaggaaggaaccacacaccagggcacgtggtattgctccatgtgcagcaacacatggagcagtggaggcaggtggaggtttacaggtcacatgaatatgatgagggtcagcagaattgcggccacgtccccaggagcagggctccaggtaggagcagcctagggactttctcggtgattctgttgcgtgttggtgtcctggtttggattcatgccatctgcaacacagcagccatctcctctacagtaagcaaactaaaccctaaaaataccttacaggctgggcacggtagctcacacctgtaatcccaacattttgggaggctgaggtggacagatcacctgaggtcaggagttcgagaccagcctgaccaacatggtgaaacctcatctctactaaaaacacaaaaattagccgggcatggtggcgggtgcttacaatcccagctactcaggaggctgatgcagagaattgcttgaacccaggaggcggagcttgcagtgattcgagattgcgccacagcactccagcctgggcaacagagcgagactctgcctc

SEQ ID NO: 197948 - DNA, 715 bp, Homo sapiens
taataatctattaatataacacctaaatttgctattactccatagtttgcattttgaactattttcatttggcataagtataacctggaaaaggcatgtctgcccttctttcagagaggaaaggtgtttgaatggcaaaacccttatgtggttgaacttttccatttctttctctgtgccttcatttgagcaggtggatattacctgaggaaaaagatgacacaaatggactaattggctttactcgaaattcatgattacagtgttcaaatgggcactgctgtagttggaatgtttatgtttccccaaattcatgttgaaatcctcacccctcaggggatggtattaggaggtgggtcctttgagaggtgattagattgtcaggatgaagtcctcattaatggaattagtacccttactcaagaggctcaagagatccctgtcccttctaccatgtgacgttacagtgagaagacagccatcagtgaggaagtgggccctcactagacaccaaatcttttggtgccttgattttgggcttcgagcctccagaactgggagaaataaatgtctgttgtttttataagccagctagtttatggtattttggtacagcagtctaaatgaactaagacagacattcaatattgctttgtaattctactcttaacttgccatgtttccagaggacttttacacccacattctcagttaa

SEQ ID NO: 197949 - DNA, 402 bp, Homo sapiens
tatttatatattgagaatatggggggaggtagataacagtagtatggtgggactaagaaaggtttgataggttaaaaaagaaacaaagaaaaattatgatgacttttatattcaggcaatgaagccatatcaagacaataataaaacaaattatttaattaaacatgaagagaatctatatggatattcatatattaatattacatatcatataatgttaaatatgaaatatattaaataagttaatgttggaacttgttcgggcatggtagcttcacacctgtagttccagctacttgggaggctaaggtgggaggattgcttgagcccaggagatcaaggttacagtgaaccatgttcctgccgctgtattccagcctgggtgaagagacaatgtctcag

SEQ ID NO: 197950 - DNA, 418 bp, Homo sapiens
ctaagaattcattactactagactggtcttacatgaactgctcaagggagtcttatatctggaagtgaaaagacaatagccaccatcatgaaaacataaaatgataaaactcactagaagagccaatacacaaaggaaaaagagaatcaaatcttaccactacagaaaaccacctacctgcaaaaataataagagagaaagtaaggaacaaaggaactataaaagaaccagaaaggctgggcgcggtggctcatgcctgtaatcccagcactttgggaggccaaggcgggtggatcacgaggtcacgagatcgagacaagcctgaccaacatggtgaaacccagtctctatgagatcgtgccactgcactccagcctggtgatggagtgagactccgtctcaagaaaaaaaaaaaaaa

SEQ ID NO: 197951 - DNA, 469 bp, Homo sapiens
gaatttgttagagtaggacatggaatggtggagagagattgggatggacgtgtcaggcagacaagcataagtaagaatatagcagcttatggattgatgggaaagataagatgcaaactgaagcctggaatactagtaaaatgattgggtcaacaaaaatagggaatcctgaagggtaggccagtttgaggggtggagagtggaaacagatcatttggggcacattgatagcagtcatttattgactgtctacttcaagccaaggattctgccaagtactgtacacacattgtctcatttaagtctcaccacagaccataatttgacaagtgcgagactccgtctcaaaaaaaaaaaaaaaattgcctatcaggctgggcgctgagtcttgcacctgtaatcccagcgctttgggagcccgaggtgggaggattgcttgagcccaggagtgcaagacgtatctcttaaa

SEQ ID NO: 197952 - DNA, 450 bp, Homo sapiens
agctgggacaggtgcgtgcattgattagcattctggagcccaacaggtgggcactggaggcttccttgccgtggtaaagggaaaccggtgagagggggcgtcatgtcatccaggggagaggagtgatgttaacaatagaaatggcagtgtcacatagtaaatgctaccgtagaatgagtgtggatgtggcgtgcagggtgtggaaggtggcagcaggcgctgtcgctaaggctttctgtggcaagcacagtacaagcattttacacacatatctatctcacttagtcccctcagtaacaccaaggaatagaaactattattataccattttatagacgaaggaatgaaggctcagagagattaagtaacttgcccaaggccactcagcttgtctctggcgggggtaggacatgtctttgtggggaagtagggaggagagtggggagagtg

SEQ ID NO: 197953 - DNA, 512 bp, Homo sapiens
catggtgtagcccattaactcagcttcctaggaatgctcttgaactagtttctatttggaaatgactgataaatgtgggctgaaaaggcccgagagccccaaaatacagcaaggacactctgaaggaccccctctgatatacttgggatgtgtgtccctgcccaaatctcatgttgaaatgtaatcttcagtgttggaggtagggacctggggggaagtggttggatcatgagggtggatccttcatgaatagtttagcactatcccccgcattgtactgtcctcacgatagtgagttctcatgagatctggtcatttaacagtgtgtggcacctccccgcttgctctcttgctcctgcttttgtcatgtgatgtgcctggcctctttttgccttctgccatgaatgtaagcttcctgaggcctccccagaaaccaaggagatgccagcctcatgctgactgtaaagcctgcagaacaataaaccaattaaacctctctttttaatacatta

SEQ ID NO: 197954 - DNA, 83 bp, Homo sapiens
caagtaaaactgaaagataattatggtatgaatgttagtaaactgtttatcacagaggtacaataagggtgaaaataaattta

SEQ ID NO: 197955 - DNA, 470 bp, Homo sapiens
gtgtgtttgtttcacttctaacaatgtttttagttgaatgagtcgccaatatttttgtttcttggttttaaaatgattattacctttttttttcaaattataaaagtagtatatccctattatgaggtaatttggagtgttgaacattttggccttttatctacgcatggtgcattttttaattgttgagatagtattttatagacaaactatgtatcttcttgtctacttaacatcctagcagaagcattttatgtcattttaaatacttttattaacataaccttttaaaactttatgaaaatcttaaacatatgtagtagaggctagtttaatgaaccctcagttctttgacaattatcagctgctaggcaatcttgtttcatgtaaatctccttctgtagtttgggtttgactggttctggtaacacttctataagtttgaatattttgaaataaaagttttagaa

SEQ ID NO: 197956 - DNA, 731 bp, Homo sapiens
cttcatattttgccatgattataagtttcctgaggcctacccagccatggctcctgtatagcctgcagaactagtttcactcttgttgcccaggctacagtgcaatggcacggtcttcgctcaccacaacctccgcctcctgggttcaagcgattctcctgcctcagcctcccgagtagctgggattacagatgtcaattatctattatgcaccagacactgtactggatgtgagggtcatggctgcccataggccatgaggtgactgcgtgcaaatttgaaaaaggctctccagatgcacacctctgcaccaggttgcatgaattgctgtaacactccccgtggagatctgcagcttcactcctgagcccagcaagaccacaagcctactgggaggaatgaacaactccagacgtgctaccttaagagctgtaacactcactgtgaaggtctgcagcttcactccagagccagcgagaccacaaacccaccagaaggaagaaactccaaacacatctgaacatcagaagggacagactccaaacacgccaccttaagagctgtaacactcactgcgagggtctgcggcttcattgttggagtcagggagaccaaaaacccaccaattccggacacaaaatgatcttctcacctcagcctcccaagtagctggtacccaggtgtgtgccactcagaggtgacagcatgctggcagtcctcacagccctcat

SEQ ID NO: 197957 - DNA, 442 bp, Homo sapiens
gcagatgaggaaggcacgagccaaggccgggggctgccggcttctcaatccaagcagcgtccactccccggctcacagccccagccaagcccacgagacagttcccaggggtggcaggaacaagggccacaaaacacagccatagaaatgcttcttgggcacggagaggcccctcaagtccaccacatcataggcgagtttccctattctggacatttcatacacaaggaaacctagaatctgtggcctttcatgtcaggcttctttcactgagcaccatgttttgaaggttgacccacgatgtgtcacttgttaggacttcagtcctttttatggttggatgtgcatagcacgttatgtttatccattttctgttgatggaaatttggattgtttccatattttgctgttgtgaatagtgctgctgtaaacattcaagtgt

SEQ ID NO: 197958 - DNA, 327 bp, Homo sapiens
gaaaccaatttaagaagttaaaaagcctcaaacacttgcaggtatggtttctgaagtttggaaggaggctattctaaaggattgttcagagttcctgccaaagactaaaaactacacaattatgccagcttctatgaaaactgaagtagtagttagtaatgtgcgctaaggtaaggaggacaagaaatgcagatggttgacctagttacataacatccccttccctaggtattttatagtattctgttttatgaccacttggttttatattttcttcattccccaggcttcagtgaaaactcagtatgcaagtgtcaaacctatgta

SEQ ID NO: 197959 - DNA, 606 bp, Homo sapiens
cgctgggtatggtggtgaacgccagcagtcccagctaatcaggagggctgaattgggagaattgcttgagtctgggaggcagatattgcagtgaggccagatcaggccactgcactccagcctgggcaacaaaacgaaacttggtctcaaaaaaaaagaaaaaaaaaaaatccaattcacttaagtgaaagaaaatcacactggcctgagaattctatgcaacattaggatatggagattttattacaaagattttattacaaagatatattacaaagattttaaattcagcccaactgtcattaagtccttcataactttcattttatgaaactgtcattcataaaatgccacaagtatgaaaatataaaaacttaggaaatattgtctcttcctaaggaatctcctagacaacacatttcagacaatcaaaaaacaatttgaaacgttccaatgtaaaggaaatacaggagaaaaacaaatccagaacatgaaactcctaaggaatctcctgtcgaacatgcttcagacaccctattgagaagcttaaacataagaaacatacggagaaatgaaagaataaaatccagaagattccacaaaacg

SEQ ID NO: 197960 - DNA, 308 bp, Homo sapiens
gcggatccccacgcgtcaaattaacgtattacgggaatagttgaaacatcttaagtacaatctattaaacacatctttgaagaaaatgctcagaattcaaaaactcactttaattaactaaataacaaaattctgtttatgtgtagacgcacagtaaaacagtatgcatctattccctagcaacctcttgagctggatatgactgacctcacaaaaaccttctgagtgtcagatagtgtggtttataagtgaagcacacattttatataatgcttagaagtaaacaaggctgtacatttttaaataac

SEQ ID NO: 197961 - DNA, 483 bp, Homo sapiens
ctttcaaaaaaacttcctctccttcattgttgactatgaagattctttcatgcatgtcctgtccactgtcagtcccctctgtattcacaagagcaagtgtaatgcccgctgtgaaggagctaaagtttgttgaataaacacatgaacaaatggtggttttgtggtgttcaactgaaatatttcctatttcagcactggaccacgctgtttttctcactacataatcggttacgctaaatgcatcacgagccaaattcaaaaggtcaaaggagaaggcaaatggcagagtgtggtaaaggggcgagtgagagggtctctgaaaaaagtcaggctaaaattacagggggttcaggcaatgttatcttgatctggatggccagttacatgacagattactttgttcttaacatacgaacatcctattcactttttggtatactggttgtttaacagtaaaaattaaatgtttaaaacccaccatta

SEQ ID NO: 197962 - DNA, 664 bp, Homo sapiens
cagcataaattcctgttccctttacccctcactcaaagtgtctgcttttggcttctgccagagactacccttccaagcctacaggatgggaagcctgcaggctgcaaccctttatgcgaaataaagctcccctttccaaatttataaacccagtgatccttcagttgacaaatccataagcaaacaaaagaaaaaggaacatcaacctaagtctcacacctcatacaaaaattaaaatgcatcccagagttaaatgtaagagattaaacttttaaaacttttaggaaaaaacataggacaaaatctttgagatctaagagtagacaaagtactatttgacttgacaccaaaagcataagaactatcaaagaaacatacattggacttcattaaaaacttttgctctgcaaaattctttgttaagataatgaaaagataagctatggactggggaaaatatttgccaactatgtatctaacaaaggactagcaccaacctttagtcagatataaagaacacttggtggagtgcagtggctcatacctctaatcccagtgttttgggaggctgaggcaggaggatgcttgaggccaggagttcaagatcagcctgggcaacaaagcaagatgatactgctacaaaaaatgaaaaagagaaaataaa

SEQ ID NO: 197963 - DNA, 566 bp, Homo sapiens
gttaaatgagaccaaagttttagaaacatttgagtggaatgcactcatttaaattccctctcctctaacaatgttaaagtagaaagtccaagttgctatttcctgaatggggagtgtccatgtgagtaggctcagcaagccctatccaaatgcacctgcctggaccttctcgaggaaaggcaaccgggctctccctcatgaggcactgcggttttgtgtcatcaaacacacccactgagaagtgggttgcctatgaccacaccagagatgggaaattcctaaccaccaaggccctaggtaatatatcagatggacttcttttatgcgggtttgatagagagcacaatctcaattatgttttacaaatccaagcagagctcaaataatgcccctgcttagtagcttcctagtgatgaccatccaggtcattcatctttcccgcttttctcaaaggcccagtgagaagtctgtcaaccccagcatcccacacggtgaaaccggcttccagcaagctctctcccacccgaggcgcaggctctgagccatcaccagccttgctgggcatg

SEQ ID NO: 197964 - DNA, 363 bp, Homo sapiens
taagtgacatttccagattccaaactttaattctatgcaaatcaacacatgcttatctagagcctattatatgcacagagctctggccaggaaataaataaaacatcttctctgcctccagggactcacaatctagtgagggagaaagatacaagtagaagaaaccgcaattcaaagcagcatttgataggggctgtaatggagggacaaaagcaacaaagaagccaggagggcaagactcaaactctccaagttcctctaagtgccagaattaacttctctgtttttgttcttactataatttttcacattgccattcttattgtttttgccttaataatgagtagtcttaggagtcgacgc

SEQ ID NO: 197965 - DNA, 730 bp, Homo sapiens
atggggtctccctgtgtcacctgggctagggtacagtggctattcacaggagcaatcatagcacactgcagcctggaactctgaagctcaaacaatcctcacccctcagcttcccaatagctgagactacagactcacacaatgtgcttggcaaggccttttattctaaatgcagtggtgagatggacaagagatgtaccatccatatcctcctttaaggaaggacttgatgcccagatgtaaagagtgtagtcaccaaacagccctttcagaatctgccccagacacagagagccccactgcttaaggatatacccttcttagagcagatcgcttctagagactaagtgagcagggttataaagccccagctattttaacctaacaattctgacggataatactcgtttttcagagctccttgataggttggccaaggctatttttggtctgcatcactgatttcttcctcagtccaactcagatttctctttcttccttgtcacagatgttaaaccttaataacatgttgaatcccaaactccacctctgcatctgtgacaaacttaacctgtgacaaatgggaagccataaaaggattttttttttttttttttttgagacagagtttcactcttgttgctcaggctggagtgcaatggcatgatctcaatcttggctcaccgcaacctccgcctcccaggttcaagtgattctcctgcctcagcct

SEQ ID NO: 197966 - DNA, 198 bp, Homo sapiens
tcgatgtctgcgacactcaggaacatcaaacatttaaatgtaaaaaagaaaactcaaaccataccacaggaaaccattagcaaatattttatagtcatggaataaggagggcattcgtaagaatgaaacaaaatccacaaacaataagcataaaaagattcaggctgggcacagtgactcatgcctgtaatcccagca

SEQ ID NO: 197967 - DNA, 217 bp, Homo sapiens
ccaggccagccttgaattcctaggcttaagtgatcctcctgcctctgcttcccaagtgactgggactacaggcacatgctactacacccagctacagtggtttttagtatgttcacaatactgtgcagtcacatctctggtggttgttttctttaagttattttttctgaataccaaaaaatacatgcttattatagaatgttttaaatattctaca

SEQ ID NO: 197968 - DNA, 357 bp, Homo sapiens
tccttcaggaagtgccagagttggaattcaaatcatagttcaaaatctgttcttttagttactatataatcccagcttctctctcatccccagcctctcaaattctagtttaaaattttggacaaaggaaaggtttcaactataaagccactaatctcctggcacattcactcccatcaactaactccaaaccctccaccacacacatgcaaaagtatcttttataaattattataaagtctaatcctactttctttaaaaggtaggcttcaaacaaattaatcagtaatttaatgttatttttaaaagtgataatcatgggtaacttgaaaacagtggaattattaatgttttaaa

SEQ ID NO: 197969 - DNA, 686 bp, Homo sapiens
aaaaaagcaatctacatggctttttttaatgccaatattcatttaacaagttatttttaaagaatctgctatatgaagaatacttaaagccccagtcctgatgggaaacttacaaccaagatggaggagatacatgtaaaataataaagacgtatataatacatcaggcaatagtaagagcctacggggaacaataaagcaggactttgtggtttttgttatgtgggtgcttggggagccctcactgagatgacatttgaggagagggagtgaaccctgcatatgtgtagggggaagagtgttcttgcagtcatagacagtagcaagtgcaaaggccttgcagccagtatgcaaggagcagccaagaggtccatgtggctggagcgcagtgacccaagtaggtgagggaagagcaagtagaagttgaagtcagaggtaaagggagatgggctgggtcatgcagggccttgcattttagtagaaatgggagtgggggccatgaagggttttgagcacaggagtaacatgatttaacttacatttttaaaggctcatctgctgaaaatagattgtcatagagaataagcagggagacaagtaagaaagctgttgcaggaatctaggtgagagatgagctggaccagaatggtatcagtggaggaggtgaggactggctggattgggga

SEQ ID NO: 197970 - DNA, 483 bp, Homo sapiens
ccctggaactatgggtagcaacaaaggagggagggcaggtcacctgtgcagaagaacatgcacacacacaggcatgcacacatatttgtacacgggcacactcatctgcacacacacatgcacgcatacgtgcacaccctccagcacacatgtgttcagatcatgctctcatttacacgtgcacacgggcatgcacactcatgcacatgtactgttgactctatcttgagcttacacatcaaagccacgatctagttcagtacttacttgtttattgatattccatttagcatttaccaagtaccttctatgtaacttggctaggcagtctttttttctcaaacaaaatccagtacaaatcctccctcatccatgaaatctttctggattctccaatgggattgaactaatcctcatagaactttccatgtgcccctgcttgtcacgaatttcatttaccttcagagtaaaattgttgcacat

SEQ ID NO: 197971 - DNA, 528 bp, Homo sapiens
tgatattattttatactttgtgcttggtcttataagcattaatctttccatttgtttgttgtattcagatgcactcaccttttttaaagctgcttctctttttttgtctgttgtcaaatctagtgctgcttctaatgacttttacagatttttttgttgatacggtattttggattttctgaatcttaaaatgttctttcaaaaaagtataaacttaagtagatatccaactcatgatgaaacttccatttatcttaactttctcctttgttggtcctccaaagtaattgatattttttcagattcttactaatgatgcatacaaatgtgtcaaatggccttaattttcaagggacaacacagtcttcattaccctgggcttatcttttatacacagcctattcaatgactccattttctttataggcaaattcattttagttttgacattatgaaaaacccacaagaagatacattgtgacttttctatgtttttctatgttttgcaatatataagcccatgtctga

SEQ ID NO: 197972 - DNA, 396 bp, Homo sapiens
acctcactaatacacctagatggttgataataaaggcagaactagaatacacgttatctgattagcaatatagtgtctttttactaaattattctgttattcatctgcacattcaacaagtatttaatcatatatttactgtagaaaacagcacatcattaaacagacagactgtggtctctgcccccaaggagaatatgtttctagtgagggaaagagatacaaattcataaatctaaactatagaaaatggcaaactctatagcacaaatgtcttttgagagagaataatgggtgaggggaaggaaaggagatgaatacctttaaggtggcaggggtagagctctttgagagactgcaaagcagagaagatgcttcaagaaaaagaagtacaca

SEQ ID NO: 197973 - DNA, 288 bp, Homo sapiens
cttgtttctgaggagcgagagtagaagggggaacactccttgacaaaacaaaactgtgaggaaaacttcaaggccaggcaaagccaaagcctgcccgtcacctcccagtgactacatctggagctaaagacacaagacccagcagtgatttcaggttcactctggacaactaaaacccccaaatgagaggaaaccaccactaagcacttagatgtgagcatggctgactgtatggacttcaacgcaccatttcctggctctgcacctgcttccccagatgggtcccag

SEQ ID NO: 197974 - DNA, 618 bp, Homo sapiens
tctgtcctgaaagcaggccgctccatgctcatctcccacaccttcacctcctgttaggccagcgtccactgcagtggcccagctcttcccagcatccccttacacaggatctgtgttcccttcatggtttggcctgcatgtccttcaacctgggacgtccactctctctcagttctgtcctcattgtgccctacttgtctacttcgggaactctccttcaccactcacctcacacccttcctccaggaagccctccctgactttctaggcagagttggagccctcaccctgggcatttccacagcagaaactgtcccaccacagccgttgctggtggtcatgtttgtgtttgccagcagcccacaagaggtcgaggcgcaacctgtagtcctcagctgctggggccgggcagtggtgtgctttcagcctggagggggcgctcaggaagaggttgtccacttgtgtgcagcttttatgtgtcctgtgcatatggttacagcaccgcttcctgtgaaggagttgagctaggggttgtgctgaatgcagagaacaagatacaaacttaaagaggcctagggtgtggcgggaaacacacaccccttcccccacctatatatg

SEQ ID NO: 197975 - DNA, 198 bp, Homo sapiens
ataaggatttcaaacttaatagataaaaacttaataggttaaaaaaaacttaatagataaaaaacgaaactcttgatctactttttccttcaaatttattctcttaaatttttagaatgctttttttttttttttttttggaaaggggtccttggcctctgtgccccagtgtgcttggggggtgtcccccgggcttca

SEQ ID NO: 197976 - DNA, 211 bp, Homo sapiens
gagtttcgctcctgttgcccatgccatgcaatgagaaagaccctgtctcttaaacaacaacaaagtcagaaggagaggctgccatggctacggctccaggtgacgtcacggccagctccgtgacgcgcggccagggcagcccgcggagaccgaggctcctctgtgacgtcagcagccggccgggacacagcgggagggcaggtgcggccgc

SEQ ID NO: 197977 - DNA, 276 bp, Homo sapiens
ggctagagtatatagtggcacaatcttggctcactgcaacctctacctcccgggttcaagcaattctcctgcctcagcctcctgagtagctgggattacaggcgtgcgccactgtgcccggcctattaagcccattaggtccattttacagacgggagagcagagacctgatgcctgaggtgggaggattgcttgatctcaggaagttgaagctgcagtaagctctgatcatgccactgcattccaacctggccaacagagctatactctgtatca

SEQ ID NO: 197978 - DNA, 400 bp, Homo sapiens
ggaggaatcgctgcttcatgacttcctcaggcatttacatttttctcttctgttgacttaaatcatgaactaaaatttatccctagaggaaaaaagaatgcttcctccattctgggctcttctcactgtacccagactatgtcttcaggactctcatctcttgtcagttctgttgtgctagaaagactggtttgaaaaaattcagctcgtgtaaacctgtgccctccaccctgtggggaacccatgtggggagcctttgaaaatatcacttatcagctgggcgcagtggctcatgcctgtaatcccagcactttgggaggatgaggtgggcggatcatgaggtcaggagttcaagaccagcctggccaacatagtgaaaccccgtctctactaaaaatac

SEQ ID NO: 197979 - DNA, 723 bp, Homo sapiens
cagagcaagactgtttcaaaaaagttaaagaaattaaagaaaaataaatctaaagaaggcttgttacgtctttcctggctggatctgttaggtgatttggtcttgcctgccctgtgcttgacatattcacagcagatcaactgtcttttcttggttggccagattaagttatttaaaagattgcaagtgcccagtagcacagagagcatgggtaaacacatacttccttacatattactggaaacaaatacagttggtcctccaactgcagatcattatgcgtatgatggttgcatctgtactgacccatgtacacactttttttcttgtcattattctgtaaacaatacagtataacaagtatttacatagcatttacattggattagctattataagtaatctagagatgattaaaatatatgggaggatgttcataggttatatgcaaatagtacaccgttttgtatcagggacttgagcatctttgaagtttggtgtctgcaggacattctgaaactaattgcccgtggacatcaagggagattatacaagtgaaacaaaatttggcaatagctattgtctttgtctgttttctgttgcttataacagaatacctgaaaatgggtaatctataaacaaataaaatttatttcttacagttctagaggctggatccaaggttaagggaggggcatctagtgagggccttcttgctggtgg

SEQ ID NO: 197980 - DNA, 380 bp, Homo sapiens
atacctggctataatagagagtgcttgatctctgttcagatgggaagtgttgtctgttagaaaacagtgccattgcttctcctccaggactcaagcagtgaggatccatctcaccgagttgtattctaaaaaaattgcctcagtgagagatgaactgagtattcctactgctgatttgcaaattgctacaacactcttggagagcaatttgttaatttttttccaacaaatattttttgagggtctttgatctgccaagtaccagtttgacttttggggatacaacaatggacagaaaagggcctcatggggcttacagtctagtgggggaagacagagaataaacaaggaaacaaataaaaagggtgatgagtgctgtg

SEQ ID NO: 197981 - DNA, 397 bp, Homo sapiens
cctaaattaaataggggcttttaagcacttcatcatatttagtcctcatgatcacctaagaggttgactttatcaaatccattttacagatgagaaactgaggctcagggagggtaagtgacttttcacaaatgactccccagggtccttatctggtttgccccagagtctttggttgctctaccccattctcttagcatagcctaagagatattttaatttctgactcagcctgagataaggaaatctggctaaacagatagatgcagagctgtgtgtgagacgagctttagcaagtctgcatgtcatttcgggtgtccgacactttctcttctctgacgtcctggcagttcaagctcccagaatccagtgtgagagaaaaataaaaatatctgct

SEQ ID NO: 197982 - DNA, 469 bp, Homo sapiens
tctggggcttggaccctttcaaggcatccatgaagttgaaactatattcataataatgatttttattacttttttcactttcattctctcaggagtgtatgtggagtgttctggaagctacatgatgtaggatgatgacatagctctggtagctaatggaatgtttgcttatgtgttcttgtatataataatttctcagttgtaatttctagtgtgataaatgtcagtaaagatagcccacataaacaaaatctctttggggtcttctataattttaaaaagagtaaagggatcttgcaaccataaagccttcagtctcattctgaagaaatgcagttactcattctttgctactttgaaactagacaaaattgctgccacattctgaatactgctgcattagaccagtggctgtcagtaaagacatctccttagcttataaccaatacgcaataaaaagccaggaaaa

SEQ ID NO: 197983 - DNA, 828 bp, Homo sapiens
caactcatctctagtatgaagcctaaaaaataaatctattgaaaataataactatagcaacttgttaagatatagacaatataaaattatgtgaattcagacaacaaaaaaaagtggtagattgagttaaagtgtagagttttaaagttttttactttgtttctttgtgatcaaaattcagttgtaatctgtttaaaaaaacttgccatttctataagattttttttgtaattctcatggtaatgacacaactaaaacctgtaatagatacactcaaaataaagagcaatgaattcaaacattaccaccagagaaaagtaagtattcagacaaagcacaaaggaagacagtaaaaaaggaagaaaggagaggagtttcaaaacaaccagaagacaagtaacagaatggcagtagtcagtccttacctattgtattagttagggccctccagtgggaccgaaccaataggatatatggatatataaaagggagtttattagggagaactggttctcatgattacaagtcccacaataggctatctgcaagctggggaaagagagaagctaatagtgtctcagtccaagtccaaaagcctcagaactagggaagctgacagtacagccctcattctgtggccaaaggcccaagagcccccaggaagccactggtgaaattcccggagtccaaaggccaaagtacctggagtctgatgtccaagggcaggaagagaggaagcaagtgtccagcagggaagaagaaagagaaccacaagatgcagcaaacaaatttatcccacctccttctgcctgctttgttctagctatg

SEQ ID NO: 197984 - DNA, 502 bp, Homo sapiens
tttggatacagggtctcaatctgttgcccaggctggagtgcagtcactcggtcacggttcactgcaggcttaaactcctaggctcgagcaatcctcctgcctcagctaagtagctaagagtagctaagactacaggcatgcaccaccatgtctggctttttaaattttttgtagagaagggatccaaaacatctttcaaattcagttaatcatatatatgccattatttgaagtctctacctaaggaatggtgctcatcacttctcttctatatataatagttttggtttatatatttcaaggtgattttatttagcatgtagatattattgatgaataaaatattctattttatttagcacacagacagagacatgaaaaaaagtatcaacgtgaaagagtacagagggtctgcaacttacaatggttcacctagattttttgactttgtgatggtgtgaaactgttgcaatttgaatgtacttcaaattttgaattttga

SEQ ID NO: 197985 - DNA, 153 bp, Homo sapiens
aactataaaactcctaaaagataacataggagcaaatctagctgatttggggactggcaatgactttttagatgcaacaccaaaggaatgaaccatgatagaaagtgctggtaaattggactttgttaaaacacttctgttctgcaacagaca

SEQ ID NO: 197986 - DNA, 321 bp, Homo sapiens
tgcactccagagtaggcgatagagaccctatttcaaaaaagtaataataaaaccttctggtataggaaggacatcttttacatgggaattttatcttacattcatttaactcacttattttcaacacttatgcttggattgcctataaagatgagataataaacaactagtcatcattttgtttttcttgctgacaaattttataatataaagacaacataagcttgttttaccagtaaacctagataggaaatcatgcatctttatgatatttaatccccaaaactatgaaaacatgtctgtttcagtcaaaccaacaat

SEQ ID NO: 197987 - DNA, 827 bp, Homo sapiens
gctgttgttgttcattttttactattccaaaaatgcttcaacaaatattcttttacagattgaatgttgcttatccaaaatacttgggaccagaagtcttggggatttctgattttcagattagggatgttcaacctgtatatacctccttacacacttttgtttctcttttgccatctcaaatcttgaaattcaagttttgattcatgtgtcatttgtttagaatattccttctagcatttcccttcaataagatacatggtggtttactctgtgagaccttacctggccaaaaatgtgttcactcagctcccagatagatccagctatgagagcctcttaagcaatggcatatcaggcagtgatgcatccatcactgggctcttcccttaggggctgggcatcacaccagctacaagactatcggctctctgcttgtcatctttctggctgcatgtagcagtcctttcccagcttcagtgcctgggagcaatttcactgcaacccctgtgtatgcagatccatagtcttccactgtctgggttcctcaggaagcaaggaagccctaggtctttgcctcaagcttgaagaaaaatctaagcttccctgctgtcagttccctggttctctcttcacttcagagagtatagccctctacctggctttcttccctggagatctcaagggaacttggggcctcagatggaccctccttagtgtgtctgcttttattcttgtgctactccatggaggaaatggaccaaaggtcaagtcaggaatttatactctcaccatcatcttccccaaatctcaatctcttgatttaa

SEQ ID NO: 197988 - DNA, 362 bp, Homo sapiens
atcatcatttgtaactgcatagtcagcatgtgtaatattccattgataatttatttaaagagtagcctgttatggccatgcacagtggtttacacctgtaatcccagcactttgggaggctgaggcaggtggatcacctgaggtcaggagttcgagaccagcctgcccaacatggtgaaaccccatctctactaaaagtacaaaacttagccgggtgtggtggcgcgtgcctgtagtcccggctactaggggggctgaggcaggagaattgcttaaactagggaggcggaggttgcagtgagtcgagatcgtgccactgcactccagcctgggcaacaagagcgagactccacctcaaaaaa

SEQ ID NO: 197989 - DNA, 582 bp, Homo sapiens
caaaattcagagagtgacagctgccaatctcaccccagcatcctcacctgctaaccaggtatctgtactcactcagcgtgcctgcttggcgaatctcagctgagtcagttacaacaggtcccctttcagacaggtgatgattagaaggtttgtgactcaaagagcatgacgtgttccctttcctctgcagcaggaagatactccctgatatcgtagcagtgactcagcctgccaagacaatccatttcattcttgtaccattcttgcataaatcacagtgcagaaagcttggcaagataatttttaaattttaaactcgaccaggagaactgttgagaaataagacttcatattgaagtacgtttcctctcctcggaagctttcaagaggcgatgctgggtgaagggttactccaagttctggaggctgaaagtccaagatcacgatgctggcagaatcggtgtctggtgggagcctgtttcctggctcgttgatggtgccttctccttgggtcctcacccggtgaaagaggtgagggagctctctctggccattttttctaagggccctaatcccatcctt

SEQ ID NO: 197990 - DNA, 212 bp, Homo sapiens
tttgcatatgtgagttcaggctatctaaaagggagcagtattcatcaggcagggtctggaagtcccctcagtgtgtgctggcagtattggaaggatcagatgagttagtataaattccatggagtccgagagaattaatcagagatactagggggctctagtatgaggacagaggcagttggtgctctgaccttgtttatgtgccagcttgg

SEQ ID NO: 197991 - DNA, 384 bp, Homo sapiens
caaagtatagagcttatttggtgaatttctaacctcattatgttttctggaccatccactgcacatggacacagtatggacattccttactactttggcccagacagctttgttgagcctggtatcaatgcacatatctggagttttctatctccttcattgcaaatttccggtctctttaagagcctgaggggcacacttcttgaagcccactccatggatacacttgtgaatattaatggtgtactcttgggtcaccacctagttgatggcataatggccattcttctcaccatccttctttgcaggaggccaagttgcttaaatgttttaggtagtaggcatcttagctataaaagccctgacttggccgggcataatggc

SEQ ID NO: 197992 - DNA, 317 bp, Homo sapiens
aaaagatcagaccaggtatagatagacagatagatagagagagagagtacatatatatatatattttttttttctatattatattttgacatcttaaaaaaaaccctcccccccctccaaagaaaaccccaacctttctgcctgggagatactgcctttcctggggctagccaattagagacagcaaagggctcaaccaggaacatgtctttgttatgcagactaaccaatccagagtcatacctcctctatttggcctgaggccctcagaagtcaatattcctctgctttaataatcccaggaacagataccaggc

SEQ ID NO: 197993 - DNA, 726 bp, Homo sapiens
gtgggtgctgggtgtggtggctcacgcttgtagttccaactactcaggaggctgaggtggcaggatcctttgagcccaggagttccagtctgcagtgagcatgccactgcactccagcctgcatgacagagtaaagccatctcaaaaaaaaaaaaagatttaaattaaatcctattaatgaattccagtcttcatatttaactttatacagctatgtacctgtgtttgcctgcatacttatgtttaaggtttttctattaagacattgcactgaacatgatatcctttaagaataactctcttaatacccataacgtgatcgaggataaaaaagtttctggaaaaaaatagcacctgctcttgcaacagttcatcctggcagcatgcttttgttttgattattcatgaaattgcagattcactctttagcttgactaacattcagtaggaaatagttgtgtgtttttaacatacttacaattggaaggctctatcttagaatcagcaaaaggcaacactgtgtaatccaaaagtcccctaaatttcccataaggatctgaagaaggcattggtttcttcagagacatcagtcacaggaactcacatgaacagccagtcacccctgcctaactcctcctcctgctcttaatggcaactaaagctaaggttccacccctgggctaggctgcaggggagtggacctgcaagtctgcactggaaacccgg

SEQ ID NO: 197994 - DNA, 662 bp, Homo sapiens
gtaagcagaggaatgaaatactaaagaccagaacttggcgctggtgtaagaacgacatgcaggccggtggaggagagcggagagcctggcaggaaaccccgcagctgcagccaatccatctacaataaagacaccaggaacacacacggggaaggacagtttcttcaataaacggtgttggggaaactggatgtccctgtgcagaagaatgaaattagaccctcatctcacaccatctataaaaatcaactcaaaatgggttaaagacttaaatgtaagatctgcaactgcaaaaccactaagaaaaaacacagggaaaaattccacgacactggtttagttaatgatttttttttaaatatggccctcaaagtacaggcaacaaaagcagaaagtagagaaatgggattatatcaaactgaaaagcttctgcacagcaaacaacagagtgaagagacaacctagggaactggaaaaaaaactgcaaaccatacaacatctgataaggagttaatactcaaaatgtgtaaggaactcaaacaactcaatagcaagaaaacaaataccagattttaaaaaaatggcaaagaaacggaatggaagcttctcagaaggagacatacaaatggctaacaggtatatgaaaaagtgcacaacatcac

SEQ ID NO: 197995 - DNA, 523 bp, Homo sapiens
cattaaagtccttgcaaaggatgcaaacatgtctttattcagcaatttttcccaaatgtaaacaaatccgaccaagactttggagaaatttgtgcaagttttacatgcatacgtactatgtgaacgtggaacttaccttaatatacttcagtgaaagggtaattggatgaccttaaaatctttttaaaaatcggctgggcacattgactcatgcctgtaatcccagcactttgggagtccaaggtgggtggatgacctgaggtcaggagttcgagaccagcctggccaacattgtgaaaccccttctctactaaaaatagaaaaaaattaactgggcacagctactcgggaggtgaagcaggagaattgcttgaacccgggaggcagaggttgcactgagccattgcactccagcctgggcaacagagcaagactccatctcaaaaaaaatttttttaagttagaatttgcaaatagatttatatcctgggaatatcaaataatcatggattatctatgagta

SEQ ID NO: 197996 - DNA, 391 bp, Homo sapiens
atttttaaaaaattacattgactagaaaacatcagtgagtagcacaggtagcaacactatgcattcagtgagcccagtgtgtactgggttacactgtaaaatgtataactgttcttgcaggagttgaaaaattgtcataaacaatgagtgtttataggcagaggtggtactatccccactttagagatgtgaaaactgaggctcagagaagggatttgcctcggattaagcctaaaacagtagagccaggtccccgccaggacagatctgatgcttttctcttgggctgtcaatgtgaatagttcccacagacatccctggagcatcatccactccccgttgctccacccagaataatacccgagaggctggcaagtctgctgtcccttcc

SEQ ID NO: 197997 - DNA, 398 bp, Homo sapiens
ttgggagtctgaggtgggaggatcacttgagtccaggaggttgaggctgcagtgagctgtgatcacccaccacactccagcctgcgcgacagagcgagaccccgtcccaaaactaaaataagtaaaaatttttaaaagataagtaacatggtcactctcaacatggtaggcactcttcatctggtccctttctttttatctctctaacttcataccctgccactcaacccttcaatctttaagtcctagtttcaactctgcaggttctacttttcttcataccttccaatgtactgtcacttcttcctggaacactatcaccttgtacctccatatcccatccccacatatattaactcatccttctaatttctgcttcagattacttctggagaatt

SEQ ID NO: 197998 - DNA, 694 bp, Homo sapiens
cgccagcgaggacgccgtccagggcatcgccaaggaggatgccgcccagggcatcgccaacgaggacgccgcccagggcatcgccaacgaggacgccgcccagggcatcgccaaagaggacgccgcccacggcatcgccaacgagctgtatacgacatcgctaacgaggacaccctacaagccgtcgctaacaagtacactgtacacaacatcgctaatgagggcactgtacaagacatcaccaatgagggcgctttatacgacattgctaatggcaccgacaaggcacgctaacgtggacgctgtacacgacattgctaatgaggacagcgtataagacatcgctagtaactatcgcaagaacaaaaaaccaaacaccgcatattctcactcatagatgggaattgaacaatgagatcacatggacacaggaaggggaatatcacactctggggactgttgtggggtggggggggagggatagcatcgggagatatacctaatgctagatgatgagttagtgggtgcagcgcaccagcgtggcacatgtatacatatgtaactaacctgcacaatgtgcacatgtaccctaaaacttaaagtatatatatatataaaaagacatcgctagtgagcacgctgtatacgacatcgctaatgaggacaccatacaaggcatcgctaacgatgacgc

SEQ ID NO: 197999 - DNA, 569 bp, Homo sapiens
ctctaggagaccagaaaagaaggcagttttagcttaaccatctctgggtggcccgttccgaactcaggatttttttcctggactcaagtagacctgatgcggtggtttctgaaacttggaatcttggtcaaatatgtggggttcccttttcttggaaaactctcagctttacagttaagtcggagtcttggtctccatttggcactagtgtctttcaaaacctcccgctttcggtttcttcgatgcacgaattagaaacataaggactaaaaaccgaaagcccctatcacttttttgtgaacccctaacaacgaggcaagtttgagttttggtctttttttggtggactggggggaacgtcggggagggggatgtttactttaaacaagattgtaggtttttctattgtagaaaaggggattagaataataagtttacttttccaaaatacagttggggcgaaccatggctctcaacgtgagaaaaccatcgccgaagacttttaaaaattgactggggaagttttctgacttacccatttcttaagggtcagtaatgcccagttactt

SEQ ID NO: 198000 - DNA, 1495 bp, Homo sapiens
tagagggcgggcggggatacgggcgtgagcacaggcgggcacgtgtcatcgggcggtacagataggtctactctgtacaaaaagaaatcatttcagagatacaggctcacaaacccctatgagttaagaaggggcaagcagcctatcgctggctcataacccaataaccttttagtcctgctggaaaaagtatgtcactacattggcctgctgatggatcagctccttaattacgtggaaaaggtggcatagtggacgtaaaacagtttgtcacttgtttagtcctctagttaggtaatattggatgtgtgtttcaattttagagcaggtacactaagattattagtactcattgcaataaaattcttaactggaaaatcgctactaattcttaattggatcttttaagttttttacttaacctaagctttctcagtctatttttccctttgagtattccatcttaaagcatgttgtgtatttaatgtggcagctatgttgcaagtcttattttggtcttaatactcagtttccagatgtaatatattacaagtagaaaaagaaatctactttccagaatgaactttgttaaattttacagatattgtttggtttatgaggttgttcataacagatgcaaatttgaggaattatgtgtagaataccagaaagactttagtgtttggcaatttatttagataaattaagataaatccatagtacaagacataaaccaaggtggtcatctctgtgtgatgaagtagcatttttttcttttcttttttaaactttcctgtatttaaaatcttttacacaaaacacattcaattgtaattaggaaaaaaaacccaaatttttaagtgtccatagtcaaaagtatgcctggatttgtcttagtttttctctgaatttcttaagaaatctttgtattagcttttttatctacattaagatatattttgttggctgggcatggtggctcactcctgtaatcccagcactttgggagactcaggcaggtggatcacttgaggttaggagtttgagaccagccaggccaacatggtgaaaccccgtctctactaaaaatacaaaaattagccgggcgtggtggtgcacgcctgtagtcccagctacctgggaggctgaggcaggagaatcgcttgaacctgggaggcggaggttgcagtgagctgagatcatgccactgcactccagcctgggtgacagagtgagactccatctcaaaaaaatacatatatattttggtgattctgatgcattttagactaggaaattttatattttaccctgctctcctaaaatgaaacagtgaagacatcattgcaaacaaccttactcagccaaaaacaaaacaacaaaaaccctccaccctctgtatgttttactataactttaattctgttctttgttcatgtaattgctttaggtcagggggtttcggctttcaggggatcctctcagagtcgcacct

SEQ ID NO: 198001 - DNA, 661 bp, Homo sapiens
ggttgggaatctaagataaactcactttatgtttaatatcctattacaatcagatgttttaatgaattagtatttgttgtatgtgtgtgtgtgttataaattatttttaattagaaattgtagttatcttgagaccagtttaaaattttaacaattagaataagatgagaaaatgatatccagggtacagaataataatgccattggggtatacaagatcacattgatttgttctttaaatgtctttcagagtggtattttagtggcctaagaacaattgttgctttcctaaataagggttaatcttactttcataggatcaggtttaattggagaaattttgttgaaaacagaggaagttaaaatgaaataaaaggtggccgggcgcagtggctcacgcttgtaattccagcactttgggaggccaaggcggacagatcacctgaggtcaggagttcaagaccagcctgaccaatacgatgaaaccctgtctctactaagaatacaaaaattagccaggcatggtggcatgcgcctgtaatcccagctacttgggaggctgagacaggaaaatcgtttgaatctgggaggcggaagttgcagtgagctgagatcatgccattgcactccagcctgggcaacaagagcaaaactccatcta

SEQ ID NO: 198002 - DNA, 313 bp, Homo sapiens
actacaaaagacagatatagtgtcactactaacattgggaggcaggttttctccagtatgggtggataaacaaaggtggatgcctgttatttatagagatttagctgactgctttaattatataactatttagaccaatggaaaaaatggcccataagatggatttttccttaaggcttaaaacactaaagttggctggacatggtggctcacacctgtaatgccagccctttgggaggccaaggcaggtggatcgcttgagcccaggagtttaagaccagcctgggcaacacagcgaggcctcatccctaca

SEQ ID NO: 198003 - DNA, 143 bp, Homo sapiens
aacttccttacctatttttgctccagttcagttttcatctctactgtctggtgaattctatagttttgaaggttgctagtgacttcctgttgtgtagtgctagacaggttttggtgattaatttaggtaggaggataaaaatg

SEQ ID NO: 198004 - DNA, 373 bp, Homo sapiens
agacaaggagtacgcgggtcgcctggttctagagaatactagggggaagtatgtaggaattgaagattagtccgccgtagtcggtgtactcgtaggttcagtaccattggtggccaattgatttgatggtaagggaagctgagtcaggaggattacttgaggccaggagttcaaggttacagtgcactatcatcatgcctatgaatagccactgcaatccggcctgggcaacatagcaagaccctatctcgaataaatgaataaatacataaacaatcggtcaatcaaacagattaaacctccaaaaagaaacagctgaaaacatgatctagacttgttgaacttcagtttacacatatacactgacttatta

SEQ ID NO: 198005 - DNA, 438 bp, Homo sapiens
taaatctctaaagaaaaaaagttattatattttgtattcttaaaattaattttgacacaagaaactttgtatattgtcacatgcatgggtaatatgttactattattaatcttactttgctggtgaaaaaaagaggctttattaggggatttgctcaagcttatacaatgggtctagagtttttcagtggcttataagctaactttgagggcaattctgaatgagaattcccaggacatttttaacaatgacattatgtcaaggtaatgcttttgaaatggcagcattttaggccacttttaaaaaggatgttactcacttagttaagtgagagttgatacattatgcaaagtagatgttatagtcatacaaaataaagcagaaactgaatttctttgtgcctgaaattgatatgaatccacttattgcattcttaaa

SEQ ID NO: 198006 - DNA, 315 bp, Homo sapiens
gggtcctgaagaggaagggcttggggcttggactcctgggtctgagggaggagggagctgagggcccaaactcctggctcccgaggagggacaaaggcactgggaactggggccccaaacttctgattcccagagacaagagggtgacctcttatgtctaagggaggaggaacctggggtcctgggcccctggaactgaaagaagacagcactgaggtttgaaggaggagtgggtaagctatggcccagactcctgggccccagctaagcaaggcttgatccagccccacctaacaggcctccccacctgcccac

SEQ ID NO: 198007 - DNA, 832 bp, Homo sapiens
ggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgcgctgtgtaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaacaaagaagagcaggctgctgctgagaaggcagtgaccaaggaggaatttcagggtgaatggactgctccggtcctgagttcactgtactcaacctgaagttgcgacggtctgaagggtcagggccctctgtgccattagaatccctactgaag

SEQ ID NO: 198008 - DNA, 1783 bp, Homo sapiens
tccgcgtgaggtgcattctcgcgccggtggcgaggttagggcccgcgttgcgacgtggtgcagcgcatattttcacaagtgggtctcccttgtccgggactatggccaccgactcgtgggccctggcggtggacgagcaggaagcggctgtcaagtcgatgaccaatttgcagatcaaggaagagaaagtcaaagcagataccaatggtattatcaaaaccagtaccactgccgagaaaacagatgaagaggagaaagaggacagagctgcccagtccttactcaacaagctgatcagaagcaaccttgttgataacacaaaccaagtggaagtcctgcaacgggatccaaactcccctctgtactcggtgaagtcgtttgaagagcttcggctgaaaccacagcttctccagggagtctatgccatgggcttcaatcgaccctccaagatacaagagaacgcattacccatgatgcttgctgaacccccacagaatctgattgcccagtctcagtctggcactggtaaaacagctgcctttgtcttagccatgctcagccgagtggagccatcagacagatacccccagtgtctgtgcctctccccaacatatgagctggcgcttcaaacaggaaaagtgattgagcagatgggcaaattttacccagaactgaagcttgcctatgccgttcgaggcaataaatggaaagaggccagaagatcagtgagcagattgtcattggcacccctgggaccgtgctggactggtgctccaagctcaagttcattgatcccaagaaaatcaaggtgtttgttctggatgaggctgatgtcatgatagccactcagggccaccaagatcagagcatccgcatccagaggatgctgcccaggaactgccagatgctgcttttctccgccacctttgaagactctgtgtggaagttgcccagaaagtggtcccagacccaaatgttatcaaactgaagcgtgaggaagagaccctggataccatcaagcagtactatgtcctgtgcagcagcagagacgagaagttccaggccttgtgtaacctctacggggccatcaccattgctcaagccatgatcttctgccatactcgcaaaacagctagttggctggcagcagagctctcaaaagaaggccaccaggtggctctgctgagtggggagatgatggtggagcagagggctgcggtgattgagcgcttccgagagggcaaagagaaggtttggtgaccaccaacgtgtgtgcccgcggcattgatgttgaacaagtgtctgtcgtcatcaactttgatcttcccgtggacaaggacgggaatcctgacaatgagacctacctgcaccggatcgggcgcacgggccgctttggcaagaggggcctggcagtgaacatggtggacagcaagcacagcatgaacatcctgaacagaatccaggagcattttaataagaagatagaaagattggacacagatgatttggacgagattgagaaaatagccaactgagaagctccaccagccactgatgccagccctggcactgcccctgcacaggagacaagtgcatttagggcacaggccccgacatcaccccaaggacaacggcagaagtagagagaaactacctacctcacttcaaattatgttggacttgacaaaaataggtgcaatgatggggggcactagaagaaaaaattgctttggacacttgggtcctttcccactttttaaagccacattcccccatctttata

SEQ ID NO: 198009 - DNA, 1411 bp, Homo sapiens
  misc_feature (15)..(15): n is a, c, g, or t
  misc_feature (17)..(18): n is a, c, g, or t
  misc_feature (20)..(20): n is a, c, g, or t
  misc_feature (25)..(25): n is a, c, g, or t
  misc_feature (50)..(50): n is a, c, g, or t
  misc_feature (114)..(114): n is a, c, g, or t
  misc_feature (1179)..(1179): n is a, c, g, or t
  misc_feature (1185)..(1185): n is a, c, g, or t
  misc_feature (1191)..(1193): n is a, c, g, or t
  misc_feature (1199)..(1199): n is a, c, g, or t
  misc_feature (1221)..(1221): n is a, c, g, or t
  misc_feature (1226)..(1226): n is a, c, g, or t
  misc_feature (1230)..(1231): n is a, c, g, or t
  misc_feature (1244)..(1244): n is a, c, g, or t
  misc_feature (1250)..(1250): n is a, c, g, or t
  misc_feature (1252)..(1252): n is a, c, g, or t
  misc_feature (1266)..(1266): n is a, c, g, or t
  misc_feature (1274)..(1274): n is a, c, g, or t
  misc_feature (1280)..(1280): n is a, c, g, or t
  misc_feature (1282)..(1282): n is a, c, g, or t
  misc_feature (1286)..(1288): n is a, c, g, or t
ggctggtcggtcgangnncntttgntctacaagcagccggcggcgccgcngagtgaggggacgcggcgcggtggggcggcgcggcccgaggaggcggcggaggaggggccgccngcggcccccggctcactccggcactccgggccgctcggcccccatgcctgcccgaccgcgctgccggagccccaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccagggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcaatgccactgcaggatgagctggcttcgctgaggacttagtcctggatgaagagggggcacgggcagctggcctgggggaactgggggctgccctgctgaactagtgcgggcggtgcaggccctgcggctggagcgagaggagtatgtnctactnaaggcnnngccctngcattcagactctggcacatcnaaatnccgnngctgtgagcactngagaantntgccgaggccctgnggaagatnaaccgncnggtnnnccggagggggtgctgagagggggcggcaggccgctggtggcacacagacggccccgcagaaggggaagtggggccaatcatagggagaacgaggaagggccagaccagcgttcgcggagcagc

SEQ ID NO: 198010 - DNA, 1078 bp, Homo sapiens
  misc_feature (846)..(846): n is a, c, g, or t
  misc_feature (852)..(852): n is a, c, g, or t
  misc_feature (858)..(860): n is a, c, g, or t
  misc_feature (866)..(866): n is a, c, g, or t
  misc_feature (888)..(888): n is a, c, g, or t
  misc_feature (893)..(893): n is a, c, g, or t
  misc_feature (897)..(898): n is a, c, g, or t
  misc_feature (911)..(911): n is a, c, g, or t
  misc_feature (917)..(917): n is a, c, g, or t
  misc_feature (919)..(919): n is a, c, g, or t
  misc_feature (933)..(933): n is a, c, g, or t
  misc_feature (941)..(941): n is a, c, g, or t
  misc_feature (947)..(947): n is a, c, g, or t
  misc_feature (949)..(949): n is a, c, g, or t
  misc_feature (953)..(955): n is a, c, g, or t
agcggctgtacggtcggaattttggatgaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccagggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcaatgccactgcaggatgagctggcttcgctgaggacttagtcctggatgaagagggggcacgggcagctggcctgggggaactgggggctgccctgctgaactagtgcgggcggtgcaggccctgcggctggagcgagaggagtatgtnctactnaaggcnnngccctngcattcagactctggcacatcnaaatnccgnngctgtgagcactngagaantntgccgaggccctgnggaagatnaaccgncnggtnnnccggagggggtgctgagagggggcggcaggccgctggtggcacacagacggccccgcagaaggggaagtggggccaatcatagggagaacgaggaagggccagaccagcgttcgcggagcagc

SEQ ID NO: 198011 - DNA, 1438 bp, Homo sapiens
  misc_feature (147)..(149): n is a, c, g, or t
  misc_feature (155)..(155): n is a, c, g, or t
  misc_feature (158)..(159): n is a, c, g, or t
  misc_feature (167)..(167): n is a, c, g, or t
  misc_feature (1206)..(1206): n is a, c, g, or t
  misc_feature (1212)..(1212): n is a, c, g, or t
  misc_feature (1218)..(1220): n is a, c, g, or t
  misc_feature (1226)..(1226): n is a, c, g, or t
  misc_feature (1248)..(1248): n is a, c, g, or t
  misc_feature (1253)..(1253): n is a, c, g, or t
  misc_feature (1257)..(1258): n is a, c, g, or t
  misc_feature (1271)..(1271): n is a, c, g, or t
  misc_feature (1277)..(1277): n is a, c, g, or t
  misc_feature (1279)..(1279): n is a, c, g, or t
  misc_feature (1293)..(1293): n is a, c, g, or t
  misc_feature (1301)..(1301): n is a, c, g, or t
  misc_feature (1307)..(1307): n is a, c, g, or t
  misc_feature (1309)..(1309): n is a, c, g, or t
  misc_feature (1313)..(1315): n is a, c, g, or t
ggaggtctcccgcgggcggggagggggaggcgtagcaactttaggcaacttcccaaaggtgtgcgcaggttgggggcgggacgcggcgccccgggaggtggcggcctctgcgacagcgggagtataagagtggacctgcaggctggnnncgaggnggnngagggcgnccgcgtgtgctgggacggcatgctggggcaggagggcagcgcgtgtcaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccagggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcaatgccactgcaggatgagctggcttcgctgaggacttagtcctggatgaagagggggcacgggcagctggcctgggggaactgggggctgccctgctgaactagtgcgggcggtgcaggccctgcggctggagcgagaggagtatgtnctactnaaggcnnngccctngcattcagactctggcacatcnaaatnccgnngctgtgagcactngagaantntgccgaggccctgnggaagatnaaccgncnggtnnnccggagggggtgctgagagggggcggcaggccgctggtggcacacagacggccccgcagaaggggaagtggggccaatcatagggagaacgaggaagggccagaccagcgttcgcggagcagc

SEQ ID NO: 198012 - DNA, 1075 bp, Homo sapiens
  misc_feature (15)..(15): n is a, c, g, or t
  misc_feature (17)..(18): n is a, c, g, or t
  misc_feature (20)..(20): n is a, c, g, or t
  misc_feature (25)..(25): n is a, c, g, or t
  misc_feature (50)..(50): n is a, c, g, or t
  misc_feature (114)..(114): n is a, c, g, or t
  misc_feature (843)..(843): n is a, c, g, or t
  misc_feature (849)..(849): n is a, c, g, or t
  misc_feature (855)..(857): n is a, c, g, or t
  misc_feature (863)..(863): n is a, c, g, or t
  misc_feature (885)..(885): n is a, c, g, or t
  misc_feature (890)..(890): n is a, c, g, or t
  misc_feature (894)..(895): n is a, c, g, or t
  misc_feature (908)..(908): n is a, c, g, or t
  misc_feature (914)..(914): n is a, c, g, or t
  misc_feature (916)..(916): n is a, c, g, or t
  misc_feature (930)..(930): n is a, c, g, or t
  misc_feature (938)..(938): n is a, c, g, or t
  misc_feature (944)..(944): n is a, c, g, or t
  misc_feature (946)..(946): n is a, c, g, or t
  misc_feature (950)..(952): n is a, c, g, or t
ggctggtcggtcgangnncntttgntctacaagcagccggcggcgccgcngagtgaggggacgcggcgcggtggggcggcgcggcccgaggaggcggcggaggaggggccgccngcggcccccggctcactccggcactccgggccgctcggcccccatgcctgcccgaccgcgctgccggagccccagggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcaatgccactgcaggatgagctggcttcgctgaggacttagtcctggatgaagagggggcacgggcagctggcctgggggaactgggggctgccctgctgaactagtgcgggcggtgcaggccctgcggctggagcgagaggagtatgtnctactnaaggcnnngccctngcattcagactctggcacatcnaaatnccgnngctgtgagcactngagaantntgccgaggccctgnggaagatnaaccgncnggtnnnccggagggggtgctgagagggggcggcaggccgctggtggcacacagacggccccgcagaaggggaagtggggccaatcatagggagaacgaggaagggccagaccagcgttcgcggagcagc

SEQ ID NO: 198013 - DNA, 141 bp, Homo sapiens
cctttttctgtacttgcttgcatttttgctttaatgtcttctacagaactaggtccttttggtgttttaggagttttttcctgttttttgaaggattcttgtccttttgatcttggtgttgatgatggttttgagtctttt

SEQ ID NO: 198014 - DNA, 538 bp, Homo sapiens
gcagttccaagtctatgaatctggcttatggatatactcccatgtgaacaaaatgatgtatctataaggttattcactgcaacattgtttataatagcaacagatgggaaacaaaataaatgcccctcaaccgggaactggttaaacaaattttggcacagccatacaatgggatccagtacagctgtaaaaatgatggagacacctctttgtgtgctggtatggagggaatcccaagacatattgttaagcagaaaaagaaatcaagatgtagaacagtgtataaatagtctgcccttcatatgaaaatgagagaaaaagaatatgtgtgtgtatgtatgtatgcatatataaatgcttgtatttccctgaatattcatgaaatacctttgtagaaaggaaattggtggtgagagacaagagtgggaagaaaactttttactgtatatcctcttgtgcctttggaatttcaaactctgtaaatatatttcctgttcgaaaaattaaattgaaatgaagacaactcataaaaaagaaa

SEQ ID NO: 198015 - DNA, 557 bp, Homo sapiens
gaataaagagtctgttcctccttccttgatatactccaatgattgtaaagaagggtacttgtagttttatattatgtttggcactagtctaagtattgtaggtgattaaaaaaactcctataaattatgttttctacctttaaaagaatgtgcaagtcaagcaaataacacatataaacaagacacctgctgaacaacttagcataataaaattcagtgctaagtgaaaagctatataatgttatactagttcatagaagagagggattcataagtgcagaaagagtctgtaagtctgttttgagatctgggctagagtagtgtttctcaaagtgttgtccaagactagcagtctcagcaccttctgtaaacttattagaaatgcagattccaggggttgccccagacctaccatatcaggaactctgggttggggtccacaatctgcagtttaacaaaccttccgggtgattcagatgaagttaaattttgagaatcactgctatagataataaagaatgtgatattttattcagttaatatgttaagtgtctaat

SEQ ID NO: 198016 - DNA, 129 bp, Homo sapiens
tggagaagtatttaggagacggactccatgagatggatgagacagagaagtctagaatgacttctaaattttcactttggttgaaggaggaaacacaggagaaaatgtttactggtgttttgtaaggga

SEQ ID NO: 198017 - DNA, 429 bp, Homo sapiens
gactctagagctcccaggtttaccaagacaattgttgaataaaatttaagtgaatgagtttgtgcttcatatttaacttttaactttccactaggctttattaaatggaaaactgaaatttacaaagtcttagagtagaagcatttttatcctggctagggattctctaagagaaccagtagcaccaagatgcactggaacagtgcaacgagagagttcatgccttagggtttagaagcatacaagcaaagggaatggtgcccacttcttactagaagaatttcacaggctggagtctgggcggaggagcctgggatgacagtagaagtgtgcaggaagcactaagtcaagcctgtactaccacctcttggtttaacaataatgtataagttacctacaagccaagtggtcactgctgaaaccatcttg

SEQ ID NO: 198018 - DNA, 356 bp, Homo sapiens
ccacaaggtctcacttctgcctgcctctccaatgccatctcctgtcaccatttggggcctttagttttgagctgcaagagttcctcccatcacacacacacacatacacacacacacacacacttaaatgagtaagtaaatagaacatacaaaacgcttaaacactttgcacatagtgagcataataagtttgctactattattagactgtcttcagtaaatatttactgggctgcctactcagtgccaagcactatgggaggctcacagatacaacacgaacaagaaatatgtggccttggccagacgcggtggctcacgcttacaatcccagcactttgggaggccgaggcagg

SEQ ID NO: 198019 - DNA, 416 bp, Homo sapiens
cagaggaggagactgaggcacagataacgtaagtaattctcaccaaggtcatgtggccctgtgtggaggtgagatgtgcagaatccaggaaggacacagaccctggggccctgggaaagttgctaatgctatctcctattctcctctcattaagaaaaacatagttttacctggctactaacaattgtttgattttttcttactcttgggtctcaaaggagttttaactttaattgctagccctcctttgtttacaccctgcgtgagccaggtaccgttttaggtgctgaagatgatgaaaacagaacagtttccatcactgtggagtttacatgttggcgggggcaggtgatgcaatggcgtgaacaagtagcaaggtagtaggtatgtggtaatcaggtctgtgcaaagaagaa

SEQ ID NO: 198020 - DNA, 777 bp, Homo sapiens
aactctggaaatcagattctctcccctcccctgtttgttgttgctgcttgttttggggttggtttgctctagtgacttttctaagtatttttgtaaattttgtttgctatgtgtggccactgaggtctcccttgttagcttagtaaccatctagttatttaacagagattcccctaaatgcctggagccaaaaacaaaaacaaaataaaccctaaaagaaaaaaatcccctaaaagaaaaaaacccaaactctcccagactttgcagattggcactttgttggggcactccttcaacacttagtgaggccattaacagctctgccgtagccttttcttcctgtttgcatggagcccaaagttcatctagaggtgaaagcttaaggttccctcagatcttttcagagcatacacctagccctcagcatgcccaggaattttaaaaagccccttttccctcaaatatctcatttccaagtttattttttcacaggttttttgttctctgtgttagttgctcctgtattatcccttacccctcatggctggggctaatatatttgcctttaagtacttttgacaaaggccacctgggaggcttcttctgtcctgagtaagttccaaggcatgtgaaataaagacaagcccttgagtcagttcctcagggacacaccagacatcaaaacacacaaccatagttatttgagaataaggtccatattgctccttctgcaacctgccctaggaacgtgggctgtcatcttcagtggccatcttt

SEQ ID NO: 198021 - DNA, 776 bp, Homo sapiens
gtatccatgaagagcctgtctggatctcccttcctgcctaagatcaatttctaaatgtaaaataactggtttcaaagatacagatgtttatttaaaatgttgctgactgttgccaaactgctatttagaaaagacattccaatttacacctttaccacagtgttttttaactctgtgttatcattctttctaatctttgccagcatggtaggcaaaaaatggacaaaactaaaaggagaattagacaaatccataagcataatatgagatatttcagcttgcctctctgagtaattagaataatgagacaaaaatacataaaagatttaaacactataattatcaaatgaatctaattgacatgcattgaatatttcacctaatacctacagaatgcagattgtttttaagtgcctatgaaagtttttcccaaattgacacatgctggacaataaaaaagatcaaaataatcaattcttgagtgttttctgacgtgttggaattaagcaagaaatggattaccaaaaaaactagaaaattgtcagctgtttgaagataagcaatatatttctgagaaattcggggattagagaagaaataacattaaactatttagaacagaaccatgaaaatatagtataacttaaaggatgtgtatagagccatgcttagaggaagagttatagccttcaaatctatacatgagaaagaatgaaggctaaaaataattgaaaggacttctaaataaagatggctgagtgaaagacacatttact

SEQ ID NO: 198022 - DNA, 409 bp, Homo sapiens
tgactggatataagcctcactgaaaaatgtccacactgctgaacaagataaactacaacttagaaccggcagccttcacagttaccagtattctttctgatggtggtgtggctctttccttccttaagtgtcaggggcatacgctgagtgtggaagcccaaggttggggttggtgacagcactgcctcaggagagctgaggcgccactcctgcagctgcacagctggctccgttcccaggttctagtagctgcgggagggttaagcagcccagtccatgcctgcccctgctccctccatcactcaggcagaagcctgaattcttttgcaggcgttccaccactcttgcataaagtttggaggtcttgtgatctctccaaaatttaccatcatactctaaatatgaaatt

SEQ ID NO: 198023 - DNA, 235 bp, Homo sapiens
tagagacagggttttgccatgttgctcaggctggtcttgaactcttgggctcaagtgatcttcccacttcagcctcccaaagtgttgggattacaggcatgagccactgtacctggccattagctgaattttcaaccctctcttcactgctggcttttcagccaatacagatgttcaaatctttcccattctaagaaactttctcgcaatcccatacaactctgtcttccctctt

SEQ ID NO: 198024 - DNA, 267 bp, Homo sapiens
ctgacatacattcaggggttttatgtgtgcatttaatgtttcttcaaaaaagctcagttgctttacagccagaaccccatattgcttttctattcattataatacctagcagatcattggtcttgttgcaaattcttatcaagtttaccttgaattgagtgttgagcttctaccttgaaatcctaacattctgtgttctgctcttgctggccttcctgactgatgctttgtgattgtgtgtgtgtgatggcatatgtgtctgagtgt

SEQ ID NO: 198025 - DNA, 461 bp, Homo sapiens
attgccttgggtaaatgcatgcatttttctacaaatttgagttaagtataacagtaataaatccattcacttttaaatgacccattcaaacaggggtactacacagacctccatttctaattggaataaatatcagaaaagggtcatctaggtaactctgctagtttactagactcctagtcactggagtaagtacatagcacaaaggtcttatatgtttatagtgataaaacagatcaaggagcaataatgcaaatattttatcctaatggtataagctaatataaaagatgtcattaagaggccaggcacgggtggatcatgaggtcaggagttcaagaccagcctggccaagatggtgaaagcctgtctctactaaaaatacaaaaattagccaggcatgatggcaggcacttgtaatctcagctacccggggaggggggagaatcgcttgaacctgg

SEQ ID NO: 198026 - DNA, 401 bp, Homo sapiens
attgccttgggtaaatgcatgcatttttctacaaatttgagttaagtataacagtaataaatccattcacttttaaatgacccattcaaacaggggtactacacagacctccatttctaattggaataaatatcagaaaagggtcatctaggtaactctgctagtttactagactcctagtcactggagtaagtacatagcacaaaggtcttatatgtttatagtgataaaacagatcaaggagcaataatgcaaatattttatcctaatggtataagctaatataaaagatgtcattaagaggccaggcacggtggctcaagcctgtaatcccagcactttgggagtccaaggcgggcctttctctcactgtccagatatcttgctctggggcaaacaag

SEQ ID NO: 198027 - DNA, 422 bp, Homo sapiens
agcactttgggaggccaagacgggcctcccacaaggtcaggatcacaaggtcaggagatcgagaccatccgagctaacacaacaacacagacgaagacatacatataacacaggcggagacacacaacacagacaaagacacacaacacagacgaagatatacaacacagccgaagacacacacataacacaggtgaagacacacaacacagacgaagacacacaacacagacgaagacacaacacagatgaagacacacacattaacacaggtgaagacacacaacacaggtgaagacatacaacagatgaagacgcacaacacagacgaagacacgcgcataacagatgaagacacacaaagacacacaacacagacgaagacacacaacacagatgacacagaacacagatgaagacac

SEQ ID NO: 198028 - DNA, 640 bp, Homo sapiens
attgcctcatgcttccctgggcagtgaagccctcccagtgttttggaatcccggtgcaaaatagccttttcaacctcctgacccacaaatctgagtgggtctcttggttttaacatgggagaccacaactgtagagcctctctgatgtgacagctacaggaagtccggtgctgtgctggcggcagaggccctcgtctgtcatcccagcccctgacggttctccttgtcttactagcttctcccctccttggcagagctctcaaaagtacaggaaagagattgcttcagtgtggtgagaagtttggcacacatctgaccaatggctccatctctagcaaatccagagtaaggtcacttgagaggaaacaggcccaagttaaaagcaccctcacagggtccagtggcttacgcctgtaatccaacactttggaaggccaacgtgggggcatcatttcaagcaagaagtttgagaccagcctgggcaacaaagagagaccccgactctaccaaaaaatatgcacgcctgtagtcccagctacttgggaggctaaagcaggaggactgcttgagcgcacgagttcgaggccacagtgagctctgattgcaccactgcactccaccctaggtgatagactgagac

SEQ ID NO: 198029 - DNA, 424 bp, Homo sapiens
gaggggtgtgtgtgtgtgtgtgtgtgtgtgtacgtatagaatgctgcaggtgtgactggaaggtcacgtttggtcactgtagcaacaggagtaggatgaagtcctgcacacagggtctctgccactgtccaactccatttggagaattgcaactctgttgccatgggccccaaccaaggaaaccaggtcttacagtgggctgcacttagaaaaccagggtagtcctggccagcatggtgaaaccccatctctactaaaaatacaataattagctgggcgtggtggcaggcacctgtaatcccagctacttgggaggctgaggcaggagaatcgcttgaacccaggagacgaggttgcagtgagccgagattgcgccactgtactccagcctgggtgacgagcgaaactccatctcaaaaagaaa

SEQ ID NO: 198030 - DNA, 426 bp, Homo sapiens
acctatacagctgtactctacaaagaatgaaaggaaatatactataggtaaattttctttaaaaatcaaccaggatatcaagaaaacctaggctagaatacagactgtgacagatcagtctaactgtattacaaatgtatgataacctaactgaatgatgtttaggtaatacagatacagatagacacaaaaataattatagatgggttagcatatacatatacatactcacatttcatagctctgtcgactttcagagcctgaagcagtgacacacccgtagtaataagcatatccaacacccagttcttggtttctaaatatcatcctccaataaaagaaaccagagtcccttggacatagggctgattttggtactgggataaggcaagtacaagatagagtaacttgtagtgtcagaaagta

SEQ ID NO: 198031 - DNA, 656 bp, Homo sapiens
cgtgttagaggatcccttcatgtcgagacttcatcccccgcctccaaaaaagaaggaagtcttgtcttatactgcaatatggtgaacattgaggaggatgtaatgctaagtgaaataagaggacaaatagtgtatcattctccttatgtgaagtatccagtgttgccaaaatcatagaaacagaaagtggaaaggtggttgccgggagctgggcatgaaagccctggacatgaattcatgtccagagctttcatgccttaaaggtacattcgttcttccgctcaaatcctgatctggtccattaaagagtgtgcgcggacaaagtttctgaaaggattagagaaggattcccccccaaggattgcccaaaactgaactacagacaaacactattttatttaaataaggggaagctttctaaaagtatacttctcctaataaaaataggtttataattggaatgataaatggtttctacaccaatttacatcacaacatgtaattttaggcagtacatcggattctaaagcacatcatgctatcctttcatagagcctcgagatcaagctaaaaaattccttagtggatgaagcatggaatgaagggtacggccgatcgatcgcaggggtcaaaaaaacaaaaccaaaaaaagaaaa

SEQ ID NO: 198032 - DNA, 668 bp, Homo sapiens
gaattctattagccttaaaaaagaaaggaattctgtcatttgcaacatgaataaacctggaggacattgttaaatgaaataagccaggcaccgaatgacaaaaaccgcatgttttcacctctacgtggaatctaaaacaatcagaactcaacagaagcagagagtagaatgatggctactagaggctaggagaaggggaatgaggaggtgttggtccaaagaaaaaggaatcttgaaaggcaggttatcctggattatttgagcagacctaatgtaatcacaagggtccttataaaggaaagaggcaggcaagagagcctgagtcaaggtggaagcagaggtcagagtgatgctgggacacaagccaagaaattcgggtagcctctggaagctgaaaaggcaagaaaacgaattcttcccatgagtatccagaagtgcagccctttttacccatttaagacttctgacctccagaacagtaagataatacgtttgtgttgttttaagccatgaagtttgtagtaacatcttacagcagcaacaggaaactaatacacactgcttgaaaattttctttttaaaaaagtactggcctggccgggcacagtggctcacgcctgtaatcccagcacttttggaggctgagggaggcggatcacgaggtcagg

SEQ ID NO: 198033 - DNA, 398 bp, Homo sapiens
ctagcccaaagacaacaacatttgaaggaaaatcagggatataatgtcaaagaacactgcagtccaggggcgaaatgaatgtgccttgagcaacttctctaggatctcacttgatagcaggctgggatttatagtacccaggggaaggctgacagtatctttcctccagatcagctctgagctgggcttttgttgataagctgtcccaggagtgctgaggctctgtcactgacagaggaggcagatgtattgaaagcaggatcgtgggttgataatttgttagggatgtagagaagcctaactggttttcttacgtggaaaagaccaccctcttttcccacttcccagatgtgctaaactcttctggcagaggatataggattgtccttggggaatta

SEQ ID NO: 198034 - DNA, 181 bp, Homo sapiens
aaggaagcggggcgcgtggggccggcgccccggagaaagtttgttcgcgccgggaccctcgggcaggccgaaggtgatccaagcctcccgcgggagaagcgcgtagtctccggggcagggggcggccaacatggagtctgggcgcagggctgggggggggggggcggcgcggaggtgggag

SEQ ID NO: 198035 - DNA, 415 bp, Homo sapiens
gatttatattttcatttttcattatccttactagtcttttagtagttttgcaatacagaaaatagaaatagagttatcaaagtggtagtaatgagtaagatttgatcacacatgtcaaatgcctgaggcattttatttatttttattttttctgtcgccatggcagaacagaatgcctgaggtatataataaaattcacaaatgtatcctttttcctcccagatatgtctagttaagtttctgaacagtatgtgttttaaaagaggaactctaaagagaacttaatattcaactattttttgtagccgcttattcataattagcaaatgaattctgaaatacttttgtaattattgttccctgatggatttatttgctatgttaagaaatagtataagactttgggcatctatat

SEQ ID NO: 198036 - DNA, 232 bp, Homo sapiens
tttttatttccctgtgtgtgacatgtctattctctctgtctgcttttatgatccttattttatcactggtttgaggaatgtgatccctatctctcagagatcactgacctttattacctgatatacagtttctcacaagccattgtttcatagataatatggaaatatttagaaattttaccaagtttactctcaaccttagtatttgaagataatgtcctcctctttattg

SEQ ID NO: 198037 - DNA, 958 bp, Homo sapiens
tttgaaccactgactgattgccctgtacttggaggatgtgaggaagcagaattgagccaataaagagaagaggaagaaggagccacagaactgagtgggatgtcccctgagcactccttggtggagcaaaagtcttgcaagtctctagtgcgctgggcaggctgagggcgttcagcggagaacacagctctgtaaatacatcagcgaggatgcatatatacagtttccccagtgctccctcagacccttggaggctgggctactccaagctctgtttcctgcaaaaaaatggagtaagtcctgtggagtctaaatacacattccctctgcattatacccacgcctcgacttcattatatctaggagcactgagacaaagagatttataacaaacttcatccaagccaagaatgaaacacggcagcctccatgcagcaggaaacccattgatctgtttcttataagcatgtggttctatgctgtttttctgccaaagcttttccctgcctcccacttgaggagcatacaccagctgattctgcagattgactctacatcattctctgtcatgaagccatggcatgtgtttatgcgtctgtaacaaagcgtttatattctgccatctgcataaaaactgctgaaggacatttcagcaagaatccctatggtttatgcagctgcatgttgaacatgaaaatctaagatatgacagtggtctttcattcatacaacctttgaattttggtaaagttctgatgtaatgttaaagagtggtattttgaggactacgcatcaagatataaacatggcacatcttttataatatcagccactggaagacatttgaaataatatttgtataattgtgggctgtattatctttctttcttgcacataataaagtcagatgcggccggcgcacgttattgttggtacctcaacaacgaaaaaactatcc

SEQ ID NO: 198038 - DNA, 959 bp, Homo sapiens
tttgaaccactgactgattgccctgtacttggaggatgtgaggaagcagaattgagccaataaagagaagaggaagaaggagccacagaactgagtgggatgtcccctgagcactccttggtggagcaaaagtcttgcaagtctctagtgcgctgggcaggctgagggcgttcagcggagaacacagctctgtaaatacatcagcgaggatgcatatatacagtttccccagtgctccctcagacccttggaggctgggctactccaagctctgtttcctgcaaaaaaatggagtaagtcctgtggagtctaaatacacattccctctgcattatacccacgcctcgacttcattatatctaggagcactgagacaaagagatttataacaaacttcatccaagccaagaatgaaacacggcagcctccatgcagcaggaaacccattgatctgtttcttataagcatgtggttctatgctgtttttctgccaaagcttttccctgcctcccacttgaggagcatacaccagctgattctgcagattgactctacatcattctctgtcatgaagccatggcatgtgtttatgcgtctgtaacaaagcgtttatattctgccatctgcataaaaactgctgaaggacatttcagcaagaatccctatggtttatgcagctgcatgttgaacatgaaaatctaagatatgacagtggtctttcattcatacaacctttgaattttggtaaagttctgatgtaatgttaaagagtggtattttgaggactacgcatcaagatataaacatggcacatcttttataatatcagccactggaagacatttgaaataatatttgtataattgtgggctgtattatctttctttcttgcacataataaagtcgggtacgcgagccagtttttattttttccctccctcgtttattccaaattttat

SEQ ID NO: 198039 - DNA, 282 bp, Homo sapiens
aagccataagattgagaagagatccaaggactccaatatgaaggtcaaggggaggagatgccagcaataagtcagtgacgtaggagggaaatgactagaatggagaacccaggaatattctttcatgcatgcctccattctgagcgacccctcatacagagttaggcatagtcttcaacccaagggtcccatggttcattccagattcagaaagaacccatgtgaaacagcagcaagtaatatgagagggtgtctctttaagaccatgctgtaaggttcaga

SEQ ID NO: 198040 - DNA, 220 bp, Homo sapiens
gtagtataaagcagcccagcataatatttaagggcattccagcagggaagacagctattaaggatatgattgtacaattaattgttatcattgtaagtgccacaaggaaaacaggataccatgagagcctattaaaagaagacctccctcatctgtgcaggtcaggaagggattctgcagaagagttgagatctgaaaaattagtcagacttagccaaag

SEQ ID NO: 198041 - DNA, 319 bp, Homo sapiens
acagcaaaaaagggagaggggcacaaaaaaagtggacacatcttggtattttttattggaatgttaactatgtattctgcaagcatttttattgatctctaaggataatattagctaacaatttagtgtcaggctttgtgctaaatgaaatgctttactggtattgtctcatttattcacctcatttttacagatgagaaaaatcaagaatgaggagagttagtaccatgcagatggtcccaggatgaaaccagaatatgaactcaggcagtccagctgctcaacctgtgttcttaaccttcatgccttcatcgatcgc

SEQ ID NO: 198042 - DNA, 582 bp, Homo sapiens
tgtacagcaggtagcggctatgacgctgagtaccgagtctgtggccgcaggtagctaggcctatgggtgtgcaccaccacacctggccttctctgcctctttcataaagggacacttgggaaggcatttagggcctaccaggagaatccagcatgatctccccatctcaagatcttttcatttaattacatctgcaagacccttttttcatataaggtaacattggaggtttcagagatcaggacttgatatctttaagggtcattagtcagcctactgcagaagagaatgggaagtggggaaagtgaggaaggtagtaacactttgggttgctgtgtaaatggtttccaacaaccaccttcacagtgaatatcactccgcgtgctcagaactggagtgccccgggccatagtgcctcttcagcatggttgaagttgggtgggattaagtgttgatcacactgggttctcataattgagaagccctatctgtaaacattatcataaacaaaaagtggtactaagcttaaggacctcccagccagaagcattagtgctggttttctccaaaggccgtaattgc

SEQ ID NO: 198043 - DNA, 161 bp, Homo sapiens
aacaatatagcatagaactaggttaatactcaaggtaaaataaggttacttgaaactgaaaatcatagaatcacatgtaccagtagcaaatatgaggcatctttggaaaaataatctcactgctaaacaatttctcttccaaacagttctgagtcagcatt

SEQ ID NO: 198044 - DNA, 578 bp, Homo sapiens
tgctaggtttacaggcatcagccactgtgtctggccaagagagaggattataactgctgaaggggttatgtggttgagagagggttattatttattttttaaagggttcttgattgtatttgggatgactggtaattcctagttgtagctgtggtctgctagggcctactataaataagttctagctcaacaggttattttttacttgctaaataaaataaaagtgtgagtcagtaattcttattattttctccctcttttgtggaaaccggcagttttactgcagaactctcctcaaggctaagctaataaaatacccaatattgtttttctgactatgaagagactaagaaaagacaacagaaaaattagcaagtcttttataaaaacagaagacatataaagatgcagcaacttgcttaagtcagtgatactacactaacttataccaaaacattttgagtagcacacgtaggctagtgaagaaaacctgcatctactagaatagttttatcttgatggacttgctaaaaaagggtcatcatagacaatacattaaaaatctggatggcgctgtg

SEQ ID NO: 198045 - DNA, 479 bp, Homo sapiens
gtgccaggcagtgcactaggcccttggggaaggtccctgcatgaatggagcttaccatctggtcagggtcatcttgttaagagcctgagttctacaatcagtgtcaggatttaaatcccaactccccctttcttttttttatttttataatttttttttttattttaaatagagacaggtcttgctatatgttgcccagctggtctcgaacacctgggctcaagcaatcctctcaaagtgctgggattacaggcgtgagccgccatgcccagcgtcaattctccctttccatctggtgcacatgaacaaattacttaacctctccttgcctcactttactcatttataagctaggaatactgtttagtagtgtttgactcattgggtcattgtgagttttaaacgtgattacacataaaaaggtcttagtacagtgcctggcacataatacacattaaatgtttgcaattattaaaaca

SEQ ID NO: 198046 - DNA, 488 bp, Homo sapiens
gcagtgcaactcaacatgtctacacttgttgtctctaattctcctttaattaactcctaaacatacttaaatcagactcttgtcctcaccattcccctagaactctggtcaggttcaacagtgacctttaagttactatatcagtaggttagtgtttggccctcatcttacttgacctatccagagcattagagacatgtatcttcctagaggcctgtgactcacttgttcctccacatttttcagaccttttaattttggaatccctgaaagatgagcacttagtctgcttatctatttgcagttattgttggggatctcattcagtctcatgacattaaatatgatttatagactgatgactaccaacttaatgtcattactccagacatttcttcaaaacaatcaattttcctatttcaggaactataggaatttttaggtctacatcaaaaattttaatagacaagttttgcatcttccaccag

SEQ ID NO: 198047 - DNA, 236 bp, Homo sapiens
ccactccaagaaaatattccccaatgcacctgcatgcctccagatctatacacaagactgttcctctgcccagagcacccttcaagtcttctcaaactggaaagctacaattttccttcaagactcagacatctgtcatctctgcctcacaaagagacacaacataccatgttcccccagcacttgtcacatagcactattatctgtgtgtgtgtatgtgtgtctcccatgaaact

SEQ ID NO: 198048 - DNA, 596 bp, Homo sapiens
aatgtgggtcccatcccaagtacaaacatggctgtaatacaaaacagaatgttacacatggctataaagaggcatatacacctctcttcctcctctcctagaatacagaagggatggagttgttctatgttctccagagatcagaatgggcccgactttaatgttggacccatccatggggcagaaggggggaggcagatttcaggttccatagtctgtgagcatttaacagaagatggaggaggtgctgtgaggccatggggaaaggaaggctgattacctgaatgggaatgggccccacgttatgtcggtcccatcctgacttgccttatttatttgttcgacgcgtctctgaatgtatccgcctcggttcccaccactgccttcgctgcgcacgccccctcgtgtttccagggctgaccgtgtccccacccgactccgcatgtttgggtctgtttcctccctctctggccctgtcttaccccatcacccgactctggccactgacctcagggccgaaggggaggtgttgtcataggaacgcgtgcggagtcgccccgtctccgagggagggtctgtcctactgtactacaggt

SEQ ID NO: 198049 - DNA, 353 bp, Homo sapiens
atctttacctttctcagaacccaagatataatattttaatagtcccagattatttttgacaccacctctccacatctaacgtcttccttctattacagagccgtgctcaagagtgctagactagattctaccaagtagaagctcttacctgagatctggaagaaagaatgaaaacattacccattcttttatcagaactgaacaaattagatgttcctaggcgaacatagtacttcgcaaagatctttcagcctttttctagaaatcgcttacctgagtacagaaggcaggagggattgtgccagcagtttcccaaattgctagtagtttctgtaagtttcggattttctaaa

SEQ ID NO: 198050 - DNA, 210 bp, Homo sapiens
tgtaagagaccccccaagaaacatgtcattctactgaaaacgcactgctaaattacagcgcactgtctacacaagatgcactcacttctgacaccaactgcaagactggggttccccaaaccacccaagatgcaataactgcctaggactcccagagctcactgaaagtggttgtgcttaagattgctggttatcacagggaaacaacat

SEQ ID NO: 198051 - DNA, 190 bp, Homo sapiens
ggtccgggcggatgataatacaatcagaaacaactaaacttaattgaagcatgttaaaccctgcattagggccgggtgcatccggagtggcaaatgccagcctggaagcagctgttagggtccactccaggacctggagctgtcccttaagaatccctgtggatatccccttcccgcattccaagttcta

SEQ ID NO: 198052 - DNA, 232 bp, Homo sapiens
aatagtatttattttatgtaaattatgtttcaatacaattgattttttaaaaaaaaacgtttcccagagtgatcaaagtggagggcagggaacagtaaacatcagtgcttatgttatagctactagaagcctcccaattccaacgacatgctttcaagcaggtctgatccttcccctggaggatacctctgacccaggggtgctacaaatgcattgcccctagttgcttctg

SEQ ID NO: 198053 - DNA, 210 bp, Homo sapiens
catcgcaaatcatggggtaaatgtcttatgaaagctgccatacaagccatgtataaacacactgggatgcttcaggcaggcgaatctatcactcagccctcaagcaaatctctgtgcttctcttacaaaaacagctataactctcagaaactcgacagtcctttcaggtaagcattaggttacaaagcatgttttcctgtggaagccaca

SEQ ID NO: 198054 - DNA, 721 bp, Homo sapiens
ggatatacatacacatacacactttttttggtgtgtgagagatggagtctcactctgtcccccagactgagtgcagtggtgcaatctcagctcactacaacctctgtgttgaaaaaaaaatcattgaattgtacacctaaaatgaatgaaattgatggcatgtaaattatacctcaaaaaagaggttgaaaggaaaagaaaaggggccgggcgtggtggctcacgcctgtaatccccaacactttgggaggccaaggcaggtgtatcacctgaggtcaggagttcaagaccagcctggccaacatggcaagttcctgtctactaaaaatacaaaaattagctgggcgtggtgtctggcgccgttaatcccagagtagctgggattacaggcgcccgccaccaagcctggctaatttttgtatatttagtagagacacggtttcaccattttggccaggctggtcttgaactcttgaccttgtgacccacccgcctcagcctctcaaagtgctgggattacaggcgtgagccaccgcgcctggcaaaaaaaacatttttttttttaacctgcacattctttgacctggcatcttcacttctggaaatttattacaggccaggcacagtgtctcacacctgtaatcccagcattttgggaggcccaggcgggcagatcacctgaggtcaggagttcgagaccagcctgaccaacatggagaaa

SEQ ID NO: 198055 - DNA, 251 bp, Homo sapiens
aaatcctccaaccaatccttacttcaagcaaatgcacctttaccaggaaattttcctttcccagttctttacctccttaggtgcacccagaaatattctctttcagtctccttatcactcctttgttcatatgaaacttactagcaactatcgtaacttaccaaattatttcctatggcagtacattaagggtaaaagtcacattgtttatctttgtatccattattacacaatgtcacctgtacaggaag

SEQ ID NO: 198056 - DNA, 1146 bp, Homo sapiens
attctttgcctttgctcatgctatcctcatagcccagaatattcttgtcccaaagtgctgggaatacaggcatgagccaccatgcccagcccttccttgtttctttaatgatggctattccccgcttcccaggccagaattatggagataattgtctcaactgattatttcctcctccaagaaaagctgaagaatgcatagtgttaagcacacggggtgcttgatagcatagtggtaaggttcaagagctttgaagccaagcagtccatctgttagctacgagaccttggagctctcttagcaaagaagagaggaatgtctattgcgtggcaatctgtggtgcctgccaaaaaagatagaatacaaagattaatcatacagtaatactcagtcttcaacctcgaggtgctcttaaaggagcccatgaaataaaataataaaccatagaaaatgataagtactactaggtaaaaaatcaaggtagagagtgatagtacttacaaaagagatacagaaagaaattggagtggaaaggagggagacagtcaggagggcttcttgaaggaggtggccaggagaaacaaggatttgggtccatggaattcagagcaagaatattctgggctatgaggatagcatgagcaaaggcattgagactgatatatcaggttgcatatagggaacagagacaagagagtggctcggtttgaccacgaatgaagtgaaatagagggagagaagagaatatagggttgaggtccggttaggcgaggccttgaatgtcatgcagaggagtccagtagcttagacagtttatatgctcctccccagtaagacgtgtagccgtataatgagagctttcgagaccaagctgtgtcgtcaattctggaagactgtcgtaccagaaggccttgacttttcctatcttggtccaatgtcactccttgcagatttgctatctcagtacaaaagatgtgaaagacactggaacatgctgttttacaaaacatctcagaaagagccagtctgagaagcagtgtgcaatggcctcaggtgtgtaccctcaaattaagagaaatattcctgaccatagcagaatatgctttctgttgtctttcttattcctatacagtgctggtggaggaa

SEQ ID NO: 198057 - DNA, 1163 bp, Homo sapiens
ggaaagctataacagggaaacagctatacaggacacaggtttaccgcggcatcagcctcaccagtcccaaagtgctgggaatacaggcatgagccaccatgcccagcccttccttgtttctttaatgatggctattccccgcttcccaggccagaattatggagataattgtctcaactgattatttcctcctccaagaaaagctgaagaatgcatagtgttaagcacacggggtgcttgatagcatagtggtaaggttcaagagctttgaagccaagcagtccatctgttagctacgagaccttggagctctcttagcaaagaagagaggaatgtctattgcgtggcaatctgtggtgcctgccaaaaaagatagaatacaaagattaatcatacagtaatactcagtcttcaacctcgaggtgctcttaaaggagcccatgaaataaaataataaaccatagaaaatgataagtactactaggtaaaaaatcaaggtagagagtgatagtacttacaaaagagatacagaaagaaattggagtggaaaggagggagacagtcaggagggcttcttgaaggaggtggccaggagaaacaaggatttgggtccatggaattcagagcaagaatattctgggctatgaggatagcatgagcaaaggcattgagactgatatatcaggttgcatatagggaacagagacaagagagtggctcggtttgaccacgaatgaagtgaaatagagggagagaagagaatatagggttgaggtccggttaggcgaggccttgaatgtcatgcagaggagtccagtagcttagacagtttatatgctcctccccagtaagacgtgtagccgtataatgagagctttcgagaccaagctgtgtcgtcaattctggaagactgtcgtaccagaaggccttgacttttcctatcttggtccaatgtcactccttgcagatttgctatctcagtacaaaagatgtgaaagacactggaacatgctgttttacaaaacatctcagaaagagccagtctgagaagcagtgtgcaatggcctcaggtgtgtaccctcaaattaagagaaatattcctgaccatagcagaatatgctttctgttgtctttcttattcctatacagtgctggtggaggaa

SEQ ID NO: 198058 - DNA, 837 bp, Homo sapiens
ggacacaattcaacgcataacacttactaagtcttcatccctctttatacaattttcttctagggaaatccaactcactctctgaagtgcacttgagtcctgcctcctacctgaagcctttcataatggaattccctcctctcagcactctgtcatgcccttcaaacaagttatatcttttatgtggttcgctattcctgtctgcccagcgcggctcaccatcctgagagtggaaatgattcagctgctctgtgcacccttcacagggtccagaggcacttcctagtgagatgatttaggatcttgcagtacagagaaaaccattacaatcagaggaaatggggatggagagtaatcaggcaatgttttctgaaagaggtgagataaagcactggaaagatgggaggaagagagaatattccaggctgttttgtgaaaatagtattttttcgttttgagggtaagattgtaaccatgcttccttacaatgatgttttagaatgttctgcatagggtccaccaggagccttaacatcagtcaggattgggttcattgtttccaactgcacttggatgtttcttgccaagcttggccctctgcacattttagatattccatctctgttaactgtctatgcctttagctgcctcagtgagatgctcatctgtctttagcaaggtaacaggtgctgtccatccatgcattttggttctgttgtgttctggtgctgttttggccaggaaggcactgcattttaagaaacgcagtggttggcatttcttttgtgtaatggcggtagttagagtgcagagacttggtggcaataaggaagagat

SEQ ID NO: 198059 - DNA, 124 bp, Homo sapiens
agagaaagtaaataatagaatctggtgttgaatttagatgaatagttttcaatctttatagtatatcagaatcacctaaagagtttattcaaacacagattgctgggcccccacctctagagtt

SEQ ID NO: 198060 - DNA, 154 bp, Homo sapiens
tgctaggattgcaggcgtgagccactgtgcccagcctctttttattttttttaagttaaaaaataaaaacaaacaaacagacttgccatatgatctatcaatataacttcctttttttttcttttttttttagaaaagatgtttattcaggcct

SEQ ID NO: 198061 - DNA, 632 bp, Homo sapiens
gggattacaggcgtgcgccaccatgccccgctaattttttgtattttaagtagagacggggtttcaccgtgttagccagcctggtctcgaactcctaacctcaagtgatctgcccgccttggccttccaaagtgctgggattacaggcatgagccaccacgcctggccatgctttagtttaaataacataaagttagcatctaggaaaaaggaggatgttttagtttcttcattatgatggaatgaaaatactttaccagagtaatttttaaggttatgtgtatttagagcttataatataaaattcatgtacacacgaaagcacataaataaaggctgatataacctttgacctaataattctatttcaacaaatgtatcctgaagaaatactagagttgtgtccagaggtttatcaagattattcattgtaccctttaaaaaaaattagcaaaataagtagaagtaataaatgatctacagtaagcacataggtcaaaaatggtatatccataaaataaaatactatgcagccctttaaaaattgttttcaaagactaatgaactggagaaaaaaagttaaacacaaaagtccttttgttattctgcaactttcttaaataaatagatgg

SEQ ID NO: 198062 - DNA, 301 bp, Homo sapiens
gtgagccgagatcatgccactgcactctagcctgggcgacagtgtgagactccatctcaaaagaaaaaaaaaaatctataattgtataaaatcccatacactagcacttcctgttattttgttcatcagcggacagcaaagcatgtagtcgtgttgccttcttgtctcccagtgatagacccatgtagcatttcataaaaatggataattaaaggggagaattgtcaaagatcaaagtgcatcaaataaatgaagtgttaaaattggattaaaattttagctaattgtaaacagcattctt

SEQ ID NO: 198063 - DNA, 447 bp, Homo sapiens
catctatttaacacatcacctttatgtaatatgtagctagttttagtgttttaataagtcccaactaaagactgagtgttttcagtgaagatggaaatggagacccaggcacttgcttagagttatcgtgagtccgatgttcctgaacttcaagttgtacaattaagggcatactctaagaacttctggatgctttctggagtatacagacagatcaactaatgacttaaatgagtgactcttgaagctgcaagaagaggaaagaaataaccacaagaaggggctatctcagcatctgttattcctgacaggaggaattaaatatgctctgctggtaattctaagcttttctgcaggggatctgcttgccccaggagcaccttagtcctcattgaggcagccattctgccataaaaacgatcatgtctcaagctgttcctgccgtcc

SEQ ID NO: 198064 - DNA, 417 bp, Homo sapiens
gcctggagatggtaaaggactttcagcagggttatgacaaaaccataaacctgatgatgcctgaagtgtccagacttccaaattcatgcggtttggagaatgttctgcctgacagcagcagggagttgtaagcaggttcagcgtcatccagaaatgcttgtgtcagaccaccgcttccacagagggttctgcagagataaaagtagacaagatggcgaggaaaaggttaaacactcccattctctaggattgcctggcataattctttgtgctcatggatgtcatcgtcaagattcgcgactgtgggcaggaatgtgcaggtgggggagtcagcaccaatgaatcctattaattcatgccagccagtcacttctgctttcaggaaaagattcagatttccccagtcttaggaacatt

SEQ ID NO: 198065 - DNA, 390 bp, Homo sapiens
tgtagaaaatagttattgagaggcatttgctgggtagtggtctttcagttggcaggggaaagatcatcactgtctttgggcctcaatttcttcatctcaaaaacaggtattgattcacacaggatgcttatgaggactaaatgaaaggataaaagcaaaagtactttgaaaactgtcagctactctacaaagcattattttaaataaaacttcaagccagcattaagaaaaaaaatggaattaaaaaagactaaccaatgaaaagaaatagaaattagaactaattcattataatgtctggttcaactagatgttaataagaaaccttttgtttaaagctgttgctgaaaatctttctaatcagtacactgtctaaacagtgtgtctaaa

SEQ ID NO: 198066 - DNA, 424 bp, Homo sapiens
taacctcacaagggtattgacaagatcaatgcatcagaaatatatcagaaagtgttttgtaaactaaataccatataaatatgtgggatgtccttacgtttgcagtttcaacattcaagaagaccattcatttcctgttagcatcccttgtactttgaggatgtggccacaaggtcctttggcctttgtcagtatcatcaaaaatgccagcttttagacacagatgtgatttatttgaaagaattatattagctcacttttatcttttaaaaaattaagacaatattttattaaaataactaaacaggcccagcccagtgaggcacgcctgtaattccagcactttgggagaccaaggtggaaggattgcctgagttcaggagttcgagaccagcctggccaatgtagtgaaactccatctcta

SEQ ID NO: 198067 - DNA, 484 bp, Homo sapiens
atcccccccatacacttccttacaaacaaatacagtaggtattgtcaaatttacttatagaaatattacatttttaacacttctgccataatataaaagagtaactaagccatattcattattgaatattatcagcatcttctacgttttgaccattcgaaaatggtatctcattttaaatatagttattttcctaatgaagaaaaataaaatattttgcattttttctggtcattttgtatttcattcatattcattctatgaattcactgtttctatcttttcttcatgtttataggttttttatttaatattctctgtttgcttttatgttgaaaatacattcttctagtttgttgtgtctttaaatttattcatttgcatgtatgcctgagtgtgagagctctgagaatcataaaagcaaaatggaattagatgtgcaagaaatacattaggaaacaaccatggaataacatggggagca

SEQ ID NO: 198068 - DNA, 439 bp, Homo sapiens
aagtattttctccctttctgcacttcatatacactttcccttagccttgaagttaatgtctgctatgcttttccaaccttggctttagttttcaacttagatgtcagttcctgtgaaagatcttttctgtttttccaatatcaattagatctacctgacataatttcatggcattctgtacttctataacactgtttcttattttacttgcataaaatagatacaaacacatataaagttgtttaaaatctatgaagcagactacaacctccaagaggccatattatattcttaaaattcaggttgcttacataaagtaaacaaaggagcaaaacttgtgctagatttgagagccaatctaacccttttcggaatacatccgagttctgttatagtctgatatcataggtaaaatcaagtgactattgcagaaatgtca

SEQ ID NO: 198069 - DNA, 290 bp, Homo sapiens
cctcccatgcagagccctttagggaagggcaaacttcacagaaacagtggccaaatctcacatctgcagaggtattgtcttttcctggacattccctttgctgccccctggggctttctcttgtcagttatctcttctgtcccttgcatttttctcctttttcattgactcattcctctctattcacaagttttctctttctcaagtccctctacctctaactaaccttactttccatctctgtgcccaaaacttgctcatctgcaaacactctgcactaaacgcctctg

SEQ ID NO: 198070 - DNA, 414 bp, Homo sapiens
gccgaggcgggtggatcacctgagaccaggagttcgagaccagcctggccagcatggtgaaactctgtctctactaaaagtacaaaattagccgggtgtggtggcgcgcacctgtaatcccagctactcgggaggccgaggcaggagaatcacttgaacctgggtggcaaaggttgcagtgagcagagatcatgccactgcactccagcctgggcaacagagcaaaagtctgtctcaaagaaaaaaaaattcaattaatgataaacaaccaattagtatcttctgagagatacaaaatattttgtttataaaacaataaacttaaaatatggaaatttaaaatgtgattgggaaaataaacattgaattgaaggattagaaaataatgttgaagaaaaacctaccagaacaaca

SEQ ID NO: 198071 - DNA, 199 bp, Homo sapiens
tgcacacgccgaatacccagaccacacgccgaaaacccagcccatcaacgaatacaggcaattcatttgagtccagcaactggtggggtcctattacctttcatgttaccaaacttggaaaaagagagacagagaaatataacagaagtcagaaatataaagaacagggtggatattgtgtggatactcggcgtgtgca

SEQ ID NO: 198072 - DNA, 418 bp, Homo sapiens
  misc_feature (6)..(6): n is a, c, g, or t
tgcgtnctagaggatcccttcatgtccagtgctttcatgcctagaaaaagaatcccaggattttccctcctgtgtgttttcgtcttgcttcttcatggtccatgatgccagctgaggttgtcagtacaatgaaaccaaactggcgggatgaaagccctcgatatgaattcatatcgagagctttcatgccacactgccaagtatacacaacttcccagtaaatggttgtggggaggaaagaggtggagcctccccagccgtttccctgcagaatcagctctgtctcatgtggaagtggagaatcagccttgcctggcctttaggaacttttgtggggaagagagctttgaagagaggagggggactttaaagagggatgaaaatgagccctgggagggatgaaagcgctcgacatgaa

SEQ ID NO: 198073 - DNA, 270 bp, Homo sapiens
  misc_feature (242)..(242): n is a, c, g, or t
  misc_feature (245)..(245): n is a, c, g, or t
  misc_feature (251)..(251): n is a, c, g, or t
ttttatttgtaaatatatgtattacatgcctagaaaaagaatcccaggattttccctcctgtgtgttttcgtcttgcttcttcatggtccatgatgccagctgaggttgtcagtacaatgaaaccaaactggcgggatgaaagcctcgacatgaatcatgtcgagacctttcatgcccataggcacattctccatccttaacactggtctatctgctcttcccatcctcctgtgggatgaangcnctgganatgaagggtaccgagctcg

SEQ ID NO: 198074 - DNA, 357 bp, Homo sapiens
  misc_feature (6)..(6): n is a, c, g, or t
  misc_feature (329)..(329): n is a, c, g, or t
  misc_feature (332)..(332): n is a, c, g, or t
  misc_feature (338)..(338): n is a, c, g, or t
tgcgtnctagaggatcccttcatgtccagtgctttcatgcctagaaaaagaatcccaggattttccctcctgtgtgttttcgtcttgcttcttcatggtccatgatgccagctgaggttgtcagtacaatgaaaccaaactggcgggatgaaagctctcgatatgaactctttatttccataatagaaaatcttttatttccacctttagtgttccctgctagaatagatgaccacaaaacccaggccagaaacgttctggtctgccgtgaacagtccaggaggcacttgttctgctgctgtggaagtcgccctgactcggggatgaangcnctgganatgaagggtaccgagctcg

SEQ ID NO: 198075 - DNA, 459 bp, Homo sapiens
tttgaaaatacacagtcagaggagacaaaagagaaaagaataaaaaacaatgaagcatacctatagggtctaggaaatagcttcaaaaggtcaaatctaagagttactggacttaaagaggagagagaaacacagatagggatagaaagttattacccctttgaataaaaaggatgttaatgagtgataattattacagagaacttcccaaatgtagagaaagatatcaatattcaagtacaagaagattatagaacatctagcacatttgattcaaagaagactacctcaaggcatttaataattaaactctgaaaggtcaaagataaagaaaggatcctaaaaggataaaagaaacaaataacatacaatggaactcttatatgtccggcagcagacttttcagtggaaacctcacaggtcatgagagagtggcatgacatatttaaagtgctgaaa

SEQ ID NO: 198076 - DNA, 405 bp, Homo sapiens
gctatttaagggcctgtttttaccccttaatccatgtcgattgcttacaagctggtgtgctaggcacggaatgggatccaacaggtaaaaataggatggatccctacctcaagtagcttttagtatttgctgtattcagttggttgcagaatacaaactagagactattgaaggtagttgctctgtcatttaccacactttagtgagcttcgtgaaggtagagatcttgattttttccttattttattccagcacccagaagtatcaactagcacataagtgcttaataaataattgtataaatgactaagggatgactgcctttctcttaaatacagtctctgttaatgtactctacaaagttttggtttttaataaaacaactgtataatatggctaattcat

SEQ ID NO: 198077 - DNA, 155 bp, Homo sapiens
taaaataataataataataataataataataataaaattaaattaaaattaaaatggtggcaggaagcagaactttcagcacctttctttttccttgaaaaatttagatctgggagtttacatcaggacacaagaagtctccttattcttttttg

SEQ ID NO: 198078 - DNA, 356 bp, Homo sapiens
ttttacccagtgtgaactctctgaaagcaggggccatatcctggccatctttatatccctcccacctaacatggtatgagatccctcatagatatatagtagaaatgatgtatgcaagagacaggacaagttggtagactatattattattattattattgtaaaatacataacaacatttactattgtaagctttttaaagtatacaattcagtggcattaaatacattcaagatgttgtacaaccatcaccaacatccatttccagaactttttcattgtcccaaacagaaactctgtacccattaaacagtaactcccctgccctctccctgaaataaagaacagcttgacag

SEQ ID NO: 198079 - DNA, 294 bp, Homo sapiens
aaattgcatggtgtatatgaagaataaattagcattaattttcttccattaactgttaataaaacatgctgatgagctccctcttcttctatggacatctctgtttcctgcctaaccaagagaaatgtaaggatttcctaatttttttccccactatgcaattgtctttcagccatatatgctcttcacctcccacaatcaagctctaggtcatgggcagccttcattcagtgaaatgtacgagacaagacttctttcagagcccatcaacactccctcccacacacacacaca

SEQ ID NO: 198080 - DNA, 467 bp, Homo sapiens
tcaattatgtaattattttataggatgtgtgaactttgtacttacgtgtgcttttgtggtagcaagtatcatctttctgtttccttttagcatttttggtgtactggtctagtggtgacaaatttccttagcatttgtttgtttgggaaatactttatttctgcttcatttatgaagcttagtttaaaaagatacacgctttgggaggccgaggcaggcagatcataaggtcaggagatcgagaccatcctggctaacatggtgaaaccccgtctctactaaaaaaataaataaataaaatacaaaaaattagcggacatggtggtgggtgcctgtggtcccagctactcgggaggctggggcaggagaatggcgtgaacctgggaggcggagcttgcagtgagctgagattgcaccactgcgcttcagtctaggcgacagagcgagactccgtctcagaaaaaaaa

SEQ ID NO: 198081 - DNA, 257 bp, Homo sapiens
gcacttcctgcgtgatggccaggacactctggcattttacaaggatcaattcatggaatcctcacctatgacagtggttcccaaacttgactacgcttgggaagctttcaaaaatttcaacacataggtcataccccaaaccaatcataacatttgaaggtaagagtaggcaccaatgtatttaaaggcaccctggtaattcaaacatgcagcaaaggttttgaaaccctgagagatgggaactgctacggtctgaa

SEQ ID NO: 198082 - DNA, 290 bp, Homo sapiens
accccaaatccagggactccagggaggggtagtctggattcacagccagagaacctttattagaggtgatcaaatgagcacaagtgtttgaggaataggtaatgactggttgaatctccctgtctatccaacaccacgtgtatctgttgagaccctggctctggtgtggcagggttagggtgaccccagctttaccaagcagaggactccacaacctttaggttcctctgtgaggggtgagatgggttacgacacccactcctctgacccaggtcctctccagcaaaaca

SEQ ID NO: 198083 - DNA, 400 bp, Homo sapiens
tatcatctcattttgttcttgaacttcattaagaacaaaacagggtgggtggggcaggaaattcctaggcgatacttctgcactgaatgggatcatactgactacataacacgttatacttagggggagacaggagcatcatctgggttctgcgaaagccgggtggtctggggcagcttgctttgttctcctgctcctctagcgcctttgccgtctttccccagcatgtggctgtgggaaagacactgaagatgaacctgcaacaagcgattctgacaccagcgctaggctctacagcccacgggggacttgctagcctcagtcacaggtgggagagctggggcagatctgcacacaagggctctcagtgatgacacctgtagccaacacctggggcttg

SEQ ID NO: 198084 - DNA, 473 bp, Homo sapiens
ctatatcctgctctatgtaatcttttggaacttaactttttttcacttaatattacagttgtccttcagcatctgtggcagattcgtttcaggacctctgaagatacaaaatccgaggatgctcaagtcccttatataaaataggttgtatctgcatataacctatgcacattctcctgtatactttaaatcatctcgtggctcatgcctgtaatcccagcactttgtgaggccgaggcaggtggatcacctgaggttgggagcttgagaccagcctgaccaacatggagaaaccctgtctctactaaaaagacagaattagctgggtgtggtggcaggtgcctgtaatcccagctacctgggagtctgaggcaggagaatcacttgaacccgggagatggaggttgtggtgagctgagatcacgccattgcactccagcctgggcaacaagagccaaactccatctcaaaaa

SEQ ID NO: 198085 - DNA, 512 bp, Homo sapiens
aattagctcttttttccctatccagtttcccaggggctcaaatacatttctaagagcaaggatttcggcagtccacccccaacgagtctgtacataaaaataaagcagcactttggaggcccagtgtataagcacaattcccaccggctgtttgatatttcttttcctactagaaaaaacccaaagtacaagaaattattctgttaaggctccacacattttaaaaatgaaagaaaagaaaattaatttaatttgctacaaaaatgtagcagaaagagaaatgttgtcattacaatctgctgaaatatctctaaattataggcaaatatatttatcagactatgcatatgctatgtccaccacagaagtaaatatgcaaatgcaataaaatatctatatttctatagtgtaaaccaaccttgtccaacccacggcctatgggctgcatgcggcccaggacagctttgaatgcggcccaacataaattcgtaaattttcttaaaacactatga

SEQ ID NO: 198086 - DNA, 303 bp, Homo sapiens
tgactttgtggaatgtcagttcagccaaaattcaaaaccaatatatacttctttcctctcatgtactaagcacaataaattttactcaataagttgtaatctcatagattgttatattaaaaaccaagcgaaattttaagataaaacatgattgcagataaatttgacatttttcattgagaagctgcaggctacactctcaagactctctcaaagccatcaagcactgatgtatacttcctcctctaggaggcgtactttgggaaatcataaactcaaattccaccactgggacctcagttc

SEQ ID NO: 198087 - DNA, 429 bp, Homo sapiens
aatttctgtagctccagaatattctccccagtcccctgagacgaagttacagagctgtgaatccggtagtgaaagccttggtataaggcgcataagaaatgtgcagattatctaccatgaaatagaggaagaaatcaaggttattcaagtagaggaatgacacgttttagaaagacttttgttataacgttatgggaaatggattataggctggaggcaagagataagacattgtcagtgtgacagaatattttattaataaagcacataatttatactcagatctatgtgagatgagaccaattcatgtcaacatgtccaatgtttttgaaaaaatgctaagtttttattatcgcttttgtttatttccctgtgaaatatagtaggctagccctctatttctcctggcgaaatcttagataggtggaa

SEQ ID NO: 198088 - DNA, 423 bp, Homo sapiens
cctagaggacccaatgtatgatatgagttggagcgcaatggtgcagtctcggcctcagcctcccgagtagctgggattacaggcatgagccaccacgtctggctaattttgtatttttagtagagacggggtttctccatgttggtcatgctggtctcaaaaaaattatagaatgaatgaatgaatgaaaagagaacctaccagtttgtaaggttcatttttggcatgctgaatgcaaataaataagtttactaagtgagaaatcgtaagagaagctggaggtggcaggaggagcctgggatggagcataggtctgatcctagtgcagggaagaggctgctaaggttgacacgtctcaaagcactagaattacaggcctgagccaccacgccctgccttatctccaactcatatcaatacatt

SEQ ID NO: 198089 - DNA, 507 bp, Homo sapiens
aaggctcagactcatgtcttattgtgagttggtatcaattcagacatactgtcacctgaaacctgaaatattagtatagttacatttaagatgtgggaagttgggagggagaaacaactaaataacacaaaatacagtgactacaatcctccaagttgaaaactgtatgaatattgtaacttttcatcacctttgacagctctaagttacatggttgtgatgctcacacatatctagttttttttctcctcttagaaacctgaaagattacactttgctgtcctcctcgcagttggggccatgtggtcctggccaataggttatgaggtgaagtcacatatatcactttcaggctgaagtatttaattgctggtgtaataatctcttgcactctcttctcttacttcggcaaatcttgctatctggagcagctggagtgatcctagatgactgaaacgtgtaatgtgttggtcaacactaaataaagtcaaagtacttaaaaatctt

SEQ ID NO: 198090 - DNA, 538 bp, Homo sapiens
cttacctggttaatttttatttctaaaatggctttaccatctgtctctgccaataacgttttatttacctgaacacttctaataggacactgcctttggaaaccatgctatcaaatctaaatgacttcctccatttactgtcttacttcctgttttcatttttattctccatatatacacttttacttgggtacgatctgtatgaatgaggcagtggcgacatttaaatatggcatgtgccaagaactattctaagaatttttcattaaaatgcattattttattgaaatacacatgaaatgcttattagataattgaggctatccttattgatggattggaaaactggggatgagtaaaccagagaatagcagaatccaaagcttgcacagttatgtaagctttcaattctgctatcagaatatgtgtattctgataaaactatattgtgtgtgtttgcttgtgtgtgtgtgtgtgtgtgttagttccaaggagatggtgtgtaggaagaaatgtgtgtgtgccagtgtggagagag

SEQ ID NO: 198091 - DNA, 439 bp, Homo sapiens
acgcgtgggcggacgcgtgggggaatttgtgtatttcaattatattgttaaatttattggtaagaagtggtacataatatttccataatatcattttaatatctgcagggtctctagtgatgtctcaaatttcattcctaatattggtaatttgtgtcttctccctttgttacttgatcaacctagctaatggtttattaactttattgattttttaaagtttgatttaattgatttttctctattgcttgtccattttctattttattgatgtctgctgttacctttactttccttctatgcattttgggtttaatctgcttatttatttagattcttagggaaatacttagtcattgattttaagctattcgtttttctttttatagcatttttatagcattcaaagtcataaatccctaaattttgtatgttgtta

SEQ ID NO: 198092 - DNA, 315 bp, Homo sapiens
aggtctcataatcatcttgtgtacactctctgcatttttataatatgctgcatctatctatccatgacagcatgttttccaggtgggcagaggcatcagtggtagcactaacagatcatatgaaaatcaaaattacctaagtcctaaataccaactaactgacaatgaaacattcaaagaaaaaagggagcacttaatttacccctgagtggtcttattaataaggattgcaggatgataagattctgtaaagtaaaataaaataaaaaaataaggctgggcatggtggctcacgcctgtaatcccagcactttg

SEQ ID NO: 198093 - DNA, 664 bp, Homo sapiens
cctcagagaaataaaataaactgctttttatggctgacagaatctaaattgggattttttaaattttaactagttactttttgacttgtttctaaggctttgctttttccctgacagattaaaattattacagtgtgagaacatgtgctttttacttatttaagactcaaatccatcaactatcttaaacaattatcttctctctgtctatataaaataaacacgatgatgagcaatgttcaaatgatattaatttttaaaggtatgtagtcacctggaaaatcagtcagttctgcattttactgtaaatcttcatttataaataggcacccgtcctctgtctcttgatggtttaacttaatgccattaaaagtagaagagatttctccagctctcaagttgcagaactggaatcaatgtatgttgttaaaatgaagaatagaggccgggcacagtcgctcacgcctgtaatcccagcactttgggaggccaaggcgggcagatcacgaggtcagaagatccagaccatcctggctaacacggtgaaaccccgtctctactaaaaatacaaaaaaatgagccaggcctcgtggcgggagtctgtagtcccagcccagtgcagtcccatcactgcactccagcctgggtgacagagcgagactct

SEQ ID NO: 198094 - DNA, 848 bp, Homo sapiens
ccagcccagcccagtccgagcgcggacccggcgcccgcagccccggcgccgccatggtggaggcggcgccccccgggcccgggccgctgcggaggacctttctagtgcccgagatcaagtcgctggaccagtacgatttctcgcgggccaaggcggcggccagcctggcgtgggtgctgcgggccgcgttcgggggcgcagagcacgtgcccccggagctgtgggagcccttctataccgaccagtacgcgcaggagcatgtgaagcccccggtgacacggctgctgctctcagccgagctctactgcagagcctggcgccaggcactgccacagcttgaaacaccccccaacccctctgcactgctggccctgctggcgcggaggggcacagtgcctgctttgcccgagcgcccggtgcgcgaggccgacctgaggcaccagcccattctcatgggagcccacctagctgtcattgatgccctcatggctgcctttgccttcgagtggacaaagaccctgccaggtcccttggccctgaccagcttggagcacaaagctgcttttctgggtggacacgaccgtccggcggctgcaggagaagaccgagcaggaagcggcccagcgagcctctccagcagccctgcagacggggcggccccggcgcagccctcgtgcctacgcgctggtactggaagctggttcctatccgataccgcaaggaccgtgtggtggcgcgacgtgccccctgcttcccgacggtgaccagcctccaggacctggccagtggggccgcgctggccgccaccatccactgctattgtccccagctgcttcgacttgagggtg

SEQ ID NO: 198095 - DNA, 268 bp, Homo sapiens
gaaggtgctgacaggcaaggggctcaggagttgggggtcagagaagagggatgggaactgaaggcactgggacttaggcaaacaaccaagactggccaaacctggtggtgccaggctcagaggccgaggctgtttttccctttacaagcggatgaagggagaaccagtctcgctcagagagtgacctgtcactgctgaattcactggccctcaagggaggggttggcatttctctgtcagcactcttcaaggggggaaggtgcatgcc

SEQ ID NO: 198096 - DNA, 384 bp, Homo sapiens
gatacaaagtgttcccaaactgtgattactaaaggagacattcgctcactgaaaattagctggggcacaggtgatgactggagtgagctgagtcatacatctcttcaagtagcatgcaaaaagggagacgattcagtgaggtcacaaacaagcaaacaacaaaaaaaataaatcaacagataaagtgaagaaggaagaggaagggcaacaatggaaagtcccctccaaagattcctagcaactgtaaatccacaggacattcattcatgacagggtcccctgaggactgaggaggtcagaataatactaacaatggctaccacttgtagaatgcttacttactccccagaacagtgcaagtacttctctgtttttcaatctatt

SEQ ID NO: 198097 - DNA, 1060 bp, Homo sapiens
cagacctactgaatcagaaactctgggggcgagggctgaaacctgctttcataagcccttcaggcgatactgatgtaaactaaagcttaaaaaccaccgttttactgtgacttcatgaagaatataattgcaatatcacctaaatttttatcctggctgggatggggcagattcttactatggacaatttctggaacttacagtatgaagagcagatgaggagtttgagacaaagaaaaaattgtacagggagtttagtgaattttccatcaggttggccattactttctttctctaaagtctcaggatgtctggaagcaaggaaagacaaaagacttgaagcaccgggtgcatgctgtgtgtcacaagtgaggtggagagttggctgtggaaggtacagcaattcctctggaattaaatgaccgaccaacacagtaccaagaggatgaagagaagatgttttgcgttgctacgtgaatcagtggatgactcatatttcacttgcatatgaaatataaggcagttaacatcttgtttgtggcttaagcaaggacattaatcctactagatgaaggggaagttggttctgttgtcttaagggatgcccccttgtgattttggtcaactgaatgaaaaagaaaagatagccttggacttttttttcatgggaggtttggaggtcaagcatgtagaaggaaaaggctgtagtcatgaatatagaactgtctgctctccaccttttcctcactctacatttagtcatcacactgaacaggatgtggcctgctgacagtgagtagctgaagtgcctgtttggtaagtaggttagcattcatcatgaactctgaaagccatttcagagtttggctgctgctctgaccctgctgtggtacaaaaaacatggatttttttttttttaactggagtaataccaaattccctttagaagcttgaagtttgatactattgctttccccattataaggattatacagtattaattaattataaggcccaaagtttgttttggcaaataaagtattattctctatcatcatct

SEQ ID NO: 198098 - DNA, 591 bp, Homo sapiens
tccttactgagtttttgtttgtacattgatcattgagagaagagttgaagtctccaagtataatggtaagtttgtttatttctccttttcagttttgcatcatgtgtattgaacctcctgttaggtgcatgtaaatttaggattgttaaaactttttggtgaatgaaccccttaatcattatataatgccctctttatctctgatagtattcctcattccaaagtctactttatctaatattaatacagcctctccagcctccttttagtgtttgtatattattttccatccatttaatctgtcttttatttaaaatgggtttgttctagacagccttttttaattcatcttgaaaaatctgtttttacattgaagtgtttagactatttacatttaatgtaattttgatgtagttggatttaaatatacaatcttaattgttttctacttatgtgctctctgatgcctatttttgagtgcattttatcttcaccatgggctcactacttacactcaacttttcctctcttttaaaaagttaatgggcttctctgtgatttatattttacatctttaataatagaccatat

SEQ ID NO: 198099 - DNA, 889 bp, Homo sapiens
gggttgaaatggtaggtagaggacagaagggcaaaagttttggttccagcaagaagtactcaagccagacgtgaagaaggactggctgacaaggattagagattccaggcgacccttacctctggactgggactgagtgcacctgtgagcccagccaggtcctgggcaccactgtggacagcagaggagataagaaggggtatggactctcaggatactccaggatacatgggggattgggtggaggtggacccccacaaaacaagcaaccaaagagagagcagaagcagtgccgagatatggggctcagcctcagaggactaggagcttgagggggcagtcagggcagactttttggaggagctggcctggagccacctgaagatgggaggatgtggtttactcactcattgtcagcagacaactttgggggctccctgtttgccaggccagtgcctactgtgagaagtgacatggaggaagtcatggacagggccagcccagcctggctgggggtatggggtatgtcactgacaacttgagcaagtcacttcctccctgtgggtgtttgtttcttcgtctgtaaacgtcagagctggatgaagttgaatgacagaccaaggagtgctcgaaggcactgggaaccatggaaaggctttgagtgggggtgggactgtagttggcacagtggagagacgctggagggacatgagagagaaggagaggcaggatgggggtgtgggggtgctgaagtctgattgggccattagggtggagaggagggaaacccctcagctcttggctgtgctgtcgcaacaggatgacactcccttctgccaggtccctgccttcctgaggatgaggactcagtgatgtgtcatagcagctg

SEQ ID NO: 198100 - DNA, 454 bp, Homo sapiens
gcgctggctgtcatttgccttggacaaaaaaagatggctaaaaatgggcctgtgtagaaatttccagtgggttttcagatctgtttcggggacagagcagggacccagatgagatgagggtatataattctttagggtttggggcgtttccttgtatttgtatttttttttttttcatgcttttaggactgttttccccatgtggcctgaggagttttcccctcctgggccatgcccacaggactagttctcagctctgtctggaagcggttgcttggcttgaggcaagttcccttctggcctcagttttctcatctgtaaaatgaagggtttagaggctgggcctggtgactcatgcctgtaaccccagcactttgggaggccgaggcaggtcgatcacgaggtcaagagattgagaccatcctggccaacctggtgaaaccccgcctttact

SEQ ID NO: 198101 - DNA, 738 bp, Homo sapiens
ggtctgtgtctagattcatttttctttttttaaagtttttctagcactatttgctcctttgtattgccttttttcctccgtcaaagattaggtgactatatttatgttggcatacttctggtctatttattttgttctattgatcaacttatctattttttcaccaataccacactatgttgatcactgtaactttacagtaagtgttgacactgggtagtgtcagccctcttactttgttcttccctttttttatttgaattgagtattatgggccttttgcctctccatataaactttaggatcagtttgccacaatgcatataataatttgctaagattttggttagaattgtgttgactttatagataaagttgaaaaaaactgacaccttcacaatattgagtcttcctatccatgaacatgaatgtctccccatttatttgattcttttttttgaaatcattcatcagagtattatactttttctcaaatagaccttgtgcatattttgtgagatttatacctaagtatttcattttggagggtcctaatgcaaatagtaatgtgtttgtttttaatttcaaattacatttgctgctatataggaaagtaactatcatttgtatattaactttgaatcctaaaaccttgttctaattgtttattggttccaagagggggttgtaggtatgtggccttatttctggattctctgttctgttccattggtctat

SEQ ID NO: 198102 - DNA, 128 bp, Homo sapiens
ttattttttaaatatggctataataaattttaaaattacatatatggcctgcattatatttttattggacagtactggtttagaacatgaaggtaggtctggatggagataaacattttgaaattatt

SEQ ID NO: 198103 - DNA, 601 bp, Homo sapiens
gcctaattaatcagtgactgtctttatttaagtcagcaagcaacaaaagaaatccaagaaatagtaactctaaagtggagaaacctagtggacatcaccttaaccaagtgatgaaaaactgaaaccactaatattggtgtaaagtgatctcgtgtactttctagtatcatgccctaaaaagacaccattctatggtattcctgtcaaaaatgctgaatctactcacaaggaaagattagacaaactcaaactgaaagacattctataaaattattggcctattctatttaaatattaaagacaagaaagaaagacaaggaaagggttgaggagactgagagagactaaagagatatgacagctaaatgccctgtatgtcctggactggatcctgcggggagggaaatagctataaaatacaacactgggggccaggcatggtggctcgcacccgtaatcccagcactctaggaggcccagacaggtggattacctgaggtcaggagtttgagaccagcctggacaacatggtgaaaccccgtctctaccaaaaatacaaaaactagctgggcgtagtggggggtacctgtaatcccagcta

SEQ ID NO: 198104 - DNA, 469 bp, Homo sapiens
aataacacatttcaaacttaaaggacaccaaaagcaaaaccaaaagcccaaaaccccactaatgttgggaagcaggaacatctttaattacctggttatataatcgcatccaagatagttaactcctaatggatctaggttttattatttataatacaagtataataagaagacctactggctttaaaatgaaaataagtggaattaaatgaaatattgtataacataatgactatagtagataacaatgtattgtattcttgaaaattgttgagagactaggttttaagtgttctcatcataaaaaataagtatatgaagtaacatatattttgagtagctcaatttagccactccacaatgtatacatatttcaaaacatgttgtacataataagtagatacaatttttgtttctcaagaataaataaaaatgttcaacaattttttaaaaaatggaatcaaggcag

SEQ ID NO: 198105 - DNA, 344 bp, Homo sapiens
agaagacaataataatcagaactatttcttgactgtgaaaagactgtaatgaaataaggaaataagatcccttaagaattctattggccaggcacagtggctgctcacacctacaatgccagcactttgggagacagagtccagcacattgcttgaatgcaggagtttgagaccagcctgagcaacagggcaaaactctgtttccaaaaaaaaaaaattagcctcagttattcaggaggctgaggtgggagggtcacctgggcctgggaggtcaagactgcagtgagctgagatcacgccactgcacctccagccagggtgacacggggaaatcctgtctcaaa

SEQ ID NO: 198106 - DNA, 410 bp, Homo sapiens
tggttccaagtctttgctattgtgaatagtgctgcagtaaacataacgtgtgcatgtgtctttatagcagcatgatttataatcctttgggtatatacccagtaatgggatcgctgggtcaaatggtatttctagttctagatccttgaggaatcaccacactgtcttccacaatggttgaactagtttacactcccactaacagcataaaagcgttcctatttctccacatcctttccagcatatgtaggtaagttcttaaatagcaattttattttgagatggagtctcgcttggctatgactggtccacttttactactggaaacagaaatcgttttctccttagaatatatgtctgtatttaccacaaaactagtttcagcacctggcacagaactaaaaaaatat

SEQ ID NO: 198107 - DNA, 414 bp, Homo sapiens
aatatttaactggctctctttgcagagaaaaatgccctgattggtagtgtttgccaatttttgtggtgtaaatactcccaccatgactgatttaaaagcagcacaaatattacagtgtatttccactactcagataccatgggcatgaatcatctcagcaatgtaaagtaataaggaagtggtatgctttgtgtatttattacttttatttttaatataatttgtttaactgtattcaatttaagttttaataatagcatgcataacgattggctcaataaaattgtgaaaatttaacaatgtggctccagcacaccacggtctctgcctctgcagcatttgatattttgcccatcctccactattgaatctgtctcttttcttggctccttgaaatcagtttctccctttttt

SEQ ID NO: 198108 - DNA, 478 bp, Homo sapiens
gctatatatcggttgatatggaataattgctaaataaatttatcatacttattgagaatgataaatattctgccacgttaaaacaaaccggacaataaatccctatgaaaatcataaattattctaattagttctcttaacacagacctatttgaaattatttgttttactttcctttgatggactttctacgttttgtataatgctggctgtactcactgtactttatgaactcacaaattcactcactaatattaatgattaaattaacagtgtaagcattcttaattgatctccatttattccaaaggtgctggaataaattgacattttcacatatccatcatcattattatttgagctaaataatgtgtgtacacttaacatcacctgattttgatccataagaccctttactattttgcaaggaaatctaagagacaaaaagctgaaatttgaagatgcagtagaaaatacg

SEQ ID NO: 198109 - DNA, 369 bp, Homo sapiens
taaataattaaaaacacaggatttgacaacaaattctaatcagattctttgacttccaagaaagcaaactcagtataataagaagtgagtgtactttgtaagcccaaatctcagaagaaaggcagtaataccttttattggaaaatgatctatcaacccgctttaacaagctggcagtcattttgcgagtacgcagttcctcggctgaaggacacatggcacagaaaggggaaatgagtttgcatttagtttagaaatgaatttatattaactaaagaatacaactatttttagctgaaacaatgagctactctgaccaggaagcaaagatctcatgggatccacctaactggaaagtgccaatgtttc

SEQ ID NO: 198110 - DNA, 311 bp, Homo sapiens
tactttaaataaaatggcataggtaagttaaaagtaaaaataaaagtaaaatgtagacctactcataactcccccgaactggaaataacacaaattctcacagatgcatggctaaaaactaccatacatccatgcaatagaatattacttagcaatttaaaaaattattggtacacacaacaaaatggattaatctctaaggcattatgctgggtaaaagaaatcagtttcaacagttacaaactatatgactccatttacatggcacttcggaaaaggtaaaactatagcaattaggaaagatcaatggt

SEQ ID NO: 198111 - DNA, 336 bp, Homo sapiens
tgaattaggggtgctcagtctgtagcaacatgcgggaagaggggcatggagcaagggcatgtgcaggggcaaagtaggtccaagccccttctccagcttgctgcctgcagagggcagcaagggcagaaagaagggttagctttgaaccaagttcaaagatgcagttactacctcggaccagacacttttaatgccaacctgactctgtatttgcaatttaaagtgacctaagaatttttatcacctaaccgggggcagaaaacttgtggggctgcccgagttttcatccaggaatggggggatgaacttccaccggagaaggaatcataaaaagta

SEQ ID NO: 198112 - DNA, 411 bp, Homo sapiens
ccgagtggttgctgagggcttctgaagcccaggccttatcgtggcagggtgcaagaatctttgttgatgaccaagtggaagtccactatgcaggacataggcgcctcagtaggggacagtgtggccagtggaacaaacatgatctgcagcccatccctgggattgagtctcccctctgccctttattcactgcagaactgagtggtcacattgtctcttcaaggctcagtttcctattgtgtaaagggaagtgatagtttctgccctgataattgaaaccataacctaggccgggtgtggtggctcacacctgtaatcccagcactttgggaggccaagacaggaggatcgcttgagctcaggagtttgagactagcctgggcaacatagtgagactcccccatctctaaa

SEQ ID NO: 198113 - DNA, 437 bp, Homo sapiens
aaattgtgctgatggtgtcaagggtaacaagattcctgaaataactcagagtacagtcttctgttaatgagtgtcatattgtagtataaatatttctttatatgtctgtcttcctcatttaactggaaactcttagggatagggacacatcttcagcatttctgggcccagcagttggcagagtgcctgtcatataataaagcatccaataaactgatattatattgagccaatatgtgaatcaagatatatcttagttgtttctgaatcagtttggtatatctgtatttttttacttattttcatatgaaaaggaaattattttatgttagaattttacattttagaatgctaccacattgtactgtattaatgtacatgctaattatttgtaatattaatcttgcttatgttcaaagtatctgagaaaattggtt

SEQ ID NO: 198114 - DNA, 670 bp, Homo sapiens
gctatgggagttgtaagccagaaaccgtaattaaaaccagtatgtatatcataacaccacaggtcaccccctagtttgtgaccacagatcttttatatcaaacaatatttgtatatgcagtcattaatcattagtccagtacatcatattgtatgaatgtctcccaggatgaggccattccggtttgcaagtttcctaaatcttgtcaagttccaaaagcaggattggccttggtaaacacacagcttcatactttcatgcatctggaataattgagcttgagatagtatcatcttttgttcttagactcttttgggctgttaacataacattgaattttcctcagttagtaaccctaactcatttattcacttctttactttcagctatggtttctccttctttccgtttatacccaaattttttcacctctgaaagggacattagaatcttcttgtgctgttccagattgcaggcagcaatacaagtctaggagtaggtcttcctcagtccactcccattcagatagggtaaagttatataggagcagaactagtgagctatttttaccatcaggcaatatagttgcattcactgttagtcccacttttgctaaatggggtgaaagcactactcaccccagtaatgttcttaggaattttgccattag

SEQ ID NO: 198115 - DNA, 1482 bp, Homo sapiens
gacgacagtagcggtggcctcagctccaccagtaactgccgctggcaggagcaccacacgctctaggagtttcccgggtatcaagtatgggtccagcccgtcccagttatcctcttcccctatggcttcattcccgttgtcagtaccccgacctcagcttgcaaccttgatcttgggcttgattataaatgacgaaagaccgcggcagccttcaaagtgcgggagcgagccccgtactggtcagcgcggcggagggatctttccaggaggccccaagcccccaagcctgtggagagacttggtaacagctggcaaggcctgctccagccaccctcgctggctccttgcccctgcattcagcgcctgagggcgttattcgccctctccctgcgtcccacgcaagcggctcaaggaactcactcgatccggattccgcctcgtatgctctccaagccttcgccacctccgcaggcgctctagaaaggcgtgatggccccagctcagtgcccgccagcccgaagaggacaagcagggctggaagggacttggttttggaaaaagccccaaccgcccccaccaactggaaggaaaaggaattagtatccaccgcatctgtttaactgctaatagatcccagattacgggcaggtagtaggttggtgtctttagatacaacagcctgataataacgctggtgacattaacaacagcttgtggaggggagagggttgttactggtgaaagttaagagattcaatctagggaagtaggagactgaactctgacaaggttaggggcactgagaaccccaatttagcatcgatgcatctaccaggcaagaaaatttgcgttttgacccagaactcagtcatgatgctccgtagaggaggtggattcgaccagcagacagatgtccccaaagtcgagagagagctaagctgcctattttctctccaggtgaaagacaaagcctagagcaccccacttaagatgaccacccccagctctttcaaaaaaaaaaaatcccccgaagagacagcgtggtgccagcgtagcagcagctcggccggttactggaaacttcacctggcaacgcagccccttttacctgacggctgcgtcttctccttgcaatgggctcatccgaatccgacagggtcagggaggtggaaagggaagacgctggcgcggcagcagcggggatcccggggcatggtattgttttaggggtcgccgccgaggtccctcctgcccatcgttgagaactgccaccctgatcccagggctcggtggacacggcggcgggagcggagatgccgcctcgccgctgctgggcaccagggacggaggaccagaggcgcacctcggaaaggagtagctcagcgccttggcgcggagatttgcgggcactgatgatatctcgagcgctcgttcctccgcggtgacaatggataatgccaaacgcgcaagtgacggcgacag

SEQ ID NO: 198116 - DNA, 399 bp, Homo sapiens
ttgcaattttcagtgtttccaactagaggcgattatttagaaaataatggtttcaatcactgtcagtcactgttttatttcatgccatctctacagtaacatccattatgcattttcaaaaagtaatattagattttatttcttaactaacttattttaaaaactgtaggcaattctcatcaaatgtgtcatattaatatgcaaaggaacagttgtccattgagtcaaaatgttagagtcaaaacaccctgttttaccaagacctgcttgtatacataataggaatctcaaactcaacataaacctatcttcccttctgtgttctatgtcttatggcatgacatggccttcctttcctcagttatctaaataagaatcatacatatattagttcattcc

SEQ ID NO: 198117 - DNA, 122 bp, Homo sapiens
gacggccaccatcagaagctaggaagggacaaagaaggattctgatcagactctcagagggacatggcccagctgatgcgttgatttccaacttccagcttccagaactgtgggagactaca

SEQ ID NO: 198118 - DNA, 411 bp, Homo sapiens
  misc_feature (320)..(320): n is a, c, g, or t
aaaacgcccggcacagagcaagtcctagagaactctgtcatccgtgaagatatgtgctttttttcttttctcttttttttttttggcgtgtacacttttcaactctggagtagatgatctgtgattgactctgtttctcccccttttttttggagatggagttcagctctgtcacccaggctggagtgctttggcatgatctcggattctgcaacttttgcctcctaggttcaagtgcttctgcctcagcctcccgagtagctgggactacaggcgcacgccaccacacccggctaatttttgtatttttagtagagacngggtttcaccatgttagccaggctggcctcaaactcccaacctcagatgatccacctgcctcggcctcccgaagtgctgggattacaggcg

SEQ ID NO: 198119 - DNA, 520 bp, Homo sapiens
tggcagagtggggtcccctgacctctttaagaggagcactgctttctgagggctcagaaggcaatctgaggctccagcatcttggccaggggctgtgaagagacaagtggagcacagggtggggtatgcagggagcaggaggtatcatgggcgggcccctcagggagggccgtggattattcaaaagtgccctggcctgctgtgcattctggaggatattcaccatcaaccctgccaggaaagaaggcctcacaaaacaccaggtctgaaggaaggatcaaggaatttctttgacagatgttaatcaagaaaacctgaacaccaagggaggctattgcttcctcctgaaactatttgactggcttggtctctttgtacttgggtgggactaaccatgagaaaaagctcatctgtgtgagtttcgtggctcaatgttatggggtacagacgtgagctactcctctaatgtccaggagctgtatcaatcccaagaaatgacttgcaatatcctgcatgtgtg

SEQ ID NO: 198120 - DNA, 546 bp, Homo sapiens
agctatctgagggtaacactgtacttgcctcctaaagatttatcccacctctgccccaccatgatcactaccacacccagacaccacctgagaagctataaaatttggatgagattggccccaccctcatctctgagagagttatagttggtctaccttaccaagaaagaagtggagaggggaatgatcaggatgaggaatcctggtagaagactctgctatatggcacctttgactcaaaaacattgatgacgtgaaaataagtcaactgctaaagttcacattttaatcctaggcaggctctcctcaacccatcaaaatgctggaccacttctttccacaatcagttaatctgcattcaagaatggaaaattaactttattattagcttaggaggaacataattaagaaagaaaaatgatgtagggaattataaggatttccaatgccaagtataaattatttttgaattagctattttaagtttttaatacctcagatccctcttcattcatatatataaattaaaggttaattgcatttaag

SEQ ID NO: 198121 - DNA, 234 bp, Homo sapiens
tgcgatgtggtcgtctgcacgtgggtgtctgcatgtgggtgtctgtgccctcaagtgtctcgtgtctgcacgtgggtgtctgcaccctcacgtgtctcgtgtccgcacaagcatgtgtaggtgtccctgctgggctctttggtgggcggccagtgatcctcgaggtcacgcatgtcttctgtgggtgcctgctccttgcaccccacagtgttgagatgggtttgcattggcccc

SEQ ID NO: 198122 - DNA, 130 bp, Homo sapiens
cagcttgcctctctgtcatccgcaggatcgggcagcctccaagtcctcatcattctaactctcataatgcctctggagtttgtccagatctcctcgtcaccactgccgctacgctaatcaaaaccaccat

SEQ ID NO: 198123 - DNA, 1488 bp, Homo sapiens
tcagtcaccagatcctatcagttctgactccttggttgctctatttttgtgtattcctactgctactgcattaatccagatcataattatttgagatactgcaactctttttctgcttctagtctttccacattcgttctccacactatcatcatagtcgtctttataaagttctgtttatttcacacctttgcttaaaacctttcattggctccccattgttctgccttatggtgtggaagattcttcatactcagaccttaccttttttgtccaacctcatctttctccactctccccacagcctatcagcaaactgtggaatagaagacaatatttactccctcaatctgtaagagcattatccatggaactttctgtggtggtagaaatgttttatatcatatatgcactattcaatatggtaatcagtagccatgtgtggctaccgaatacttgaaatgtggttagtgtgactgaggaattgaacttttaattttgtttaattttaatgaatttgaagttaaatagccacatgtggctagtggtaatgatttagacaacagagatctcgaacagtgcttctcaaccagaggcaatatttgccctccacgcccctaggggacatttgacaatatatggagacattttgggttttcacacttggtgagttctactggtatcagatgggaagaggccaagcgatgctgtttcagcatcctccaaaacaggatgtcccccgcccccataacagacttagcccaaaaggtcagagtgctgaggttaagaaactctattctagactgttccttctttgttcgtaacacgtacttatagtttaggattcgtcttagatatcaacccctctggaaagccttctatgatttctcaggtctgaattttatattttctgttccattatatccttaccttatttgtgtgatacaataacctttatggtagttataattggcatttttatttggtcttggcttcttgagtataggaacatatgcattggaatatacccagaggcacatgaacgtgatcaatatttgttgaatgtatgaacgaatataaactaatgaatcaatcattaaacatactgcggtttaaaatagaagtgttgccaccttaaatttataccttttagagatcatacacttataaaatatttggaaatatttttgggagttactcctggtttgccaataagtaaagataactcattcctttagaagggaagaacttttttttttttctgtttctgccattcttccctttgctcctgctctacttagtttagtatgccccttccttccatactcacctgttaaaagataaccaatccaccccactctcatccccagagtgctcgtggggaactaaaactttattgcataaatgcaggaaggatttgagcaggtgaagtgggacaaagagactagaaactaaaaaaaaaaaaaaaaaaaaaaaagaactgactag

SEQ ID NO: 198124 - DNA, 455 bp, Homo sapiens
  misc_feature (414)..(415): n is a, c, g, or t
  misc_feature (421)..(421): n is a, c, g, or t
  misc_feature (427)..(428): n is a, c, g, or t
caccctcactctgctctgtttgccctttttctatttctattttttaaaaaattcagtctgaacaaaaaacattgagcttataacatcagtacttcattactctatttctgtatttcagctggtagtttttgtttaatatgtagttataaaacttgtatagacctaactgcataaatatttaatgttttttgataggcagtatgttaaatatatattctcaggtgtacttctactatagatggtccccttgagaatagattttactgtgcatgaacatagttcctaaatctaaatccctactcttttttttaatttatttatttatatttatttatttatttattttttggagatggagtctctcactctgtcatccaagctggagtgcagtgagccaagatcatgcccctgcanntcagcntgggcnncagagctagtctctgtctcaaaaaaaa

SEQ ID NO: 198125 - DNA, 397 bp, Homo sapiens
aaaaatttatataataatttttaaactatgggattgtacattatgtgtttcttccttaccatgcccttaagatcctaataacaagaaagtatgtattattagcaacactcctaccctaaagagcatatgaaacatatacaaacaatctgtaaatattttacaggacaattattttctttttactcaaaccataacctgtagtattttgagagcctattttaggtagtgaatttagaatgtcttcctcctcctattctctggccgatatagatttggttctccaccatactgtgatacgtttgaaaaggggaactgtattttatctttctatccttatcatccagagcagagcattactagtaaatagaaaataatcaatattttagtgaataaataa

SEQ ID NO: 198126 - DNA, 239 bp, Homo sapiens
agttatgttcagcataactagcaaatccaaaggccagctccacatggagaaatacagtatattcttgttggctgctgaatgcactgatttgtaacttacagtctagagttgcagttagacatgatggtatggtctcactttaggagcgaaaagaaggaagcagtgcttcccgccttccccataactcacatgtacatttcccatatgtgtatataaagaatctattttggaaagcatca

SEQ ID NO: 198127 - DNA, 957 bp, Homo sapiens
tgctgtggatgacctctgatgtgcctgccctatgtggacctatactccctgtgtgatgacgcctgatgtgcctgctcctagatgaccctaccctgtgtgatgacccgaggccgcccagggccctccccgggagacccgaggccgcccagggcccttcccggggagacccgaggccgtccagggccctcccgggagacccgaggccgtccagggccctcccgggagacccgaggccgtccagaatcttggattccaaagatccgctaacctctgttttaggggaaatcagtttctgcctgcgtgtgtgttcagctaggggttcaaggcccggcgacgatggctcagcctgcttggggaggggccatttgttcttcccacgcagagacttgccctcccactcaccgataagttgagtgcaagcatgtcgtctccgtacatgaaagtaagcctgaagactcaggtctcgtctctcattttctgaagatttttgacatagaactgattttttcccacattgagaactagctccaagatggccatggtcgcctctgctgggctttgtgggggcagagaagggactaggatgtagctaagtacaactagcaagtcctgtggagcctcacgtccaggttctgctaccccttttcctaagactctatgaagcgggccaggcgcagtgactcacgcctgtaatctcagcattttgggaggctgaggaggcaggcagatcacttgaggccaggagtttgagaccagcctggccaacatggcgaaaccctgtctctactaaaaacataaaaattagccaggcatggtggcacatgcctgtggttccagctacttgggaggctgagatgggaggttcacttgaacccaggaggtggaggctgtggtgggccaacatcctgccactgcactccagcctgggcaacagagccaaactctgactccaaaaaa

SEQ ID NO: 198128 - DNA, 921 bp, Homo sapiens
  misc_feature (25)..(25): n is a, c, g, or t
  misc_feature (28)..(28): n is a, c, g, or t
cgggagacccgaggccgcccagggnctncccgggagacccgaggccgcccagagccctcccgggagacccgaggccgcccagggccctccccgggagacccgaggccgcccagggcccttcccggggagacccgaggccgtccagggccctcccgggagacccgaggccgtccagggccctcccgggagacccgaggccgtccagaatcttggattccaaagatccgctaacctctgttttaggggaaatcagtttctgcctgcgtgtgtgttcagctaggggttcaaggcccggcgacgatggctcagcctgcttggggaggggccatttgttcttcccacgcagagacttgccctcccactcaccgataagttgagtgcaagcatgtcgtctccgtacatgaaagtaagcctgaagactcaggtctcgtctctcattttctgaagatttttgacatagaactgattttttcccacattgagaactagctccaagatggccatggtcgcctctgctgggctttgtgggggcagagaagggactaggatgtagctaagtacaactagcaagtcctgtggagcctcacgtccaggttctgctaccccttttcctaagactctatgaagcgggccaggcgcagtgactcacgcctgtaatctcagcattttgggaggctgaggaggcaggcagatcacttgaggccaggagtttgagaccagcctggccaacatggcgaaaccctgtctctactaaaaacataaaaattagccaggcatggtggcacatgcctgtggttccagctacttgggaggctgagatgggaggttcacttgaacccaggaggtggaggctgtggtgggccaacatcctgccactgcactccagcctgggcaacagagccaaactctgactccaaaaaa

SEQ ID NO: 198129 - DNA, 368 bp, Homo sapiens
ggaaagaaataacgtgcttgctgtgaatacgttcactttaaacattatgtctgttagtaaaacactaaaatcagcccaaatatccaaccactggatcaagatttaatgaattatgatatactaatacaagataataacatacattaaaaatgacgaatagaacaccttgtagaaacactaaacatttttgcaggtgtaatgtcacataaaaaaatctaaatgtaagaggtagtagctaaggggtatggatttctctatagggtaatgaaaggttctaaaagtgactgtggtgatcgatgcacagctctgtgaatattctaaaacctactgaattgcagatttcaataaataagtgaatggcatttgaa

SEQ ID NO: 198130 - DNA, 484 bp, Homo sapiens
atgcttgtatcagctttaaccagctgccctgtgttccatgtttctgggttggaatgagaaagctattagaacactggaagactgcaagccacatacaaatcatctttgttactgacacttgggggagtactttatagtggctgtcaagaccaatacaaaacatggtttgtgcctgaaaaagtcaagtgccattattcaaaaagaagatgttagtaatccaaataactgaacaacatccaggatcttcattgagtttagctgctatagacgcagatttattattgagtctgacttaagtaaattagcatgtaggtttgcattctagatttgatggaataacaaaggttaattacttgcaatgatctatgctggaataggagtaaaaggggagagctatatttagatttaatttcaccattcttaagggaatactatgtgaggggacgggattattatagggggcaaaggaaggagtgctaaggaa

SEQ ID NO: 198131 - DNA, 545 bp, Homo sapiens
gtggaatactatttagcacaaaaggggacaaattacagatggtaagtttttttttttaaatcagaaaaatataccaaatgagaagaacaagacacaaaagatcacatattgcatgattccattaatattaaatgtccagggaaaaggcaaatctacagagacagtcaactattggttctctaggactagtggtaggaagagggattaactacatacagattagaaggatctttactgggatggtagaaatgctccgaaatggatttacagagatggttgcataacacattaaatttgcaaatagtattcgattgtatacataaaatgtacgaatttcacagtatgtaaattataccttggataaagttaattttaaaaagtaaaatctctttcatcaagactgaactacatacagttttctccttttcattaaaatggtgaatttttccaaaggactagaatactagtagcacatcactcttccaatacagattattagaccctatttatacctcgactttcctagttctggagcctcagagaaa

SEQ ID NO: 198132 - DNA, 300 bp, Homo sapiens
gaggggaggagaaaggaacagcactgagaggggccaggagcccaggaaggggagggaagggcagccgcgggccaggggtgagcctgcgggccacgcgcgacccccggagccttcgcagccctctcagtgtccccactcccagcccaggcgagtccacaggacccgggcccctgctcctccctcgccttctctttgctccttcttttgctttgtggcctttctttcccttcccagagacacctgggagctgcccccaagctttggggcgccccgcggggccctgccaagggtgcgtgtgag

SEQ ID NO: 198133 - DNA, 206 bp, Homo sapiens
ggatggttcttcatccagtattctcattatcattcatcagaagctcattgactcaagtatttgatgaattgtagctgactgtagctttggcacgtagattcttacagacagtttaatctcttctaagtgaattctgagtcccaaataacatgttgaaaccctcagtggtctcactttccaataaacatggctttgaaaaccagcac

SEQ ID NO: 198134 - DNA, 116 bp, Homo sapiens
ggtcagtgtgcatatggggaactgatctgaacccaggtattctaggcccagggtcagagagtcagatcttaatccctcaggctaaacagtctctcaatttactcgttctccttcct

SEQ ID NO: 198135 - DNA, 415 bp, Homo sapiens
ggatttagggaagaggttcttagacatgacagcgaaagcaccatccataaaagaaaaaggataaattggacttcatcaaattaaatttcatcaaaaagataaattttgacttcatcagaattaaaaactattattctgtgaaggatacttttataagaatgaaaagacgagagacagacttggagaaaatatttacaaatacaaagggcttgtctttggaatatataaagaactctcaaaacttaactataagaaagtaacccagttttttcaactgggcaaaagacagacacttcaccaaagaggatatacagatggcaaataagcacgagagaagatgcatgacatcattaatcattagagaaatgtaggttaaaattaggatatcatatgcacttactagagtgactaagat

SEQ ID NO: 198136 - DNA, 670 bp, Homo sapiens
tgaagcacctacttcctgtgtgtgttgctttcacagcattagccaactgttttacttcatgatatttaatacacacatccacacccatacatgcttacatacagctcccagttcccaacctcccaactcctgtatttgggatcccattttctagataagagatttgtggctttaagaggttcagtaatattttcaaagtcacacagaaggagggaaagcagggatgtaaaaccaaatttccctaattttaaagcccttgttctttcaaccatgccacaccacctgctacacaaagcccctggcagacccatatgttaccttccaaatcccttctgctgatgttagcaaccactaagggtcaaaggttgtattttcaaaatgtgactcatgagccattagtaagttctgaaatcaattgctgggccttgaccagcatttttaaaaaacaaaatagcgcagggtagattgagtagaatagatcagaaagagtaagaattgtttcatgaaccttggtttcaggtatgcatgtgtggagtgttctaggtcttaatgtaaaatgtatttcttattatgggtttatatttaaaaagtttgaaagtcattgggttcagtggatgctctcacatagacctagctcatgaattgagaattactgaacactcagctctct

SEQ ID NO: 198137 - DNA, 188 bp, Homo sapiens
ctattttaggtgttttagattaatcagtgaacacaacaaagatatctctgacctggaatagctttgactcaagcagggaggaggataaatgcaataaattgtaaattagatagttttgttacaaagtgatgcttaaaaacgaggaaaagtagagatgaatgatattgggagtgtttgatgatgggagg

SEQ ID NO: 198138 - DNA, 227 bp, Homo sapiens
tcaatcaagtaatccttttatcttgttttataggtaagaataaggaagtctaaatgtaagaggtcaggccaatgtcacaaatgatttagcaatcacaagcaaacttgagagatgattgaataatgttatgtgaacttcttgcaaccacggggaaatcaattacccaagccttagatgttcccttgccaaggcagggtggacagtgtttagggccatgtttattcacc

SEQ ID NO: 198139 - DNA, 669 bp, Homo sapiens
agtaactgggactacaggcacacgccaccatgtgcagctaatgttttaattttttatttttttttagagacagggtctcaccatgttgtccaggctggtcccgaactcctggtctcaagcaatcctcctgccttggacagccaacatgctgagattacaggcatgagccaggcccccagccctgagcatatatttgtacattcctttcctcatttgatcttcacatcaatcatctgaagcagagaacgtaattatccccattagacagctgcagggacgaaggcactgggaaggcaggtgctgcccagatcagagagcatcgctagcagagtcaggacttgaatcaagcatgtctgattctaaaacctacttgcctacccaccatgtgatgcccaggtcaattccacccaacaagagggcaggcactacatctgccttattcttcgccatattcccagtgcctggcaccaggtgaattgcccttggaaaaggatgagagaaatcagtggttctggaagtgtagccccaggaccagcagcagcagcagcacttgggaacttcttagaaatgctgattcttggttcccattgcagatctactgaatcataccaatgcacgctagagtgtgagaaccactgggacaaatgggcgaacgtccccaagcctgat

SEQ ID NO: 198140 - DNA, 386 bp, Homo sapiens
tgaaaaaaaaatgcagattctcattttctaggtctggaatggagtctgcatttccaactagctcctgggcatgctgatggtgctggtccaggagctacaccaagtaatggcacaagagtgtctaatgtgatcttcttattcagtgttgttatatctatctatgtaaagtgatttcgaagggaaataaaaatggtttatttcaaattcattatttttctattttatttaataaacttcgagatgaaaaaaccaccatccagaaaaatagaatgaaagtttctttccaacggctgtattagtccgttctcatgctgctaaataaagacatacccaagactcggtaatttataaaggaaagaggtttaattgaatcacagttcctcatg

SEQ ID NO: 198141 - DNA, 514 bp, Homo sapiens
acgtgatctggtgcaaaaagattgggaactgctcatatgcatgactttcctgaatctggaatgcacactgtgttcaagaactggaagggactggtagaaagtatgagattaatctgatgaggagacaagagtcagatcaagtagaatattgtaagccatgttgaggactttaaagtttatcttaaagtaaacggaaagcttatttaaaaattttaagcaggagttaggcaatctgacctgacttgtgtcttagaaagattactttggctgccgtatggcatataaagagagaccgagggaagtagaagtccaattagaaaggctgtagcgtttattcaagcggaagataaaatgtggtgtgttttgaacggtggcagtggaaaaagaagtgaggagggagattcaaaatatattttggcagttatggtgatggattagatttgaagagaggttgaaggaagaattcagcaaaagcagttggctggctggatgcattactattaggatgaggatc

SEQ ID NO: 198142 - DNA, 180 bp, Homo sapiens
gaaaggatcctgtagctagtaagtaatagagacaggatttgaatttaggtggtctcatactaaagcctgagctcctaagagtttgttatattgccacagtgagtaattattaagtatatatcatctccaaagcaagaatcaagaggctattttgtgtaaccactgtgctatgtgccgtca

SEQ ID NO: 198143 - DNA, 510 bp, Homo sapiens
cgtgtaacatctcaacacaaaggtcaggaagcagtggccatgcgccagagaagaaaagcagctgtgttacatgactgtttccagcactttttcccttggcataatgcatttagaaggtcctgaaatgttattttctttttacatctatggctgcttttgtgctgcagtggcagagttgagtagttgcaacagagaccatgtggtccacaaagcctaagatgtggccaggcacaggggctcacacctgtaatcccagcacgttgggaggccaaggtgggcagatcacttcaccccagaaattcaagaccagcctgggcaacatggtgaaactctgtcactacaaaaaatacaaaaattagctgagcacaaggacatgtgcctgtagtcccagctgctcaggaggccaagatgggaggattgcttgggcccaggaggtcaaggctgcagtgagccaagatcatgccactgcaccctagcctgacagaatgagaccctgtctcaaaaaaaaaa

SEQ ID NO: 198144 - DNA, 359 bp, Homo sapiens
cactgagcaggtcatgcacactgctggggagcgggggtgggagaggaagatcagcaggcttgacccacaactaccaccactggggcccaaagactgccccacctggcatccccatccccagcaaagcctcgccacagcctccccaaacaaccacagccaatccactgaggaactcacagataccactgacactgattatagctgaagaaatatggaaactaaactactgcccccacccaaaataaaagccaaagcatcctacccaaccaatacaatagatacatctatcaggaaaagtcttttcctatgaaagccaatccataaaattgaaagaagagacagttacaccagatgcacaa

SEQ ID NO: 198145 - DNA, 348 bp, Homo sapiens
agctgtggaaaaaaaaataatacaatgttttaaaaaaaacactcaattctgaatgataaacaccaagttcaagtcagtggttatttctgggggggtcctcacagaaatggacaattggaataacacagtgaacttcagcggtgtttttcgtgtctcatttcttaaactggaggtacatttacaatgtttattatattttctctatacttctttgtctgcctgaactagtttgtttcccagtagttattggaagaggaacagaaatctaacttttttgagacagggtctcactgtgtcatccaggctagagtgcagtggtatgatctagggtcactgcagtctcaactt

SEQ ID NO: 198146 - DNA, 641 bp, Homo sapiens
gacaaagtgagaccctgtctctaaaagaaaaaaaaaattggcctgtgagcatgggtttgattttcaaacaggacctggagggtagggacagacagtgctgtcacccttaggtgctgaacactcagaaacgggccagcggcagcccttccctcacctgcagacaccagattgggcagaacagcacatggcacttgcagctcttgcagtgagggcagaacccagtgtcaacccttctgcctgtgggaggggctgctgaggcctgcggagaggccagggtggaggctcgtccccttgtccagcccttggcgtggtctccaccaggtccccagcccaccagtgcagggcgcccctgagcctgctgctgccacgggccctgtctctacccaggacgtccccacaccctcgcagtgtcagggaaatgatcatggtggcggtgacactccgcaggcagggctgctgagagaagctgagaagggtcacactgcaggcaggggcccgtgtgacaagcccctctcaccccgagagagctgaccaggcagctcacgagcagagccacatcccgggagtccgagaaaggtcctggctgggctcagccacctcattggccacgggcagcctttgtcgtgtgagccttgctctcc

SEQ ID NO: 198147 - DNA, 911 bp, Homo sapiens
ccagagtattcctcaaatctcttccagtccttttatattaagagcaagcggtggttctagaatcttccttaaaatctctctctggctgtttcctaacttttccatggttgtcttagctgattcgtttttcctgtggggaaaattgctgttggtcctgcgaccagagctcctttggtagcttctgggcctggggagtgggaaggagaaagtagctgctaattagccgtcaggtgacttcaggggaaagcaggagagaaggttgaaaatcagtgaatccacaaatcatttagctactgccttgaggccatcctgtgtagcaagtggcagaggcaggattttggtaccctgggcaagtcgccccctctgagggcctcggtttcctcatctacccgggtgaggagaataagcctgcttaaaacgatttctaagatacataaagaacagtagagaacagtgcatgtagcaggcggccttttgtgtgcaggtggggatagtgccaaccacgcttttgtttaaacgcacagcaagtctctgcaaagatgtgcaacagcagcctgtctccagggagcagggctgggaggctgtgggactcagggaagacaggccacactattcccttttgtaccttttgagctacaacaatgtgaacatactacctattcacaaaatgagttagtttgtttttttgagaccgagtttcactcttgttgcccaggctggagtgcagtggtgtgatctcggctcactgcaacctccgcctcccaggttcaagcaattctcctgcctcagcctcccgagtagctgggattacaggcatgcaccaccatacctggctaattttgtaatttttttttgtagagatggggtttctccatgttggtcaggctggtctcaaactcccgacctcaggt

SEQ ID NO: 198148 - DNA, 114 bp, Homo sapiens
atgttttagacttaccttcataatatggcatagtttttggaagattctcattagtatgaaatctatatcctcttttcatggtgggccaaatttgtaaaaatagccaaaaaataa

SEQ ID NO: 198149 - DNA, 434 bp, Homo sapiens
tacttcctgaattcctgtgctcctcgggtaagacttcctcgtggagatggagctaaagaaactaaaagacactcccacccttgttaggatagactttatttgcacataaggtcagacaaatttccataatgccacctgctatggactgaacatattcctgcaaaattcatgtgttgaaagctactccccaatgtaatggtattagatgaggtttgaggaggtggtttggtcatgaaggtggacccctcaagaatgggattagagcccttacaagtggctgaagcaaccagagtgttccttttccatgcgaggacatagcaagaaggtcccacccaggagccgtaagcaagccctcaccagacactcaatctgccttcaatgtggacttcaaggtctgtgggaactgtgagaaataaatttctgttgtatataag

SEQ ID NO: 198150 - DNA, 301 bp, Homo sapiens
ggactgcccaatgaatctagacagttccattatgagacaagttaattttcttcttctggaaggcatacaatggggacagcctattaagcccaaacctctctttctaacttcttcctggaaagaatttggagtcagagttcttatttaacatttcagatcctacagcgccaccaagtgaaataggattttttctccataaggagccctatctgccctttgtgcaaaaccattagttccccaattcctctccctcctgtgtgcctctgttagggactaagctccatgctccatctgttaacag

SEQ ID NO: 198151 - DNA, 236 bp, Homo sapiens
caatcctgtgcgtattcggggtggtggtggcggcagtggcagcggcagcggcggcggcggtagcagcagcggcagcggcagcagcagcagcaacagccataacaacggaggtatttaagggttctagtgagtcatttgtgcttcgaagtccagaccccagcaagccacataatagctgtttcttttctcttttctctctctttttttcactccctgatgactgctctcaagagcga

SEQ ID NO: 198152 - DNA, 308 bp, Homo sapiens
tgcatctacccacggggttgccacgactgagctttgaggagacctgtgagcagtcacagagtgaccacacttcatcacagtctggcttggagtaatctccctctctgggaacatggtagatacatttatttaaattatatgaaggccaagaattttttagaggccaaagtcatttaaaaacaaaggattttttaaagctcggttcacaatgtcatgtgaaagttgaagggcaaaactccctcagtgaaaatgtatttccaagtagaagattccatgtcttacaaaatttgagaccattatttgcatca

SEQ ID NO: 198153 - DNA, 537 bp, Homo sapiens
ggactaatgcttgggatttattattgagtttcatatgaatttggaatctagattcatcccattgtttaaacagtctgctttgtttttttcttaatagttacttgaaatgctaaaggaactaaatagagccagatattacacagaagatgagacatttcaagatcattctgttctttataatcttatctccaaaatttctataatagacgattattgcagtggtcactcttcaattctagcagctttagaagctgaaaccacactgaaaaagtggatgtttacacatttagacccatccttagatctgtataatacaattaaaccacgaataaacaaaacatgatttatgcttgtcaaaatttgtagaactcttcagaaattgtgactccatctccaccacagaactaaaactcatcaaaatttattttattattatgtgtaaatagcaatagatttagttgctaggtgccatctgctcagtgtcgaagatcactgtgaattggaatgcttacatttcttgaacaatcagcagtactt

SEQ ID NO: 198154 - DNA, 575 bp, Homo sapiens
aactaatctttagactcatatggaaatgtaaaggacctggcatttgggaaaaaaagaaactttgaaaaggaagaacaaagtaggagggacaacactacttgatttcaagatttattataaagttacagtaatcaaacactgcggtactggcaccaacaaagataaacagatcactggaacaaaataagagtccagaaataggcccacacatatttctggaaaactaaattttggcaaaagtacaaaggcaattcagtaaagatagcctttttcaacaaacagagctggaacaactggatattcacatgcaaaaacgtaaacttctagccacctcataccatagttaaaactcagatgaatcatagaggaaaatagatcctaaaactgtaaaacttctagaaaaaagcatagaagaaaatctttgtgatcatgggttaggcaaagattttagatacaaaataaaaaaaataaattaaaaattgatatatagacaataaaaattaaccatttctgcttcttcaaagaaacaacttcttcttcaaagaaaactttaagagaacgaagagacagcccaa

SEQ ID NO: 198155 - DNA, 243 bp, Homo sapiens
tgatctgaggatcccaagcttttaccgctagacactaaacaacaagaataaatagtcaaataaagacaactaacaggttgtgaacaaccatcagaggggaactagcatagaccaaatattatcctcatagtctttctataaagtagattttatcatcatcattttgtagatagccaagactcagagagggtaataacctgccctaaggcatacaaccaataggcgtaagctaaaatatgaatg

SEQ ID NO: 198156 - DNA, 519 bp, Homo sapiens
acttaacatatatagtaattgacttaacctacttgattcaccatttgttgttataaaatattgccttaattaaatatttcaaatcttaaaggtttttccattatatgaaattttttaaggaatgcttttcaaaaatgaagactgcagtaccttttgtgatttggtacatataaccaaatcgccctttttattgtgtagttacagttgataatgccacctgaaatacatgaatgtgccagtttcattgcagttttaccatagtggagtgttaaagcagcaacaatctaattatttaaaatcctagtggtagttggtaatgtcatcatatctttgatagcatagctggaagtacaaggaattgctactgtctttgagtaaacaaaactctaactttgaatgagccgtaaaaggatagtctctaacccaagagagaacaaataaccccatctccctatatcctgaagcacagctaaaacatggctggagtatttgcaagaaactaataaggaaattttgcaa

SEQ ID NO: 198157 - DNA, 461 bp, Homo sapiens
gagttttcttccctaactcattctcagccttttccttaagagtaggtccccagaagtttcctaatgaattccttacttcctctgcaatgaaacctctaatgctgtcaccatagacacaagggctggccctgaggtcagcaaatcagaaactatgggatcacatccacagcgactcaaatcaccagggcctaaaagggcgtgtccttccatcgaacatgtctaggaaacacctgatcactgtctaggaaacaccatttactcctgacttctcccacactcaccttcctcacctacggtccatcaaagccttttgaagattttattcactccttatgtcgtctggtaacataggggttctaagacaggcaatgcttctggagctaacactgtctgtctcagaaccccagtgttaccagatgacatatggagtgaagatctgagaactgctttttttttttttt

SEQ ID NO: 198158 - DNA, 345 bp, Homo sapiens
tagataggatttgccaggtaggtaaccagattgaatagaatcagttttagttcttccttttcaatttgaataactgttatttcattttcttactttattgcattggctaggacctccaatacaatgttgaagaggagtgagattacatattgcagcattttcttatctgacatgcattgtattttgtttgtctcacagctcagaaaggccttactgaccattctgtctgaaatacatcttcctctttttatcattatctcagcatcatacttaattactttatattccttgtcataaattatatgtatttctttgttgtctgtctcttacactaatccgtaagcg

SEQ ID NO: 198159 - DNA, 573 bp, Homo sapiens
ccattttaatagcaaataccttccaatatatgcttagtttttcctgtttattaataaagctatgatactcatccttatagctgaatgtgaatacatatcacaaagataaatttctagaggtgaaactgtggaattgttgaggtcatatcccttattttaggcttctaatatactaaattgccctccagaaaggttgtatttagtctctactcaacaacctctttgcctgtttcacagtctggctcaaactagtattgtcactatatttagtattgttattctaaaacaatttaacaatattctgggcaaaatgacatcataacggtttttttttttttcttggagacggagtctcgctctgtcacccaggctggagtgcagtggcacgatctcggctcactgcaacctctgtctcccaggctcaagcggttctcctgccttaagctgggattataggtgcatgccaccacgcccggctaatttttgtacttttagtagagacagggtttcaccatgttggccaggctggtctggaactcctgacctcaggagatctggccgcctcggccttcc

SEQ ID NO: 198160 - DNA, 194 bp, Homo sapiens
tagcatgcaggataaaactattgaggactggataaaataatgcatttttactttgttcctttcgtcttgttttagacaaaaggctcattgtgctatgtgaacgctcaggtcttgtgtaacttgttgactttatatatgtacatatcggtcttgctagattaccttcatggcagttacttgagccagatggaaga

SEQ ID NO: 198161 - DNA, 412 bp, Homo sapiens
cgggtggatcacttgaggtcaggagttcaagaccagcctggccaacatggtgaaaccctgtctctaccaaaaatacaaaaattagctgggtgtggtggcaggtgcctgtaatcacattttagttttgatttgcaaagcactggcgcatgaaaaaatcttgggccgggtgcagtggctcacgcctgtaatcccaacactttgggaggccgaggcaggtggatcacctgaggtcaggagttcaagactggcctggccaacatggggaatcctcatctctactaaaaatacaaaaattagccgggcacgatggtgtgcacctgtaatcccagctactcgggaggctgaggcagagaactgcttgaacccgggaagcggaggttgcagtgagcctagattgtgctgctgcactcca

SEQ ID NO: 198162 - DNA, 941 bp, Homo sapiens
gtgaattttggtgatttttagctttacagatagtaaaaaatgccaaaagggtgtccttttgatctatcaaattagtaaaaataaaatttttactcatccttactcatcagtgctaataacttgtgtattagcactgataaactgttggtctgtaaattggtaaaagtgggtaaaaattgattaaatttttcggattataaaaaagcttagatggcctggtgcggtggctcacacctgtaatcccagcactttggaaggccgaagtgggtggatctcttgaggttaagagttcgagaccaacctggccaacatggtgaaaccccatctctattaaaaatacaaaaattagccaggtgtggtggcaggcgcctgtaatcccagctacttgggaggctgaggcaggagaatcgcttgaacctgggatgtggaggttgcagtgaaccaagatcgcaccactgcactccagcctggggtacagagtgagactccatctcaaaaaaaaaaaaaaaaaaccccgggggcctcaatgtggcgggcgggcgggaccacacgggtttagtggaattgggccttgtcaaaaaagtggttctgggaccagggttttctggtcaccaaggtgggaaaatcggcggggtcccctataaggggggccggataaatcgatacagcccggttaacccggttagaactcggagaacacaagagaactaaagcaaaaaggagaaacgaaatgacaaacggcgataaacaatggtccccagacgcgggacactaacgaaagcacgacaacaacaaaccacaacaaaccagattaaaagcgtacaacagggaaccaagaacaacgaatagggagtatgtatgcccatatccaacgcacgacgccatagaaacagttttcacggaaacaagcaacaacaagcgagcacacaacaacaagtacc

SEQ ID NO: 198163 - DNA, 408 bp, Homo sapiens
ttatctttttatctcagctatatttgtgcttatttgaaagtgatttacataccatgataattgaaggttatgaggatccccttttcgcagataagttccacgtaaagccgtgtttcccaaattgtgttttgtagactgccagtcttagagagattagttgtttgtaggagaggttccagggtgagatttcaacttgggaaaacactgggttaaacatagttaaacagagttttatttttgatggtgattgtgttactgtttttctgcagagcttgtcagagtttttagtagtgtgtattggcaaattgagaaatactgcacattatatttccttccttcaagtttatttggtcaaaagaacacaccctcccccccaggaaatacccacaaacatcttgaagaaaggtt

SEQ ID NO: 198164 - DNA, 673 bp, Homo sapiens
ccctcctggagtttgggaagaccctgtgtgtcaggtcagcctggtcccgcagttgccatttccatgtagcaaggaggcacctgcctgtgctgggtgggaggtgtcctgagctgtggcatggtggggattggagtccacaggggtgctgcttccactcagtgtgggaccctcagtttctaatcgagctcaataggcggatagcgtttgcctttctacggggcatattgagctgctctttggggcttgttgagttcagaaccccatgggcaaccaggtggaccatgtttcctcctgagactccacgaggcagagtgggtgtcgccagagcttccatgcaagagtgggacctggaggcatggtggcatggtgtgctgggccgcctgctgggccgggtgagggctgtggagcctccccactgagaggtggttgctttataggttatggcagaaaagggtctgggtattagagtaagatatggaaactcttgtctccaaaacatgaagaatccaaataaatgtgtccgtcaaagacctgtgggtggtaacagtgtcagcagtttatgtttaacgattaataggatctgctgcaccctgaccagacagtgcccaagaattttactgaaggcaccggcccctgtattttatgtggggtgatagcataacccttttttttt

SEQ ID NO: 198165 - DNA, 394 bp, Homo sapiens
ttcttgcttatagctggtggcctattctctgtgaggttaactatcagctcaagactccctaggtggtaagttgggggctgggggcagtattcaaactatgcttgcagagcaccatgctgtcctgcctggggttacagctgggcctctcaggcattgatggaagaattgagatatgacttggcatcagtacaatccaagactttgttcagaaacttgtatttgactgtgtccgattattacattgataataaaactcctaggaatacattatttagaatgccattttctcccttttcagtgaatattgaactactgagcacccaggatatttcagttgactggtcataatactttctcctagcagaatgatatatgtgaaaaatatgaatattaa

SEQ ID NO: 198166 - DNA, 178 bp, Homo sapiens
aaatggtcagtggagaggcagtttgggaaaatagacatacaaaatagagctgcagcctggagctctcaagcagctccgtgctatcttagtcggacttgctgttattctctttcagttatgaccaaattatttttctaactttctaagttagcagtgttgttttttattcctaagtctg

SEQ ID NO: 198167 - DNA, 459 bp, Homo sapiens
  misc_feature (1)..(2): n is a, c, g, or t
  misc_feature (4)..(4): n is a, c, g, or t
nngnattcggcacgagggtttaatttcacgtatgtcacaaaacatggtgaaatctctcaccattttcctctcatctgtgggaccagagctgccttttctccctttctccccaacagctctgaacagctgtcctggggaccagaggctcacccttccctctgcagaaccagtagaaactgggcagaacagtgaatccatttacctccagaggacactagagactgtaggtttaaagacataagagaattatgtggcagatggccttgattatttgtgtggggcagatggtatgtacggggaaacacagagcgggggcttaggcgggagcttcccttcgtgggcagcatcttgcatctgcaagcttaatcctgggcacgaggcccaattctatgctcctctttgttgccttctccagctgtgagacattcactggaattttcagtaaataacttcttagga

SEQ ID NO: 198168 - DNA, 392 bp, Homo sapiens
ggagtcggctcagtcactgacagaaaaacgacactgagtactttatctcttaaaaacggtgaagaaagaggaagtttgagacaactgcaatatacttaataaaaaaatgagaaaggcaagaataaaccaaaatgtcaacatgaattctattatggcagaatcataaatataactttatccatcagtgtttgcaattcttctgaaatgcattatattgatttataatgaaaacacttttaaaataaggtaaacaggttattgacagaatagtagattttctggtcaaaataagtctttttttttttttaaagaaggagtctcgctctgtcacccaggctggagtgcagtggtgtgatctcggctcactgcaacctctgccttccaggttcaag

SEQ ID NO: 198169 - DNA, 261 bp, Homo sapiens
cagcggaacaagcaaatgccttttatagggaagtagccactgaatcactaacttttagcctctttcttccttaaaacccaatctgccattcaatgcatctgaaaatagaagcgcaatatgttgctcccagagagaagggggtggttgatgtcagggagtaacttaaatgtaccttgtttttaaaagagcagttcagttgagagctgaagagccccagttataacaagtcgttatgctctagcactgttgcttgttccgctg

SEQ ID NO: 198170 - DNA, 878 bp, Homo sapiens
tcagtattatctaatcaggaagaaatctaactgttcttccagactttcttctcccatcctctcatctcgcctccaaggattccatccagtacttcccaaccacctgcagcggaagcagctcaaataatcctatgatcatctacaagtctgcaaggctgaccttcccgggctcccactgctccctgcttccagaacgtgaaggctgctttgcaatagactgacccccctttgtggccaggggagccatctttctgctcattccaggcctcccttactacagaggcacagagcaaaggcagcacacatcacgggggctctgtcatctgcttcctttgagtagataatcagttttcactcagaggaagatcacaggacacggaagaaccaaatgtgtatgctggctcagataccaggggccctattaagagatagcataatgggaaagataagtaggttgttttccccccacaaagtatctatttctaagctatgtttcaacagtgcgctgcagcagtttctggcttcctattcaagggaagagaaacagggttttgctcagatggatatactagatacggttatctcacttggcccctgcagatggagatggtaaattcctaatgacttttccaggggagatgtttgggggctcacttggcaacactaaacagttagatctatccctttctgtcaaaccaagagagttttccagttttttccatttccccagtgccattatgatgatcattgctccttgacaacacattaaaagataatgtgtggaaaatttttaacatcctttaaactttctttctttttttttttttttttttttttttttttgagacccagtctctctcttgttgcccaggctggag

SEQ ID NO: 198171 - DNA, 373 bp, Homo sapiens
aatctgatgaagtgttgcatgtccatgagagcacacaggactaggcttagtgactgccttctcgtccctctgggccaggcttcccagtcttgctttcctgtaccctggactcctggtggtatttctgaaaagctctggcaatatctcggcacaaacaagtcattgtgtataagccagcagtgcctggaagcccctggaggcataggggccccagctgttcttacttgcagaagtgactctgagggacaatgaccctggagggccatgcaaaatgcattccagttgtaacttaagctctggagctgagctgtttgctttgttgattctccccgaaggtgcaggatggaaaggaggggaccactttagcaaaaag

SEQ ID NO: 198172 - DNA, 596 bp, Homo sapiens
gagaaatgaatggagatgtagacatgagatgtaaggaccagaatttggaggtcaattaaagcaattagcaaatagaaatcatttaagctattaagactgatgctgtcatatatatatacacatatatatgtatatgtgtgtagatctatacatatacatatatgtatacatataaacatatgtgtacatatacatatatgtatacatataaacatatgtgtacatatacatatatgtatacatataaacatatgtgtacatatatacatatataacatacgtatattatatatgttatataacacgtatattatgttatataacatacgtatattatatatgttatataacatacgtatattatatatgttatataacatatgtatattatatgttatataatatacatatattatatatgttatataacatacatatattatatgttatataacatacgtatattatatatgttatataacatacgtatatgttatataacatacgtatattatatatgttatataacatacgtatattatatatgttatataacatacgtatattatatatgttatataacatacgtatattat

SEQ ID NO: 198173 - DNA, 306 bp, Homo sapiens
ggtggagacgctgttactgggcaaatgttcctttaagagcatcttatctgaactgctgcagtcctgaagaatgtctagtgataaaccctgtctagaaatacgtgcatacatgcaagacatggatcatgaaaagcatgagatgcatgaaggacatggaggaatttcttgtgggattattttagaaagtccttgagacagtcgttatctcagaaatgcaagcatgaactccctgccttcgtgccatcctggctccaatttcttcgggtctaatcagtgatttcatcctggtatctgcaactttcacac

SEQ ID NO: 198174 - DNA, 534 bp, Homo sapiens
atattataatcttataggataactggtatatgcagactgtcatgacagaaatgccattatgcaatgcatgactatatattacagacatcagtatgcttcctcataagcactttagcatgcatataactaactacagttcaatatattaaatattttctcctcctagaggtaaaatgtatattaacgaaatgaataaaacttaaaacttaaattatgttttctgagcttgagaaatgcataagactatgtaaaccaaatttctatcaagatatacaccattaactttactctagaatatttttaaggtctattcccagtcaatccctgcaccttcttccccacccaagaggcaatcgctattacaattttttttcattatagattaatttgccttttatagagcttcacataaatagaataatatattctgtactcttttgaataaggcttcttctactcagcataatgttttggaaatccatctatgttgtgtgtatcagtaatttcttcctgatatttctattttctgttata

SEQ ID NO: 198175 - DNA, 315 bp, Homo sapiens
acagaactctttcttgatttctcttttgcctttacctttggtctcaacacttggactggtcctgtaattttgtttctctttttgcaatccctatccagaatcactggaggtcaaatgtctttgccaatttgagtttttccacttgaacaagaaaagactgtcaagggaaagccaatcaatttcacaatgtttagatgctgaagatacagggcacagcttccttcttgaattgcttgttgtttacctagttgacaatctactgggaaaaagaaattccttttccagaaaaggttttcaccaatttcaaggaatcct

SEQ ID NO: 198176 - DNA, 499 bp, Homo sapiens
tggattttgatagacatttttcgaaagaagatataaattattaataagcaaataaaaagatactcaaaagcatttgtcagtggagaaatgcaaatcaaaattacaatgagatacaactttatacccactggggacagctatgataaagaaaaatagacaattaaaagccctggtaataaagtagagaatttagaaccctcatacattgctggtgagaaggtaaaatagtatggccacttcagaaaatagtctggcattatctctattcaaaagaaataaaatcatatgacccacacaaaaattgtacagaatattcacagcatatttttcaaaatggtcaaaatcgggaccaatcaaagatgaatggagaggaccaggtgcgctggctcatgcctgtaatcccagcactttggaggcagagatgagtggatcaccttaggtcaggagttcaagaccagccttgccaacatggtgaaacccctgtctctactaaaaatac

SEQ ID NO: 198177 - DNA, 180 bp, Homo sapiens
atgattggtgctgcctcacgttccagtatgagcttttctccttgcctcatactcttctaaagtgtttgtagcatgcactccatgatggctggccatcagtatccatgctttcagtggcattcttcccaaatccagagatgccttcttcattcactaccagcttctactcatccaccagtc

SEQ ID NO: 198178 - DNA, 493 bp, Homo sapiens
acattatccgaaacctccaatggcatcctgactcctagacctggctacttttcttttttttttcttggaggtagaaggcaattaaggcttgaagtaaaagagctgagaatagggaaaccctggtatgttgcacacctgttatgtgctagacatggtgctgggccctttttgtgttcaagagcttttagcttttgaagatattactttgtcctctagccccaaggggaaaaagtctcctagaaatggaatagtcttagcagtcaagtccaaggacacttcatcatgatgttagtaaggtgcatgtgtctccaggtttcaagtagatagaaagaatcataaattgcctctggttgctttgtagaaaacgctgattagagaagccgatggccagagtaagttccagtgttctgtaccactgtagggtgactacagttgactatatgatacagtttcaaatagctagaaagaggacgttgaatatcggtccccccac

SEQ ID NO: 198179 - DNA, 243 bp, Homo sapiens
tatgtgaaaaaaaaactccctaagcatgagaacctataaaataaaagggataataacaatatatatgagtacataaaaatattgtctctaaaattcaaaggtcaaatataaaattacaaagcaaattgggtaaaaggttaatatcctgcacactgagggcttccacataaatgacaaaggaataaagcagataatttgtagaaaaaacacagaggaataaattgaaaacactcagaatcatta

SEQ ID NO: 198180 - DNA, 347 bp, Homo sapiens
atgctgctagactgaggacaacactttgagaaccactgggcgtaggcctgcagtagctgggattttgcactccttctgctctaggcctcagctttttcatagacagtgttgtggcttatggctccagaagagagctgggaaggggctggaggatggtccctcctccccactcttctgacgggttgctcagcccccatttcaatgacacgctgtcctgagggcagcagctcctttcacaagtgtttttctgcatggccatgttatatattctttaggggaggggatggcagagatgctttctacatctacacacatgctcccctttccctgcggcaccctggcagaca

SEQ ID NO: 198181 - DNA, 682 bp, Homo sapiens
tgcctttccacaggcatgttgcacaaccaatgcttcaaaagttgaacaaattgggctgtgacattttgcctcatccgccatattcacttgacctctctccattgactacgacttcttcaagcattgcgacacctttttgcagggaaaacacttccacaactagcaggatgcagaaaatgctttccaagagttcgtcgaatcctaaagcatggatttctacactacaggaataaacaacttaaaaatgtgttgattgtaatggtttctattttgattaataaagatgtgtttgagcctagttataatgatataaaattcatggtctgaaaccgcagttatttttgcatgaacgtaaatgatgaattttagatgctgaaatttctgggcatctaaatcttctttcacatccctgattatttttggaataaactcccagaagtggaaatataaggctgaaggcctggtgtggtggctgaagcctgtaatcccagcactttgggagaccgaggtgagcagatggcttgagcccaggagtttgggacaacatggtgaaacctcatctctacaaacagtgcaagaaatcagccagcgtggtggcgtgcacctgtgttccccgctaatcaagaggctgaggtgggatgatcacctgagtccaggagatcaaggctccagtgaaccatga

SEQ ID NO: 198182 - DNA, 545 bp, Homo sapiens
tgattacattcgattccatttgatcatgattccattcgattccactcgatgattccattcgattccattcaatgatgattccattcgagttcattgactcttccattccattccattcgatgattccattcgagtccattcgatgattctattcgattgctttcgataattccattcgattgcattcgataaatccattcgattccatttgaggataattccatttgagtccattcgatgattgttccattcgattctattcggtgattccattcgattccatttgataatgattccattcgagaccattcgatgattccattcaattccattcaataaagattccattcgagtccattcaatgattccattcaagtccattcgatgattccatcagattccattcaatgaatccattcgattccattcagtgatgattccattcatttccatctgatgatgattccattcgattccattcaatgattccattcgattccatttgatgatgatttctatcaatttcattcggtgactccattcga

SEQ ID NO: 198183 - DNA, 588 bp, Homo sapiens
ggctctcaggccgcttcactagagattctattccgggggtctggggaaggacccaggaacctgtattttttagcatgctctcctgttaattctggatttgttggtgtgaacctgagctggaatcatcaggggtggcttcctagaggagatgggcctagaattggcatccctttgcttggtggtagagtccccactgtgggccaagtgttatgctgggggctgggcctccgtggtgaatcacatgtggttctgggccactaggagctcatggtctaatgtggaaagtttccaaacaagtagttacagttcaatgagattggtgccaagaaaagtatatgcaaaatgagtccaggtactgaagagtcagcacacgatttccagggtggagacatctgaacctctcgcaggtttttagggagaggaagagcttgtaagagcacacaaaagggaaacaacatggcgcatctagggaaccagaaatagtttggtatggctggaatgtggagtaaatacaggaaagtagcacgggactgtgctaggaaggcaaacagggaccagactgcactctggcctgatagccaaggggag

SEQ ID NO: 198184 - DNA, 519 bp, Homo sapiens
aggtggatgggagagagaaacaattttgaataacatagctcaactgtctctgagaagttgatctttgagcaaagacttaaaagaatacagtgatcaaggaatgcatatatctgtggggggaaaagagttccagaccaaggatagtataagtcaggcactacggggaatgggagaaaagtggaagatgtggatcttgtcctagagaaacttaatctctggttggatagaacaacaacatacacaactgagcactcccacagcaccctgtgcttatgtcttggtgcttttcacatggtttctttttcatattgtattttaattatcccagttacttctctctcttcttcccactagactgtaagcatcttgaggtaggggccatatctatttttggtatcctcagtgttaagtacaatacccaacagaatagatactcaataaaccaataagtatgagtcaatttaaggaacaatactgaagaccataggattgtagtgtctctaagccatacatttccct

SEQ ID NO: 198185 - DNA, 348 bp, Homo sapiens
agatgaaagagaggccctcttcctccacctcagccctgaccgtgttgaacccttccccacttggagtttctttccctttttcctaagggaagggggaaaaacaaggtgaccttttccatttctagaaatggaaaaactagaccagagcttattgacagatttcctgagggaaagatgcggtcttgcgtcacatcagccaccatgtgggatatgtctttcaccttccatggttgtgaggagtccccagccacatggaactgtaagtccattaaacctttttttcttctcagtcttgaggacgtctttatcaacagcatgaacatggactaatacaataccctatttact

SEQ ID NO: 198186 - DNA, 524 bp, Homo sapiens
agcccaggagtttgagaccagtctgagaaatgtggcaaaacaccaactctactaaatataaaaattagccagtcctggtgatgtgtgcctgtagtctcagctatttgggggcttgaggcaggaggatcacgtgagcccaggaggtgaaggctacagtgaagtgagatcatgcaactgtacttcagcctgggcaacagagcaagattctctttctaaataaataaataatttaaaatatatatatatatatatatatatatataatagatttcagagcttttaaaatgtattaatgtgcattttaaaaggattctgaatcacttttccaaagtgcgtgctagaatccaacctcagtatatcatgttagaaaggtctaatctatctttctagagcttgatctgtttcttatgcccatagtgcttggactgaattcttttccaacctcaaaagtggatccacatgtctcaaatattgctcatggcaaggatttcctgcttgaaaacctacttggccaaaatattacc

SEQ ID NO: 198187 - DNA, 487 bp, Homo sapiens
gcagggtcaaagaacagtgtaaacacacacacacacagagtcatcttttggtatctgtgggggattgatggtttcaggacgccccatgggttccagaatccacagatgctcaagtccctgatataaaatgacgtactatttgtatatgacctatgcacatccttctgtatgctttaaataatctctagagtacttataatacctaaacaatcctacacatcacttcatttgtgtggattcaacatagtacttgacacatggcatattcaagttttactttttggaactttgtagaattttttttctgaatatttttggtcctcactcagttgtatctatggatgcagaacccatggatatggaggaccaactgtgtgtgtgtgtgtgtgtggtgtgtgtgtacacatacatatatatgtatatacatgaatatacttctcttgtggctatatttgtcttacggatattaaaaataagaacaaatatt

SEQ ID NO: 198188 - DNA, 124 bp, Homo sapiens
cacttcaccccggcagtgagcctgctgagctttgtgaacatacagaccccatccaggctggccagtctcagaaaaaagggcagctttacttccagactgcagcagaaaaccccaaatatcccaa

SEQ ID NO: 198189 - DNA, 505 bp, Homo sapiens
ccaccaccacaacaacagaaaaggttggagtcacctttaatgtaataataatgcccacgtatgcaaaaggactcaagggaagatggttggaactgggtggcatataacaaagtcagaaacttatctggccaaacaatacagctgaaaatcagatttagttatgctgactcactgaagccagaaaaaaaacacctccagatagctagcatccaaaaaaatttgtcaggtcacccatggtagttcacacctataatccctgaactttgggaggcagaggtgggaggattacttgagcccaggagttcaagcccagccttggcaacatggcaaaaccctgtctctacaaaaaattttaaaaatagctgggtatcatggtgcacacctgtggtcccaactattcaagagacagaggtaggaaggctgcttgcgcctgggaggtcaagggtatagtgagccatgattgtgccactgaactctagtctgggtaatagagcaagatcctatc

SEQ ID NO: 198190 - DNA, 455 bp, Homo sapiens
aaacctggggcccaattgtggatcaagggaagatggttggaactgggtggcatataacaaagtcagaaacttatctggccaaacaatacagctgaaaatcagatttagttatgctgactcactgaagccagaaaaaaaacacctccagatagctagcatccaaaaaaatttgtcaggtcacccatggtagttcacacctataatccctgaactttgggaggcagaggtgggaggattacttgagcccaggagttcaagcccagccttggcaacatggcaaaaccctgtctctacaaaaaattttaaaaatagctgggtatcatggtgcacacctgtggtcccaactattcaagagacagaggtaggaaggctgcttgcgcctgggaggtcaagggtatagtgagccatgattgtgccactgaactctagtctgggtaatagagcaagatcctatc

SEQ ID NO: 198191 - DNA, 164 bp, Homo sapiens
gtcttcagttctcgtcagcatgaactaacttctcatcatggaggcacatagtaactgcattctcagaagatttatgcagttaaccaattgatacaagttttctttttcttgaatttttttttttttaattgaggcacagtcttgctctgtcacccaggttggag

SEQ ID NO: 198192 - DNA, 465 bp, Homo sapiens
gtattatgcaacctctcacatctttagttttccaactgcagaatggagataatagtacgttataggacttctgagaaggttaaattaaaattcttttataaagcacttgacttggcatatcatagaggttcattaagtattaggtttatttcccgttagaatacacataggatagaggagcagttaatttttattattactatagaaatcttcagggaggaaatgatatttaaattgtgccttgaaggtggagtagggttttgatatgtgttagatgggttccaaggacattctacttttaaggaactaaatgagcaagggctcaaaggtgtaaaacgtggggaaggctgtaaatacacttatgaatgtcagcatagtccagaaccttaggaaaagcaatttaggtcttaaaaacaaacaaacaaacaaaaagacaacaaaaaactagtagtaggaatgtaaaaa

SEQ ID NO: 198193 - DNA, 183 bp, Homo sapiens
taacttctttaacctgagagccatgaagaagagcaaagtgataactgacaacttgggacccagagcttccaggcaactgctcaccctctgtcctccctaggccaagggcgtgccctgttttgagagaagaggaaagcagccatatttccagtctgaaccacacatcacacttccgcctgcaca

SEQ ID NO: 198194 - DNA, 332 bp, Homo sapiens
ttggtctggtgtctgggatgagactggggcctaataaaaaggagcttaaatggactgtaccttgtagcattctgaggacaggtctgacttctgagaagggaaagtggtaaaagtattgtccagttctttttaagttggtggctgagcttggtgaggtgtgtttttaaaagacctttagtccgttctacttttcttgaagacagaggactataagggatataaactgaaaaactgcttggctaatttgactaataaagcctggtctgttatcagactgtatagaggtgggaaggctaaactgaggaattatgtctgacagaagggaagaaatg

SEQ ID NO: 198195 - DNA, 545 bp, Homo sapiens
  misc_feature (22)..(22): n is a, c, g, or t
  misc_feature (32)..(32): n is a, c, g, or t
  misc_feature (50)..(50): n is a, c, g, or t
  misc_feature (81)..(82): n is a, c, g, or t
  misc_feature (84)..(84): n is a, c, g, or t
  misc_feature (88)..(89): n is a, c, g, or t
  misc_feature (297)..(297): n is a, c, g, or t
  misc_feature (341)..(341): n is a, c, g, or t
ccacgcgggatgtccaaaccanaatgagacancaaccccatataaaaagntgaactggcggcttcacacactcacacacanncncatnnacacggatgaaatgtttggacagaggcaaatttcacgtggtcatttctgtttctttttaaatacaggtttgtagggtggtattttgttttttccagctataaaaaaaggcccaaaagtgcatgtgtgaggggggcaaggcagaaattaagcaataaagtcattttccctggagggacatgagagggagaaaacaggaggcagtgctgngagaacgcactttcctcaccactgggcttcttgttattcttagnatgggggttcggcgtgtgcatgcacacgccgaggacccaaaccctacagctgtccaggagtggtatacagtgacagcacatatgactaaagaggactgaatagagtcaccttgataaacgatgacatttcctcatagaatctctctttaaatcaggggttatactcatcagaataatcctgcacacttttgcaaaatgtacatg

SEQ ID NO: 198196 - DNA, 422 bp, Homo sapiens
ctcaaatttctaatggatttgtcttagacacttattgccactccttagatagtcattgctatctttgaagttctggacgatacgtgtattacagaggaactggagacattccatcaccatagttagcttgattggataccctttaaaagcatatactcgcgcctgtaatcccagcactttgggaggccgaggcgggtggatcacttgaggtctggagtttgagacaagcctggccaacatggtgaaacctgtctgtactaaaaatacaaaaattagcctggcatggtaccacatgcctgtaatcccagctactcaggaggctgaggcaggagaattgcttgaacctgggaagtggaggttgcagtgaaccaagatcttgccattgcactccagcctgggtgacaagagcagaactccattaa

SEQ ID NO: 198197 - DNA, 567 bp, Homo sapiens
aggatgtggagtggctacctctaattatgtggtggagcttatagaaaaaaaaaaatgacaggcttcagattttaaattcttatctccaggaaatgtgaattaatcaggagtttctaagactgttgttaaaggaaaggagcagctccagttctacaaattacagtacagaagaaattaataactttgctggacctcttatctgaaagttaaggcaaagactgggacccaaagagttcaaatggaggagtttgggagaactagctgactccaagtacctaaatctctaaattccctgagccttgcttgctagcagaagcagtttctataatgacctcatcagagatagtcaccttgcagggtaatgctattttcccctaggttctaacccatcatccctcttcgcttccagaaccacagctagagtcagatcaaggactgtccttatggcattattacaaaattggatgcaacagaagcacatatttgaagaaaaaaaatggcaagatttgctaatgtgttatgctagttttctattgctgctgtaacaagttaccacaacctcagtgg

SEQ ID NO: 198198 - DNA, 676 bp, Homo sapiens
gggtggatagatagggtaggcaaagtctttggaagttttcttttgatgcttccattttctcattaaaggtaaagaagaggaggtgcaggtattggtgggcagatagatggtgtaggtaaagtctttgcaagttttcttctgatagttcaattttctcaggatgcaaggtcacctactgaaggtgaaagagaggtggtgctggagttcctaggataagggagaaagtaagaaacagtggtctaaatgaatggaagactaaattaaactaaggaaatgcagcattttaactactggtcagcattaaagggctagggaaatctagtaaagctactgtcagcataaaagggttcgttgtcacacatttcaagtaaaattagtcataaagattgttttttctcgacacgtttagttactgaggttcatgtgagaataagaagaaaggagtaagaaacaatgaaagggtagtatgacataaatggttcttaccatttattggtcggtggtgttggcaggattattaaaagtagaattctagagggagtaaagttgaaaagatagaaagcaataatcagagaatgaaatgtgtgaaaccgagaatgggataggttgtgtttgaaaaatatactattacctagctccctaaaagtttaccaaaaaaaaaaaaaaaaaaaaaaaa

SEQ ID NO: 198199 - DNA, 1138 bp, Homo sapiens
gccactgtactccagcgtggtgatacagcgagacaccgtttcaaaaaaaaaaaaagtgtgaatgaacgtggagggctgtatgggggcgggatgggctgggggtgcaggaagaagccctgagaaaggatagataggaggctagaggagcagtgcgcaggagagtggagctgctgacagaggtggatctgagcctcacccgggttgcggctcaggtctttctattaatccagttctgccagcacagtagtgccatgctctgtggaaacagccctggagccagcactgcctcctctcctcccgctgcccatctgcatcccagccactgtccctgaggcctcaagatgtgttgaaccttagggatgagtctgcagaatcctagaagttgggtgcctccttccctgccatcctgggctgggggcttgagaggcacctggttgtgagggctgggattagagtgcttccattgcgaaactgtggagcctggagagttaaaaaataaatgaagaagctctgaccacagagcaatttgagggctgaattatttagagcctctgctccctctggcttctcctggggaagggccaaaggaggaatgtggagccagggagggctgagcttccctggccaggcttgtgcactcaggggccctgggagtccacactgtcctgccatgtcctcagccgcttttgtccttgggtcacaaggcctctgtggtttcccgcagcccacagggcctgacagattcaggttgaggctgagaggagagaccctccctttcctctttgccccactcctggtctggcctcccctgatgctgcttggctccaggacatagcgataatgaatgacataaataagtcattctcattagcagcgggtgggtcactggcccaggagacaggacagcaacagcggaggtgggtgtggacagggctggtcaagtcccctggtctttctctcaggagccccagagggaggcttaatcctctttcagtctctccaggattatgttttcagcttgggggacttgatgaaaatccatgcttccagcagtcaagggggcccaggagaggggtgccagtagggtcccctaggaaggaattggggtgggacggccaggcgctgaggctgctccagg

SEQ ID NO: 198200 - DNA, 243 bp, Homo sapiens
ggtgtgcaccactacgctctatttttatcatagaataagccaaaggcagccttttataacactgtttagagctgagttagggataatgaaagctttaaattgggggtaattatgtacagtacatggcaaaggcataataatgagctcttacaagtcagtgatacctaggcaggacccccagtggagatgaagtttagctattatcagtttacttttaaaagtttaacatcactaaatgcagtc

SEQ ID NO: 198201 - DNA, 636 bp, Homo sapiens
aaactggcttggtgcaggtggagtggtggaaaacaaaccagagaggaatgtccattcccgtcccatggccacagggcctgcaacaaggcagctgggcagggaagcagagtctatgtgactccatcctggcctctgtgctttctcttgtgtccccagccagaaggaagtctttgtcgaggctttactttcttggtattcttaggaaaatgatggctactggagatgcttcttcaagtcagggtctcacatctcctcctgctggcctcaagtgctgccacttaaagaggtcttccggacacttttccaagttccggaggagccccagaagcagctctggggtcatgactcttgggtaacttttctcaggccaggcctgtgccctgggtcatgaagtcacagctggaggagtggtctgccacagcattgaggccagggccatagaggagagcaagggtatacacaggctcagtcccctaggcagcctgcctctgctctgggccctgcagcccatggtcttagcacttactccctgcctcatagcaccctggctccccactggccttatgggcagccacatctgatcccctccacctccttggctaggccctgactgccccaggtgtctgggcacttgct

SEQ ID NO: 198202 - DNA, 538 bp, Homo sapiens
ctaattttttgtattttcagtagagacagggtttcaccgtgttagccaggatggtcttgatctcctgacctcgtgatccgcctgcctcatgcctcccaaagtgctgggattataggcatgagccaccgcgcccggccacgtctggctaatatttttgtgttttcagtagagacaggatttcaccatgttagccaggctggtctcaaactcctgacctcaagtgatctgaccgcctcggcctcccaaagtgctgggattacaggtgtgagccaccatgtcccaccttgtatttactgtttataaaagaaaaaggaattttatttgtatcaactggctaattaatgcaaaatttgtttagtgattttgctaagctgaactcacactaataaaggtagttataaatatgtaatttatggaaacccattattttgttgctctttgagatccttcttgtttttcttgtttgcactaatacagattttaggctatctgaaaactgtcaggaaatgaaaagtcatgcagtgaatcataaaatgaa

SEQ ID NO: 198203 - DNA, 546 bp, Homo sapiens
gaaagagggaaaagcagaggaaatttttgaaagggagtgtgggggcaatcatagaaagagggacagaaggcaacaacggacaagaaactgaaaacatatagggaaagaaagggtccttcgtggatttgtcatttcacagatttacaactggaatccaccttttatcaaaatacgtgtgttgagagacatggcattgcatttcttactacatactgtgctaaaccctaggtgacctcttatttttggtaataaaagttataatttcagcaaataggttttatccattaactccatagcctccttgatataacctgagattaagttaaatttaaagtccaagtgagctcaaaggtgtaggtgaaggttgttgctattaggtctaactgaataatagctctctgcaaaatcccagccacataaaagcactgctctggcagtcatagcaaccttgccagctttggatgtgattgctgacagagagttcactgatttttccatggagaatcctgaagcttgctgttcgggttgacatttttacaactgtgt

SEQ ID NO: 198204 - DNA, 442 bp, Homo sapiens
cagaattcagttggtacagatgtttggctttattaataattatcaaaactggaacaatccaaacatccctcattctaactgtacaaacaaactgaaatactactcaggaatagaaacacactattgataaatgcagcaacatagatgaatctgaaatgcattatactaagtgaaagaagccaggctaaaaagactatgtattgaaccatttcatttatatgatattctggaaaaggcaaaatgaaaggaaccagaaaccagatcagcggttatgggggctttggggtaaaggaaaggagtaagtacagaggggcctcagggaatttggggaggttacggaactatgctttgattatagtggtggttacatgactggatgcatttgtcaaaactcatggaactatacactaaaaagggtatgctttaccttaaatctgatttt

SEQ ID NO: 198205 - DNA, 171 bp, Homo sapiens
gagttcgaggcaactacctctgacatagcggtggggggtggggatcgacacctcaagcattctaaagactggagcgctgggtctgaaattcaaaagtgccgcctccagagaagagtagaaaggagttggagtgtaccaatgcgaggcgagagaggacgctgggctgaaaca

SEQ ID NO: 198206 - DNA, 431 bp, Homo sapiens
cagagtcttgaccacagggagttcacaatttaacaggacagtgaagtgatacaataattaaaaccgagagggttttctcagccttagcagtgttgatgtctagggctggataattctttgttgtaggaggctgttctgcgcattgtaggatatttggtagtatctagtatcccaggcttcccctcactaaaggtcattaagcacgtgctctaccccacccaacagtcctgataataataataaaaataattactctagacattgcctaatagccctggagtaactgggagcaaaatcactccccagttgaaaattgactgcaatagtgtgataaggcctatgcacatgggacatgaatgacttcttgtgggggcagttctcaagctgagtcttgatagatgaggagaaatttgctggatagttaaggacag

SEQ ID NO: 198207 - DNA, 334 bp, Homo sapiens
atgcatgaatcttaggatatatacatataggtactttaggttgaaacgatcactggagatatttaaaaatatttttatcaaggtcaaagctactcccaaagtatagctaactgaaatgaatatccaagatcccattgtagggacggggggagctgtgttactgatgatttggcagcatcttaagaagactactaatggtggcatcactaccaatgaatttatttaagtgccagtatgtatctaaattacccagaaataactcctagcctcctctgaaagcaaaaggggtagacacgccctccatacctttccacaaatttccatctatctctcc

SEQ ID NO: 198208 - DNA, 293 bp, Homo sapiens
atatcatttgctttaaatattttttcatcaaaactttggcatgacagattaaagcattcaaattatggaacacatctgtcatataaccaaataggcaaaggtgtgtttcactatcaaaccatttaggtaagttagaattactttctctcagacaaatctgatctcatttatcaattcatgtaaatgtgttaagacacactccctgatatctcacttcttaatgttactttagaatagacagatcacagagccttactaggagttattgcctaaataaaatacagttccactgc

SEQ ID NO: 198209 - DNA, 4093 bp, Homo sapiens
  misc_feature (15)..(16): n is a, c, g, or t
ccagcgcctgtccgnnattgcctgccgcctccgtgggaaggggacacaggtccctgcggatgtgatggcccagctatggctgtcctgcttcctccttcctgccctcgtggtgtctgtggcagccaacgtggccccgaagttcctagccaacatgacgtcagtgatcctgcctgaggacctgcctgtgggtgcccaggccttctggttggtagcggaagaccaggacaatgaccctctgacctatgggatgagcggccccaatgcctacttcttcgctgtcactccgaaaactggggaagtgaagctggccagcgctctggactacgagacactctacacattcaaagtcaccatctccgtgagcgacccctacatccaggtgcagagggagatgctggtgattgtggaagatagaaacgacaacgcacccgttttccagaacaccgctttctccaccagcatcaacgagaccctgcccgtgggcagtgtggtgttctccgtgctggccgtggataaagacatggggtctgcaggcatggtcgtgtactccatagagaaggtcatccctagcactggggacagcgagcatctcttccggatcctggccaatggctccatcgtcctcaatggcagcctcagctacaacaacaagagcgctttctaccagctggagctgaaggcctgtgacttgggcggcatgtaccacaacaccttcaccatccagtgctccctgcctgtcttcctgtccatctccgtggtggaccagcctgaccttgacccccagtttgtcagggagttttactcggcctctgtggctgaggatgcagccaagggaacctcggtgctgacggtggaggctgtggatggcgacaaaggcatcaatgaccctgtgatctacagcatctcctactccacgcggcccggctggtttgacatcggggcagatggggtgatcagggtcaacggctccctggaccgtgagcagctgctggaggcggatgaggaggtgcagctgcaggtcacggccaccgagacacacctcaacatctacgggcaggaggccaaggtgagcatctgggtgacagtgagagtgatggacgtcaatgaccacaaacctgagttttacaactgcagcctcccagcctgcaccttcacccccgaagaggcccaagtgaacttcactggctacgtggacgagcatgcctccccccgcatccccatcgatgacctcaccatggtggtctacgacccggacaagggcagcaatggcaccttcctgttgtcgctggggggccccgatgcagaagccttcagcgtctccccggagcgggcagcgggctcagcctccgttcaggtgctggtgagagtatccgcgctggtggactacgagaggcagacggcgatggcggtgcaggttgtggccacagactccgtcagccagaacttctccgtcgccatggtgaccatccaccttagagacattaatgaccacaggcccacgtttccccagagcttgtacgtcctcacggtgccagagcacagcgccaccggctctgtggtcaccgacagcatccacgccacggacccagacacgggcgcgtggggccaaattacctacagcctgctcccaggaaatggggcagacctcttccaagtggatcccgtctcagggacggtgacggtgaggaacggtgagctgctggaccgggagagccaggccgtgtactacctgacgctgcaggccacagatggcgggaacctgtcctcctccaccacactgcagatccacctgctggacatcaacgacaatgcacccgtggttagcggctcctacaacatcttcgtccaggaggaggagggcaatgtctccgtgaccatccaggcccacgacaatgatgagccgggcaccaacaacagccgtctgctcttcaacctgctgcctggcccctacagccacaacttctccttggaccctgacacagggctcctcagaaacctggggcccctggacagagaggccatcgaccccgccctggagggccgcattgtgctgacagtgcttgtgtctgactgcggcgagcctgtcctcggcaccaaagtcaatgtcaccatcactgtggaggacatcaatgataacctgcccatcttcaatcagtccagctacaactttacggtgaaggaggaggatccaggagtgctagtgggcgtggtgaaggcctgggacgcggaccagacggaagccaacaaccgcatcagcttcagcctgtcggggagtggtgccaactacttcatgatccgaggcttggtgctgggggctgggtgggctgagggctacctccggctgcccccggacgtgagcctggattacgagacacagcccgtcttcaacttgacagtgagtgctgagaacccagacccccaggggggtgagaccatagtagacgtctgcgtgaatgtgaaagacgtgaacgacaatccccccaccctggatgtagcctcactccggggcatccgtgtggctgagaatggctcacagcacggccaggtggctgtggtggttgcctcggatgtggacaccagtgcccagctggagatacagcttgtgaacattctctgcaccaaggccggggtcgatgtgggcagcctatgctggggctggttctcagtggcggccaacggctctgtgtacatcaaccagagcaaagccatcgactacgaggcctgtgacctggtcacgctggttgtgcgggcctgtgacctagccacggaccccggcttccaggcctacagcaacaatggaagcctcctcattaccattgaggacgtgaatgacaatgcaccctattttctgcctgagaataagacttttgtgatcatccctgaactcgtgctgcccaaccgggaggtggcttctgtccgggccagagacgatgattcagggaacaatggcgtcatcctgttctccatcctccgagtagacttcatctctaaggacggggccaccatccctttccagggtgtcttctcgatcttcacctcctccgaggccgacgtgttcgctgggagcattcagccggtgaccagcctcgactccactctccaaggcacctaccaagtgacagtccaggccagggacagaccttccttgggtcctttcctggaagccaccaccaccctgaatctcttcaccgtggaccagagttaccgctcgcggctgcagttctccacaccgaaggaggaggtgggcgccaacagacaggcgattaatgcggctcttacccaggcaaccaggactacagtatacattgtggacattcaggacatagattctgcagctcgggcccgacctcactcctacctcgatgcctactttgtcttccccaatgggtcagccctgacccttgatgagctgagtgtgatgatccggaatgatcaggactcgctgatgcagctgctgcagctggggctggtggtgctgggctcccaggagagccaggagtcagacctgtcgaaacagctcatcagtgtcatcataggattgggagtggctttgctgctggtccttgtgatcatgaccatggccttcgtgtgtgtgcggaagagctacaaccggaagcttcaagctatgaaggctgccaaggaggccaggaagacagcagcaggggtgatgccctcagcccctgccatcccagggactaacatgtacaacactgagcgagccaaccccatgctgaacctccccaacaaagacctgggcttggagtacctctctccctccaatgacctggactctgtcagcgtcaactccctggacgacaactctgtggatgtggacaagaacagtcaggaaatcaaggagcacaggccaccacacacaccaccagagccagatccagagcccctgagcgtggtcctgttaggacggcaggcaggcgcaagtggacagctggaggggccatcctacaccaacgctggcctggacaccacggacctgtgacaggggcccccactcttctggaccccttgaagaggccctaccacaccctaactgcacctgtctccctggagatgaaaatatatgacgctgccctgc

SEQ ID NO: 198210 - DNA, 690 bp, Homo sapiens
  misc_feature (15)..(16): n is a, c, g, or t
ccagcgcctgtccgnnattgcctgccgcctccgtgggaaggggacacaggtccctgcggatgtgatggcccagctatggctgtcctgcttcctccttcctgccctcgtggtgtctgtggcagccaacgtggccccgaagttcctagccaacatgacgtcagtgatcctgcctgaggacctgcctgtgggtgcccaggccttctggttggtagcggaagaccaggacaatgaccctctgacctatgggatgagcggccccaatgcctacttcttcgctgtcactccgaaaactggggaagtgaagctggccagcgctctggactacgagacactctacacattcaaagtcaccatctccgtgagcgacccctacatccaggtgcagagggagatgctggtgattgtggaagatagaaacgacaacgcacccgttttccagaacaccgctttctccaccagcatcaacgaggtgacacctgccttaatgtggttgtggggcagggggcatcccaaagtgcttctcagagtaggaagagccagagacagtcagtggggcattcagagttgggaaaaacctctcctagcaggggcagcttcaagaaccaaagccagggggatgtaaccccacaaactggttacagcaatattttgcaatcagtcaggttaggaattctttcagtgatgaaagca

SEQ ID NO: 198211 - DNA, 683 bp, Homo sapiens
aatgcagaatcagagatgaacctggaagggttccgactggtgggtgtcccgatagatggaaatgcttcccaaggctggttcaggtgagaggcaccagaggagcaaaggttcagccactggaacatacacaggtgtttccatttgcctggacagtggggcatgtggggaagcagagggaagcaggtctggaaaagtgaggagggtcttgcacatcagctgaccggaatggatggatttggtctgtggaaacagactttattggacagtgacttaatcacatgtgttcttccctgactctgggatggctctagttttaagcagtaaggcagacaaggtttgccttgggaagccctccctacaatcccgtctaccagattcctggcgtcctcctgtccccaaagccctcagcctgagtaggccccctcctgggagatgctcagtgaatatcaaatgagggaatgaacgaatgctcccgacatgtaagaccctcatccgcatatcaaaactaacccgtccagtgtcccatcccttcaggactctgctagaaaagagccagattatctactcacttgttctcatgaaggcattatggcaagttaaaggtaacccccccaggtaaaggtaactgcgtttgtaaattgatgatctggagaagatcttaacacatgggattctgatggtgg

SEQ ID NO: 198212 - DNA, 145 bp, Homo sapiens
acttggtggcttaaacagcagaaatttattctttcacagttctagagtccagaaatctgaaatcagtatcacacttcgtccagaggatgtctgcctgtgtcttcacattgccttcttttctgtctatagccaaatctgtccctgt

SEQ ID NO: 198213 - DNA, 674 bp, Homo sapiens
cttacttaatactagaagctgagcaatgaagaaagctgcatgacagacagatttattctggtgccatcaaagctgcaatataggtgaaaatccaatggaatgggctttggctattgagagaagaaagcagctgataactgagacaggcaaactttctgcaactgacaataaaggaaaagaatgtgacatgcatggacatgcataatacaaaactacagatactaccttcctagggatgtttggtctaaattaatttgaagtctaaagtagagaccacccaactggtgccactgggaagtggtttagcaattgtggaaaatccagagtatataattctacaggtagacagcttagaattgagtgaagagattcagcatcacctttgattttattatttctccaatgccagcagaaaagcacatctttgattttttaaatacaaatttttatcaaaaaacagcattcaaccccaattcagtctacttgacaacacagtttgaagttcttgatggcatatatttggcttcatttttaggtattctaatttaagacagtattggtttgcaaataaactcaaatactttgggggggattatggaaaagttttactcaattccagataccaaaggtcttggaggacactttgaaacaatttagcacgcctctactgtgcc

SEQ ID NO: 198214 - DNA, 305 bp, Homo sapiens
agcaacatactgtacatgagaattaaaacactagtttatggctataaactttaaaaatgatagtactgagaagggcattagaagaaagtggccaaatcagaaatctggaactgtgtcttccaaatttcagtcgttacatataatcatctttagatttctgttaattccttgtacctaatttctatatttttttgcccttgaaatttgacttgtttaaacaaaaacaaatagaaaggaaacactcaacactgaataaaatgttttaaaatttttgctacatagtgtttccagctaaagattatata

SEQ ID NO: 198215 - DNA, 176 bp, Homo sapiens
cgatactaaggagcaagccaagagattttttttttcccctgctaacttgctcatgattggtcttttgtggatatgtttacattggtgaataaagtcaaagtactttattcattttgcttcagtagtgtttttcatactgtggttgggctatattattgggtaatgaaatcaattta

SEQ ID NO: 198216 - DNA, 215 bp, Homo sapiens
tgtcttcacagtttatgcatttatccaacaaatttaagcatgtttgtgctatggactaactttatagatattatagttgagttttgtgatcaagtttggaaaacacatttaactagtggtcttctcaaaagcctttaatatactcctaacagaaatgaagtgtttctcgtattttttgaccagtaatccctgttcttcatgaagttttttttttt

SEQ ID NO: 198217 - DNA, 572 bp, Homo sapiens
taaggaatcagccaattcatatggtaatattattctacttcatgaatgactatgttcacgcagcataggaagattcagaattgaaaagatctataggcatttagagaatatgggaggaaatgaagaaagagagaagtcagcactatcacaaggtccatgtagggagaaggaatccaggtgcccacaaagagagaatcctggacaggaatttgaggttttgccatctccatcaagctacaccatcacctgggctttacttgtctcatttgaacaacaaatttgtttaactgaatggtctgtaggtctttcagctgtaatagagctggtatttcctgattcaaacagcaggcagatagagagcttaagagaaaaccaccccaggttttatctacaagggccaattaaagacaaattagagtcgtagaaagtctttcaccccttccgaagtactctgaacatttccacactcttgagactcttgatatatatagtctggaagtgactgaaggtttaaacctttatttgctgttaacacatactgcctaagaaataaaatgatccctaagtatgat

SEQ ID NO: 198218 - DNA, 423 bp, Homo sapiens
tcagattgccaactataagaacctaagaagtaagctccatttgcctttttatttttgtattcaatacccaagggagaggagaaagagaagatgataaagaggggaaggaagagaaagagaaggagaaggaggagaaaagaaaagctatgtttctacatcagaactcatcctaaatcagtctgaatgtcttctcttacttttgctaatattcattaacaacattccaaagcatactatgatcagcaacaaggcaagaataattaatacttcattattttatttaatactggcattttccaatataatttcaggccaagaagtattagtacataaagaatggaaagtactagtacataaagaatggattacatgctttcatataccatagcaaaggacaggctttcataaagattttgtgtgtat

SEQ ID NO: 198219 - DNA, 371 bp, Homo sapiens
gttctaggggctcagtaggatgcctgtggctgttgccatcctagcctccacatgtggccatgggggttctcgaccattactgttgcctggggtgctatccagcagccatgggagtgggaggtgggggctgcagtaagacagggagaaaagaaaagagaaaatagcctttgtttcatccttctcgtttgccagtcacatgactgttggccagtttacagtttgttcaactggaatgggaaaaaattacacagaacttggtttctgtctgaggatggcacttaaaacacacatgactgcttacaaatctagaaatggacacgggagcctgaagtaccggcaactgtgccaagcccctcctttcctctgttgta

SEQ ID NO: 198220 - DNA, 513 bp, Homo sapiens
cagccatggcaaaaccccatctctactaaaaatacaaaaattagccaggcatggtagcgggtgcctgtatctcagctactcgggaggctgaggcaggagaatctcttgaacccaggaggtggtggttgcagtgagccaagatcgcaccactgcactccagcctcggctacagagtgagactgtctcaaaataaataaatagattaattaattaattaatttgcactggagtcaaggaacctcttggaaagaaaaaacaaattgagaactaactcttccattctgagactccatgctaccaggacttctattcaggaggtcccctgactgaatctgatgacagaacaagaccctgttccagagaggagctcacccaaagggaagggtcactaggaaagcagagcagggtccaggggcttggcaggaggtggaggaggagggtggtggtcagttctggtatcttccagggccctgcagggcagcctctctggactggaagcagcccacaaaagca

SEQ ID NO: 198221 - DNA, 398 bp, Homo sapiens
ttatttattttgagacaaggcttgttctatcacccagagtagagtgcagtagcatgaacatggcttactgcagcctcaacccagtggactcaaggcatcctcctacctcagccttccatgtagctgggaccacaggtgtgtgccatcatgcccaggtaattttttgatttttgtataaatgaggtcttactttgttgcctaggctggtcttgaactcctgaactcatgtgatcctcccgccttggtctcccaaagtgttgggattatagacatgagccactgtgcctggctggagctgtgttttaataaaactttatttacaacaacaggcagaaggccagatttggcctgtaagtcatggcttattgacccattttctagggcagcttccactaact

SEQ ID NO: 198222 - DNA, 768 bp, Homo sapiens
ctttatatcacactctctcttatgggaaccatgtgctttacccaaagtggactattcctcatttctaggtacatttggaattttctgtatactcacttaagttactctcttctcatgaatacctgttagtctccatattctcccagggaaaactctttccattttataaccagtaaaacatcatgactcttcacggtctccttcaacaagggaaaaaggcaaagatttttttccaattccaataacactatgatgtacctttctagcacctcttacaatattcttgcttttactatcatcgtatttatgtaggatacttacctttatttatctattaaatttgaagccaggtcttgttaattcgatgattctcagcaggcacagtgtgatactcttaaagaccctcctaggaactttttaaaaaacatttactcactagcaacgctatagttctctacttcctaagaaagtatgctgttttgaggctgttagatatcattagctacacaaatggtgatcttcagtataatcagagacaattctgccactcttaagtatgtagagttagtttttttaaattttagtgcaatattaattacacgcttaaaaattatcatgtacttcttttagaaaacagaaaataccactaccagtttctgccatttcaagaatggaaaatgctcacattaggaaacacaaaccacaactcagtcctctaatggcccttaagcaacttttaaatgtgggcaaatacaccattcatgctta

SEQ ID NO: 198223 - DNA, 504 bp, Homo sapiens
ccaccccacccccccataactgggactacaggtgtgcgtcaccacacctggataatttttgtatatttgtagatatggagtctcaccatgttgcccaggttggtctggaactcttgatctcaagcaatccacctgccttggcctcccaagggtgctgccaatgcacccagcatgttgctgattttctttgagacatagtggcaaagaaaattttctcagctctgtcttaccaccgtgaaagactgccttcagagtgtttcagttacctcttcccatcaatatgagaaaagatgagtgtgaggaataggtagagggaaaaattaaagttttttgtgtagcatgaattatgggaggggattatataggtaattctagcatgcacatagctcttgtataggcattgtgccagtaggtaggtattagagtagacatggttctttgtagtagccttttataaaattgacttgctttggtgaaacagctcctggcatcattcagacattt

SEQ ID NO: 198224 - DNA, 404 bp, Homo sapiens
cttgggggtcttctctatcattctgctgctgggggcttgggagagaaagctccccctccatattccccaccccaactgctcagccctcacctggcacagagaggcttcaggtactctcagacccagctactcaataattgcctctgtgagtgttcagccagttctaggaggtcttaagctgctaactggtagtcccctagaaaagggacctagaggttctctcaagtcctgtgaaattttcccatcttcctaaaaatccccatctcacagtgctgcttgagaaaggttgaacctagattggcacccagcaggtgcccagtcaatgttggatcctttctttgccttgtctgtgactgtccctctgtcagcctaagaatgtggttccttttagttaaagagattct

SEQ ID NO: 198225 - DNA, 445 bp, Homo sapiens
cagcttcatgtatattcatacttatcagatagggtcaacgcctcttagtttggtttgaaatctcactgggaaatgtacttcttcctttgatagatttatcaggtgatatagtccaaccattcctgaaacaatacatgaaaaaaaatgttaatagttacctattaactataaatataactaaaaatagttaatagttaatactgaccttgaggtatatattgtctgtttcataataacaacaggcaaaattgcaaaacacattattaaagggatgatttgtgggttcatagattaagtatctgtaaataccacagccctacatgtgtttactaaatacaagccatgtaaggataaccttcctttgacagggagatgtgacagggactggggctccagcaaagactttccacgtttttaatgtctttctgggtagctttaggggcat

SEQ ID NO: 198226 - DNA, 454 bp, Homo sapiens
aagtgaattataattgcctgccacaggactgtgtggcgctgcctgtgacagcagcaaatggggaaaataggaaggcattagagaaggtctgttgtactgatgaagtggaattcctagaacacactgtgctataaaatgagatttggctccacagtgctgggagcaaacaatggactcaatagtacccggccttggttgctgggcatattctagctcctttagtcagagcagcctttcattcaaaggagcaggagccacactagagaatgggaaagagggggtggattcctggtccagagaaatcctgagagtgagatgttaggggggaaaaaaccaacatcctttcaaccaggatgaatagtaccatgataagatagcttctcacactccatacgatacagcaaccatgtataccattttttaaaataagtaattatagaaatgactgataaaa

SEQ ID NO: 198227 - DNA, 305 bp, Homo sapiens
tgtaacatttgtattggtgccttaccaataagaattattttgtctgacatgtggacataggctcttatttacaggactttttcacaggttgaaaattgctaagtaactacccttactttttaaaagttgaaaattttcctgactcttcaagagcttccctgaatattttagaaaaagataatataaataaaaacacacatttcataattaaatacaaaccttttgtgtcagctctaaaaactatcagttgactggttggggggaaggaaatttagcataaaggaaatgaaggagcagcaaaaaaa

SEQ ID NO: 198228 - DNA, 883 bp, Homo sapiens
tcacatcaataaatatatgataggatattttacatttgatgtatcctgaagattaattcaacaaatgtttagtgagtaggcttgttgtaggtgctgggaattcagcagtgaacaaaacaaagtctctgcctcatggagctcatattatagtagggaagactgtcaataagcaatatacacattactaaatgatagataatgcccagtaatgtggcaagttttatggaaaaataaatcaggataaaaggataagagtgatatggggattctcttagttagggtagataaggaaggcctcttagctaaggaggcacataaatatctgatcatttaatgagagaaggagcaacatggatttctagagggaaactatcctagaagagaagcagcaagtgcagtgaccctgaaatggggatttgtttggcatggagaaagggcaagaccagtgtggctggagcacagcaaatgagagaaattagatggaaatcaaggcagatcatgtatcatctggtaaggtttggattttattgggaagtgacagaatatgacgaagggttgagagcaaaggagtagctttgctgtaaaaggatcactgtgggctgggagcggtggctcacacctgtaatcccatcactttgggaggccgaggcaggcggatcacttgaggttagaagttcgagaccagcctggtcaacatggtgaaacctcatctctactaaaaatacaaaaaaaattagctgggcattgtgacgggcgcctgtaatcccagctactcgggaggctgaggtaggagaatcacttgaacctgggaggtggaggttgcagtgagccaagattgtgccactacactcaagcctgggcaacagagtgaaactgcatctca

SEQ ID NO: 198229 - DNA, 330 bp, Homo sapiens
aaacagcagctgtacatattataacttggaaagcgtaagaccttccaggtgttggagtgttgggacgcttaggaggcattcttgctgcccagcgctgtggaggttgcaggaggctttgcattcccttccacttagggtggctggccgcgcagattcctttagtgtagcctgctccgaacttgccgctctccgcggccgtcgacagcactgcgaccagaaaaccaaacctttttgtcctaactttttttttttttccaacgtggtgtttaagaacaccgcttcacccccgagaactcattaattgaggtgtttcagtggttaacagcaaga

SEQ ID NO: 198230 - DNA, 330 bp, Homo sapiens
tagaacaatataatgacctccgcaccatatcaggatagctacaaaaagcctgcattttctaagccctgaagttctaagccatgttatatttgtgcataaagaaattcaactggagtttttattggaattaggataaatattcaaatcaatttgggtaggactgtcatcttttacaatgtcttcatattgatgactatagaatatattactccatttaatcaagtcgtttatgtcaataaaatcttacagttttcttcatgtaacttctacatatttctaattaagaatattcctacagattttatctggctattttgttattgttattgc

SEQ ID NO: 198231 - DNA, 105 bp, Homo sapiens
tggccctgcactctgtttattaaatgcctacaaattattaaaaaccacagatgcttataatatttactattttttacgtgcaagaaaagggatggtaaaaatttg

SEQ ID NO: 198232 - DNA, 476 bp, Homo sapiens
ccaatcccttccaatagtgttctttttcaggtttcatttctgacaccatttattccaaccgaaataacaaacatttggagaggaggtggtgtaaattattcaactcggaaaatataaatgcaaacatactaaataaattcattgggaaattagtccagttgatatatgtggtcatgaatataaatgaagaccatgcctcatggttgttggttttgtcccagccatgttcccttattctgtaggcatggaacagggagacggttgccttcatctcatacatgtttgcagaaagaaagtgggccaagggagtgaggtagtgcaggggagagatgataattaaccacggaatctgcactaggtaaagaaacatgcaagagcatgtcaggggtggtggctgtaaaaaaatgatagcgtcaataaactggaagaccttatcatatctgaagaaatattggggttattgaaaaggtgaactg

SEQ ID NO: 198233 - DNA, 579 bp, Homo sapiens
ctatttcccagtgattctcaaacttgggtaaaggaaaaggattattgggtgggattacaagcatgagccaccgcacccggcctctgagggctttttctattacacatatttgacaggggcacaaatatataaaaatatacataaatgactaaagagggagaaaatctggaagaatgcacattcataatttacgacagcacagcttcgtgtctaacactgctttctttctctctgtgagcctctcaaatggtggccatgggtaggggtggagtctggcaggaagagttcagcagcgggggagagggaaagtgaaatggaggcaggactgaatcacccgatgtctgctctgtagggctctgagtgaccattcacggctctcagaggctggtgctggttgtgaccagtgaaggacatgaaaaaacacagacagggccctgaatttccactgagctcacttgaagggactggccttaattctttcccactctccccggggtgatggcagaatggcgaggatgggaaggtagttgtttttctgacatccttatttggcaaaataaaaatctgacaattgtgtgg

SEQ ID NO: 198234 - DNA, 276 bp, Homo sapiens
aaagcattttatcaactatgaagcaataaacaaatgtacgttttgtttatagatttcttacattggtttttcggaaacgaatttcttgtagcactttgggaggctgaggcaggtggatcacatgaaaccagcctgggcaacatggcaaaaccctgtctctacaaaaaacacaaacattaggcatggcgatgtgtacctgtagtcctagcctcttgggaggctgagctgggaaatggaggttgcagttagctgagattgtgctactgtactccagcc

SEQ ID NO: 198235 - DNA, 413 bp, Homo sapiens
tatctcacatctgttctatagaagtcattagaaaaaaactgtttccatcaaccagtaggcatttaccaagttgttctgcaaggtacttggtggtggtagtgtatacaaatgaatataaaatgagatcctttcctgaagttaggtaaagaagattcgtgtacatgacagaaaattagagactggcttttaaataaaataggagataagagaaagatgattgtgaattggtgtggttacagaagtttcaacaaagtagaactatctttaaggataggtaaaatttaggcatggagaagggaacaagatgaatagaggcatgaaaattagagtgtgctttgtaaataagtgaacaagagttttcacatgttggtattgtctatgaggaataaaagtcggttcaaatatacagtgta

SEQ ID NO: 198236 - DNA, 359 bp, Homo sapiens
agtcagagaaatgcagttagttctgaaccatgatgagatacctttattcacttatcaggcagacaaaaatctgtatgaaattatgtgtaggaaactcagtcatgctctttggcaaatttacatcacatcttaagtgattgtcactcagttcaaaaaagtcttaattaatgggtgtaacctttcctctctggtttaaaaaggtcagaaaaccatcacctgtatttattgaaaataagtagctcattcttgaaaagtacatctggatgatgagaagtagaaagaacagcaaattaaccactgcttccagcttctgattttttcttttacttgactcttcacagttgtgagtcatctacttt

SEQ ID NO: 198237 - DNA, 314 bp, Homo sapiens
ttctagaacattctagaaaaatattggtgaggctacagggcctgggtgatacctatgaagagtactcactcaaaggcaaagttggactaattcaccatatctcacctggggctacaactagaacattttattgttattgattttatgtttttgtttctgcatgaagctgctacacagagaagtgattctcacattggagagcactgactcccagaattttaccatgttactaagatgtttttaacatgatctacatggatgctgtttctttgccttccgaggctgattttactttggctttgggttaacttcca

SEQ ID NO: 198238 - DNA, 281 bp, Homo sapiens
tataattttagatattgttaagtgctatgaagaaaataaggcagaatttgtaaagccagccagaacattccagagatagtaggactgctgcaaatagaagagtgtaaatctaaaccctgtaaagcctgtgactagaagagtgaaaatcacttaataggaagcagctgtgtgttccatgctgttcctcatctgctgtgaacatctgggccgattcctaagacatacaacacttggacatgccatccaacatgcaatctttatttctcagcagagtttctggc

SEQ ID NO: 198239 - DNA, 112 bp, Homo sapiens
catcataaagcacctgcagtgtgccaggacccactctgacaactgtgataaaataaataaagccaactgtgataattgctagttagggtgcccaaagctaaggctggtcact

SEQ ID NO: 198240 - DNA, 576 bp, Homo sapiens
tggatggatcacctgaggtcaggagttcgagaccaacctgaccaacatggtgaaaccctgtctctgctaaaaatacaacaattagcctggcgtggtggcaggcacctgtaatcccagctacttgggaggctgaggcaggagaatcacttgaacccagggagaggcggggtgaaggctgcagtcagccaagattgcaccactgccctccagcctgggctacagagtgagattctgtctcaaagaaaacaaacaaacaaacaaaaatgtttttaataaaatgatttctgcccaaaggggaacgatcatggaaatttaaagctaactccatttggctgcttttaaattacaagagataatctcccatactttttttttttcagtgaagaaaaaaaatatccaaatctcctttggatagcagataaattaaaattataaaacctgaactgcggcttttaccagtggccagttgccatcaggaaagaaaattatccactgaataatgagggagaaaaaaacctacaaaattttgcatgtgtgatcactaaacaggttttgcacatgaccagcaaaagtagg

SEQ ID NO: 198241 - DNA, 447 bp, Homo sapiens
agtaatgtcactagcataagcagatgccagcaaaatgtatcatatcagtcacacataagtaaattgctataggacccaagaagtaaattgtgatgaaaatttccttctgagggaaatatgatctcaaatgacatgttttttagtgttcaacttttattttagatgcagggggcacatgtacaagcttgttacatgggtatattgtacccaggtagtgagcatagtacctaatagtagttttcaagttacattttatatttgtaagtagaatatttgattttattttgtgacttctactttatagaatagttttagatttatagaaaaattgtgaagacagtagagagaatttccatgaaccccatactccatgctgattgtttcctttgctgtgcagaagcttttatacttgatgtcatcccttttgttcatttttgctttggttac

SEQ ID NO: 198242 - DNA, 561 bp, Homo sapiens
tccttaccaagatattcaagcccctccacgatcattctccaatttgccttattaacctcatgttcccactcgagccctagaagttaaccagaaatttacttactttcccactcaccaccacccctgaacctggactcatttttctgcaactatagatctgctgatatgatttccatgtctgtaatgccatttaattattcattcatttaataaacactttcaaattcccaactatatgccaaactctgtattaagcccctactatgtatcaaacacttgagctacaaaggtaaggcatatatcatctatgcccttaaaaacctcacaatcttttgtatttttttttgagatggagtctcactctgtcgccatgctggaatgcagtggcgcgatctcggctcactgcaacctctgactccctggttcaagcgattctcctgcctcagcctcccgagtagctgggattacaggcacacaccaccatgcccagctaaccaaggcaggcggatcaccaggtcaggagatcgagaccatcctggccaacatggggaaatcccctct

SEQ ID NO: 198243 - DNA, 403 bp, Homo sapiens
taaaaaagcttgctgaacaccaccctcagtgtttgattcaagaggccagaggtagggcctcagcacttgcatttctagcaagtttctagatgatagtgatgctacaattccgtcactactctgaaaaccactgaaagcccctggagcttactggaacgtgtgcgtgaacagtgtgaatgagttaccccctcacactatagcaagactatggtggaattcactgagaggcaaactgcaaaatctcagggagagattctgtacccaaatgttgacttccattacctgagtgaatgtattttgaactgtcactttcaaaatgttttatctgaacagcagcacagcagcaaaagactctgaacaaggtcaaggatgagcggcacagtgcataactcacacttcaaca

SEQ ID NO: 198244 - DNA, 1188 bp, Homo sapiens
ttcatgctggctgccatttctgagagtaaattgtgtctcaggaacttcacatgcatcatcttccattctcacaactgtcctaagaaatagatttgattcctaatgtgcagatgagtggttgagactcagtgagacaacacaccttctccaggatcccacggtaaatacgtggtagagctcagatgctatcacaaagcccagtaaggcaggaaagcaggaggcataaaagggaggacatctggggctcaatagaagtggggaaccccaagagggcccatcaacccctcccagcagcaggaaagatggttttcagaacccaagtccattcattctctttcctgtgctccttcccacggctttcagctcaaagacacaattggctctttaagaccaagagggagcaatactctcattaaaaacactcacttttcctctagctcatggccctccacatgacttctctagctcatggccctccagacagaacaaaggggtcccaaaatgcctagcgtggaatcacagaatggcccaggcttgaaccatctctattcccagagatagtcacagagatgcacgctatgggacagtcttggcagggtctttgaggaggaagtggattcagcaggatgatggggctggcatcgtggatgccagcaacgtggatgcctgttggtggtgtgctgatgctacacacatgcattcacacatatatgcagacacatgtacacacacatgcacacacacactaaaaacacccacagacatgcatgcttttacatttatttatgataggtgtgccccagagaggagtatcttttaccagttgctctggttgtttctgaattctggaagagtctggacagagaaattcccagcatatcctgcatctcattcttggtgtgaagcaggaacacgcactcattcctatttggctatagtcttcacagctttctactgtttcttttaaaagaaggaaactaaaataatataattcaatgttgtccagtcagctttgattactgtcggtccctgtgtgtgaagtgctgtgctggcttgaacgggacatgcaaaaatcaagaaggcaaggtccagtccttaaagccctagagcaagggttgacaaaccacagtacttgggctaaacccagcccaccacctgtttttgcaaataaagttttattggaacaca

SEQ ID NO: 198245 - DNA, 481 bp, Homo sapiens
atagctggtaaagcactctttctgggtgtgtctgtaagagtgtttctggaagagattagcatttgcatgggtagactgagtaaagaagacctgttctcaccaagtaagtgggcatcatccaatccactgagagcccagattgaacaaaaacacaagagaaattcccagcatatcctgcatctcattcttggtgtgaagcaggaacacgcactcattcctatttggctatagtcttcacagctttctactgtttcttttaaaagaaggaaactaaaataatataattcaatgttgtccagtcagctttgattactgtcggtccctgtgtgtgaagtgctgtgctggcttgaacgggacatgcaaaaatcaagaaggcaaggtccagtccttaaagccctagagcaagggttgacaaaccacagtacttgggctaaacccagcccaccacctgtttttgcaaataaagttttattggaacaca

SEQ ID NO: 198246 - DNA, 460 bp, Homo sapiens
agttaaaatatcccttatgggaaacgaagggatgggccaaattaaaggaataggttgggccagttaactgcagcaggaacatgcccttaagacacagatcactcatgctattgtttgtggcttaagaatgcctttaagtggttttccaccctgggcgggccaggtgttccttgccctcattcccataaacccacaaccttccagcttgggtgctaagggcattatgaacatgttatggtgctgcagagattttgtttatggccagtctcagggccagtttatgaccagattttgggggacttgctcccaacagtctccttctggaggatgactgggtagcagcccagggtagttttacagtttcgtgttttacaccagtgctgggcaccctgggtagttacttgattataattccttaaacagagttttccaaattaaaatattacctgttttttataga

SEQ ID NO: 198247 - DNA, 424 bp, Homo sapiens
gcaactgggaataattgaaattttctgccattagctattcccagcagagtattctgagtcacatagaaagtgtcagaagcatataaattactgatacattttttaatcccatattccctcagggttggcgtttttctctcttgaaagtttcccccttaaggctgggcgtggtggcttacgcctgtaatcccagcactttgggaggccgaggcaggcagatcaagaagtcaggagatccagaccatcctggttaatacggtgaaaccctgtctctactaaaaatacaaaaaattagccacgcgtggtggcgggcgcctgtagtcccagctactagggaggctgaggcaggagaatggcgtgaacccgggaggcggagcttgcagcgagctgagatctcgccactgcactccagcctgggcgacag

SEQ ID NO: 198248 - DNA, 431 bp, Homo sapiens
ctcaggaccagaagtataattcatgagtgaattatactaaaaatttaaagaagaattaatgtcaatccttttcaaactcttccaaaaatttgaagtggaggtaacaccttcaaactcctttcatgggaccagcattatccttacaccaaagacagataaggacaccgcaagaaaaaaaattagagaccaatatccctgatgaacattgatgcaacaatcctcaacaaaatactagcaaatctaatccagtgccacattaaaaggagtatataccccataatcaagtgggatttattcctgggatgtaagcatggttcaacatatggaaatccaaaaatgtcattctccacattaacagaacgaaaggccaaaaccatatgattatctcagtaaaagataaaatgttcaacaaagttcaatatcctttcaag

SEQ ID NO: 198249 - DNA, 276 bp, Homo sapiens
cagggtgtctagggcctgcgctgcacaacatcagtctttgaacttggtattttggggactttctgaatccaaggctgttgaggaacatggaagagttcttatcaaaggtggttgactaagccaagtgtcttcccaacattcactttggtgtctccacgtgtagcagagaaaggaagaccagcaaattgtgatgtagcaaaaattttttttaaaacaccgtgggttgaacttctcataccttcttaacttcccaaagccccttttctgtctctgtta

SEQ ID NO: 198250 - DNA, 518 bp, Homo sapiens
cagtggcttacggctgtaatcccagcactttgggaggcccagacaggcagatctcctgaggtcaggagttcgagaccactccggccaacgtggtgagacctccgtctctactaaaaatacaaaaattagccgggcgtggtggtggctgcctgtaatcccaggtactcaggcgactgaggtaggagaatcacttgagcccaggaggcggaggttgcggtaagccaagatcgcgccacggcactccagcctaggcaacagagcaagactccatctcaaaaaaaaaaaaaaaatgctgaattcaggttgtggtgttttgcattggatgaaaattcagttttacacaggtaggtaggtagaaaagggaggaatattttgattcgggtaagtgtgaataattttctttgatactataccaaagtcatagtttcttaaagcttagctgggattacaggtgtgagccagtgcacctggccttggccctttctctttttatttcctcgcagttctctccctttttt

SEQ ID NO: 198251 - DNA, 345 bp, Homo sapiens
gactgagacagcaaaggagatgtaggtttgtaaaaggaagggcatgcctgcagggaacagaatgagcaaagccgcacacatcacgggtcccctgttgactggcctagcctcctgcagcccaggtgccagctgatctgggcccactttaccaacatcatctgtgatcgttgatgctattttaggttcttagcttcaattctcagtgacagtggggagcgggccttctcaaggttaaagaggccagcctggaaagcgtaccaggactcccgcactgcagaaggccatcctatccctgtactcgcatttcctgtcggtgctcggcagagccacactcttcccggccct

SEQ ID NO: 198252 - DNA, 392 bp, Homo sapiens
agaaaggagagtcattttgagagatatcagcatgacttttggtgatcttaactagaggaagggacagattctgcagtagacaatgcttttgggtctggcttcttggtagacaccccaggatcaggtctaaggtatgttacccatgtattcccataacagcatcatttctctgtgctttgagtttcaccatttataaacctgcttaaagagcttatcttcttcctaatcataccttgagacaaaatgcactttataccagtaaagtatcatgagatgttcgtttggaagccgttatgccaaaagagcaagcatttacagccttgctttttatttaccaagtgtattttacactggaaaaggtttcaatatggccccatatagtatttattttg

SEQ ID NO: 198253 - DNA, 311 bp, Homo sapiens
gggaggggaactacacacaatggggcctcgtagaggggaaggaggagggaaagcatcaggataaacagctaatgcgtatggggcttaataactaggtgatgggttgataggtgcagcaaatcactatggcacacgtttacctgtgtaacaaatctgcacgtcctggacatgtaccccagaacataaaattttaaaacacgtacagtcatttttgagacatgcaaccccaaattcatcaagataaaaatgtgtctggatacatgaattccaggaagaagtggctttctaatatattggcttggaaaaaatat

SEQ ID NO: 198254 - DNA, 496 bp, Homo sapiens
gcctgcaggtgtggccgagtagggtgggggcattctcaggaatgccactggagtagcactgggggctcaggtgaggtggctgcccccagggctccgcagcagaccttgtcccagggctgggggaggatctgagaccccttccccagggccaggagtgcccctacttctctcgggctgccactgacccctgcccccgacccacctcctctggggctccatcaccctggagctgggtgggcaggggctctggatcttggattgtccctggagggcagccagagcctggtgggacagaggctcctccacggccctcccctggcgagccacctccttttaccctcccctccactcccagactgggcagctccctcctgtggattcaggacaggacgtgtttgggggtggggtgccgtctgacctgttgcagggaggaggactacgtcacgggcgggtgcccgaaagatgcccagtaaataggagtaagaaatgaatgatg

SEQ ID NO: 198255 - DNA, 418 bp, Homo sapiens
catgctattccatagttatagcccatgttaataggagggactgtggtgctgcaacaagagctcttgaaagaaaactaaaagaattgagttataaatctgtcactgagactgtgaagtttaatcctagaagaaagttttgtcacttctcagggcctcccatttcctcacctataaataaagtgaggatatgagactcaagtatttcaatagggatctactggcatttgaggaggcacaataatttcttatataggactgcccctggcatcacagaaatttagcatttctgacttcaggcaccaaaagcctacaactctttccagttcttataataactgtatttcccaatgtccctatgcactacctagcagaaaggagtggcttggttgacagccactggtagatgatctcaagttct

SEQ ID NO: 198256 - DNA, 592 bp, Homo sapiens
ataactggtttctgcctcctattgccagtcaattgaattagagttccccaaacttgcttcctgggtctatctactgagattttgctttggtcagtttgaggggattcctataaacttgtgtttttactgcataaccccagaaagactgttcttgagcaccaagagttatgatttttaaaattatggttgcaagtttgtcagggaaaaggtggtaccttgtttgaagttgcatgttagtattgtagtggacaaattttctaaaactttcttataggactgtatatcctgctttgtaaactttatgttcaggttctttgtctttctcaattgatattttatcattcatattgatttataatgtcttcttttatcagatatattaaccttttcgtaagacatatttgtaaattgatttccagctcatttgccttttaaattaggctgtattcttcttggatatatggaatattcttatatatgtagataactttcatctgtgatttctttcactgcttttaaacttagaaagttcactctcatccagaatttaattattatttacacacttcctttttattaaaaaacatttttg

SEQ ID NO: 198257 - DNA, 522 bp, Homo sapiens
ttagaagcaagattgggtcggttaagttagatctctttcactgtctcagtcataattttgcaaaagcggtttcacaagcagtcaataccaggagcctctgaagaccaccatagcagtcctcagtgccaggcaaatccactaaaatagaaacaccaggctttgccaagaagggaaaacaaaaagaaaaacaaaacaactttatcgcacatttcattagaatttcagggacaggctgggtgtggtggctcacaactgtaatcccagcaatttgggaggcccaggtgggtagatcactttgaggccaggagatcaagaccagcctggcctcccaaagtgctgggattacaggggtgagccacgaggcccagcccataatttctaatctcgtggctaatgttagtcctccaaaggcaacctagtccccaggcaagaaggaagtctgccttgggaaagggctgttaacatctttgttttaaactataaaataaaatataaactaagcttctcccaaagttagttcag

SEQ ID NO: 198258 - DNA, 470 bp, Homo sapiens
tatctgctgggcctgtggcaaccatttcaaaatatgtgaatgaaatatatgtgggggtaaactatttttatttacttccctaaagaagggatggtgttctctcgggaattctgtgcatagagagcctgtggcttaggcactttgatttatgtatatctcttcctgtgattggctatctagggactgctatctccagcaaatcttctaaatgtctgccatgtagaattcctttctcatctttctgtctcacccccttatctagctgcttctctaaccctagagtgacactgcactccccacaatctcctatgtcctgaatattttaccccatcctaaactccatctctaacacagatgcactttcttgtgctgcctactgcattgtacatcttccccttagttcccatgatgcaactctgccctaccccagaaaatgtaatttaattggtctgggataaaacctgggacac

SEQ ID NO: 198259 - DNA, 487 bp, Homo sapiens
actcagtaataagagaacaacttgatttcaagatgggcttaagatttgacagatacttcagcaaagaagatatatgagtagcaattaaacacatgaaaaaatgatcaacataattcatcattggggagatgctaattaaaaccacaatagataacactacacacttgtcagaatggctaaaatttaaaaaacaaataccaaggactgataagaatgtgggacaactggaacactcttacattgctttttggaaagcagcttgacaatgtcttataaatgtgtcatttgaccaagcaatcccacttctgggtatttacccaagtgaaataaaaacttatcattattcacacaaaaacctgtatggaatgtttgtaataaccttatgtataacctccaaagactggaaacaaccatcatgtcttccatctggtgaatgaatacatgtagtacatggcatatccatgcaataaaatactgatatgcttgg

SEQ ID NO: 198260 - DNA, 737 bp, Homo sapiens
ttcattctggattctttggacgttacattgtattggctctgggttctgcctcctctggagaatggggagttttcttctcacaggcagttcagtacctggcagtcctccttgatcctgaggtggcttggtgccaggctttctaatgattttttatttgcccttagccctggttgtggatccttaattctcaaggatttagaatctcttctgggcgtcactggaagccttgacattctcctccccacctctagttggttgagcttgagcctcagatgctgtcctggccctgggcagctggggagcccctgcagccttccagcggtccctttgtgccgagcgcaggctcttcagtggtgcttcagtttagattcagctgtagatttgcgggtagtccgtccgcatatttcgtggttttccctctgtggtttctttctcaggcgggctttccctcacattctggttgctctggcaggccgggaccccagcccctgcagtgcaggaaggtgcgccgtctgtggttaaatgcgcgtcttacctgcaggcttctcggtgtcaggggttgtgcttgttttattgctgattgcgtcagctgttctccagtgccctcaagcagttttaaaaaatattttatccagagttcatgattattatcagccaagggttagtccaatgcacccctcccttgtttcatagatgctccttttgaccttttcaaataaatatggatggcaagctca

SEQ ID NO: 198261 - DNA, 433 bp, Homo sapiens
ccgatatcatctccgcttacaataagtggtctccatacactgtgcattgtctttgttttgttttgttttgttcttccatttatcattaccattaattgatactacctggaaatagtgtcccgaggagcaattatttattttgttactatagtcttgaagattctgcctatcccccaacccccacctcctgtttagacagaatgtccaagagaaggggaaataattgcatcatctttttctcagttaacttttggcagtctcctgaatgcctgcccctagccaacaggcccagtggttccagcctctgtacagatgatttctagattattttgaatttaaatttatttctatcatgcctaaacatagtaatgaatagtgacatattttccaggaattttattttcggttgtctggtaattattttttgatgatt

SEQ ID NO: 198262 - DNA, 506 bp, Homo sapiens
tacagccattttcggtactggtgccatcacaactgctgatcgtttctgcaggattccagaaaataatgtatccatgatacagagtgtatacaagttttgcgattacgccttctgcgtaacagtcagtcccaccgcagtttaacccacaaggaattttctcttgtcctaaactattatggccttctttgtccgattgaacggaggtaacgaagtctcgtcttccgccagtcgtccgggcgaagccagtctggagccgctccggagcgcgcgttgtgattggctcttacattacttttctacctaattcgtatccttggggtgacagattttccccactacaaggaagactgggaagttctaagcaccgtcctttggcaggaaaaaacaaacaaaacaaaacaaaaaaacagaaggccgaatagacattggcaccactgtccatctacaagcatcaaaaataaaattgctggtggtggttagtagaataaaattataaaatctgaaaa

SEQ ID NO: 198263 - DNA, 496 bp, Homo sapiens
cttggagctggagatgaggggctgggcacccgtggaataggcatgaggccagaagagagtgacagcgagctccttgaggatgaggaggatgaagtgcctcctgaacctcagatcattgttggcatctgtgccatgaccaagaaatccaagtccaagccaatgactcaaatcctagagcgactctgcagatttgactacctgactgttgtcattctgggagaagatgtaatccttaatgaacctgtggaaaactggccatcctgccactgcctcatctctttccactccaaaggctttcctctggacaaagctgttgcttactccaagcttcgaaacccctttcttatcaatgatctggccatgcagtattacatccaagataggtataacttcctgttgaccagtgagatgggtggctttgggatcatgcgtgttcggggaacccactgtgagaggggcagagtcaaaccaacatgcctaatttttgtaccataat

SEQ ID NO: 198264 - DNA, 635 bp, Homo sapiens
aaaaggttggggactgctggactatacaatctctgtcacaaccactcagccactgtagcactaaagcagacacagacattgaatataaatatgtaaagcactaaacctggctgtgtttcagctagatttgcacataagcaatagtttgccaaccagatgagtagacaataggttagaccaggtaattagaagcgtgaactgggaagagtactcatattcaaaagatatttagcaggtatcatccagaagtattggtaactgaaaatgtgagattagtgtgaaggtgaagaactctaaaccctgacttcagtactttagcaattcactgaataggaaaggtaagaaaatgaaaagtattgggtcatgggaggaaggtcacattcagctcacattccactggccaagcaaatcccctgactaaggtggaagtctgtggggccaggaagaattcttctcttataggaaggcactgcaactcacatgacagtaagtgcagccatataatcttcttacaggtaagaataattacaggtagtgaataattaggaaaattactataatatacagttcagtccatctgactctaaatttcttgcctaaatgctaaggagatttgttggttttggcaccggtat

SEQ ID NO: 198265 - DNA, 133 bp, Homo sapiens
tgctgagattacaggcatgagccaccgcgcccggcctctatatttgttttattcttccctcccccatataaagatttttggtttgagagttaatttatagatctgatttttgagagttcagcatattatatgt

SEQ ID NO: 198266 - DNA, 125 bp, Homo sapiens
tgctgggattacaggtgtgagccactgcgcctggcctcttaatccacttctaagcacaggcactggtgctatgtctggttcactttctattctttgttcagattattaatatgtcatttgtgatt

SEQ ID NO: 198267 - DNA, 626 bp, Homo sapiens
tgaatataagcaactaaatattgtatattagcagtaaagacaaagtgccatgaagaaacagggaaagatggaatgaattcttcctataagcctggaatgcaattttagaggtagatatttgcgaaggaggataagggcttgacacaccaaggagcagaaatattattagtcaagccataagtgtatggcatgtttgcagaatgatgaagaatccagggagacaagagagaaagctggtgtctgagtcagcacagaatagagccccattaacttgatcctgtaagaaactcagcttttaattttaagtggggcagaatggatcagagggggaaaactgaagagagagagacttcctaaggaggtcactaggatctacacaagttaagataatatacagatgtcagaatccaggaaccaacatttcttctagtattctctattctattctgaagagccgttcagtgggtcaatgtattgagtgaaggagaaaaaagtccttataaaagccaaattttaacttttagaatcccaggctgttctactggtctgagaccactcaccaacatctaccccgccagtcttcctccacaatggaccaaagtgacctttctaagtataaatctgat

SEQ ID NO: 198268 - DNA, 583 bp, Homo sapiens
gaaaattatgtgaagacaaagggagaggacggccatcgacaagccaaggagagaggcctcagaagagactaacttgccaatactttaatctcagacttctagataagaggagacacaggcatttacagaggaaaactcatgtgaagacgagggaggagacagccatcaacaagcaaaggagagaggcctcagaagaaactaaccttgatcttacacttctagtctttagactttgagaacaaataaatttctgttagttaagccactcggcctgtggtatgttatggcagccctagcaaaccaatacactgtataacaggaaaaaaaaaatctagatctgggtcgggcacagtggctcatgcctgtaatcccggcactttgggaggccgaagggggtggatcaccagcctggccaacatggtgaaaccccatctctactaaaaatataaaaattagctgggtgtggtggcacgcacctgtaatcccagctacttgggaggctgaggcaggagaatcgcttgaacctgggaggcagaggttgcagtgagctgagatcgtgccattgcactccagcctgggcgac

SEQ ID NO: 198269 - DNA, 456 bp, Homo sapiens
cactcatggggagatagaagagtgttgcggtcacagcaatggcagagcagttttgtggctcaggctccttccccaattttgggtttccctgagagtcacatggctgggtgatctaaatcctcctggtcctggggcaggggtttgcctctgccaccctgcaggtgcagggccactgtcccactgtgctgctgttgtctggccacctgcagtcacagtgccggcatccaggacgccctccccctctcgctttgacatcaggagaggggctgcctccagagccttgggagaaggccactcctacggcccagagcggctgctttgttgtgccagcaagtgttccccaaaaggcagggacaatggccttactcacctgtgaaattctgttctggaccagcattgtccaacaggaatataacgagagacataaatttaaagttttgtactaaccacattaaa

SEQ ID NO: 198270 - DNA, 235 bp, Homo sapiens
atattttcagtttgccacaagtggctggagagctgcggcttaaatcccacaggaaaatcctgtgtcccagaaaaagtccaattcttgcctctactcatggagtctggtcaagagcctggaaaagagaaagaatccacctgtcagaagctgcctgggtggatcagggaaagtctgatgagaaaagattatgcacacatgtgggtttcataataaacatggaatattgacagttaaa

SEQ ID NO: 198271 - DNA, 304 bp, Homo sapiens
tgacatttctatactataagaacctcaatacagaatgagaattagtagcaacagattacaaaagatctcaaaataaagttctacaaactaacacttaaacaaaccctgtgaactactaccctgaaaaatgaagaagcacaaattcatagcaatatagtcccaaattagaaaattgcaaaacagtctaaacatttgcactaaacacataaatcactaccttttcaagtaagaaaagtatagtctagtcttaccttattgctgcaaaaggctggaataaaaaatactgacttatagaagcaacttt

SEQ ID NO: 198272 - DNA, 324 bp, Homo sapiens
catgtggcattgtgggtgctctgttgtcctgtgcttcctatagtggatgcctagcggtgtccctggcctctgctgactagatgccagtagaaccttgcttccccattcgtgaccatgaaaagtgtctctagaccttaccaaataaatgtgctctggaggtgtggaagagggcagaattgtctgggttgagaaccattgccttggcgtgagactgatgggaggtgcttttcaatctgttgctcccttagatgatcactgtttgaggtccttgttgatcattgtagatcatcattcatagatcatcgtcgcctttctatgattgaa

SEQ ID NO: 198273 - DNA, 483 bp, Homo sapiens
tggtaggtagagatgtccttattcttagaagatgcacgtcaaaatatgtaggaatgacacctgcaactcagtttaaaatggttcacaaagaaagtaaatacactaaaccaaattgttaacaacttgtgatctaatgaatggtaaatggtgtaaactgtattactttttaatatgcctatggcttttcaaatttctcaaaataaaatggaaaaagactgaatgaaagcctattttctaataaaaactgacatcgtatatttgaagaatatgagtagataataacagttacaatttccaataccatgttcaatgagttttagtcaccattttttcgtttctaatgaaatcaggatgttttcatcctaaaaggatgatgctaaacagtaagtgtaattctgtttttcagatggtacaaacaggaatttcttaattatataatgagtgaaagaacacaactgccttaccagattatcatgacattct

SEQ ID NO: 198274 - DNA, 369 bp, Homo sapiens
agccctcctgacccccacacagtggtaattcagccagctattcaggaccactggcgtaggggcatcccgaaacttatctcaacaaacacagctcctacccccaggcacgggcaccttaagtgtctctgcagagggccaggcaggagtaagcgctgacctccttggcatctccaacttggggccttttcttctggtccactaggcaacatcatgtccctcaacttttgtttggaaagcaaacgctttcatttatgctgttaacaggaggcagcagcaccccccgacacaccccaaattcccctaggattaacgaatggatctagactattaatactccaagtgtggtccatgggctggcaacatcagcac

SEQ ID NO: 198275 - DNA, 443 bp, Homo sapiens
ctggtcttgacctcatgatctgcccgcctcggcctcccaaagtgctgggattacaggcatgagccaccgcactcggctgagataaggcagtttttgtgaagaggacaccctgacatactggtgactggacgtaaagtgtgggttccagcccctctgagcaaactttgaagcccattttctggaataatggtagtacccaggaagtccctactcctgttctagggtgaccagcctacaccagcccttaagtaggtgctcagcctcacagaagtcttttagcacagagggtgctactattgggtcttttctgcatcactgctcaccatgacttgccattggagagaccaaatttttcccgtaaccttctgaatttaattcatatttgtcaaaagaagtttgttttgtttgtatctgtttagcataacacacctgttgaaaaggta

SEQ ID NO: 198276 - DNA, 236 bp, Homo sapiens
gaagccacgcgatcctcaaaaataagctgcacgtcttcgcaacattcgctgagtgaccccagaaataactgcattctgtcccctactacatgtggcatcgttattggtttttttaacccacaatcttccaaccattccacagctttattgcctgaaaccattaggtgaaatgggtggatccggttcaaaactgcctcctctcacaccctccaagtttcctatagggttaccgagtc

SEQ ID NO: 198277 - DNA, 593 bp, Homo sapiens
ccactaatacccgtgagcatcagagcagtaagagaattatatccatactttggtgatagcatttctaaaagcctgccttctctattattttgctgagcagaatttatattttccagatgtctcaaggataaccgttgtgagcattgtgatttacactaaaaacaaacaaaaacaacacgcctctctaagctttagtttccttgtcttaaaatggagatgagacattgccacccaattcacaggttgctgccaggatcaagtgagataattcttatggggtgctgcctctgtgcctggctaagtagttaagtcctgaatgaatgatggctgctagagtcaccattactatcatcatcctctggcctctccagctgtttacctctgcctgccttatccttttccttcatagcctttgcataatcgtagtttttgtctcacctgggttgtatctgtccttttcacacttgtgacaaatggtagacactcaataaatattgataaaatgaatccttgaatacatgactattttgttcttgttttaaatgaaaaggcattctccatttgttgctggctgaatgatttctttgtatata

SEQ ID NO: 198278 - DNA, 133 bp, Homo sapiens
ctagaacccagctgacttcccccacagccgttcttacctattttattactgtctggcataattaccagcatgtaaactccaagaaggtgcttcatcttattccagtgcctggcataggcatagggtgcatagt

SEQ ID NO: 198279 - DNA, 232 bp, Homo sapiens
atttcacatcttgtgcctaacagcagtacgcagaacagagtggcccttcttggggagactacacagtaaaccatcatgacataattaatcctttctagattactgcaactctactgatttgctgaaacagaataaaaacattgagaaggcataatatacatgcacacttttttaaaagcatttctcaattgcatgttaatgtctatcgacatgtaccaccccttcttctcaa

SEQ ID NO: 198280 - DNA, 425 bp, Homo sapiens
aaccagggagcaaggactgccttccattaagtgggcggggctagcaactgggccaaagatgcccaatggcccagagagaattcagagggggcctgtcaggtggaaggagccaggctggatgtgggtaggacctgctgtgcccatgtggccaggcaggcaaggcagatcaactcacgtgcagaccagaagccagcaaggcaggtcctgcaggggtgaagaagctgaggcccggggatcctgggtactccctcaagaaccttgagttaggagtggcctcacatcttcaggattcctggctctgttcgtttccttggctttctgaatttcttaagtatgcttagatgatgtacatcttacaagacaaggctggagggaatggcttgtatcaggtcccagagctggaaggtgggggtcccagaggccca

SEQ ID NO: 198281 - DNA, 187 bp, Homo sapiens
cctaaattactcactgccatgtcagtcttattgatcgagctaatgtcataaaaacatgtattatgggtagctgcccaactaccctgtcctctcttttagctctatggccatttatttcttatgctttatataccaactttcctttcctagttttgtgagatcctcaaggattagttcttgtcacttt

SEQ ID NO: 198282 - DNA, 463 bp, Homo sapiens
aattcttcttaatttattctatgaaaccagcattatcttgacttcaaaaccagataaggatacagtgaaaaaagaaaagagcaagccagtatctctgatgaacataaatgcaaaatcctcaacacagtactatcaaaccaacttcataaacacatcaaagagataatgcatcatgagcaagtgaaatttattgctgggatatgaggatggttcaacatcaaaaaatgtggtacagcacatcaacagaatgaaggacaaaaaccatatgatcatatcaatagatgcagaaaaagcatttgctaaaattctatttttcttcatgacaaaaactctcaataaattaggcctagaaggaatatacttctacataataaagtccccgtagagcaaacccatggctgacatactgaatggagaaaagaggaaagcctttcctttaagaagtggaataagacaaaggatg

SEQ ID NO: 198283 - DNA, 453 bp, Homo sapiens
atttttcaaaattagcaaatgagatgcaagacacttcacagaagaaatcattggtcaatatacatggtaaaatattctcaactttactaataacaggaatacctattatcatatctaaatgtttcacctatcagtttggcaaagatttgtttttaagaacacaatccttggccaggtgcggtggctcacacctgtaatcccagcactttgggaggctgaggcaggcagatcaccagaggtcgggatttcgagatcagtctggccaacatggtgaaaccctgtctctactaaatatacaaaattagctgggcatggtggcgcatctgtaatctgaactacttgggaggctgaggcaggagaatagcttgaacctgggaagcggaggttacagtgagctgggatcgcaccactgcactccagcctaggcgacagagtgagacttggtctccagca

SEQ ID NO: 198284 - DNA, 466 bp, Homo sapiens
cgtctctactaaaaatacgaaaaattagctggtgtggtggtgggtgcctgtagtcccagctactcgggaggctgaggcaggagaatggcgtgaacccgggaggcagagcttacagtgagccgagatcgtgccactgcactccagcctgggcgagagcgagactctgtctgaaaaaaaaaaaaaaatagaattacatatgtggcttgcagtatagttgtattagacggcactaccctatatgatagttactctcaaaaccaagtttcatcaatctagaccttactgttgacttcaggatccatagtcaactgtctttttcatcagtttcacattgttgttccgtaggcattttaaactgaataggtccaaagctgaatttattcatctctcatcatatctgttttgaaaaatggcccaaccatttcccttgatgctcaaactagaaaggtagaagatatttgaaacc

SEQ ID NO: 198285 - DNA, 279 bp, Homo sapiens
ctgggagttgatggagttgatctgctcaagtgctgctttactagcaaagcaataagtacatgccagaaagtcttctaaggttctcggtgcatactgggatctccactgtaggttccaggagaagacagagtagctgaaggggcaatctacctgcagcccccaggtaaagtccagcttagagcatgctttggagtgggactaagagtttggtcaggtgctagggtggagtcagatttcttcgtttctacctcaagacactctcaccagaagagaaggaag

SEQ ID NO: 198286 - DNA, 971 bp, Homo sapiens
ggagagagactcgagaggcctggaacaacgtcacagtgtggggctctcgctacgtggtggggcagaccccagtctacgtgccctatgagatccgagtccaggctgaaaatgacttcgggaagggccctgagccagagtccgtcatcggttactccggagaagatttacccagtgcccctaggcgtttccgagtccggcagcccaacctggagacaatcaacctggaatgggatcatcctgagcatccaaatgggatcatgattggatacactctcaaatatgtggcctttaacgggaccaaagtaggaaagcagatagtggaaaacttctctcccaatcagaccaagttcacggtgcaaagaacggaccccgtgtcacgctaccgctttaccctcagcgccaggacgcaggtgggctctggggaagccgtcacagaggagtcaccagcacccccgaatgaagcttacaccaacaaccaagcggacatcgccacccagggctggttcattgggcttatgtgcgccatcgccctcctggtgctgatcctgctcatcgtctgtttcatcaagaggagtcgcggcggcaagtacccagtacgagacacacagaaggatgttccccttggccctgaagaccccaaggaagaggatggctcatttgactatacgtgatgaggacaacaagccctgcagggcagtcagacatctctggacggcaccatccaagcagccaggagagtgacgacagcctggtggactatggcgcagggctgggcgaaggggtccagtcaactgacacgcacggttcccttccttcggggcagttaacacggtgtcaaaagcggaccacggacgtacacccagcagggccaagcgaacagctccgcaagccccacgttacctcgcccactgtctatctaccctctctggcctacggagcccacccaggcccagccaccaccttcgcatgcg

SEQ ID NO: 198287 - DNA, 813 bp, Homo sapiens
tttatttggctgactctctgtatcctctgctgtctccaaattcttgtgtcttctcctggaatatatttttggttaaacagcagaggaatgaaagaggtaccctacccccaccttcatcactcctacccctccaacctcaacagtttcccccacattactcccatttcttttctgagtgaagattttttggacaagactaggatcagccaccttccaacaactagaaccgtcctacaaccatttacctttcccctggcccctctctccaacttctcggagctccaaccctctccccctaccccaattctaccatccctgattctaagccacgcctcagagagacctgcagttcagaaaagcagagctgccaaaattgctggtgcctgtggacaagcaaaagctgttcacaggcatcaattattgtcagttttttcttgatgactctgaactgaccgaatcccttcctttttgcgcagtaagacagagactatgacactgggcaatgcatctccttttgcccagtaaaaccgcacgtggtttcctttccttcatcctcttcatccaccccatcagaaaggccacttgtttgtagcactgcctcctggattaggtttctctccctggtccctttcattcccttctccacataagactatgctcctcttcacaatttggaaacagctagagaaagcagcatgattgggcacagttgctgtgtatcagagacatgaacgtgcatttgaattatgagagccaggtcttttctcaataggcaggaggaaggcatcttttgacacctgtattttatctgct

SEQ ID NO: 198288 - DNA, 655 bp, Homo sapiens
atctttgaagtgaggattttacttctatgcaaattcttttctgtcagaggtgaatccctattttagtcatgaatatgatatttattcccctttcacaacaggaacttcatatatatgtatataagtgctgtgtggtgttctaaactatttcagtcttgcattagcattgtaatacataatgtagctaatctgctatgaatttgggaatgcattttatgacaaatttacagagctgtcagggaagatggaaagttgctgatttctcatataaaactgtcttcatagagcttgatgtgaatctcctgcacttctggaagcaggtatttaactcatccccaggaaatcaagcctgagagaagttctggtgagctgcttggctcctgtgttgagactggtctggtctcttagcatttgttttggcaaagaatgtttggatgtttatagaggacagatgagagctctggtcaagtatgagagctgttggtgggagggagaatccatttgggatcccatatgaaaagtcctgttaagggtgtgagcaggccttagaagagggtaatccaaagtggatctgtggattccttaggagctaagaggaaagaaaggccagagtggagtgcattcattcaggtcaaggcaattgcaggtgaaaaca

SEQ ID NO: 198289 - DNA, 771 bp, Homo sapiens
gctaaccctggccaggcaaggtggctcatgcatgtaatcccaacactttgggaggctgagttgggcagactgctcaagcccaggagcccaaggccagcgtgggcaacttggcaaggctgtgtctctgcaaaagaatacaaaaattagctggagtggtggtgcacatgtgtagtcctagctactcgggaggctgaggtgggtggatcgcttgagcccaggaggtccaggctgcagtgagccatgatcgagccactgcactccagcctgggcgacagagcgagaccctgtctaaaaatattacagagataggccgggcgtggtggctcacgcctgtaatcccagcactttgggaggccgaggcgggtggatcacgaggtcaggagattgagaccatcctggctaacacggtgaaaccccgtctcaactaaaaatacaaaaaattagccaggagaggtggcgggcgcctgtagtcccagctacgcaggaggctgaggcaggagaattgcgtgaaccccggtgggtggagcctgcagtgagccgagatcgcgccactgcactccagcctgggcgacagcgagactccgtctcaaaaaatatgtatatatattacagagatagccataactaattaaaggggttagagaagccaactcttgccacatgcttgggagaagaactagaaaacctgtggacagcccttatgacaagcacagcttcctgcggttcccaggggaagttagtgccacaggatggaggctttttctgggatac

SEQ ID NO: 198290 - DNA, 401 bp, Homo sapiens
ttagggtcagggttagaataagggtcaagctcagggtcaggataaaggtcagggttaggctgagagtcagggttagggtcaagattagggtgaaggtcagggttaaagttagggtgagggtcagggtcagaatttgggttagccccagtgagccctgtgtagaaactgtgtaagctcctaagtcacctgagttccctggctcacctctgagactgcagtggattggatctaagctccttaatgcttttttactttcacagtcaagaaagtgaaaaaaaaatgttgccaatcaaactattgtacaatgaagaatggaggatgcatcctaacttcagggatgttgtaatgtgaaaaatgtatatcttaggattttagtacatggtacctgcgtggctctggca

SEQ ID NO: 198291 - DNA, 226 bp, Homo sapiens
tggatggatggatggattaatggatgaatgtatggattggatggatggatggatggatggatggatggatggagagatgaatgcatgggtggatggatggatgggttaggtgggtcaatgagtaaagtaatgggtcttaactagctggaaggaaactggcatcctttccattttcttattatcataattttaccaaactatccatatctcaaggcatctactgaat

SEQ ID NO: 198292 - DNA, 276 bp, Homo sapiens
tttgagacatgtgaggtttgaggtccctttgaaacacccaataaagcagttagatgtctgagtatgatgctccagtgagggacctgtatgaaaatagaaaccgagcaatcattagaatatctgtgtcaagtatgccatcggagtggtgcggtcactcgatcactagacatttccgcctttcactcacattaggttttgtttatcatcaagtaagagagctgaaagtgcaggctcaaagtatcctgtgggtgcttccctccctgagctgcaggtggg

SEQ ID NO: 198293 - DNA, 361 bp, Homo sapiens
gggacccaccagaggatgaaaccggaggccccactcccatcagcacgcctctacctgccctccacctgcacctcaccggtctggccatgccaaagagatcgtctcccacccgctaagactgttccaggttccctgggcccagacagcatggcttttctctccaggtcccggggctctgtggtacaagctcccttcactacactctccacaggcagctatagcttcgaagagccacgcggaggctggtggtagagctatctcctccatcagaggactcatccatcagactctgtgccagaaacagtggtgctgccctcttaaaagaaactgcaactacttaagcctgaaaaggagaagacca

SEQ ID NO: 198294 - DNA, 241 bp, Homo sapiens
tctgctccagcaaagaccctcctgggggggtcctttccctaattctctcagcagaagcttcctcagtggccgccagaattcactgggagctggatgcgcccccggagctcagcgcctctccgaggacagtcaagaaaccgtgaagggctctgggtgcctccccagacccggggcccaagactcttctgtcttactggggcttctggaatattaagaaccgaaaaaggtgaaagtggagcta

SEQ ID NO: 198295 - DNA, 413 bp, Homo sapiens
ggaactcccatgacattgacactcttgaaaataaccagttattttgaaggatgtcctttaatgtggatcatctgatgtttcctcgtgattaatacagttaggcatctttggcagggacataaccggagtgatgctgtgttcgtctcattgcttcctatttgttggtgcacgattttgatttgtcccatgactgatgatgttcactttgatcaattgattgaggttgtgtctgccaggtttctctgatttttccctttgtaattcccttgtaattaataggtattttgtggagcagttctgtgaaactaagtaaatatcccattcttcatcaaactttcaacttattcatttattgtgtttatttttatcagtatgggtttgtatatattcattttattcaataggttataaag

SEQ ID NO: 198296 - DNA, 171 bp, Homo sapiens
tttagcttcctcaaacaaactaactgccagccaagaatttagtatccagcaaaattaagtgtcatatatgaaggaggcataaagtctttttcagacaaatgctgagagaatttgccaccaccaagccagcactacaagaaatgctaaaaggagttctaaatcttgaaacaa

SEQ ID NO: 198297 - DNA, 364 bp, Homo sapiens
catgtaatctttgtacctactctctgttcttataccccctccccttttgaaacccttaataaaaacttgctggtctgagactcaggcaggcatcacagtcctaccgatatgtgatgtcacctcctggtggcccagctgtaaaatttctctctttgtactgtctctatttctcagccagcagacacttacagaaaatagaaagaacctacgttgaaatattgggatttgcttctcccaatatctggcatgccaatgtggttttctttttcctaagtgcatgtgggaacccaattccctctggtaggtttgtagaaacgttcatcagtccggttcacagaaatgcttgtccagctccctgacgatt

SEQ ID NO: 198298 - DNA, 245 bp, Homo sapiens
aaatgatatggcccgctctaggagctaaacataaggatttgtggaaactattaaatgcaaactttgggaaagaataaaaaagcatctagaaggacactctacaaacttgtttttggatatagcaaaattaaagaacaaatgtttaaagcatcccagggacacctgaccttaatgccaagaactggagtgcttaaaggagctgcagacaaattagcagctagtaacccattaaaatggataaaaac

SEQ ID NO: 198299 - DNA, 811 bp, Homo sapiens
cgaagtctcattgttctttccaactgaacactgccggtgtggtgtgcctcacttctcagtctccattcactaacccaaatatccccaaagatgtgcaccaatttttctgtctagcattcatcagagtgctcctgtgtgccaggccctctgctaagcactgggcatacagcagtgaacagaaaccccagggggctcatagaccagttgggaagattggcattaaacaaatgaatatgtaaatccaaatcaagaggtatgaacaccatgaaagacaaaatcatggttgaaagttgagtgggcctggggttggagagatactgccctaagcatctcccctccccacctggcttgccacttgcccctttatagaataactaatcgttgttcagtctttgatagtttccactgaaaacatccctcttctacctgacagaggagggtcaagacacccagagcacaaaggagctgatgggtttagttagctgttactgcggaaagccaagaggatgagcttgagagaacagactgagggctttagatgggtgaatgtgagaaagtctacagtgcttgctgtgctgaggaaaaaatccaggtggatcacctggaggtgacccaaagtgccaatgaagtgcatgtcaatggccctcttcacatacttcactactgtatctggagctctcctgaacatctttctcccattcctcactgagttttgctagacatggcaaatgttaactcattaccaactcttaattgtattgctgtttctttgcccctgtctagctctttctatttgtacattttgtaaaga

SEQ ID NO: 198300 - DNA, 381 bp, Homo sapiens
tgtatccatctaaaaatggcttccacaaaaaaatacttcttatattttctctttttaattaaacaaatagaaattttatttatttatttttaacagcaaaacaggccaggcactgtggctcatgcctgtaatcccagcactttgggaggctgaggtgagaagatcaccgaggccaggagtctgagatcagcctggacaacatagcaagattcagtctctaaaatttttttttaattagctgggtgtggtggcttgcacttatagtcccagctattcaggaggctgatgtgggagcactgcctgaacatacgagcctgaggttacagtgagctataaccataccactgcactctagcctgggtgacagggcaagaccctgcc

SEQ ID NO: 198301 - DNA, 266 bp, Homo sapiens
catctcaagcaaaatggaatgcctaatctccagtctcccctattcccaaacctaattgcctctgtcttggtaaatggcaactccatccttcaggatgttgaagcaaaaacaaccggagtcatcattatcacctctctttcatagcccactagtccctcagcaaattctgctgacttcaaaatacacccaaaatctgatcatgcctcatcacctctaagttacctatccaatcaatattaacaattaatcactaagacctatctatt

SEQ ID NO: 198302 - DNA, 585 bp, Homo sapiens
ccacctcacccggctaatttttgtatttttagtagagatggggtttcaccacattggccggggtggtctcaaactcctgacctcaagtgatcctcccatctcggcctcccaaagtgctgggattacaggcatgagccaccacacccggcccaatgagctttacttttctacataaggaaaataatggtagaaatgaaatagctgtgaaacttgttttgctatttttgtaccatgctaaaatgttaactactgcttatgtcggcatacacctgagagctgctgtgatttaagcctttttatttttctgggtatgatgtaactcctcccctacctcatccaagtagataagttcatggaggataaacatgacagctgctgtttcttttatagctggttccagggaatatccactgaatataggaaagattgtcagttgctgtgtgctgccctggtgctggtggagctttcagccttcttctcagaggaaacaatttaaatgtttttgtgaaaccctagaggtctggggtttgtaggacagtcttgagcagagcaggcaaaggtgaagggagtggagcccagacgtgc

SEQ ID NO: 198303 - DNA, 351 bp, Homo sapiens
gaggcggagtctcgctccgtcaccaggctggagtgcagtggcgcgatctcagctcactgcaacctccgcttctcgggttcaagcaattctcctgcctcagtctcctgagtagctgggactacaggggcccaccaccacggcgggctcatttttgtatttttagtagagacagggtttcatcatgttggtcaggctggtctcgataatgtgacctcgtgatctgcccacctcagcctcccaaagtgctgggattacaggcgtgagccaccgtgcctagccaggctgtgatttctttaggggaaaagacaggtaacagtatggcagtgaacatagaaacagttcaaaaattag

SEQ ID NO: 198304 - DNA, 254 bp, Homo sapiens
attcttcccttcccttttcaaccaagcgccttgagaaaacattataatgtttctgaaacttgagttcacccaaactatttttaaagaaccttgttctgtatcttgtaacctatacaaaaataactaaaaatggaatatagacctaactgtaaaacttgaaactataaaagttcttaagataacacggaagaaaatctttgtgactttgggttaggcaaagatttgttagctgtataaccaaaatttgagccata

SEQ ID NO: 198305 - DNA, 585 bp, Homo sapiens
ttccacttcctttggtgcctggaagagatgaccaaaaacctcagcccagactctgctgccctagagttatttgtattctagctgagaaggtcaaaaacactgccctcaaacttccaggcatcagtggataacccggcctcacacaaacacatgaaggagtacattaaacattgactcatctgtggtgctaccagaaggaaggacaaaggaggccatctggatcctgtctgcctgagctctcatttcagctctgccacttggaagttcagtgaccttgagcaagttacacaatcactttgtgtctcagtttcctgactgtaaaatggggataatgatggaactttccttcttaactctttgtgaggattctgcaggtcagtgcccaggacacccaggccctagccatggcaatgtccacagatgccagtcatttcttcctcccaaggccagggttctgaccctttttaatggcttggtccataaaaaatatggatcatgccataaaaaaggcatggttgaaaaaattcaaccagcctagtgaagcacacgaatccttctcaaaataatggtataaatgtataaaat

SEQ ID NO: 198306 - DNA, 1160 bp, Homo sapiens
gtcccagttcctcaaaatatgagacaaactttgcaggattataaaattggaaaaaatagatcagaaaatcacaaaataatttctctttccaattcacattactgtgtccccaaagcttcatttgctaacagtattaatggccaggcttaggattgcctttacatacattcaatatttctttatttagttttctaggttagttgagtgtattaacctgaaggtgaatcacaaataatagtgaattactattaaaccaaaaataaatgggcgtaggagtacaaaatttgaaaagtaatttttatgaaaaggtaattctagaatggaggaaaaaatgattgtggagtggtattgtcacttagtgtttattttaatgtaaatatgaatggatttcccattggtagttaaagttcttgctccattccaaatcttcatatagttaacacaactttcaacaggtttatctttcttcacaagatttcttccacaaactagtaaggtatcatttgagggaccttagagacttgtggtcagtgaaggatgcaaatagatgaaaatgagaaatagtttatattgctagccactaccgatattcctctgagaatgctggaggatttcacttttctgttattttgaggtagcacgattgtgtaatttcctttggccaatgaaatgtgaatggtgtgtcacttccaagcagaattatgtaactgccagtgaaagactcttctgctatcttttcctgttacagcaattacataagcactggttgatactgagacaccataaagtcaaagcaatccaggatgctgagccaacatgtggagaaaagctgtcataggaagtccccaataactacaaaggactctgcagcagcaagaaataaaattatgtttattttagaggaaaaactgaatgttaactcacaacagcatatgtattgaggtcccactgccattaagctaatatgaaccagataaattttaagaggggggcattttttttacaacaggaaatacaactgtaggagaacattattgttgacactttttactaagacatctgaccgttaagcagattagataacttgaattccatggaaaaaatctactgtgttttgatttctttttcttaaatataaaaggtagcagaagaaaaataat

SEQ ID NO: 198307 - DNA, 604 bp, Homo sapiens
atctaaacaagtacaaaagtctgttgctgttgttttctaaagatttacttatacatgagtgcatatttagacaattgaaagaaactaaataattgtgttctttttttttttttgagacagagtcttgttctgttgcccaggctggagtgcattggtgtgatcttggctcactgcaatctccacctcctgggttcaagccattcttctgcctgagcctcccaagtagctggaattacaggcgcgtgccaccatgcccagctaatttattgtatttttagtagagatggggttttaccatattggccaggctagtctcgaacgcctgacctcaggtgatccgcccacctcggcttcccagagctctgggattacaggtgtaagccaccgcgtccagccagaattgtattcttttatataaactgagagtttgggatattggctggttaaaatgctaactatgaatctgaacacaggaactcactgtcgctcttgaaaagattactctttcctgcttagagttttaatggtctgaattatgttttaaacaaatttgaaattatgttctgatttgctctaaatggaggcaaatcctttgttaagcaat

SEQ ID NO: 198308 - DNA, 311 bp, Homo sapiens
aaaataatatttcattttatttttaaactactacattaaaatattttgtggttcagcattttctaatatatttaatgactctttgtatgttctgtaactttttcctttttttttttattatttttttattttttatttttaatgttttttttttttttattatactctaagttttagggtacatatgcacattgtgcaggttagttacatatgtatacatgtgccatgctggtgcgctgcacccactaacgtgtcatctagcattaggtatatctcccaatgctatccctcccccctcccccgaccccacc

SEQ ID NO: 198309 - DNA, 472 bp, Homo sapiens
atgctcaaatatttgtatgtgtttttttcattatcacaattactgtcatgtggatattatttcaaatttatagataaggaaagtaaggctcagagaagttaggctatttgttcggagtcatgcagtgataagttatgaagctggaaactgaacacgttataatctggcttagatgggagagtgtggaggagaaggagaatggcactgagtgtcaaagaacagcctgagctgaagcactaggagacctgcgtggctacagcgtcaaacaggacaataaaaagaaagttagcaacataagatggcagaaaacctcaaaaatcagtgagagaaattctctggatttttaagcagaaaaaaaataatgaaaatcattgatggtcatagagagcttgaatataagatttttgtaagaatatgattttttattctatgactaaagcagaagaaccatacacatcaaatttgtaaaaaa

SEQ ID NO: 198310 - DNA, 274 bp, Homo sapiens
tggagttagaaacatcagtataaactaatgtttagcttaacacagacatagttaagtatggataaatttatagacatacgtatatagtattcacatatatttccttgttctatcagctgagagagcttagaagcagataccccagtagtaaagagggcacattatgttcagctcttagtttctaacactgttctccaataaaagggaccagttcccttggagaaatgactgatcctaggatgaggtaagaaatacacaaagtaagccttgaata

SEQ ID NO: 198311 - DNA, 482 bp, Homo sapiens
cttgccatcccctgaggtccttcctttggcttaggagctctgccagagaagtaggggtgggacaagggtgcctggcctgtgtgcccagggtggagggagatgattttggattgtgtttgtggtggttgtaccagcaagcagatgggtgggaccaagacagcactccaaggctgtgagtcatgggggaaacctggcctggagtggagaggaaaagctaatggtgaaataccctctccagagccagcctattggacatcatcccaggattcaggtcaagttgtttcgtctcctgtcccctgaccttccaccaagaaggcagctcctatggtgtaagccgtcactccaggggaagcctacgatgaatggggttagagcccccagatcccttactggtctggagagatttctaaatccaggaataaacctccccttggccaggcacagtggctcatgcgagaaatctcagcactttgggaggccga

SEQ ID NO: 198312 - DNA, 453 bp, Homo sapiens
acatgaaggtctgcgtattctttcacatgtgcacatatgtggcacttttccatgatgcaacagcagcgggtctctagctaagctacagcagcagctctaagaggcaggggaccctgaaacgaggctgaaaaaaagaatagtccataactgacatcaggcaggctgctgttgtaagcaaagaaaggaggctcacaggggcgtggactcaggccagatcaggctattgtgggagaacacggagcacatgtgtcagctggaaaggggccggctcaggagacaaaataggcacgagaggaaacccaaaaattgacatacatgactatccttgtagaaatgtataaaggtttggattattttgcttatcgagttataataaagttattctaaaaatgtttatgtaaagtattatgtacatttttgttaccttataaagattatttatatttgagttgt

SEQ ID NO: 198313 - DNA, 264 bp, Homo sapiens
tgtaagaaacctccatcatgaaataatttagatatttgaaatgtgaataatgaaagtagagtcaaataaaagtatatttgctttaactttagtaaagaggggaaatataaaagttgcataaatttaaaaattaatctggagatattccatgctaagggcttgttaaataagcaacatgaagagcatcaatcaggttggacatttttattgtcaatgtttagttacttccagtgtagattagtgttttttgaaacagaagtaggc

SEQ ID NO: 198314 - DNA, 352 bp, Homo sapiens
agggggtaatgaaaatgttctgtaattaaatagtgatgatggttgtacaactttgttaatataataaaaaccactgggggccaggcgccagtggctcatgcctgcagtttgggaggctgaggcgggtggatcacctgaggtcaggagttcaaaaccagcctggacaacatggtgaaaccctgtctctaccaaaaatacaaaaattagccgggcgtggtggtgtgtgcctgtaatcccagctgcttgggaagctgaggcaggagaatggcttgaaccagaaggcagaggttgcagtgagccgagattgtgccactgcactccagcttgggtagcagagtaagactccatctca

SEQ ID NO: 198315 - DNA, 236 bp, Homo sapiens
tgttgggattacaggtgtgagccaccacgcctggccctgaaaaatatttttaacggttacattatcatggagaattggatggtataaaacaatagcagttctcatatttgaaaataaattgatgtaatgaaacaaatgagaggatcaaataatattgtaaaaagaataaaaacccacatatggacaggtctgtggaaattgtattaaagactacctctcccagattgtttccgttg

SEQ ID NO: 198316 - DNA, 237 bp, Homo sapiens
catatttagccatcaaaactcagctccagctacacttccaccttagcttctcccccggtttgcctcttacctacagctttctgtcctcttcatagtttcaaccatgactacatcacatatcttgacacatcactacttttctgtacttgtggtttactcattcatttgttccacaaaaatcattgagaattttttgtgtgccatgttcatgggaatagaaagattgaaaacatgcat

SEQ ID NO: 198317 - DNA, 269 bp, Homo sapiens
ggtagaaagttagcagtgaatgtggtgagacacagtcaaattctcagagaagaggatgaaagaaattcctgacagaatctttggcaggggtgcagaagtagagaaggcatctgaaatggggcaacagtgagaagtgggcctggaaatgaaggtttgccaaaagtctttaactaaaacaatcaactcatataatggtactgccctagtccttagccatctagatttgtctctctctctctctctctctctctctctctctctctctctct

SEQ ID NO: 198318 - DNA, 480 bp, Homo sapiens
tgatgagacagaaggagaacggtggcatctctcactgtaaaggaaagaacactggggccacaaagtgtcatcagccatgttcctctccagtccaaggactcccagacacttagtgttccagctcctgagtgaaaatgttaaccatcagcacactctcaaagatcactcactctaggaagtcagctgccatgtcatgatgatgctcaagcagccttgtggaaaagcttcacaaggagaggaactgaggcctcctgtcaacagccatgagagggggctgtcttaaaagcagatcctccatccccagtcaagccttcagatgacggcagcccctgtggacatcttgaccacaacttcatgagaccctaagccagaaacactcagctaaactgccctggatttctgactctcagaaactgtgagataataaatgtgtgttattctaaactaacagtctagaataaactgttatgcagcaataaa

SEQ ID NO: 198319 - DNA, 395 bp, Homo sapiens
tggaacagcagaagaggaatgtggaaacataagcaagactatttcttgttaaaagtgtaagttgtggtaatgagttggattttattcagggtatatgagaaatttatgaaagatttcaacaggaaaattccatagatatgaggctgctctgaggaatattggtctatctgattacttaaatgggaaaaacagttggaacctgaggatgtctatttctgctgtagggaacggaagcaaagaaatctgatttgtaaccacagcggaatggacatgcagagagaagcagagatgtaagactgagaaggaggtgtttgtttgttcactgtggtactctattctgttgttccagtttattcctgactgtattctgaccttgaatgtaaagagatgacacc

SEQ ID NO: 198320 - DNA, 466 bp, Homo sapiens
agagtttccctcattctggagcttctgactccccactcccaactctgagagtcgttctccttcccataggctatgcagtctcatacagctgggctgcagtgccacacctcaccagtaggtgctgccttcagctcaatgtgactccagcctgagcttcgagctgtgggtgctaagaagtggctacccctggctgggcgcggtggctcacgcctgtaatcccagcactttgggaggccaaggcaaatggatcacgaagtcaggagttcaagaccagtctggccaagatggtgaaaccccatctctactaaaaatacaaaacttagctgagtgtggtggcaagtgcctgtaatcccagctactagagaggctgaggcagagaatcgcttgaacccgggaggcagaggttgcagtgagccaagatctcaccactgcactccagcctgggcaagactctgtctcaaaaaaa

SEQ ID NO: 198321 - DNA, 810 bp, Homo sapiens
tactttgactattttagatgccaggcgtgtgtcttgaagagaccagtgaagaggggcttgaagttctgattcactcgaacttttttgggttttatgtctttcctttctcgtcagcatcaaggccatctaacttcaaggctgaatgaatgagttctgttttccttaatagggagagggaggagatggcctaggactcattcacagctgtgtgtgtggaaagtgcattggtgatagatcttgacttatttagtgatttttcagaagattgttggtttttcactggtaagaccaacaactatccttgttaaccagctttaaccagaaggactaaggaagttggacatctcgtaccactcgcaattgattttctaatgcagttctcttgtttaaattctgtggctgtgataatctaggtagccaattactcttttttgttaactaagaagatttatactgctgttgtgctagggtttgtaatttaaggtgtggacatgtccaggatgttaaatttagcttgtgtctcaaaactagagctatccaaactcttttttgctctggttgccctggtcccttgatgttcagcaagcagctttgcagtgcccacagcactccggcctccctccttggtactgcagggccactgtgaagagggaatcaggacaggatccttcaggtcttggcttaggcatctttttttcctaaaagtctttctggaccaatagtctgtcagcagggacggcttcacagaagagatgaaactcaacttttaagactggctgggtttgggggagggaagagaccaagaaggaa

SEQ ID NO: 198322 - DNA, 608 bp, Homo sapiens
cagacatgttggagtgaggtaagattatccgaccactgaattgtagatttccactataattcccatttctattacagcactcccaacttcaactgcgctttgtgtccttgtgcccagaactctctgtttctactttttcaaagagtaaaaccaccaacccttttagggtggagagggaaaggtaggatggccatgtactatgcacggaatgagggatgagggagaaggtctcagggtctacgacttctaatacagaatttcagctaatcgtactgtgttttagccccatgtgcaccttcatcatcagaggtacctagtgcctccaattcctagactctttaagattttcttttttttgggacagagtcttgctctggtggatggagtgcagtagcacaaccatagctcactacagctttgacctgggctcaagtgatcttcttgcctcagccttctgagtagctgggactgcgggtgcatgccaacacacccagctcgttttgtcaatttttcgtggagaccgggtctagctctgttgccaggctggtctctaactcctggtgatcctccctcctcgggttcccaaagtgtagggattatcggtgtga

SEQ ID NO: 198323 - DNA, 319 bp, Homo sapiens
aaatattattctcttcctacttatgttttcattgaaccaaaacattgctggctaatgagtggctggtacaataaagccttggttgaatttccagcccatgctggacaccctggggttctcctgcactgcacttatcacattggaatttgtcttttcttctagatgccagcttcatgaaatcaagagttttgtctattacattcattgttatatccttagtatgatgcctgcctcagagtgacaaatatttttcaaataatgattaaatacatgcacttatgattgattcatggacatatgattacatgcataactgaat

SEQ ID NO: 198324 - DNA, 110 bp, Homo sapiens
aaattcctagaaacatacaactttctgagattgaaccagaaatagatagcactcctgaacagaccaacaataagtagaaaaattgaatcagtattaaaaaaaattctacc

SEQ ID NO: 198325 - DNA, 277 bp, Homo sapiens
ttgccaggtcacttgagaacagatgaagagctaactggaagctattgctgaaaccttacacagtgtcctgggaagttttagcaaatagtaacttacgcagaacagaacacaatcatccatcatcataaaacagaacccagaggggttgaagttagcttgtagaaacagaacagttaaaagattaaaactgttatcctcatttaataattgagtaccataacaaaccagacaagccttatggagattgggtactgttattggttctgtggtatgctat

SEQ ID NO: 198326 - DNA, 199 bp, Homo sapiens
tcatccacatcagggtgagtagtggaaatgaatgaggttaggaagaattattgcattaatttttagggctcaccaactcagtgcttacaggatccaaatgaaagaataaacactgcccattctaggatgataaatgacagccgaaatttggcctcagtataggggcagagagtggcagcctggagggcacatgcctcat

SEQ ID NO: 198327 - DNA, 534 bp, Homo sapiens
tgtaccgactggctggctaattttgtggtttctgtaccatcacatgcctattttaagacactctccagcactgtcggttagggagtgtaaattttgcaatattttctgaaatgtggcaatatcaaaatgtaaaaggcacacatacttggtcaccatacaaatggcactatttactctgtgggcatatttgtaaaagttgccaaagaattatatacaaggatgttcatcagagcatttcttttgaagagtaaagaaatggacatgaacctgtggtccgttcatacggtggaatacctatgcagctgtaaaaatcagtgtggtagatctccgtatatgagttgatgtggaaggttggccagttcacatgataaggtgaatagaataagttacagaacaggctgtagagtatgatcttatttgtagatgtttaaaactgagtcataagtatgcttatatacagatcgtttctggaagtatgtactggaagtctacctctggggtgtgggttttcggcgtgtgcagtcttctatactg

SEQ ID NO: 198328 - DNA, 1397 bp, Homo sapiens
ggtttaactaaggattaagcttaaaagagtcctcctgtggcttcactggctgctgaccacggatattaggtctttatcctatgggcttctccattaggacagtttgcggtatggcagctgtactctctttctctttttcttggttgctgtgaaggaagtcagctgccatgctgtgagcttccattgaagacagaagtcttccttctaaatgccacgtgagtgagcatggaagtcaagccatgcaatgactgtcactctggctagcaccttgattgcaatcttctgagaggccctggtccaaagtcaccctgcaaaaccaatgcccagaattactgacatatttatttcaagctaataaattataggcgtaatttgtaatatgcagaaatagataactattacgtagatcaaatgaaaagattttccaatgtgtagaaactacataaattcttttcttacaggacaatcttattctaatcaataacatttgcttttaaggcagataatcctccaagttttctaatgatatctgaaactattaactgattctgtgaattatgaaatctgaaaaggaattggaagttgctaaaaatctatcatttgcattgaccagtgtgaagcacagtggaatgagaatgcgtgccctgacaccaaagaaaaataagtgactggaaagctgaagaatcaccggcttcagtgacatggaacccagtgatttgatttttgacgagtatcgggtgactttgaggtggtcaagaaaccacactttaagaacaatgtccaaaaaggggaaaaaaaagagcaaccaaagaaaaaaaatccataaaattgcacagaagaaaagaaagaaaaataaaatacacaatatggacgatggagaaaaacagttacatttctttatggatcaagaagtttgtgtacacataatctcattttgagatatataactatttttgtctttcagaagtgaatcaaaatatttcaaaatgctgtcttatgaaactacaatattctcacagattagaaaagtttttctgtaaaagtcagatagtaaatattttaggttttgcagtgtcttttgcaactactcaactttcctactgtagcacaagagtagctgtggtactgtgcaaataaattgcttgtgttccaataaagcttcatttacaaaaacatgccatgggccatatttggcctgtacactgttgtttgccaagtcctaatatagttgcttagcaagtattgtgagctatttgaggaagacatgaaagttcattgggttgctaaaaagtatgtagaaattcaaaggaaaattaaaatttaggctaagttataatacactgttttaacaattgtaaaatgtaagagaaatttacaaataaaaatcccaaataaaa

SEQ ID NO: 198329 - DNA, 345 bp, Homo sapiens
cggcccatgtcgcgactgtggtcggaaacggagcaggtcaaaactcccgtgctgatcagtagtgggatcgcgcctgtgaatagccactgcactccagcctgagcaacatagcgagaccccgtctctaattttgaaaaaaagaaaagaaagagaatggttcaatttcccaacttctttttgcctgtttacccactttagtatcagctgtaccaaaggtaattcatcaatagttttccttcatcttcccattttaccctgatactgatgctataaatggaagagaatctgctgctaacttaacttctgtttcagttactgtagcatcatgttctgcccatatctaaa

SEQ ID NO: 198330 - DNA, 1433 bp, Homo sapiens
cttacagatactgggaaaactcaaagaataaaacatctgagcagggaccaagagcaatcggggagtccgtatcatgtcacagagaagcgtacaagcttaggaatcttgttttctgaattcgaatcgcaggttgccagttacacctgtatgcgactcaacaagtactttaacctgtctcttagctgttatactacaaacctcaggcttgttaagagaaaatgctccgcaaggaactaaacacagaaggttctaacgctgagccaagactgggaaacgaactctgggaactcaccccaggctccccaagaacatcgcccctctggctggagcgcaattggtgattggctacttaacccgtccgtcctttcccgcccaggggtccaatccaatccagcccggctccgctcggagacagttcgccgagtgggcggtgtctatgacgttttctgacgtgttacgtcacggtgggcggaagtcgcggccgctgttttgaaatcgggccgcggggggtctctcaagctggttccaacgctgaggccccacagcctcccaattccgggcagacccctgacacctgctgtctggccccttccggcctgaagctgcagccgcgccatgtccacccctccgttggccgcgtcggggatggcgcccgggcccttcgccgggccccaggctcagcaggccgcccgggaagtcaacacggcgtcgctgtgccgcatcgggcaggagacagtgcaggacatcgtgtaccgcaccatggagatcttccagctcctgaggaacatgcagctgccaaatggtgtcacttaccacactggaacatatcaagaccggttaacaaagctacaggataatcttcgccaactttcagttctcttcaggaagctgagattggtatatgacaaatgcaatgaaaactgtggtgggatggatcccattccagtcgagcaacttattccatatgtggaagaagatggctcaaagaatgatgatcgggctggcccacctcgttttgctagtgaagagaggcgagaaattgctgaagtaaataaaaaactcaaacagaagaatcaacagctgaaacaaattatggatcaattacgaaatctcatctgggatataaatgccatgttggcaatgaggaactaagctgatatttaaatttcctgctttacacatgttataccattgttttttccctcaagtattttttccctgtgaagaagattatttatctgcttttattttagtcactaaaactaaagtttttatttttacattgtgatttttacattaaaatattaactttttttaatgctattttatgaaagattattgtaataaactttgatggggtttgtattttggttaatcttcatgaattgaataattgtttttttaaagcaaaataaagttttttaaataaatgt

SEQ ID NO: 198331 - DNA, 593 bp, Homo sapiens
ttatacaaataaaagtataaaaattgaccttaatctgatatattctctatacaagtgattagaaaacttgaattatatttttgccttttaatttttgttaatcattcccagcaacttattccatatgtggaagaagatggctcaaagaatgatgatcgggctggcccacctcgttttgctagtgaagagaggcgagaaattgctgaagtaaataaaaaactcaaacagaagaatcaacagctgaaacaaattatggatcaattacgaaatctcatctgggatataaatgccatgttggcaatgaggaactaagctgatatttaaatttcctgctttacacatgttataccattgttttttccctcaagtattttttccctgtgaagaagattatttatctgcttttattttagtcactaaaactaaagtttttatttttacattgtgatttttacattaaaatattaactttttttaatgctattttatgaaagattattgtaataaactttgatggggtttgtattttggttaatcttcatgaattgaataattgtttttttaaagcaaaataaagttttttaaataaatgt

SEQ ID NO: 198332 - DNA, 1169 bp, Homo sapiens
cttacagatactgggaaaactcaaagaataaaacatctgagcagggaccaagagcaatcggggagtccgtatcatgtcacagagaagcgtacaagcttaggaatcttgttttctgaattcgaatcgcaggttgccagttacacctgtatgcgactcaacaagtactttaacctgtctcttagctgttatactacaaacctcaggcttgttaagagaaaatgctccgcaaggaactaaacacagaaggttctaacgctgagccaagactgggaaacgaactctgggaactcaccccaggctccccaagaacatcgcccctctggctggagcgcaattggtgattggctacttaacccgtccgtcctttcccgcccaggggtccaatccaatccagcccggctccgctcggagacagttcgccgagtgggcggtgtctatgacgttttctgacgtgttacgtcacggtgggcggaagtcgcggccgctgttttgaaatcgggccgcggggggtctctcaagctggttccaacgctgaggccccacagcctcccaattccgggcagacccctgacacctgctgtctggccccttccggcctgaagctgcagccgcgccatgtccacccctccgttggccgcgtcggggatggcgcccgggcccttcgccgggccccaggctcagcaggccgcccgggaagtcaacacggcgtcgctgtgccgcatcgggcaggagacagtgcaggacatcgtgtaccgcaccatggagatcttccagctcctgaggaacatgcagaaactcaaacagaagaatcaacagctgaaacaaattatggatcaattacgaaatctcatctgggatataaatgccatgttggcaatgaggaactaagctgatatttaaatttcctgctttacacatgttataccattgttttttccctcaagtattttttccctgtgaagaagattatttatctgcttttattttagtcactaaaactaaagtttttatttttacattgtgatttttacattaaaatattaactttttttaatgctattttatgaaagattattgtaataaactttgatggggtttgtattttggttaatcttcatgaattgaataattgtttttttaaagcaaaataaagttttttaaataaatgt

SEQ ID NO: 198333 - DNA, 1115 bp, Homo sapiens
cttacagatactgggaaaactcaaagaataaaacatctgagcagggaccaagagcaatcggggagtccgtatcatgtcacagagaagcgtacaagcttaggaatcttgttttctgaattcgaatcgcaggttgccagttacacctgtatgcgactcaacaagtactttaacctgtctcttagctgttatactacaaacctcaggcttgttaagagaaaatgctccgcaaggaactaaacacagaaggttctaacgctgagccaagactgggaaacgaactctgggaactcaccccaggctccccaagaacatcgcccctctggctggagcgcaattggtgattggctacttaacccgtccgtcctttcccgcccaggggtccaatccaatccagcccggctccgctcggagacagttcgccgagtgggcggtgtctatgacgttttctgacgtgttacgtcacggtgggcggaagtcgcggccgctgttttgaaatcgggccgcggggggtctctcaagctggttccaacgctgaggccccacagcctcccaattccgggcagacccctgacacctgctgtctggccccttccggcctgaagctgcagccgcgccatgtccacccctccgttggccgcgtcggggatggcgcccgggcccttcgccgggccccaggctcagcaggccgcccgggaagtcaacacggcgtcgctgtgccgcatcgggcaggagacagtgcaggacatcgtgtaccgcaccatggagatcttccagctcctgaggaacatgcagaaactcaaacagaagaatcaacagctgaaacaaattatggatcaattacgaaatctcatctgggatataaatgccatgttggcaatgattccctcaagtattttttccctgtgaagaagattatttatctgcttttattttagtcactaaaactaaagtttttatttttacattgtgatttttacattaaaatattaactttttttaatgctattttatgaaagattattgtaataaactttgatggggtttgtattttggttaatcttcatgaattgaataattgtttttttaaagcaaaataaagttttttaaataaatgt

SEQ ID NO: 198334 - DNA, 1392 bp, Homo sapiens
cttacagatactgggaaaactcaaagaataaaacatctgagcagggaccaagagcaatcggggagtccgtatcatgtcacagagaagcgtacaagcttaggaatcttgttttctgaattcgaatcgcaggttgccagttacacctgtatgcgactcaacaagtactttaacctgtctcttagctgttatactacaaacctcaggcttgttaagagaaaatgctccgcaaggaactaaacacagaaggttctaacgctgagccaagactgggaaacgaactctgggaactcaccccaggctccccaagaacatcgcccctctggctggagcgcaattggtgattggctacttaacccgtccgtcctttcccgcccaggggtccaatccaatccagcccggctccgctcggagacagttcgccgagtgggcggtgtctatgacgttttctgacgtgttacgtcacggtgggcggaagtcgcggccgctgttttgaaatcgggccgcggggggtctctcaagctggttccaacgctgaggccccacagcctcccaattccgggcagacccctgacacctgctgtctggccccttccggcctgaagctgcagccgcgccatgtccacccctccgttggccgcgtcggggatggcgcccgggcccttcgccgggccccaggctcagcaggccgcccgggaagtcaacacggcgtcgctgtgccgcatcgggcaggagacagtgcaggacatcgtgtaccgcaccatggagatcttccagctcctgaggaacatgcagctgccaaatggtgtcacttaccacactggaacatatcaagaccggttaacaaagctacaggataatcttcgccaactttcagttctcttcaggaagctgagattggtatatgacaaatgcaatgaaaactgtggtgggatggatcccattccagtcgagcaacttattccatatgtggaagaagatggctcaaagaatgatgatcgggctggcccacctcgttttgctagtgaagagaggcgagaaattgctgaagtaaataaagttttgggagaagctttttgatttggcttttgttattttttcttcaaacatgaaaatatttaaatatttgtgtgcctgctctctgacaggcattgtcctcagtaccagaatttcttccatgaagcagctggatgtgttgtcggctatatactcatttcacatgagtggacaagtttcttcttggagaacataagactccagtggaaacaaagcagcacctgtttcatgtacccatttcatgttttgatgaatatttacagaaacaaaagtattgtgccatatttttaatacattggcatttggttgtattaaataagttgctttatagatctgtgt

SEQ ID NO: 198335 - DNA, 880 bp, Homo sapiens
aggagataagcaggagaagaaggaaaggcccaggcaggaatgaaacaggccatgaatgttggagtgaagccactggcctcctcgtgctaagcagctactgtgagttctttccactcccccaagacattgcataaataatgtcactttctgacaccccgctgaatgtcctgcttattcgagatatgcaggacatcgtgtaccgcaccatggagatcttccagctcctgaggaacatgcagctgccaaatggtgtcacttaccacactggaacatatcaagaccggttaacaaagctacaggataatcttcgccaactttcagttctcttcaggaagctgagattggtatatgacaaatgcaatgaaaactgtggtgggatggatcccattccagtcgagcaacttattccatatgtggaagaagatggctcaaagaatgatgatcgggctggcccacctcgttttgctagtgaagagaggcgagaaattgctgaagtaaataaaaaactcaaacagaagaatcaacagctgaaacaaattatggatcaattacgaaatctcatctgggatataaatgccatgttggcaatgaggaactaagctgatatttaaatttcctgctttacacatgttataccattgttttttccctcaagtattttttccctgtgaagaagattatttatctgcttttattttagtcactaaaactaaagtttttatttttacattgtgatttttacattaaaatattaactttttttaatgctattttatgaaagattattgtaataaactttgatggggtttgtattttggttaatcttcatgaattgaataattgtttttttaaagcaaaataaagttttttaaataaatgt

SEQ ID NO: 198336 - DNA, 1047 bp, Homo sapiens
cttacagatactgggaaaactcaaagaataaaacatctgagcagggaccaagagcaatcggggagtccgtatcatgtcacagagaagcgtacaagcttaggaatcttgttttctgaattcgaatcgcaggttgccagttacacctgtatgcgactcaacaagtactttaacctgtctcttagctgttatactacaaacctcaggcttgttaagagaaaatgctccgcaaggaactaaacacagaaggttctaacgctgagccaagactgggaaacgaactctgggaactcaccccaggctccccaagaacatcgcccctctggctggagcgcaattggtgattggctacttaacccgtccgtcctttcccgcccaggggtccaatccaatccagcccggctccgctcggagacagttcgccgagtgggcggtgtctatgacgttttctgacgtgttacgtcacggtgggcggaagtcgcggccgctgttttgaaatcgggccgcggggggtctctcaagctggttccaacgctgaggccccacagcctcccaattccgggcagacccctgacacctgctgtctggccccttccggcctgaagctgcagccgcgccatgtccacccctccgttggccgcgtcggggatggcgcccgggcccttcgccgggccccaggctcagcaggccgcccgggaagtcaacacggcgtcgctgtgccgcatcgggcaggagacagtgcaggacatcgtgtaccgcaccatggagatcttccagctcctgaggaacatgcagctgccaaatggtgtcacttaccacactggaacatatcaagaccggttaacaaagctacaggataatcttcgccaactttcagttctcttcaggaagctgagattggtatatgacaaatgcaatgaaaactgtggtgggatggatcccattccagtcgaggtaattttttgtgatagagggaggatgaatataaggtgtgaactagtgtcaagacagttgttaatctttttcctctctctcctgttttagcaatat

SEQ ID NO: 198337 - DNA, 625 bp, Homo sapiens
cttaccattacaactttgattctgcttgctatggggccacgctcagattaaaagtaatgattttcatctttgccttataaactttgttaactctagttaaccgatataagttaattcttgaaatatttatatttcatctgaaaaattctggcgtatatgagttcatatttttttacttgtgataaaaatctcagtcaccttagggatagaacttccagagtgcctttcaaagcgatatctcggctttttatctcctgacaggttaagagtgtagagttttgtcaattattcatttgaaggagtttttatgttttcttttaatgtgcttcttatattggaaaaaaattcatgacccaataattgaggtagtgtctggtttgtgtcataatatgcaaatagcaaaatggaagataatactccagcctgataacatgtgtgatgtatgtggtgatggtgaatggtaagggttgtgtctatgtgctgatctggggaaactgctagaggaataatagagtcaccaaatttgagcaatatgaaagtgtaaaatctgaatcaagtacgttgagatcaaagttagcagtgactggcaaggaaatgaaagaaaataaagcgacataccaaataa

SEQ ID NO: 198338 - DNA, 479 bp, Homo sapiens
catccctgataatcagaatgagatctttttggtgcagttgatgctggtgagaggacaggcccaaagggaccttctggctcctccagtcaccacctgatgacttaaactatgagcatccaatgccttatctgtgccatgaaaatgatattggcacttctccaggtgtggcagagaagctgttagaagatgatgtgcataaaacagcatagcacagagccttgcccaagagtgggggcttaagagcaacgcaagaaggaaaaataaataaacaaataaaacatctgattgcagttagtactccacctccaccccgttcacaatttctgaaaacacgctagatactggcaaggtggagtattacattttgttgaatctaagaacgcagaatggttctgatcagggagatggaaagagaaagctaatcagcaatgacaagtaaaaagtgtatgcagaagacagagcggagattcaagtctcag

SEQ ID NO: 198339 - DNA, 651 bp, Homo sapiens
ttgtatagctgtctagagttcccttcggatattggaagcaagatcgtgatcgtcctatgggattgcaggtgactagccccaaatctcacactgtttctattccaagtctttttatcaccacttgcaattatgttttccagtttggcatgagatgtcagggcagtgtagtattttgggctgttctgagtaacagaataaccagtgtttcacagttcatctttttcaaaatatagtaaaatactctttccaaagaaataccacataagtgcttggtttgtcattgtttagtaagggagtgtgagatgcctcattttgtgtgattgaagaggcctgttcaatgctcgtgatgatcttgcaattgattcatcccacaagcattccctcttgattgaatgccagagacagtgccagacatgctgcttggcattgagagggacagagaaggtgacctgggatggggaaggctagggagaggaggctggccccctacagacttagtgacacgccagaggtcactttccaagaggaaattgcagcaccatcttgacgtatcctgctcctcatttcagcgtcaagtgctgagcacgcggctgcaagaggcctgtgagtgctgtgagtcctgtccaattcctgagagatggactttccttg

SEQ ID NO: 198340 - DNA, 412 bp, Homo sapiens
aggaagttttaggtgccaagataactgctagatcattgaaaaactgcagctggaccaggcctactgcaagcagcttccacagctgatactggggaatgtagtgatacccagaatcttgcagatgccggaaaaagtaaagccccaaagggtgtgatggctctccctggctttgagagctcctaggtctgtgaacactgaaaggccacagctcttgttttatttttgtcttaccacaatgtgataagcaaggggaaacttttatccctgtttgtgttccaggtcattcagctctgccattcagataatctcaaattatgtttctgcttccaggaagaatgtggttcatgctgccatcagccctttcacttgtttctgtagagataatccctgtgctggttatggcaacagtcat

SEQ ID NO: 198341 - DNA, 372 bp, Homo sapiens
gcatgttagtatattcgattatctgctgcttatatgactgtacatgtctgtgaaagtacacagaactgtacacctaaaaagggtaagtttgatatgtatgtaagattatacctcacacgcacagtgctcatagaacgacagagaagggaatcttgaggggcaacagtacatcggtggatggatgggtgggtgaatagaagatgaattgatgagtggatgaatgggtggttagatgggtggatggatgagtagatgaatagttggatggatgagtgaatggataaatccatcggtgggtgggtatagacaaattatatatccttcctaggtatacttcaaagtgagctgatctattccaggaatcaaaataaa

SEQ ID NO: 198342 - DNA, 577 bp, Homo sapiens
agaaacatgcttcaaatgtatcctggagtgtctagcgcgactcagtgtctctgcacacgtgattccgtccattctcacttcttcacggagcctcttccttttaccctctggctctcagcacagtgtgtgtgtccccttcactgaactgccctgacagctggcactgtgctggtcttgtttatcctgcatgcacttggcctaacattaagtaactgttcagttaatatgtaatgaataatggaatgagctcctagatgcatcttcccagctaatttctgtaaaggcagaaacaatttggtgtttatgagaacttcaagaatatatgcagccaatcttgaaatcaaactgctcaaacagtctgacaatagccatggccactattctccatcatgctgttccatttaaaaaggacttacacacgtttctatctacttctcacactaaccttgtggagtaggtgggattatcctcattttcaccagtgagaaaacagaggctcatgaaagagaactaatctgctcaaggaaaatgactatacctgcagttctaaaccagggaaagagctgtttcggtgttg

SEQ ID NO: 198343 - DNA, 410 bp, Homo sapiens
atcagcacagattgtggaatgtttaggaccatttcagttcccaaagaaagagcccctgaagagctcatagaaagggctcgcaggagagtagagaaggaccagggagtgctggacacttctaacagtcacaggtgctgtgacttctaacagttgcaggtaaacagggtcccagaccttcccatctgggactgatggattgattgtgaagaatatatactcattccacaaatttaaaaagggaattaataatgaaagacttaagtgtaaagtagagcacccaagactctgctcggaaaggtagacgcaaatgataaccacataggtaaatcccctgcatgtggctgggaagagagggtgagaagtagtctatctatggttagtggccattttctctagttcacagaccatgc

SEQ ID NO: 198344 - DNA, 604 bp, Homo sapiens
ataaatgagattatttaagacttcagtgatgctaaactataagtttgaaaaatttgaggaaaaggagcaatatgaattaatggaaaaaattatctatttgatttaattcaagaaaacgacttttttaaaggaagaatgacaaaacaaatgatttaacaccccacctgtagcatagatgtgaggaaaagtatagcgttaatatatccagtgataagtttttgataaatattacatcttgcttgtaaggtcagggtatataattttacctgtgtgtcagtttaccaaaagattcacataagattaaatattaaattctgatatttgtctttatatttcactaaatcaaatagaatttgttttcaagctacaaatatataatgtttttcaacttatttttcatattttatctgttttttgttctataaacataaccagacatccagttttaattcttgtatcaaatatcctgcaattgttaaatataatttaacacttaatattttaaataatatgatttctatataatttgaaatatttctaattatatgtaagagtcaattttgtaatgaatttatagctaataaataatcacaaaaacttaatc

SEQ ID NO: 198345 - DNA, 357 bp, Homo sapiens
tctgtttctccctttagtttctgttggttttgcttatgtattttaaggccctgttattaagtacacacatttatggttcttataacttcctggtgaattaaatttttagcattttgaaatctctttttctttagataaatactctgtcttgaagtctgttttatcatatgttaatataggcactttagctttcttatgcttacagtttatataccttttcttttcattcatatgctttcactctgcctttttttacgaagtatatctctcgctttgcatgaagtaagattcatgctcagattctcaacatcatttagtggtggcccaagtcatatttgttttaatttgccttttaaa

SEQ ID NO: 198346 - DNA, 635 bp, Homo sapiens
cccacgttggtgatgctgaggtggtggtggggatgatgatggtggtggcgatgttgaaagggtggagaagaatgtgatgacagttatttctacctttcactaaatatctgcacttcaattcctgacctcactttatcctcacaacagctgtgtgggggaaagaatgcccagttcacagacgagaatactgaggctcaaagggtttgtgtaaaggcagtaagaagtagagtaagaattcaaactcagatctacgcaacttcagagcctgggagctcaccaccatgccattataaaattgtgttcctgagatgatggtgaaggttgcatatccccagcaaactgctagaacatgttattcaccagagagctgtgagcacataagaaggaagtggtgatcacccggtgccagtgctggtgtgctacaaacatcatagaccagcttgtctggtttccccttttgatgaggttccttagctggtggaccaggagcacagctggagttgtgatttcaacatgctttacatagacacagctttatgtattatacatatgattaaaaattatggcggaagttttaaaatgaaaaccaattcacccacctctgccaacaaatcacttttcacgcctctttcccc

SEQ ID NO: 198347 - DNA, 331 bp, Homo sapiens
agagctctctgtaggaaacacagaatatataacaggaaaataaatagtcaataattacacccctcagagatcacccactcagagataacattttctctcagtctttcagaaaaactaattttacaaaaagtcctggaaactgcctttttaaacaaacttgtgtcatgagctgttcccatgtctaaaatttcattagcttttttttctacataatggtctacatataaacataccataaattatttaacattttccctgttgctggatggtttcaacaattttgatcttagtgtagataatgctggattaaatatctttgtacctaaatctt

SEQ ID NO: 198348 - DNA, 379 bp, Homo sapiens
acagcagcagacctaaagctggacaatgaccagcatcaccttcacctgcccaaccaccagcagtagcctttctccttctccagcccaaccccagcccagtctctccctttggtctccatccagcccattccttcacagttctgggtcccaacaggaacatttgttatgtatacgtaactctaaggctttgaggaggctggaggggtttagcaatgagctttttgtttcttttgttcccctctgtttgccccctcatagacgcccatgataaccagcgctcagcctcttgttttctgcgttgctggcttcagctcacatgagggaaactgaagatccaaagatagcgggagtactctacatcaatacatcaaaggaaagg

SEQ ID NO: 198349 - DNA, 563 bp, Homo sapiens
tctcccaacgtgctgggattacaggtgtaagccaccacaccaagccgctatttatttatttttaattttttctttcataaattgtgtagtttccacatagaggtcttgtaaaatttctactgtgttcatttctagaaatgttatagtttgagttgttattgtaaattgaattgttttgtattacatttttataattggatattgtcactatgcaggggaataatatttatttgttgttcttattttaatctctattttgttgctatactcagagtttctaatataaacacagcatctgccaaaaatgttaactagttcctttctttcttttttaacttcatatctaatccctaattggatagatttttgttactattctttgttaatgtatctatttatatttttcttagtttagaaaacatagtctctattatttatgtatctttaactatgtgtggacattatttatagcctgataacaggatgaaaattattttataatccattggcattagaaaaaaatgtgctcttttgtttcagaataaagtttggcataaaaatcc

SEQ ID NO: 198350 - DNA, 473 bp, Homo sapiens
cataaatatgcatagatattaacttctctttaatattctcttaagctggccaggtgtggtggctcacgcctataatcccagcagtttgggaggccgaggaggtgggtggatcacttgaggtcaagagttccagaccaccatggtcaacatggtgaaaccccgtctttactaaaaatacaaaattagccgggtgtggtggcacgtgcctataaccccagctactcaggaggccaaggctggagaatcgcttgaacctgggaggcagagtttacagtgagctgagatcgcacccttgcactccagtctggccaaaaagagcgaaactccatctcaaaaaaaaattcttttaagttctcttaatatctcttaacattaagttctcttaatatctgtgcatgtttctgtttagatattattacttaatgatttcatgatgcctctacttcacagcaaatttattcatccaaaaaata

SEQ ID NO: 198351 - DNA, 435 bp, Homo sapiens
tgatatttatatttttaatgagagaaaacaaactccagaatttgggaactgtttttccggttttgctttatacctcttggacactccttcgaaggactggatctgaggggcattggggtgcgactacggtggacaagggatgattaattttcatccaaaaatctttggtggattcccccggctctccagctcaccagtctaacagtagtttaaaacagaagatcagcaacgtttggagagtttttttttctttgcgttttaatgataaacttgatttattcaattctattctgaggttgtctttctatattttgagtataaaacgatggccatactatgttggaaccactaaggttcttctcttcacttgttattcgtaaagtctctttgtaatctgagaatttcctgagtaaactgggaactgttatacataat

SEQ ID NO: 198352 - DNA, 791 bp, Homo sapiens
gaatgaagctcctaggtgcctcggtcctctcgccatagagcagggaacacagagaaaagggattttcctgtctgccgctttggttccgcatcagtagaaccccatgggaaagtctggactggtgagagattctctctgctaattccaataaatggctttcttgtctagaaaggaatcatgcaacacggtgtcgtctgggacttagagttatggacatgtgctgagctgggctagcgtaagcttgcacctcagcagataaaaatgccaaataacatacatttaaaaaatacatacgtagttgggcttacaagaggaagaaaaatccatagatgtctgaaatgattaattgaaagccagaatggggagatctcttactgaagcagttcccagtggaaaggtggcttggggtaaggaatgtctagaccagacctgaactgggcccacaggcttcattcatcagacaccagggcaggagagaaggccataaggatctggctctgagaaccctatgctaagctatgatcttcagtaaaaagaaactacaaaatctcctactcattcgcaaagggcaatgacctcagtaaaaagtgactatgcaatctctaccctccagctcagggagctggcagggatgtttgtctttacttggagttctgggtgggagaaggctcccatgagaaagcaaaaatctgcaaggctgtgttcaacaagactttggtgtccaaaaatatactatacacctgatgaagcgggacctcaatctagaaatgggtctgggccacgatcctcat

SEQ ID NO: 198353 - DNA, 606 bp, Homo sapiens
  misc_feature (14)..(14): n is a, c, g, or t
  misc_feature (17)..(17): n is a, c, g, or t
aggtgacctagagnatncagttccttctctaaatcttctcttaatctactaagatgcattgctttcatcttcctgacaaaatatgcttcattcttctgatggcctatttgtctttatacctgatgcataagacataaagctgtcatcttgggactttccctcaccatcattctggcctcactgtcttactctcctacatgtgtctcccaacctgggtgtatgtcctgggtgtgttgccctgatcttccactttattggtttaatttcttgttttggtgaagatggtaagttctggacagcttagttagggaaccctgatgttactgcatttaggttttcctcctggactgatcaggtaagattcttccaatctcctgtcagaagagtcaaagtctgctattactattttggatctgggtcaagcgagatagtggggtagagagaggtgggcattcaatatgcatgcattttcttaagctggctttgttcagtacagtgctcccaacttcaactctgcttgggatccccaagcaggaaacctgttctctctctcctgtgaatatgcttcctggaaagagaagggaaatagaagcggtagtgtacctt

SEQ ID NO: 198354 - DNA, 1192 bp, Homo sapiens
tctcctcatactggtttggaaattatatattttctttgcattctttcagtagttgccattaaaatatttttagttgaatatttcattatattcccattccatctttgtttttatatttagattttatttcaccaaaaattttaaaaactcatagttgaaaatatcaaatacttcctcatgagccttatatccctccctccttcccctgaaacaatcatttacatttcttttactggtcatgttggtatctacttccatgtctctaaaaaacattcatttctcaatttcttatatttctcaattttccagtttttggtattatctattgacttcccactctagaaaatgactgctcccaccatatatgtgccttctttcctcttcacgccctcacaatacagtcattttatgtttgcgtttgatatcaagcaatatatttacattaatgtaactatgcacaaactgttcacagctgagccatgtaggaaactatgataaatttttctttcctgagcagctttttgcttgccctggagctaattatcttgttttaccatttgcttagttttctatgtacttatcactaatttaatcccaaattatttaccagttctctaaatcttctcttaatctactaagatgcattgctttcatcttcctgacaaaatatgcttcattcttctgatggcctatttgtctttatacctgatgcataagacataaagctgtcatcttgggactttccctcaccatcattctggcctcactgtcttactctcctacatgtgtctcccaacctgggtgtatgtcctgggtgtgttgccctgatcttccactttattggtttaatttcttgttttggtgaagatggtaagttctggacagcttagttagggaaccctgatgttactgcatttaggttttcctcctggactgatcaggtaagattcttccaatctcctgtcagaagagtcaaagtctgctattactattttggatctgggtcaagcgagatagtggggtagagagaggtgggcattcaatatgcatgcattttcttaagctggctttgttcagtacagtgctcccaacttcaactctgcttgggatccccaagcaggaaacctgttctctctctcctgtgaatatgcttcctggaaagagaagggaaatagaagcggtagtgtacctt

SEQ ID NO: 198355 - DNA, 508 bp, Homo sapiens
aagaccagagaacaccacctttttgtgattatggggctgtccccaaacctgtcaggaaggcggatgacatggtctgcagctgttcacctcctgtggactgccctgtttcagatctgggttcatggagtgtttcacctgcctggctgaagaaggaacgtggccgtacttgtgaagctaatagtgagaggttcatttgtttaaacagcagttggtggaaaagcatggaatcaaggatctttacacgtacatattcaaaaccacttcacctcgcatcttgcatccatgtagccccttcacgctcacaatttttcctctcgtgatgtctattctcactcagggccaactccacgggtgtgcgaccagtgcagcatcccagggtctgcactcaggaggaggtaagggttggctgcatacatctcatgcacccagccacgaaaggggccccgggagcccgcgagaggctctctcctccaggaagtacccctctgcccaagggcacgatgttaca

SEQ ID NO: 198356 - DNA, 628 bp, Homo sapiens
tttcaaaaagagagagagagagagatggacaacagaagaagggttgacacctgtacagtgggtgtcctagaaagaagaaaaaataaagagaggagagaaaatatttggagagataaatgtatgagaactccctagaataaaagaaaaaaataagacatcagaatcaaagggtcagtaaagtgccaaataagataggtaggtggaagaaatcattatttagatacattttggtgacattaaagaataaagacaggccaggcgcagtggctcacgcctgtaatcccagcactttgggaggccaaagtgggtggataacttgaggtcaggagttcgagaccagcctggccaacgtggtgaaaccctgtctctactaaaaatacaaaaattagccgggcatgggggcaggcgcctgtaatcccagctactcaaaaggctgaggcacaagaatcacttgaacccgggaggcggaggttgcagtgagccaagatcgtgctgctgcactccagcctgggcgacagagagagagactgtctcggaaaaacaaaaagaaaaaagaagaacgatgacaaggataaaaagaaaaaagaatgaagacagggataaaaagaaaaaccagacttccctccaa

SEQ ID NO: 198357 - DNA, 150 bp, Homo sapiens
gggaatgatatttactctgtttactatcaatgtgagcacggacatgcggcatcatcgagtgagactggtgttccaagattcccctgtccatggtggtcggaaactgcgcagtgaacagggtgtgcaagtcatcctggacccagtgcacag

SEQ ID NO: 198358 - DNA, 457 bp, Homo sapiens
caccatagagctgaagtctgtagcctagtcaagttgtagccattgtaacatcataacacaacatattactcaggtgtttgtggcaaggctggtataaacaaacctactgcactgccagcggtataaaagtattgcacatggctggacgcgtggctcacgcctgtaatcccaacactttgggaggccaaggcaggcagatcatttgaggtcaggagttcaagacaaacctgaccaacatggtgaaaccttgtctctactcaaaatataaaaattagccaggcgtggtggcgtgtgtttgtaatcccagctacttgagaggcgcgtgtttgtaatcccagctactggagaggctgaggcaggagaatcgtttgaacctgggaggtggaggttgcagtgagccaggattgtgccatgcactccagcctgggcgacagagcgagactctgtctaaaaaaac

SEQ ID NO: 198359 - DNA, 281 bp, Homo sapiens
ttttttaataattatataactatacctgtattttatgtaaagatatctattccccgaacctttattttttttcataaggactttttccggtttgacctgaacctttttatttaaactaagtggccacccttacttcctcaattgtttgagattttccttttttaatcccaacaattttttttttttttttttttttttttttttggagatcttctctacttcctcgtctccttggaaatttttttcttacagtgaatctacaagtgaaaagttggacagta

SEQ ID NO: 198360 - DNA, 135 bp, Homo sapiens
tctcatttatgtccttttaagaactaaaacataccactgtaaaacaagaaatattcaatataatgtcaaccataaaaattctttcagaaacatagtagaaactgggttcttgaggaagccatgatgaaacggctt

SEQ ID NO: 198361 - DNA, 637 bp, Homo sapiens
gaaaaaaggataagtagaagatcctgattaccttttagtcatagatagtttcattatgttatcttttagggtctggaatacactgaccagtgtattagacaaaattttatgagaattggttaaagatatagggaagaaatgtatttggaaaaaaacaaaccaaaccaaaccaaaacaaaacaaaaaccattattttgagagtaaatacttggggggaagaagcttgcaagccacccgaatatggcctggactctggcgtgtgtgtgcgtgctggggagtatcttggtgttggactctggcatgtgtgtgcgtgctggggagtgtcttgatggtgatgttgtgtcattgcttcatttttggcactcagtcactactcaagaaaaccagattgaaaatttggaatctgtgcttcagtggattgaaactggcctccagtcactaaggaaaaaatcaaaacaaaacacacaagaatttagagagaatatttttctgccaaaaaataatttttcctttatgctatttcttatttgggtcaatactccaatggaaaaaatagatagattggtcaagagttcaatataattttctgtgacatttgaactaaagtaactcataaaaacttaaacacaggaaattg

SEQ ID NO: 198362 - DNA, 417 bp, Homo sapiens
ttctttttgagatggagtctcgttctgtcacccaggctagagtgcagtggcgcaatttcagctcactgcaacctccgcctcctgggttcaatcaactctcttgtctcagcctcccgagtagctgggactataggtgcatgccaccatgaccgggtaatttttgtatttgtttagtagagacgaggtttcaccatattcatcaggctggtcttgaactcctgagctcagatgatccatccacctcggcctcccaaatcagtttgatatttcaatagtcagaaactacatggaagggaaaggaggtagctgttatagtctttctgatgaataacatcttaatcatatgttaatgcatgaaagaaaatgggaactctgacaatgccaactttatcaaaccaaaaaaattccatcagctac

SEQ ID NO: 198363 - DNA, 161 bp, Homo sapiens
aggatgaggggggtgcaaattgctttgcttcttgtggtagaggtaaatttttaactttttggaaattgaaaacaacttcttaataataaggaacttgttttatcttcttattgccagtttcaaatcctttgaaggctatcatatatatcaatagagctgag

SEQ ID NO: 198364 - DNA, 88 bp, Homo sapiens
agctgcccgtgaagacagccacaccacacaccgcggcctgtgggtcaaacctaacccacaaaggtgttttgttggatccattccatgt

SEQ ID NO: 198365 - DNA, 349 bp, Homo sapiens
aagaaaaatagatgggaaagggaaagaaaggagcaatttgacaactaaaaatagttgggaaaagataagaagaaacaagtgagtcttagagcaaaggagtgaatggagccaacagatctctgttgctctttgctcagatggggtaggccttggctctgccaatgagtggtgtaaagtccaaatactgtaagggaagaggacgtgcgagcagccatgaaatattcctttctgagaaactaggaaactggacaagacccctccggatggtgcccaggatagaatgtgacttgaaaatgacaaagagcccaaagtgcagtacttctttaacctatttaagaatgttgaacaa

SEQ ID NO: 198366 - DNA, 592 bp, Homo sapiens
aatctctaaatagcttgtgggaaatgaggtagatagtattagcaccgttttgcaggttagcacattagggcagaggtagatgacccaaagctctgtgggagtctggctatgcctgccttgtgccctctgcctaacacacttttgcccagtgcttggggctcaatgaatggtgacttattcaatgacaatggaaggtgatttgtgcaaggccaccagtaaattagtaacttagtaaaagttagaatcaaggatgctccaacggttataacaagtcattgtatttccaaactagctggaaaaactaataaaatgttgttggggggggagcactaaaaataaatgggaaaaggaaaatcaattgaaggatgtcacaatataaaaggttaagattcacaaatgtgagatcaattctaagataaatatcatttaatattcagagaacatattacttgatgggtgtaccatggtttactcaataacctactattaaacatctactgggctacatttttgcacacagacctacctatttcacaatcggtcaaaagggccttgaccattctcagttcccacaaggtagaactttcagaat

SEQ ID NO: 198367 - DNA, 786 bp, Homo sapiens
atttagtgttaatcctgtgtatattacatatacacagccaactggaccttcttgtactccatcaccatctcctcgagtgataccaaacccaactacagtttttaaaattaccgtaggccgagcaacgactgaaaatcttttaaatttagtggaccaagaagagcgctctgcagcaccagaacctattcagcccatttcagtgataccaggctctgggggagaaaagggaagccataaatatcagagaagttctagttctggatcagatgactatgcctacacacaagccttgctgttacatcaacgagcaaggatggagaggttagcaaagcaactgaaacttgagaaagaggagctagagcggttgaagtctgaagttaatggtatggagcatgacctgatgcagagacggctcagaagagtcagctgcaccactgcgatccctacgcctgaggaaatgacaagattgagaagcatgaacagacaactccagataaatgttgactgtacactgaaagaagttgacctccttcaatctagagaagtatactacagcagaagctctcttaaactttcatttacccaactcaccagattagagatggtcttcattttctgtggaaaatatactgactgatgtccacagctgctgcatacttttgactagtaggctgcattctggaaactttgatccaaaagccatgaataatttttatgacaacatagaacctggcccagttgtactccagcctggacagcagaacaagaccctgtctcaaaaaaaac

SEQ ID NO: 198368 - DNA, 255 bp, Homo sapiens
ttccttttggttttcttccttgacccattggttatttagaagtacattttttacttcccatgtatttgtttgtctattttttcttttattgatttctgatttcatgccattctgatcagagaacatactttatattatttgaccctttaaatgtattgacgtttgttttatagcctgcctagcaggtggtctgtcttagaacgttccatatgtacttgagaagaatgtatattctgttgttgaaagtgttctata

SEQ ID NO: 198369 - DNA, 304 bp, Homo sapiens
gttgggttgtcttttcctctgcctgatatgtgaatgtgtaagtgtgtgtgttgaaaatattatttgcaaaatctgttgagacagtttgaggcctaggatgatgacatcatcctcattagtagactgaagtttgtttctgcctggtgcttgggggccctagcaatgagtcatcacttcagttctatttcaaggattacagagtcattagaagcagagctgcaattgttgagggtccatttattgtggagtctctttttttccctaggggttgcttccagatcccaacccacatttccctccttct

SEQ ID NO: 198370 - DNA, 307 bp, Homo sapiens
tgatattcatctcctccagtgtgggggatgttttcccctctctgacactgcacaagctggtttaggaggtcctgggcaggcactggcagaaggcaagaattatcttttcagtttttctcaatcctgctaacaatgcccaaagagaaagtctcagttcagtgctattgtgtcattaactcctctctactgcttgctaataatctgtccttgtaacagagtagacctcagagtcagacaatcttagttttctggaatttagtaacactattactaagtaaataaatgaattatttatttatttatttat

SEQ ID NO: 198371 - DNA, 556 bp, Homo sapiens
gcgcaatcatggctcattgcagcctctacctccctgggcttaggtgatcctcacacctcagctttccaggtagctgggactgcaggcatgtgccaccacacctggctaatttttgaattttttgtagagatagtgttttaccatgttactcaggatggtctcaaacacctggactcaagccatctgcctacctcagcctcccaaagtgctggaattatacatgtgagccctgtgcctggcccgttaaatctttttaaaagttttttaaagtttatgtacatttatattgctttttgtcttcttcaccttgtgtttttcattcaatgttctgtttattatatttatctatgtttatatgtatagctctaattcactgctacataaaattacattgtttgaatatatctaaatgtatttatttttccattttcctcatgatatattaatagaatgtttcctttttttaatttttacaaacaatactactgtgactgtgaatgaaaagatcaatggattcaattatattaaaataaatactgtaccaaaaatatcttat

SEQ ID NO: 198372 - DNA, 570 bp, Homo sapiens
cagaagtacaattctttttgtataaatgaatataatagtgtcttttcagtacaattgggcttcttaaatatttgaatacagtatatacgaagtggtggttttataacatatatctgccctctgctggtgaaaatgcgttattgctgtgaatttaacagctttagtaatttctttgaatgtaataatactctgtaatttcaaaagttgtcataaaactaaacttgggaaaaaatacccttatcatttgaaaggaacattctctttgggacagttctgcacaatgaattattctgcccaaaatgccagtagtgccctgtttgagaaatattgacctaatatactgatgatgatgatttttacattgtggctgtctctctgtgttttttttaagtttttctgtaagttctaggtttgtcctgtccagtgtggaagtcactagccataaggctatttaaccgaatttaaacattcactttcttaattccagtagcctcatttctaggcttaatagccactgtggctaggagctaatgtattggataatgcagattatagaatgtttccagcatc

SEQ ID NO: 198373 - DNA, 354 bp, Homo sapiens
aaaatgtctaagcgtggggctaagtcaggatgcagagttcatcaaaaagtccaggaataagcaatggcccaggcatgagacatttcagtgaacagctgaagggacaaccttaacctggcatcagtttacaatgtgtaagatggatatctggtagcatcctaggactgaggacacatgaccaccttcatgtcatcagcccttgggagctcaatcccaataatcaggatgctccccaaacatcttaggcctgtccttcagaaatctacaaccggcaactgtcacctgcttgttctcttcatttacacttccagcttgtaactatcccctgggcatgacaagggctagaggtcagta

SEQ ID NO: 198374 - DNA, 430 bp, Homo sapiens
ggcagaggctgcagtaaggcgagatcatgtcactgcactctagcctgggctacagagtgagactccacctaaaaaaaaaaagttgtgaactactgctttacgcagctgggatgactctcagacctgatattgagcaaaagaagccagacacagaatatatactatgtgagtccatttatataaagttcaaaaaaatatatgtcagaatagcattttatttccagagtgggtagggtggagggatggatattgattggaaagaggcatgagagagttttctaggggtgctgtaaatgttctgtgttttggccagacatggtggctcacggcagtcatcccagcactttgggaggctgaggcaggcggatcatctgtggtgaggagtttgagaccagcctggccaaatggtgaaaccctgtctccactaaaa

SEQ ID NO: 198375 - DNA, 355 bp, Homo sapiens
ccagtggaaagagcaactcagaagactaacgagctgagcaaccatgtatgcatcattttaatttttatttatttacgtattttttgagacagggtctcttgctgttgcccaggctggaacgctgcggtgcgatcacggctcactgcagcctcaacctcctgggctcaagcaatcctctcatctcagcctcataagtagctgggactaaaggtgtgcaccactacaacaggctaattttattttattttgtagagacagggtctcactatgttgcccaggtgtatgcatcgtttagcagtgcttctcaaactgaatgcgcactgaatgacttgaaaatcttgttaaaatgcaggtt

SEQ ID NO: 198376 - DNA, 291 bp, Homo sapiens
attagcagtcctacccacctgcacgaggaggttattttccatccttaaaaccagtattctcccaagatggacggtaatgtagctacaactacaaactcttaaatagacttactccaggcatgacttaattgatttcagaaaaataaacaaaagcaaaacaagcaagagaagatccatgatttcatcacattgacacttggctctaacaattctatattcctattctcagacatctccaaggtcttccagtgacttcgctcatgttccttcttccactaggaataccttttc

SEQ ID NO: 198377 - DNA, 254 bp, Homo sapiens
tacatgcccagcccttcaacaagattgtgtgcggcacctaaaatgttgctagtgaaaggaaaaagggtgacagtttattcggcatctactatgtaatcaactctgtgctacatgttttcacacttcacatgtgtttgtttttaaggctcttctttcttatctttttttttttttttttggaaggtttcgctttgtcttctaggctatagtgcagtagtgcaatcatggctcactgcagcctcaacctcctgagc

SEQ ID NO: 198378 - DNA, 744 bp, Homo sapiens
gcttaaaactcccaaatgtattcccagcgaaagccccagtccccttccaccaatagacttttcattgtcctgggaattttaggcccattttctaacctgtttttacccgacctggactctaaggatagtagccagctaggaatttgggttgtctacaccagatacttaagttggctcctttaaaggaagcagaggttctttgctgaatggttaccccacactgatccctgactatggccctaaggctgggactcttgaaattaattggaatggggtagacagtttcagaactgagcaaagtgtgggtggagaataggtactgactggattctgtttctcagggatggggaacgtactctccggacaatgaaccacaaccaacgccaccaaccaatactcataattaataattacaacagccctggtgcagaagacattgcaccatgaatgcactaagcatgcccgaaacctcatgcaaaaagtttaaaactgaggcgtctgcaggagctgacagggcagggaaaggcacacacaccaagatcaggtgaagtcagcactgagctaatgtcctgttccaggataagcttagttgggctgggtctgaaaggtggaaaccagcacttggaaggtcctggagaagagacaagggcaagagcagagaaatactgcttacctgtggtcggaaattctggtgttttcaaatccatatccccagcctggactcctctctcaattccagaactt

SEQ ID NO: 198379 - DNA, 449 bp, Homo sapiens
ctggttcagttggtttcaagcctgttcaatttgctgtaactgaataaatgcatatagaagacttttggtgtgcagagccctagtaagcatcattgtgttgtgttgcaaaaattttgctttgtgcatattgaacttttccagaaagtcacaacttttccaaagtaaaggcacttgacctagatttatgggtgaggtcccattctaattagtaacatggaatactactgctacatagatatacatcagctgaactgtgatacaggagaagaaaggaagtgagtttacagggagtgaggaaaaatgacaccttatgtatgtgttttgtggagcacttctttgtcccgtctacacacttcacatttatttttacataacctcactacaaactcacgtagaatatatgtagttttgtgttggtaaatgtttaataaaagcaaacaaacaaaaac

SEQ ID NO: 198380 - DNA, 749 bp, Homo sapiens
tgcactccagcctgggcaataagagcgaaactcctgcctcagcctcccacgtagcttggaatataaggatgtaagctaccaatgaattagtcttgatgaaaatttgaaaattactgaaaagttataaagagaaaaaattatctgcaatctcactacccagagataaccctgttaatatttttctgtatttcttttcagtctttgtctgtgctatttctatgtatgagtgtgtatacatgtgtttgtgtgtgtgtgtaataacaaacttgagattatactgaccatatagttatgtaccctgttttttataacctaacttcatacatatttacccatgtctatgaaaatgtgacttttaaaaatggctgcctaatattctattgtatgaatatgccacaatttaactacttctctctttggatattaggttgttctaatctttcaccattataaataatagtgggatagacatccttgtttgtaaaatttcatctctatattagactctttaggatatactcatgtacatggaataagtggtttagacagtgagaactttttaggctctttaaaatatttccaagttataaccctttagaaagattgtactaaattaacaatgtatgagtacccatcattctgccccttcaccagtatcattatttttttaatctttgacagttggttaacataacaatcggttgtttctttgaccattctaataagagttgctttataatggccgggcg

SEQ ID NO: 198381 - DNA, 345 bp, Homo sapiens
ctttagacaaaggagggagagattattaatgaaaccatttttataatctagtttttcgtaatggaaagaattcggcagagaaagattattgtgtttcagctccttaatattgcatcccgttttaactttccttgaatagcaaatagctaaagcggtatacagatgtgttacctttggcttcatgggaaatgcatatttcaagaactttaatcatctagagaagaagtttaccaaactcaaaacagcagtttttgctgtttaatttttcttacgaataagaaagaatctgaaaataaaaaagaaaagaattgcacaataatttagggtattgtccaaaccaaccca

SEQ ID NO: 198382 - DNA, 624 bp, Homo sapiens
tggaaaagcacttcataattttgtcagaaaaaatatgtatcaaagtaatttttcactttgttacaaattcgagtgtgtcaacatctactctatatattaaagtctattcaacacatgcataaataatggaattaataatataaaatataaatgtgcaagtaagttgacaaattgttgaaagttatttgctagaacatgaaagtcaaataacaacagttggggaataccaaaatatcatgtgcttttttatctgtctagggagattgattacttaatccacttctttttaaagcttcatgagcactcaaatatattgtaactttctgaatgaaaagataatatacaatgaatgtgagggtttcatgttgatcttcctattgtcttttaacaacaaaacaacctttcaaacataacaatataaaacaaaaattatttgagtatctagcaaacttctcttggagaaagaaatatactgagacccaatttgctgtagagagtgagattccaaagcatattttagaagaagagaaattaaagaaaaccttaatttccttgcctaagaaataaatgtagaagttccacctctagaatggcaatgtgaagagctccatggatcttttataa

SEQ ID NO: 198383 - DNA, 620 bp, Homo sapiens
atgcttagtgaaggaagccagacccaaaaggctatatagcatatgattctatttatataaaacgtccagaataggtaaatccataagaaggtagactagtggctgccagggactggagaaggggaaaagtggggagtgactgccaatgggtatggaggtttctttttgaggtaatgaaaatgttctgtaatgagatagtggtgatggctgtgtatctctgttaatatactaaacatcactgaactataccttagaaggtgaattttatggtatgtgaattatatctcaatttttaaaaaggatctgggttgaaatggaatgtgatcactatagtggctccacaggccatctttatgggtagtgtgatgtgagttttgggtacaatcacacagctctgcactcagaccctgttttctgtttaataactacaaggaatgctggcacatccacagtgacagggaggctcctcaatctctgccccaaacagggctggataaaaaaccaaagtgggacgctaaaatgtgagtctcatgttggcaactatgtggactgaatgtctttacaagggcaggatggctaaggaaaagaaaccaagttatttagttaagaaaataaagaag

SEQ ID NO: 198384 - DNA, 224 bp, Homo sapiens
agtgtgatggatgtacagagtaatttgtttttgtcctccatcaactggcaggcactcatgaaataagctgaattgtgtttaattaggtttggggctttgccaggcaagtatgatagagaacgaaggagcaagaaaataaataagtaatcagataaaatttgaacttgaagatatttacaaggaagtgagtttactgattgaccatgaaatgaaagccaggcaat

SEQ ID NO: 198385 - DNA, 385 bp, Homo sapiens
tagcgacccatgtcggcgatgtggtcgtgcgcggcgcagtcccagctactcaggaggctgaggcaggagaatcacttgaacccaggaggtggaggctgcagtgagcagagatcgcccactgcactccagcctgggtgacacagcaagactccatctcaaaaaaacaaacaaaaaaactagctgcttcttctgttcctaccttcctacctttagttgcattattttccacgtggtcagaaatctggggattttttttaattaaaaaaatttttttagagacaggatatcgctatgttgcccaggctggtcttgaactcctggcttcaagcagtcctcccactcagcctcccaagttgctgggattacacacatgggccacagtgca

SEQ ID NO: 198386 - DNA, 521 bp, Homo sapiens
agcaagacaccatctcaaaaaaaaagaaagaaaacggggaaagaaaccgtaacactgcggatggagctcaaaaagtaaagctgcttatattaatttcatatgaggtcaaatggttttagatattttaatacaccctgagatcattgaggtgtattagagtgtggtaactaatgttgatagggctattcacattactgtgttcagtgtattcatatgaaggtagtaaagaatgtattacatttgacaaattatactcagggattcaaaagttggttccagaatttactgaactaatatttttgagcatatattgtcttagagcagtatatacatatgtcctggaaatgctagtgtgtccattagcctttaaaaataatattaaaaatatatatccttatttatgtaaatgaaatatgacaaattttttggcaatttttcagttttttggaattgtaagttttcaaactttacattgggtttgtttttatgcaaggaaggtcattttgattgagaaaagtaag

SEQ ID NO: 198387 - DNA, 451 bp, Homo sapiens
gatgtgggtgatctagaaggatcccccagaggcacgaagggaggatgagtaggcatcagtcagggaaaggagagaagggaatttgaggcaggaagcaaagacctcaagaactctgatgagtccatacttactactgaaaataaccaatctctgcctagagaatagaggtggagaaagaggcagactggactagagtagaattccaccaggccctgaccagctgcttcactgaccacatccatcatctcatctcacctcatcctcaccataagcctgagaggcaggcaggacagtgggaaatgcaaggcatagggcaaacagcctgatagtaccagggcaagcccaagtgtcccatccacccaaactgtggccacgagtcttgattctacctccgttctacaagtgggtccgggaatgcatgcaaatggaggagagagaagagacgcaccgc

SEQ ID NO: 198388 - DNA, 667 bp, Homo sapiens
cataaccttaattttattagtttatagccataaatgtattgtgtattagagacaagatagaatttagggaagcctgttagtgcccctaacagactcacagtctggctgaaaacctgattttctattctatacccagaatctctgaggagcagacttagtcaaccaattccaaagagactggtgtaaaaatcagaaaaccggtttgtcatgttgctgattatatttgctccctgttggccaatctatatgtaaatccaaattatagctagaaatttacctagcgagcattccattagatcaagggcagtgctttggagaaccatatggccacaagtcctcttgctgtgatgacatagcctgttatttatggctcatagattcttatgttgtatccattttggttatgagtaatggggttgattaatttttattttgattaaattttgttatatttttcctaacattccaacattcatttgggaaataagaatttctcaaaattcttattctagaaataagaattttcaagtgtgcagtgaaatcaaaggaatttgaaaataaacacctgtatacctgccagttagggtctattaacatcttactataattgccttaccagatatttctccacccattcatccattttttgatgcatttcaaagtaaat

SEQ ID NO: 198389 - DNA, 442 bp, Homo sapiens
gctactatcctattgctttcctaataccataactttacaaaaaaaagttttccataacctctcctctcgttctctttaactcactggaatcaagcttttacctccacctctgaaaatgctgtatgaaggtcaataatgacctctaagttgctaaacagagcagtcaactccgaattctgaccttccttaaatatcaacaatagctgacattgatgatcactctctcttccacaatagagtgatttttctcctaccttactgacaactccatcacagtctactttggtcattcctcctcatcttcactttgataataaagcatcccaggctgggtgcagtggctcaagcctgtaatcccatcacttcgggaggccgagacaggtggataacctgaggtcaggactttgagaccagcctggccaacacgatgaaatccagcctc

SEQ ID NO: 198390 - DNA, 409 bp, Homo sapiens
gaaaatttcagaaataaacaattcttaagttttaaattgcatgccattctaagtaatatgatgaaatctcgtgccatcctgctccatcctgcttgggacatgaatcatctctttgtccagtgtacccacaccatatctgctacctgcccatcagtcacttggtagccatctcggttatctaattgactgctgtggtatcacagcacctgtgttcaaggaatctttattttacttaataatggccccaaaatgcaagagtagtgatgctggcaatttggagagaacaaagcagtaaactgcttcaagtgaaaaggtgaaaattctcaacaaggaagaagaatcatatgcttatattgctaggatctatagtatgaatgaaacttttatccatgaaattctgaaggaaaaa

SEQ ID NO: 198391 - DNA, 176 bp, Homo sapiens
aaattatatttatagaatgaaatcaacctaccaattctttctctctgcccagtctcttatgacattgaatctgtataaattataagctataaactttcaaaattggtggtgagttaaaattttattttctgttttataatatctttgaaaatttcttcatacaaattaaaacaaaa

SEQ ID NO: 198392 - DNA, 143 bp, Homo sapiens
ccaaatgagctgcctctccttcacgctcccgtcgcatcctctgtctcctcttcaatgcccctcacactgaatgttaattgcctcaatacgtgccctgtcccccactagggctccctccgggcagaagccaagtctttttcatc

SEQ ID NO: 198393 - DNA, 598 bp, Homo sapiens
ttatgatgttcagaattctaagtatagcatgacaaaacccttctcctattattttctttaaaatatatataaaaaacttttgctgctttttggtggataataacacacacacatgtacacacacacacgtgcatccccattaccttttaatggaacaaggcaagtcctttaatggggaaacatgcattcctattaccttttaacgggacagtcaccattaaaaatgtctgcagttacgtatttctaaaatcagctctgtgggtaagaaatttaatgtagctgccgattctgtgcggttctggggaaataatagtttacaatcttctaatttgcctctaatttcacttctaactccaacctgtgctcctgaagcaagacgtttttggaccgtcagcaggcagatgaaggcctgagagtggtaggagagctattgtgggctttcctacctcagggctagaggagggcttggagaccggcaaaggaaaagatggaccatttcaagtctcagagcaaaaatactaagagacaaagttgggatggaaaatgaaagtgacgtggcaatcgatagaggaaatttacacaaatctgaaaattctga

SEQ ID NO: 198394 - DNA, 457 bp, Homo sapiens
caagaaaatggctgtaaatatgtaaattaaatttgacctgaaaattagaaggtggtcaagagaaattaaccggtgtctaatgatgattgttcagttaagagttattcactaggggataaatgtcgaatgatttaatattacttccttaaaatgacatgtgctccttgaatttaatgaggaaacggactaatagcacggggaagagatccaatgtgaagaaatcaagttgttcagcattataccaccctgaacactgcactctgtgcatggaaaaataagaatctccctaaatggactgaaggaaacagtaatataaacatagaaattactgtacatatttaaaagataggaaagtcatgtaaacttattatgtattattttttgtttctttgtaaaatccatgaaagaagatgttcctaaaaacagagaaaggtggtcttactttacttaaatagta

SEQ ID NO: 198395 - DNA, 899 bp, Homo sapiens
tgtgtggagagtggacatacctcacctgtgggtgtttactgcccttgtggcctggtcagaggctgcagggtggctcctggacccagatgttgtgagagacccttagtgcactcgtttgatttagttaatatttatgagcagctcctgtatgacaggcccattctgggtgtgagggtgggggctgtgatatgtccagatgctctcacttaaagaaggttctagactcagaggcaagacgttagagaaggttctagactcagaggcaagaggttagagatgggtgagtccatctctttttcagatgagggggcagctcagaggaggagaggggcttcccaaaggtgcacagcaaggtggcatcacagccaggatcgggacctaggaatcttggaacccttccctgcactggccctgggacagccctgggcacccaaggccctgcctccctactggctcccaggagaatttctcaaaaagcagccctccagccccccgcagcctctccacagctcccacctgcctcctcatggcccccagacaccctgcgagccccacctccagatctttttcctgccactgccagggatgagttccccttgtcctgtccgggctggaccctcctgggtgcccagcagagcagctgacactgacagagctttcgctggggccaggcatgcgcattatctcatctcacactcaccacactgaggaaggtctattacccccatgtgacgggggcggaaactgaggcttaatccaaggccacacggctagcaagtggggggcaggacacaagtccagactgcctccctccccaccacaaagtgcttcagcctctccagcagccccttccctcagctctaatgatgttgcactgtttcccaccccgtcgggtggag

SEQ ID NO: 198396 - DNA, 460 bp, Homo sapiens
ctaaacctaaaattaaaattagaaaaaaaagagtctctttctcagacccttccaaaccaacatgtgtgaaacatagtgagttgtccttttaaacttttatcatatcatgtaaaggtgatgtactccacaagtggcaggtatttactgagtgcctgtcatgtcaggcatctgggagagactagggtgaagccaggcacaaaaccacacattcaacagtgaattgcatgcatgatgtattaccattattatagtgagtatgatgaagaacaggatgttttgagagcatataacaggatctcacctgagttggcaattggggaaggtttctgaggcagggcagtgaagccaagaggaaggacctgtaggagaacctttggtgaagaggagggatgggcttttccagcagggggaatggcattgggatgttcccatgtctgaaggggacaaggagttgggagga

SEQ ID NO: 198397 - DNA, 718 bp, Homo sapiens
tgtgctgtgcagacttgtatcctgagagtgtttttctgaacctgtttccaaaacctatagattctaacaacttcaagacttttccttccgcctgtggcattgtggggaagacgtgttcctatggatggataggtggttgtcagccaaaaactgctttaagttagtcaacatctttgccacagaaagcatatcaagagatgattcttcaatggattctatctgtcccagacaggacaaagagttcagtcagacacagctggctgcttctccacagcagaggtgggtgaaaagtgggtagaggtgatgtactcctgtactactgccaggaggtctcagatttggcagcctattccttgggagagttcaggttcacatttcaaattacacagtagggatggatcctgtcaattcttgcttacaagcctttgaagattttctattgttttccaaacagcattttaaaatccttaatatgaaccaaaggccttaaacaaagaggtctccaccatttacactactcttttccaacactatcctccaagttccccaactcctaccatattttagacctcagttaaatgggttcctccagttttccctgaccaacgagcccacataggttaggcagccctgagatgctttcatagcactccatactattcctatggcacatctaccctaactataattatttttatttcatgcttaagtgcttcac

SEQ ID NO: 198398 - DNA, 569 bp, Homo sapiens
aatgggagaaaatttttgccatctactcatctgacaaagggctaatatccagaatcaacaatgaactcaaacaaatttacaagatgccaggattttaaacaaccagtttcttggttgtccgggtcccctcaggctgttactcctcttctgcattcaccatctcagtcctgtatactttactcaggagacctgtataactgtcttgtctatctcctgcttgtttacttttggaggcactcttcttgggcacatctttgacaacagctttgcttggagtttcccaagaatctggatgtgctaacattcatgagggaccctcaggggtcagcattggaagagcctttcaaaatactctagaatcctacacatcttgtcttcaaggggcttttttttttagttctttagttaggacttcataatggagtgcccttgtctaataactatgaccttttttgagcactaatgagttttggcattctgaagctctccccagatactgactagcaccctgggagtttggtcaggttcttggtagaagttcgaccttcccattctctgtttcctcacca

SEQ ID NO: 198399 - DNA, 629 bp, Homo sapiens
gaggagagcttggctgaaggagtgggagtgacagttacacattttttaggcctaaaccacagacttctttgggaagaaaggggttacgtcttcctacaaattcagagccagctgctcatgccatgaatgcgtggtatgacccgatctgagtgtggatcattgaggcggccctcccatggctgacctgctcagctctgacagggcccgggctgcctctgctagccgaggagttactgagaataagttgccgttactcgagccttggtcactgcagcaccttgtcaggcacttcaaatctcatgtcatcctcacccaccctaggtggtaggtgctatcattgttttttggtccctcatgaatctcctccaacccctggcatgtctatttgggaatcttttttccaggaaaggaggcccagtggtgctaggcctctgaggcttcagttcatttaactcagaaaaatcccccgccccatgactcagggagccttccatgcatttgtttcacttaaggaaaatgacccgagggtgagatggaaagggaattggctgttgccaggcagagccctgtgtgtcaggggccagcagccaagtgagtgatccaggaagtcatccaattgcaaccagaaa

SEQ ID NO: 198400 - DNA, 420 bp, Homo sapiens
cgatcttggctcaccgtagcctccgcctcttgggttcaaactattctcctgcttcagcctcccgagtagctgggtctacagagtggcatgccaccacgagcggctaattttttgtatttttttttagtagagatggggtttcactgtgttagccaggatggtctcgatctcctggccttgtgatccactcccaaagtgctgggatcacaggcatgagccaccgcgcccagccagaagtcttgtttatttaacccaccactaacaaatcagagtgtggccttggctgttgatagcagagaataatatttattggcttggtgccattgcttgggcaagctttctaaccatagtgggtaaatgatgccctgtgtcttggcagtcaggcctgggctgctcctctctgggagggggagccccagg

SEQ ID NO: 198401 - DNA, 460 bp, Homo sapiens
ttgtattgggctgacttgtcccagaggcttcaacaggcacagcccagaaccaggaatagtcttgataatattatctaatgtgctctggaggctctcccaacgctcccccaacatcgggaaaagaaaaacaaatttcctttttttacggaatgagtttatagattcttgttctctgtaactagtgacttcaagtattctgttttatctaagaagtacaatgtaagtcatgagaagcctgagtaggctgaactacagctgtttgggcaccatagtgagggttataggataagcccatgcccagggaaacctagaaaatggacatgtgggttgcttggcaacggtcatgtgcaatcctgtctgtcctgcctctgtatccctgctttcacgccactgtaaacttgcttcaagctagcccaccaccttttgtgaaatgtgcataaaagtcaggttctgtctttgt

SEQ ID NO: 198402 - DNA, 333 bp, Homo sapiens
cttgtgtcttttgggtgtgttagacctgggaaacaatctgtcttctcctttcacgtgccccaaagcaggactccaatcttccccgggcctttctgattgggagtcttaagaccctccccagagagggccccaccctgttccctgggaaaggcatgctgacaaaaccctacaggacggtttggagacagggttagttcaactcgtgtgtgtccccagagggtgacaccacagggatgaatgggagttccaggcccctccccagcacctcaacctgcacattgcttcatctggatcctttgtaacatcctttataataaaccagtgaaggtgttt

SEQ ID NO: 198403 - DNA, 346 bp, Homo sapiens
gtggggggtggtcagcagaacggcggtcccagagaccatggggccctcatccctagaacccgtgggtgtcccaccctccctggccaaaggggctctgcagatgggactgagttgagggctttcacacaggggttcatcctgggttatacggatggcccactgtcctggaagggtccgtagaagaggagatgcctggccgggcgcggtggttcacacctgtgaaccaccaacacattaggttcacacctgtgaacctccaacacattaggaggccgaggcaggcagatcacttgaggtcaggagttcgagactagcctggccaacatggtaaaaccctgtctctact

SEQ ID NO: 198404 - DNA, 970 bp, Homo sapiens
  misc_feature (9)..(9): n is a, c, g, or t
  misc_feature (34)..(35): n is a, c, g, or t
  misc_feature (45)..(45): n is a, c, g, or t
  misc_feature (51)..(51): n is a, c, g, or t
gcagagggnagttggggaggagtaagtttagganngcctcggtgnaaaacnatattggcaatgttacgggatccagtgtcacgttacctgagcgagtggaaacatgtccagagaggggccacttggaaaacctctcttcatatgagtgatggaagaagccccaccccagatgagctgcctacctgctaccctggggatgactggtctggggtcagcttgcgggagtttatggattgcacctacaacctggctaacaatcgccaggtgcgcatgctggctgacctcagcctggtgggctgctataacttgactttcatgaacgagagtgaaagaaacaccatcctgttgcagagtgcaaagaacaacctgaagaacatggccttctttgggctcactgagttccagaggaagacacagtttctctttgagagaacattcaacctcaagttcatctcccccttcacacagttcaacatcacgcgggcttctaacgtggagatcaacgagggtgcccgccaacgcattgaggatctaaacttcctggacatgcagctttacgagtatgcaaaagatctcttccagcagcgctaccaccacaccaagcagctagagcaccagagggaccgccagaagcggcgggaggagcggaggctgcagcgagagcacagggaccaccagtggcccaaagaagatggggctgtagaagggactgtcaccgaggactacaacagccaggtggtgagatggtgacctcctgccctctcctctctcaggagggggagggtgagcaggcacattgactttctgttgaggtaccttggagaagctgagccattctgaggacatctggctgtgtgtgcttgatttggacatcttcttccttctttgtcttcatttttatccagctggagattatccgtcttgttcttttttttcttgacattttgcaattggtgatattaagtagggt

SEQ ID NO: 198405 - DNA, 936 bp, Homo sapiens
cttctaggaatttctattacatcacaatgttacgggatccagtgtcacgttacctgagcgagtggaaacatgtccagagaggggccacttggaaaacctctcttcatatgagtgatggaagaagccccaccccagatgagctgcctacctgctaccctggggatgactggtctggggtcagcttgcgggagtttatggattgcacctacaacctggctaacaatcgccaggtgcgcatgctggctgacctcagcctggtgggctgctataacttgactttcatgaacgagagtgaaagaaacaccatcctgttgcagagtgcaaagaacaacctgaagaacatggccttctttgggctcactgagttccagaggaagacacagtttctctttgagagaacattcaacctcaagttcatctcccccttcacacagttcaacatcacgcgggcttctaacgtggagatcaacgagggtgcccgccaacgcattgaggatctaaacttcctggacatgcagctttacgagtatgcaaaagatctcttccagcagcgctaccaccacaccaagcagctagagcaccagagggaccgccagaagcggcgggaggagcggaggctgcagcgagagcacagggaccaccagtggcccaaagaagatggggctgtagaagggactgtcaccgaggactacaacagccaggtggtgagatggtgacctcctgccctctcctctctcaggagggggagggtgagcaggcacattgactttctgttgaggtaccttggagaagctgagccattctgaggacatctggctgtgtgtgcttgatttggacatcttcttccttctttgtcttcatttttatccagctggagattatccgtcttgttcttttttttcttgacattttgcaattggtgatattaagtagggt

SEQ ID NO: 198406 - DNA, 2266 bp, Homo sapiens
  misc_feature (510)..(510): n is a, c, g, or t
tatgatttaaaaatttgaagtattgactgttaatgctttgcttgaagtgttacctgtgatcagaccccgacagtgtttaaggtaaagcgtggcctgtagatcccgggacgctcccagtttggccccaatcattcgttaccctcctggttctcagatccttcgaaatgtgcagatttgcagccctgcatcctgcttgtcactcagcgtggcccaagttttgtttcagaaaataggagccctattaggtcatccccagcttgttaagtctcattattgtgtgttttcccctgggttgttggaatttgacacagttttacctgatgtgatgcttgaaggcgaccctatgactctttttaaaggaagagtttgcaggacggttttggactggggcttgtgggaatggaggaggggaggtgggcacatggccggggaaacagctccaggctgcacgaccagaccagcgttcccaccctcaagagccagtgagaaaccttggggagaaaaagcaangatgggcaaggcttccctgttcgtctccactcatatcaaaatttccagcctgagctgggtgtggtggctcacatctgtaatcccagcgtcatgggaggctgaggcaagaggatttcttgaagccaggagttggagatcagtttggccaacatagcaagaccccccatctctaaacagtaaaaaaaaaaaaaaaaattagccaggtgtggaggcacgcatctgtagtcgcagctactcaggaggttgaggtgggaggattgcttgagcccaggagttcgaggttgcaatgagctatgagtgccactgcatttcagcctggacaacagagtgagaccctgcctctagaaaacaaaaacaaaaacaaaaacttctcccagccatcgagaagttaaaatgtggctcttaagttagttactgaacaccatacttcagcgtgctgatccctacaatttctgtaacgttcctagtaatcaaccaagaagtcgcagcgctgagacctcctgcttgcgtggatgtaccttttttggcgggcttttcctattgtggtgctggtggtttgtttgtgttttaaattagatgcagtcttttaaaactgtgaggtttcctacctcgcacctgatacctgcattcaggtatcagcaaatgcaggtatcagcttctttgggggaagaaaacccaggatctctggccacttgactctgaggctgccttgcagaactgcacagcctccaccccacccactattttcgtgaccccgaggccacggcccaggtgccattcatcactgtgcagcatggctttcctgtgctagaggaatgtttatctcctccatccagccatggagagcaggaaaatagagttcaatatgggtgggcattgcaacgccagcgcctctttctctgggggaagactctcccctctgtataagttgcagacacccactcttgtcacacatttggctctgcccacctggcctcacaggcatttgagtttgtgttccacccctccccatcccagagcccagcagtcagcagtgagagaagccaaatgtgtgcagggagtgcgaggcggcagctaccatgcaaactccaggggcacaccgccccccagtaatctctccccagagtgcatcaggcaataacaggaagatactcagctgttcattatgacatgatttcccattttcaaacctgacaagttggtcttgatgctgttattcaaataactgaaagtaaatggttgtgaacaaggaatttcagatcacagactcagtaagcctggccagcccccaaggctgtgtcttccttaaagttgggatctctgtattatctcatactctatagtagagcaataaacataagctgacttatgtgatcacttaaaactaccaggaagaaacattttccgtaataaatttagtgtaggattgctttgtcttctcacactcacttttcagaaaagaaaatgtaagtattgccaggcgcggtggctcacacctgtaatcccagcactttgggaggctgaggcaggtggatcacttgaggtcaggagttggagaccagcctggccaacatggagaaatcccatctctactaaaaatacaaaaattagccgggtgtagtggcgcatgcctgtaatcccagctacttgggaggctgaggctgaagaatcacttgaatacaggaggtggaggttgcagtgagctgagatcgcaccactgcactccagcctgggcaacaaggcaaggctccgtcta

SEQ ID NO: 198407 - DNA, 306 bp, Homo sapiens
gattggaaacagaagagagattctgggggtactgtgacctttaaagaatgtggcggtaaggaagaaatgagcaaaggagattgaaaatgccaaaatgaaaaaaatggagaagcatgaagtatcttggaaactgtatgaatatatgtcaaaagagtagaaaggcaaacaaggtctttcatgtcactaatagttgaagtagtatgagaatttagaaaacgtctttttgaattagcggtgtcattggtgacctttgacaaaggtaggtactgttaaaggcagaaatcttacacagatttcaagtgaatg

SEQ ID NO: 198408 - DNA, 491 bp, Homo sapiens
ttatatattttaaatgtacaaattaagaagttttactattttatgcaatcagtgtgtgtagattttcccttatagctaccagtatttttgttcatcattccatcttgtgttaaagacctcttccatctgggatagtcgtctcctcttatttaagtacatgtctttaaaaccccctttccttgaagatctcttctttcagttcttgtttgactgcagtgtctttattgctttctcagataggattagaatactaggtttacagttattgtctcttactacattgaagatacaaatcctagctagattgcatcatttcctagctcgcattgctgctattttgaagttggctgtcagtctaattgccgttcctttgaaggtgatcaatctcttttatctggcctctgggtttgtatcatttccctacagtgtttctagggatagatttctatttttacttgagatttgttgggtttcctggatgtgaagttttg

SEQ ID NO: 198409 - DNA, 371 bp, Homo sapiens
gacaacaaaatcatgtcattttcagcaacatggatggagctggaggccattatcctaggtgacttaacagaacagacaactgcattctgcaggttctcgtttataagaggagggctaaacattaaatatatatgaatataaagatgggaaccacagacactggagatcactagacaggggagggaggaggggcatgtgggctgaagaaccacccactgggtaccgcttttactgtctgggtgatgggatagttgggaccccaagccgcagcctcccacaattgacccatgtaacgaacctgcacgtgtactctttaatctataaaaagagttgaaattaaaaatgaataaagaaaataaaatgacatgagg

SEQ ID NO: 198410 - DNA, 242 bp, Homo sapiens
ctaaacagagaggacatccttcccactcctccaaaaaatcatagcttttattctggtgtatgtcttgcataaatttggcacaaaccccagttctgtcttttattagctgtgtggctctgggcaagttaagtaacctctctggtcatagtttagcttctccttgcccctgacctacaatattctcaggatttttccacagtgcaataataacggtcccctctcccaccacccttcactaaccc

SEQ ID NO: 198411 - DNA, 527 bp, Homo sapiens
gcagtggtaagcatttattacagcacctggaatgcagttacctggttgctttttgttccattaacaagttgtgaaaaagtcttgatggagcttttagctgtaaaacatcttagagcgtaatctgtttttagaagattaattccatctgaaatagagaagcaaatgataaacagcttaaaagacaccagagaaatagatcgtgttacagttgaggacaataatattattccacatttaagaaaatttttagcaagagaaaaaaaaacctgaaaagaaccatgagtttagctgtgcttattgcaagaaattagttcggatatttttgcaaagacgtgttaaaggggaacgaataattaggacttttctcagctaaaaaaaaagaaaagacgtagaaaatgttattttaaaaacatttttggtttatgtaattattcgaaagctccccttagaccctaaaaacaaaaacaatcctccaaactttaaatttatgatttatttatttacttatttttcaatctgaactttct

SEQ ID NO: 198412 - DNA, 451 bp, Homo sapiens
cttaaccgagtgatcagacctggtatctctcacggtagaatggactgtagtaaatgactcatcacttggattttgagtaaacaacatcacctagcaaatattaatatatctgcaaaaacatttagtctgtatacaattaaacttgtagactggggctgtccaatggatatatcatgtgagccacatttgtaatttaaaattttctagtagcaacagtaaaaaatgaaaataaaaagataaagtaattttgtaaatatattttatagaactcaatatgtccaaaagattggattttctacatgtaatcaaaatgattaataagatagtttacattctcttttatgctaaatctcctgtttgatgtgtattttacatttattgcacctcccatttgtattcagtttgatacaggtatacccaagatgtgggacattctgtaagacagctgttc

SEQ ID NO: 198413 - DNA, 490 bp, Homo sapiens
attttctactgtatcacactgagaagaaaatactgtgtcaattcaaagtcaaaggactctaactcaaccaatacttttgcttcttaatatctccttaccaaagactgtacttatccctgtcatatacatttatagttttaaatagttatcagtgtctgaattattcactttgtgatctatttatagctaatactgactcctctgggcactttactggcaggctttcccagaagtctacctgtttagaaattcaagtttaataacttcagttagtctagactgtatgttgttaatactctatagtatggtttagtattggtttacagctttttataaggtctttcttagttatctatgtaagtgtgtgtttctcaactgtaagcattcacagaagactaaacacagtaattcagtacaatgttgcaaaaacactcacattaaaaacagaagttccaggcaggcatggtggctcacacctgtgatcccaaca

SEQ ID NO: 198414 - DNA, 5524 bp, Homo sapiens
attactctttacctgtgaagagtagaacatgaagaaatctactctattcagatattctccagattcctaaagattagagatcatttctcattctcctaggagtactcacttcaggaagcaaccagataaaagagaggtgcaacggaagccagaacattcctcctggaaattcaacctgtttcgcagtttctcgaggaatcagcattcagtcaatccgggccgggagcagtcatctgtggtgaggctgattggctgggcaggaacagcgccggggcgtgggctgagcacagccgcttcgctctctttgccacaggaagcctgagctcattcgagtagcggctcttccaagctcaaagaagcagaggccgctgttcgtttcctttaggtctttccactaaagtcggagtatcttcttccaagatttcacgtcttggtggccgttccaaggagcgcgaggtcgggatggatcttgaaggggaccgcaatggaggagcaaagaagaagaacttttttaaactgaacaataaaagtgaaaaagataagaaggaaaagaaaccaactgtcagtgtattttcaatgtttcgctattcaaattggcttgacaagttgtatatggtggtgggaactttggctgccatcatccatggggctggacttcctctcatgatgctggtgtttggagaaatgacagatatctttgcaaatgcaggaaatttagaagatctgatgtcaaacatcactaatagaagtgatatcaatgatacagggttcttcatgaatctggaggaagacatgaccaggtatgcctattattacagtggaattggtgctggggtgctggttgctgcttacattcaggtttcattttggtgcctggcagctggaagacaaatacacaaaattagaaaacagttttttcatgctataatgcgacaggagataggctggtttgatgtgcacgatgttggggagcttaacacccgacttacagatgatgtctccaagattaatgaaggaattggtgacaaaattggaatgttctttcagtcaatggcaacatttttcactgggtttatagtaggatttacacgtggttggaagctaacccttgtgattttggccatcagtcctgttcttggactgtcagctgctgtctgggcaaagatactatcttcatttactgataaagaactcttagcgtatgcaaaagctggagcagtagctgaagaggtcttggcagcaattagaactgtgattgcatttggaggacaaaagaaagaacttgaaaggtacaacaaaaatttagaagaagctaaaagaattgggataaagaaagctattacagccaatatttctataggtgctgctttcctgctgatctatgcatcttatgctctggccttctggtatgggaccaccttggtcctctcaggggaatattctattggacaagtactcactgtattcttttctgtattaattggggcttttagtgttggacaggcatctccaagcattgaagcatttgcaaatgcaagaggagcagcttatgaaatcttcaagataattgataataagccaagtattgacagctattcgaagagtgggcacaaaccagataatattaagggaaatttggaattcagaaatgttcacttcagttacccatctcgaaaagaagttaagatcttgaagggtctgaacctgaaggtgcagagtgggcagacggtggccctggttggaaacagtggctgtgggaagagcacaacagtccagctgatgcagaggctctatgaccccacagaggggatggtcagtgttgatggacaggatattaggaccataaatgtaaggtttctacgggaaatcattggtgtggtgagtcaggaacctgtattgtttgccaccacgatagctgaaaacattcgctatggccgtgaaaatgtcaccatggatgagattgagaaagctgtcaaggaagccaatgcctatgactttatcatgaaactgcctcataaatttgacaccctggttggagagagaggggcccagttgagtggtgggcagaagcagaggatcgccattgcacgtgccctggttcgcaaccccaagatcctcctgctggatgaggccacgtcagccttggacacagaaagcgaagcagtggttcaggtggctctggataaggccagaaaaggtcggaccaccattgtgatagctcatcgtttgtctacagttcgtaatgctgacgtcatcgctggtttcgatgatggagtcattgtggagaaaggaaatcatgatgaactcatgaaagagaaaggcatttacttcaaacttgtcacaatgcagacagcaggaaatgaagttgaattagaaaatgcagctgatgaatccaaaagtgaaattgatgccttggaaatgtcttcaaatgattcaagatccagtctaataagaaaaagatcaactcgtaggagtgtccgtggatcacaagcccaagacagaaagcttagtaccaaagaggctctggatgaaagtatacctccagtttccttttggaggattatgaagctaaatttaactgaatggccttattttgttgttggtgtattttgtgccattataaatggaggcctgcaaccagcatttgcaataatattttcaaagattataggggtttttacaagaattgatgatcctgaaacaaaacgacagaatagtaacttgttttcactattgtttctagcccttggaattatttcttttattacatttttccttcagggtttcacatttggcaaagctggagagatcctcaccaagcggctccgatacatggttttccgatccatgctcagacaggatgtgagttggtttgatgaccctaaaaacaccactggagcattgactaccaggctcgccaatgatgctgctcaagttaaaggggctataggttccaggcttgctgtaattacccagaatatagcaaatcttgggacaggaataattatatccttcatctatggttggcaactaacactgttactcttagcaattgtacccatcattgcaatagcaggagttgttgaaatgaaaatgttgtctggacaagcactgaaagataagaaagaactagaaggtgctgggaagatcgctactgaagcaatagaaaacttccgaaccgttgtttctttgactcaggagcagaagtttgaacatatgtatgctcagagtttgcaggtaccatacagaaactctttgaggaaagcacacatctttggaattacattttccttcacccaggcaatgatgtatttttcctatgctggatgtttccggtttggagcctacttggtggcacataaactcatgagctttgaggatgttctgttagtattttcagctgttgtctttggtgccatggccgtggggcaagtcagttcatttgctcctgactatgccaaagccaaaatatcagcagcccacatcatcatgatcattgaaaaaacccctttgattgacagctacagcacggaaggcctaatgccgaacacattggaaggaaatgtcacatttggtgaagttgtattcaactatcccacccgaccggacatcccagtgcttcagggactgagcctggaggtgaagaagggccagacgctggctctggtgggcagcagtggctgtgggaagagcacagtggtccagctcctggagcggttctacgaccccttggcagggaaagtgctgcttgatggcaaagaaataaagcgactgaatgttcagtggctccgagcacacctgggcatcgtgtcccaggagcccatcctgtttgactgcagcattgctgagaacattgcctatggagacaacagccgggtggtgtcacaggaagagatcgtgagggcagcaaaggaggccaacatacatgccttcatcgagtcactgcctaataaatatagcactaaagtaggagacaaaggaactcagctctctggtggccagaaacaacgcattgccatagctcgtgcccttgttagacagcctcatattttgcttttggatgaagccacgtcagctctggatacagaaagtgaaaaggttgtccaagaagccctggacaaagccagagaaggccgcacctgcattgtgattgctcaccgcctgtccaccatccagaatgcagacttaatagtggtgtttcagaatggcagagtcaaggagcatggcacgcatcagcagctgctggcacagaaaggcatctatttttcaatggtcagtgtccaggctggaacaaagcgccagtgaactctgactgtatgagatgttaaatactttttaatatttgtttagatatgacatttattcaaagttaaaagcaaacacttacagaattatgaagaggtatctgtttaacatttcctcagtcaagttcagagtcttcagagacttcgtaattaaaggaacagagtgagagacatcatcaagtggagagaaatcatagtttaaactgcattataaattttataacagaattaaagtagattttaaaagataaaatgtgtaattttgtttatattttcccatttggactgtaactgactgccttgctaaaagattatagaagtagcaaaaagtattgaaatgtttgcataaagtgtctataataaaactaaactttcatgtgactggagtcatcttgtccaaactgcctgtgaatatatcttctctcaattggaatattgtagataacttctgctttaaaaaagttttctttaaatatacctactcatttttgtgggaatggttaagcagtttaaataattcctgttgtatatgtctattcacattgggtcttacagaaccatctggcttcattcttcttggacttgatcctgctgattcttgcatttccacattaaggtggctctcaaacccaaaacacagatcgatataagattttaggaggtggggtgaggcacaattatgaagtgcatattattcagatgtatagtaaatactttgcattgcttttataaagggttctttaaggattttttaagatttttacacttccaaagtacatttactttttgtcttgataatgaatcacttttgccagtaattggcctcttccaaaagtgatccttctgacttacagatgtttaaaatgtgccatgagtttaactacatcttgatacaaacatgataaaaaaagaaaaaaatatattccaaaggttgggactctggacgacaaatttttttaaattagccaaaaagcattattaacattataaactatatttactataaacaattgctatcttaaataagcaacttctaaaaataaaaaaaagaagccatcacctccaggaaaaaaaaataggaaaggatataatcaggtaattctcaaagaagaaatgcatgagaaaaatgtatacagtttcaacaatcaaataaatgcaaattaaaacaaaatatcatttttttgccttgtaatttaatgatgaataaaaaaatctaatgt

SEQ ID NO: 198415 - DNA, 2620 bp, Homo sapiens
ataatccatttaagtcttagcttctatttctgcaaaggagaagtttgaattagtcaatcttccttccagatccataactcagtttgataaattacttagtatctttttctacagagaaaatgctcatacataataataaatatgtaatcataaaattattttcattagtctgttttatagaattcaaattaatcaccactatttactcttgtgcctcttggtgatcggtgctgtctgttacagatcgctactgaagcaatagaaaacttccgaaccgttgtttctttgactcaggagcagaagtttgaacatatgtatgctcagagtttgcaggtaccatacagaaactctttgaggaaagcacacatctttggaattacattttccttcacccaggcaatgatgtatttttcctatgctggatgtttccggtttggagcctacttggtggcacataaactcatgagctttgaggatgttctgttagtattttcagctgttgtctttggtgccatggccgtggggcaagtcagttcatttgctcctgactatgccaaagccaaaatatcagcagcccacatcatcatgatcattgaaaaaacccctttgattgacagctacagcacggaaggcctaatgccgaacacattggaaggaaatgtcacatttggtgaagttgtattcaactatcccacccgaccggacatcccagtgcttcagggactgagcctggaggtgaagaagggccagacgctggctctggtgggcagcagtggctgtgggaagagcacagtggtccagctcctggagcggttctacgaccccttggcagggaaagtgctgcttgatggcaaagaaataaagcgactgaatgttcagtggctccgagcacacctgggcatcgtgtcccaggagcccatcctgtttgactgcagcattgctgagaacattgcctatggagacaacagccgggtggtgtcacaggaagagatcgtgagggcagcaaaggaggccaacatacatgccttcatcgagtcactgcctaataaatatagcactaaagtaggagacaaaggaactcagctctctggtggccagaaacaacgcattgccatagctcgtgcccttgttagacagcctcatattttgcttttggatgaagccacgtcagctctggatacagaaagtgaaaaggttgtccaagaagccctggacaaagccagagaaggccgcacctgcattgtgattgctcaccgcctgtccaccatccagaatgcagacttaatagtggtgtttcagaatggcagagtcaaggagcatggcacgcatcagcagctgctggcacagaaaggcatctatttttcaatggtcagtgtccaggctggaacaaagcgccagtgaactctgactgtatgagatgttaaatactttttaatatttgtttagatatgacatttattcaaagttaaaagcaaacacttacagaattatgaagaggtatctgtttaacatttcctcagtcaagttcagagtcttcagagacttcgtaattaaaggaacagagtgagagacatcatcaagtggagagaaatcatagtttaaactgcattataaattttataacagaattaaagtagattttaaaagataaaatgtgtaattttgtttatattttcccatttggactgtaactgactgccttgctaaaagattatagaagtagcaaaaagtattgaaatgtttgcataaagtgtctataataaaactaaactttcatgtgactggagtcatcttgtccaaactgcctgtgaatatatcttctctcaattggaatattgtagataacttctgctttaaaaaagttttctttaaatatacctactcatttttgtgggaatggttaagcagtttaaataattcctgttgtatatgtctattcacattgggtcttacagaaccatctggcttcattcttcttggacttgatcctgctgattcttgcatttccacattaaggtggctctcaaacccaaaacacagatcgatataagattttaggaggtggggtgaggcacaattatgaagtgcatattattcagatgtatagtaaatactttgcattgcttttataaagggttctttaaggattttttaagatttttacacttccaaagtacatttactttttgtcttgataatgaatcacttttgccagtaattggcctcttccaaaagtgatccttctgacttacagatgtttaaaatgtgccatgagtttaactacatcttgatacaaacatgataaaaaaagaaaaaaatatattccaaaggttgggactctggacgacaaatttttttaaattagccaaaaagcattattaacattataaactatatttactataaacaattgctatcttaaataagcaacttctaaaaataaaaaaaagaagccatcacctccaggaaaaaaaaataggaaaggatataatcaggtaattctcaaagaagaaatgcatgagaaaaatgtatacagtttcaacaatcaaataaatgcaaattaaaacaaaatatcatttttttgccttgtaatttaatgatgaataaaaaaatctaatgt

SEQ ID NO: 198416 - DNA, 2218 bp, Homo sapiens
acagatgtgttgtactaagttctgcaagcctttggcaattccaggatatgtttactttcccttgataagagaggaattggaagagtattttcagctgttgtctttggtgccatggccgtggggcaagtcagttcatttgctcctgactatgccaaagccaaaatatcagcagcccacatcatcatgatcattgaaaaaacccctttgattgacagctacagcacggaaggcctaatgccgaacacattggaaggaaatgtcacatttggtgaagttgtattcaactatcccacccgaccggacatcccagtgcttcagggactgagcctggaggtgaagaagggccagacgctggctctggtgggcagcagtggctgtgggaagagcacagtggtccagctcctggagcggttctacgaccccttggcagggaaagtgctgcttgatggcaaagaaataaagcgactgaatgttcagtggctccgagcacacctgggcatcgtgtcccaggagcccatcctgtttgactgcagcattgctgagaacattgcctatggagacaacagccgggtggtgtcacaggaagagatcgtgagggcagcaaaggaggccaacatacatgccttcatcgagtcactgcctaataaatatagcactaaagtaggagacaaaggaactcagctctctggtggccagaaacaacgcattgccatagctcgtgcccttgttagacagcctcatattttgcttttggatgaagccacgtcagctctggatacagaaagtgaaaaggttgtccaagaagccctggacaaagccagagaaggccgcacctgcattgtgattgctcaccgcctgtccaccatccagaatgcagacttaatagtggtgtttcagaatggcagagtcaaggagcatggcacgcatcagcagctgctggcacagaaaggcatctatttttcaatggtcagtgtccaggctggaacaaagcgccagtgaactctgactgtatgagatgttaaatactttttaatatttgtttagatatgacatttattcaaagttaaaagcaaacacttacagaattatgaagaggtatctgtttaacatttcctcagtcaagttcagagtcttcagagacttcgtaattaaaggaacagagtgagagacatcatcaagtggagagaaatcatagtttaaactgcattataaattttataacagaattaaagtagattttaaaagataaaatgtgtaattttgtttatattttcccatttggactgtaactgactgccttgctaaaagattatagaagtagcaaaaagtattgaaatgtttgcataaagtgtctataataaaactaaactttcatgtgactggagtcatcttgtccaaactgcctgtgaatatatcttctctcaattggaatattgtagataacttctgctttaaaaaagttttctttaaatatacctactcatttttgtgggaatggttaagcagtttaaataattcctgttgtatatgtctattcacattgggtcttacagaaccatctggcttcattcttcttggacttgatcctgctgattcttgcatttccacattaaggtggctctcaaacccaaaacacagatcgatataagattttaggaggtggggtgaggcacaattatgaagtgcatattattcagatgtatagtaaatactttgcattgcttttataaagggttctttaaggattttttaagatttttacacttccaaagtacatttactttttgtcttgataatgaatcacttttgccagtaattggcctcttccaaaagtgatccttctgacttacagatgtttaaaatgtgccatgagtttaactacatcttgatacaaacatgataaaaaaagaaaaaaatatattccaaaggttgggactctggacgacaaatttttttaaattagccaaaaagcattattaacattataaactatatttactataaacaattgctatcttaaataagcaacttctaaaaataaaaaaaagaagccatcacctccaggaaaaaaaaataggaaaggatataatcaggtaattctcaaagaagaaatgcatgagaaaaatgtatacagtttcaacaatcaaataaatgcaaattaaaacaaaatatcatttttttgccttgtaatttaatgatgaataaaaaaatctaatgt

SEQ ID NO: 198417 - DNA, 463 bp, Homo sapiens
taaattttaattacctatgttagaaaaagacagaagaagtatgaaaaaaaattgctgtcactatctcagtagcctgatggtttttcttcacattcctcaggtattcttttctgtattaattggggcttttagtgttggacaggcatctccaagcattgaagcatttgcaaatgcaagaggagcagcttatgaaatcttcaagataattgataatgtaagtctgagttggccatctatccacctatctaaaagattgtccagttaagtcaatttctttgtcactttatccagctctccacaaaatatcactaaaagtagttattgtaacctagtaatctcttaaaatttgattctgtttagaagccaagtattgacagctattcgaagagtgggcacaaaccagataatattaagggaaatttggaattcagaaatgttcacttcagttacccatctcgaaaag

SEQ ID NO: 198418 - DNA, 409 bp, Homo sapiens
cgcgcctgaggctcatgcatttggctaatgagctgcggtttctcttcaggtcgggatggatcttgaaggggaccgcaatggaggagcaaagaagaagaacttttttaaactgaacaataaaaggtaactagcttgtttcattttcatagtttacatagttgcgagatttgagtaatttatttctagcctccagctctgaaataaatgacatgttgttgtttttaattatttttaagaaacgcaagctagcctttggaatcaatatccctgcttagagcagaagtttgttggctgagtggagcacagcatatgcattttccctgtcttttttgttctttcttttaatgatacataatattttacatatttatgaaatggggtacatggaagcgttttttacatgcccgga

SEQ ID NO: 198419 - DNA, 405 bp, Homo sapiens
tacagctcggacccaggagatcatcgggggtttaacccactccaggcatagacttccatatttctaaatcaaggataattgtgcttacctcatagtgttattgccatgatatatatatgctaaggaaacaatgtaaaccacttgtaacatgcgtcacatatattaagtgctcaaaaaaaaatcaactatctctttccttagacttaaaaaatatatatgcaactctaacttgctgttaatgcatttatttcatcatcctgaaggtattcgttgatagcctaatatgggttgggcccacacacaggttatttaggacagagaggaagagaaaatagacatggtcttattccctaatggagcttgcagtctgaataaggagaaaggtatcaatcaacaaataaccaa

SEQ ID NO: 198420 - DNA, 495 bp, Homo sapiens
ccaccccaagctgtctccggcctgcggtcagggggaggggctctagctgtggaaagttggcagaggcggccggcagcagccgggagagtggaaaaaatgatatcaaacccggaaaaatgcaggccggatggagggccggagtgggccctgggagaggagacaaagttttgctgtgttgcccatgatggtctcaaactcctgagctcaagagatgctcccacctcaacatcccaaggtgctgagatttcaggcatgagccactgggtctcaccctgctatcatatcttaaggccttgcagaaaccaggatttgttaaaggaatgaaagctccttgagggaagggccctcagtgctgctctgatcccagcacctacaacagtgcctggctcataataggtgtctgtgaataaggaatggaaagcatgtgagaaaaccacactcttcctcagcctattatagtttaaaaagtactttctcatccataaaaacaaaacc

SEQ ID NO: 198421 - DNA, 537 bp, Homo sapiens
taaacaggcgcaggggttcattgtgctttcttcgtatataattgaactttttcataataaaagtattatgtttaaataaaaccagagaaaaaggaaataaaaaactgaagcaccaccattcacctcaagcactggggataaagtgtgaattatgaattttggggtcagcaactgtctgtggtttcattaaaaattcaccactgaggccaggcacagtggctcacgcctgtaatcccagcactttgggaggccgcggtgggtggggtgcattttacagaaaaggagaagttgtgggacaggcattcacataggtaaccatatatttgtaaatcaatgctgtgacatggttttatcttttcttgagagtcagtgcaacatgctaactatctatatgagggcaatgtctgtagaagttcattcttgcttcttgaaacaaatggaattcacctgtgctgtgtaaagaggactaatgaaactatccatataatccaggcaaaaacttgatgctgagggtaaagaggcttgggttgttctgaa

SEQ ID NO: 198422 - DNA, 347 bp, Homo sapiens
tagtgtgttcactcttaagatggtattgtgaagagataagatagacctgatgcaaaatagcttaaaatctagacacttaacctctgagttgcatgcagatagtagtaatgtgagggtctactggtaagatttcaacaggaagttctttgtgcagtttgactgtatgtaaaggcactgaaatgccttgcctagaggaatgacaggaaagctgtgctgtaggaaggttgactggtagggatgggtagtgtaggcaaggctctaggtaaggacatagaaaagacggcttacctggtttgagtgccagctaggctgcttagaacaatggttctcaagattaatgccagccc

SEQ ID NO: 198423 - DNA, 310 bp, Homo sapiens
atatacacagattgagagtaaaagcatggaacaatacatatagcaaaaactgacagaattgaaaggaaaaaaaccaaaaagagttccgcattaatgcttggagactacaacgtacaactttcaataatggatagaacaaccagacaagagatgaacaagtaaactgaacacttgaacaagacttaaacatggcctatcagatatctctagaacactacacaaaatagaatacacattcttctgaagtgcataaaaacattctcaaagaccaaagtctaaaatactacactacaagtcaagtctcaacaaa

SEQ ID NO: 198424 - DNA, 150 bp, Homo sapiens
atttggacataatattttattagtaaccaaaacagctaaatctaagtgaattaagtaatattttaaaagggtaatggtcaggtgtgtttagaaatagttcttttttctctttgagggaattctgcaatgtctggtagatggaggagggga

SEQ ID NO: 198425 - DNA, 963 bp, Homo sapiens
  misc_feature (293)..(293): n is a, c, g, or t
  misc_feature (296)..(296): n is a, c, g, or t
gaaaagccgaaagagcgaggcgagaaggaggggttgtggaggttagggcccaaccagcaagtcccgttgctctccctcctcctgacgaggagcggagagggaaggggaggagcgagccggggcaggccgcgcacaccaggagcctcctcgtggagggggggagcggaggaaaggggtagctccgccacctctgctggcggcggcggcggcggcgaaagaagaagaaagtcagggcccgtacctaccgccacagactcagaaacgcccctgcccccatctccccggaaataganaanagaaaggacacagaagaaaatgaacaacccacaaacgacagcaaacacaagaagaaggcaaaaagagaaaacagacacagaagaagcaaacacacccgacgaaaaacagcaacaaacacaccaaacacggccacagcgacacacacaacaaaaacaaggagaaaaacacagacgaagacaacacacagaaaagaaaaacagaagaacacagaaacaaaaaagaaaagaaaggggacgcaaaagaggaagagaaaggaagaccaacagagaagagaaggtacgagcggaagagggacgcaacagacagaacgggaggacagagcggcgcgagggacggcagaaggcagggcagagaagaacgagaagaaggagacggacgcggagggagaagtagcgagggtgagagagagagggcagggcagggaagcagggaggagagggaggaagagagggagagcgagcactggaacagaaagaagagaggacgggagaaagggtagaagaccgagagagagtggtagaaagagcgacgagaaggcggcgaggaggagccgacgaggaaggagagaggaaggagggagagaggagggggaggaggggacggcgacgaacagaaagggagaggacgagagcgaagtcggaaaggcgggaggggaacgaagggagg

SEQ ID NO: 198426 - DNA, 423 bp, Homo sapiens
tgacaggcatcttttatacagaaggtaatatttagatgtcataatttctagtggggcagaagaactaattaaatgcatgtcaataatgataatgatgatggcataagcaaaggatagtttttggttgctgattattcgggagatactatgctatgtgctttatatagattgtctcagtgacagctcacaaaatttggagggagctacacttctatactcactttatagataagaaccttgaggttttagagatgttcactgactcagaatcatacgggaagtgtgtgactcaagcccagctctcatagttacctctagatttcagtgcattcagatttcaaagacaggagtggtcaatgagggctggagtagtccagaaagaaaagtattgatgaacttcatcatatatttcagaaattgatt

SEQ ID NO: 198427 - DNA, 393 bp, Homo sapiens
agcacaataaagcgaactgcagtaaaataaggtatgcctgtatattttttaaatgcacttgagcctttctaacccctttgagaattaagaagcagtttgcacaccctctgcaatctaaaatggatcccacatctatgcacacacatgcaggactaggttcatgtattgtataacccacacagtcaagtcctgcaagattcaataaaaacctgtagtcaggttcattctatttcagatgcagaaattgtttgtaatgaatgaaaaatgaacactattagccacgtgcttttataattcactagataacatatgaaaccactaatgttgtccactaacgatgactaccatcatgaccaacacaacaaaaccagaaacagtatttcctcctttttt

SEQ ID NO: 198428 - DNA, 560 bp, Homo sapiens
cagatggagcacgtggtccaggcatgccaccgcttcatccaggccagctatgaacctctgggcatctccctgcgccccctggaagcagaacccccaacacccccaacggcccctccaccaggtagtcccaggcgctccgaaggacacccagacccacctactgaatctcgaagctgcagtcaaggcccccccagtccagccagccctgaccccaaggcctgcaactggaaaaagtacaagtacatcgtgctaaactctcaggcctcccaagcagggagcctggtcggggagagaagttctggtcaaccttgcccccaagccaggctccccagtggagacgaggcctccagcagcagcagcagcagcagcagcagcagcagtgaagaaggacccattcctggtccccagagcaggctctctccaactgctgccactgtgcagttcaaatgtggggctccagccagtaccccctacctcctcacatcccaggctcaagacacctctggatcaccctctgaacgggctcgtccactaccgggtaagagcccctctttcttggc

SEQ ID NO: 198429 - DNA, 382 bp, Homo sapiens
ggatgcagggtcctgttctgggcaggggaggagggtagctgggtttaaagttggagaggtagtaagtgtgatgtgtgggttttcaataaacaggagatgaaatagctggagtctggagggggtcaggtgactcaggcacttgtgtgagagtaagtcttgtagcctatgtgaggagaaaacagtgagagggtgccctaaggtaagcttaagagcctctttggtgagtttcgctgccgcagccaaagcctgcaggcacggctgccagccctggacagtgggctcgagctgcttggaaaggtaggctactggctggtgtgttcttcctaccagttgggccaggagccctgtagcaaccttttcccgctcatcggtaaagagatgg

SEQ ID NO: 198430 - DNA, 501 bp, Homo sapiens
agtttgagcatggagtctcctctgtcgcccaggctggagtgctttgggtcgaagcaattctcgctccttgcccccctggtagctgagattacaggcacacgctaccatgcccaactaatttttgtatttttactagagacagggtttcgtcatgttggccaggctggtcttgaactcctgacctcaggtgatccacgcgccttgggctcccaaagtgctggattacaggcacgagccactgtgcctggcaagatctgcttttttagctctcacatatgagtgagaacatgcaacagttgtctttctgtgcctggctggcttcacttaacaaaatggcctccagttctattcatgatgctgcaaatgacagaatttcattcttttttatggctgaataatattccattgtaatatataccacttttttttttttatccattgatgggcacttaagttctacattttgcctattgggaatacaataaatatgagagtgcatat

SEQ ID NO: 198431 - DNA, 366 bp, Homo sapiens
tcaagagattgagaccatcctggccaacgtggtgagaccccgtctctactaaaaatacaaaaattaactgggcatggtggtgtgcgcctgtagtcccagctactcgggaggctgaggcaggagaattgcttgaacccgggaggcagaggttgcagtgagctgagatcacgccactgcactccagcctggcagcagagtgagactccatcttaaaaaaaaaaaaaagccacttaatgagttccactgaagagtaatactagtcaccttcagtggttgtaggtactgttgaacaattcttttctctgcagttgaagaccttatatactctagtcaggaactccactttcctcacttttccaactccac

SEQ ID NO: 198432 - DNA, 481 bp, Homo sapiens
gcgagtatcgattggactagaggaaaagcgagtatagagttagataggcttcgaagaagtagtgccctgcctgatgggacgaagatgcgcgcagtctagctcccagcaggatatagtaagtagtaataatagcttatttattagtttagtgacttggttagactattttcgtaaagtctccttccccaaagactggtgaagattttcatgttgtgcctcagagagtgcaaccttgggcatgtacagagtctccctgggatgacattgagccaggctgtctttgactagctctttccatgatctctctgttaagctttctacctcttctggtatcacatccagctgttaggctctactaactgctgactgaattctcgactgtttttgataatgccctggagtatacactgctccaaagtctaattcaattaaattcaggaaggggtaatttttgaaattgagctttgttctgaccttggga

SEQ ID NO: 198433 - DNA, 321 bp, Homo sapiens
ttctttacttcaggatcaaatatttttacttttcgattttatttttttgtttgtgaagagttgggagttgctgggtttagttatgctactctctttttaagggagaatatagcagtcctagagggatttgcaaactatagctcttggggaaacattcaaaattttccttgtgtaagaaattttatgagtctcgagggccggatgtggttgctcatgcctgtagtcccagcattttgagaggccaaggctggaggatctcttgaggtcaggggtttgagactggcctggccagcatggtgaaaccccatctctaccaaaaaa

SEQ ID NO: 198434 - DNA, 330 bp, Homo sapiens
ctgtgaaatgggctaatgaaccgagggatgcatctgaatcctttaggaatgctgggaagcaatcccgacaaaactttggagaaatgaccaacttttgaaggagctttcaaaatccttcacctcagaaaactctctgttgcaatgatttacttgattataataatcttttgagtactcaggtgatttaagtttgtacctgttggtttggatcaatcagatttattagggaccagtttcttgatcacgctcagtatttatttttcctttgaatctcaggtgcaggtggaggaagctatactccactggtcatgttacattattatctttgat

SEQ ID NO: 198435 - DNA, 561 bp, Homo sapiens
ggaaaggcttcatagaggaggcagaacttctacagggccttcaaggccaggtgcggtggctcatgcctgtaatcccagcactttgagaggccgaggcgggtggatcacctgaggtcaggagtttgagaccatcctggccaacatggtgaaaacccatctctactaaaaatacaagaattagccgggcctggtggcacatgcctataatcgcagctactcaggaggctgaggcaggagaatcacttgaacccgggagacggaggctgcagtgagctgagatcacgccattgcactccagcatgggtgacagtgagagactctgtctcaaaaaacaaacaaacaagaaaaccccagacttttggaggtttctttttatatctgattaacactagaccagagaattcccagaactatgtattagtagccactgaaccacagccttggttggggcttttaattgactataaattaatatatttttctcttttgtctttttgtagtaaattctaaaaacaaacagaatgttgaacaaattatatatgcatttcgtataaattatgt

SEQ ID NO: 198436 - DNA, 130 bp, Homo sapiens
atcagtgcattccagactgacaacctactttgcatagggtcctcactttcctgaagctcccagcagggatatgaaagcaagcccagttctatgagactctgttttattctcctgggtgactggtgggaag

SEQ ID NO: 198437 - DNA, 532 bp, Homo sapiens
tgccagtgcagcaatagttaaaagttttagaggctaacatttccagtcaagcaagcagaagcagatatttaaacaggcttttagtaagcaaaagttagagccggatttagagtaagttaaacacaaattccgaatagttgaagtacatcaaaagaatgcatttatttgtctcttattttctattcttattttcattatggaaaattacatacatgcctcaagataaagagaggatagtatattgagccctcaagtatccatcaactggctttaatagttaatggccttttgccacaaccagctttaatagttaagggcatttcgccacaaccagctttaatagttaacagcgttttgccagtcttcttttatccatcttttcctctgttttttgaactgctagaatattttaaatcaaatcttaagctccactatgtagtccttttgtatgtgtctttaacagtaagaataaacacacatacacaaacacatttgcattatcacctagaaaaacttaacagtgactctttac

SEQ ID NO: 198438 - DNA, 386 bp, Homo sapiens
atgtaaaagtttgaaaataaatataaattaaaagttacaaaaaaattcatagtagtgtcaaaacaaaactatatgctttcctctgatagcacttagaagcagagtagatggcaaaactgggcaaagattcaaagctaagaatactggaagaaaagtgattgaagagggaactgaagctagaggagagaatgaaacaagaggtgctgggaccagaaatcttgatacagcttaaagcttaagaataaacgtgctgggaaaaggagaatgagcattggaatgacaggaggctacagtcagaaaagtaggatattaagcattccaaatcagagttgttattagtcatttaggaaatgcaaattaatcccacaatagaataccactccaca

SEQ ID NO: 198439 - DNA, 472 bp, Homo sapiens
gggatgtccagggtgagggaacagttctggattgcatcgtggtgctgctcacacaaatctacacatgagataaaacggcttagaactacaaacacatacatatgtgtgcaggtaaaagggggaaacctaaatgagctctgtagattgtgactttcctggtcttgatattgtactagttatgcagtatattatcattggagaaaactgggttaaggatacacaggagtactctgcactgtttttgtgacttcttgcaaatctatatttcaaaacgaaaagtttctaaaaaattgaaatgacataagatataaactgagaaatttcactcataccgtctcttcaatgttgccaaccgctttcattggtttcaatataattgtccagtgttcctttatgcaaataaaaagcacatttaaatctgcatttcattcccttccctgcatttttccacaaaagtaagtgtaccatgtac

SEQ ID NO: 198440 - DNA, 414 bp, Homo sapiens
  misc_feature (14)..(15): n is a, c, g, or t
tcagccggtccgtnnacgtgtggaatagatgcactcacacagatagctagatgaactccatcatgttttaagagagttggttttattagttcagttagttcactttcctttggtttcataatgtaagaaacaaaaagagtaagagcagtgctttatttcagtagtatggggtaaggctttaactttctgggtctgaggcggaggtttctgctggcatcttagctttctgtgtgtttgtttggtttactcctgacagagacaatggaatgcttcaatgaaaacgcccaactcattttccatctatgaatgaacaggaggcatcccgtggctaaggagggataaatattccgcgccactggaggcctgctggctcacccgggctacaccactattgtacccactctggcttccaca

SEQ ID NO: 198441 - DNA, 379 bp, Homo sapiens
aacttggtgtttggtgaggaggatagataaatctacattcaaatacagtgatttgataaattctttcaaagaatgagcaaagctctatgaaagcacttaatgatgcttgtataggtcagggaaagtttcattaagaagatattggagctgaggtctgaggatgaagataatcttactaagtgtagaaggaaggaggtccaccttctatgtacgtgtggaactgagcagacacattttaagaaaccacgggaagtgtggtatttgtgtgtgtatgtgagtgtggtgggtattgaagggtgacatgtggaagcaaatgaggcttggggagttagcaattaggtcatgaagagttttatataaatatttaggaaaatttgtc

SEQ ID NO: 198442 - DNA, 277 bp, Homo sapiens
tggggctctgggtctgaaatggctggggggatgcgctagctgagagaggcaacagggtcgtagaggcagaggggtcaaaggggaggacaggaaagaagcaggaggaacccgggaaggcacccgacgcctgcgcaccgccggagagaggccaggccccaggctcagctagaggcaagcgcacccgaaggagccaagctgagcaggacagagtccaggcctggaaagccggcctggagagccggcctggtgcaccggccagagcaccccgagggatacg

SEQ ID NO: 198443 - DNA, 496 bp, Homo sapiens
tgcttctcctacattctctgacaccaggctcctcccagtgataggaaacatggtccagtcattctcataccacacatttctcagcctcctctacttggcattctaactgggaaatcccagggcaggatgtgtgccaaaggtaagtaataagattcccttacagaggtgcccctcaggcagggggtataaagagaaagtggtttgagtcccttggagcgagacagtgtgatgcacttctatggccttgggaagacttccggattctggggaggacaggttggcaagcactggtcttcctcttagattctaagtcagatctcagcaagatatctaaggggccaggcagggaccctctccttcatatgttcccgtaagcccaccaaacagtggagcacattgctggtggtgttacccattagagaagtaaatatctagctctgggcctacttcttcccaagtttaaggaagtattacagagtgagaagatgtgcacgtg

SEQ ID NO: 198444 - DNA, 649 bp, Homo sapiens
cattccttgccagtcatgacccatggtccttagatgtttacagctaaagtagcagcttgttaacgcctgcaaggacacactcctacaataacagaaagtccagatgtcctgatatccataacagtatgtgctttgaatataattgtagttatggtttgaggtactcacacactagaatgtcgaggatagttttatttaaatcagtattacacattttgtcatgctgtctgctcaccctcatgtagactcagcttagcttagtctttatatacataagaccccctacataagaaaaacttaaagcaaagatggtgcgttcctctgcttgccttctgagggtgctgtactctggaagggagtagcttctaaataacttgcttctttcactgcactctgtgactcaccttgaattccttcctgcgtgagacccaagaaccctctcttggggtctggatcaagactccttttccggtaatgaatccaggaggcgaaaaaataaggacatttaggaatcgagcaattcagtaaacatttgtgtgtgtgtgtgcacccacgtgcatacatacacttacgtgtagaggatctagaaagatctttatattctttgaatagagaagatacacatttcccatatgatcatagtaccttt

SEQ ID NO: 198445 - DNA, 458 bp, Homo sapiens
cagcacggagagggcagtgggaggaggacgctgcagccgaggtgcccgcagacacccccaagcccagtggtcaggtcagcatgcactggtcatgttcatggcgtggccgacggggaggctgctgccccatcctcccaaccccgacgaccccagcccggccatgcagaggcatagtcgaccgtctcactaaggaacattccacagaattcctgaccaggcctcctccaaaccatccaggtcatcagagacaaggagagtctgagaaaccgtcccagcctcggggagcctgaagagacagaacgagtagatgccatgtggcttccaggaagagattgttgggggcggggcagggggaaggacatcaggggagagcgaaggaagtgtaggcctcagcagctgtgtggcagcactggcttatttattttttattttttatgtttattttattttattttttg

SEQ ID NO: 198446 - DNA, 140 bp, Homo sapiens
ttccttttcccgaagaacaacagtagccaacaatcacaaccacagaaacctaagtttctctgagtagatgacttaattcttctgccagccccacctctgagactccagcagccatgaagattatgggccggtgttgacaa

SEQ ID NO: 198447 - DNA, 499 bp, Homo sapiens
gtgaagcctgagaaacaccaaagatggcagtctgctccttcctcaagactgtatatctacccaatagaatactataaaatcactgcatgtccacacaaggaatgctgcaccatcaaatactacacaaggaacaattctatacattctgatatagaaatttctcttaagacataccgttatatataaaaaataaattgtagatcaatacatacagtccaattcacataaaacaaactgtgtgtatatacatatatgtgaactaaaaaaatattgagacatatagaccaaattgttaatgatagttatatttgtggaggtgaataaaactggggtttaagaaaggagttaggattgctccatatacatctgtttgcttgcatttttaagtaaaatatatgtatgtataccttgtgtaattaacaaagtaaaccaacataaaaagaaaaatcatcatgaccagtagaggttgtctttacagtacaataaatttctctttaca

SEQ ID NO: 198448 - DNA, 347 bp, Homo sapiens
ctcctggcctcaagtgatcccacctcagcctcccaaagtatgtaggattacaggcgtgtcactgtgcctggtcacacctgcataatgattttgtgaacagtttctcttacattttattagttggaattctacagtaacgaagagcttcactttctccttcatccgtgtgcgttcacttccttccatctggattggtcaatggctcctcctttggtccttggaatcagaccccactgctggcattgaccgtgtgatacacacatgattcttttgcaccccgtgtggcgtgacccagagcttgtgtgccggctgggccatcctcctgccccatgtatgctaaaatacac

SEQ ID NO: 198449 - DNA, 547 bp, Homo sapiens
acataccagctgcaggccccagcatacagcaggggcttcattattgctgctgccaggtgataaatggtcaagcccaggcccactgtggacagagctggccaggattcttgtaaccctgacaaacacaacacacttcctcaccccaccagacaaggctctgggctcaaatagctgcccccaggccccgaggactcaggccggggcatttaactgatgcctgctgtccggacaggacacggttcctgggctccacccaacccgcctctcccagggaagcagggacaaaaggatggggccctgtggggatggctggccctgaggacaacacaggcacatgagaggtcatttcaggagaaggacgtctgggaggcatccaccaactcatgctgaacaagagtccagccagagcccacccgtttatgaaagaaaatgataataataatagaaggacagggagggggctgcagggatgggggctctgcaccagctcccacaggcctgtccagggctcctgctcccctctgagtgatggcagggcaggcgcctg

SEQ ID NO: 198450 - DNA, 200 bp, Homo sapiens
gagacaatgcctaagtaaattcagtctagctttctgacatgctcttcaagacacccacacccccactctgacagcctattcttttaggcttatctcccacaacacgacccacccacctggcactgtgaccctacaataattctctgtttcctggacctgcccagttctttcctgcctctgtgcctttgctcatgcagtta

SEQ ID NO: 198451 - DNA, 245 bp, Homo sapiens
gctaaccaagtccttactttatttaattcactttccccatacactgtgctgtaagattattttatttcagaaaaatgtcacatcttcctcttggtactaagattctcttctcattttaccatttttccctattttagtttaatgtcctttcatttctattatgtgttatgtgttccaagttttacatccctccggcattcattttaatagaattaggagaatctataaataaaagtagctcctta

SEQ ID NO: 198452 - DNA, 465 bp, Homo sapiens
tcttccagtttaggattatattttatatcctatttcataatgtgcagaactcaattattcaatatagaactggctactaaattccattttaaaagtcgtgcatttgtatttgaattaatacacattttattaaaagggttgtttattggagggggtgttttatttatttgcataggcctttatggactgtgaagtttgcttttgggcaaaaaatatttgtttgctatattttgttatttctcttggtatcatatcttacccatctttgtatctgtcatttattttaaaagatccaggaaaatttcagaaagcgagctgtcctatttttgaacactatataaaaacaacaaaaatggaatatctgtgatgttaggaaagttaccctgaactaagcctccttttaaaagctcagagaagctgacttcaaaaaaaataacgtgaaactataatcatgcaagtttgttt

SEQ ID NO: 198453 - DNA, 415 bp, Homo sapiens
tctaaaatcccaggaggagagacataattggagtgcagaaaacagttgaagaaacaatgagccacattttcctggaattggaaggctcactgagagtcagaggagacagaggaaaaaccatggccagaggcactacaggaaaacctaagaacaccatggcccgagacggttaacacagagcactgaggatcaacttgattggattgaaggatacaaagtattgatcttgggtgtgtctgcgagggtgttgccaaaggagattaacatttgagtcagtgggctggggaaggcagatccacccttaatctggtgggcaccatctagtcagctgccaacgaatataaagcaaacgtgaaaaggagggacggcctcgcctcccagcctacatctattctcccgtgctggatgcttcctg

SEQ ID NO: 198454 - DNA, 418 bp, Homo sapiens
caaatcttaaatgaaatgcaaacaccaggactgtgaacctgtagctttggtcacaggtagcaatatggccttactggttgtatagcacttactgaatttttcttgagaattctaaaatttgagagtgatgccagataaaattgcatcaagaaatctgaaaggaacgatttattctggcttcaggaaatctgattttatatttctgtgacataagacaggttttcttttttccagaatgatcctctactctgaataaccataaaatttcacttgtggaatacatcaaaattatttatacatcaaaattctcttaaatattttatagtaatctttctaaaaatccttcagtcttactgtacttgtctagagttgcaaaaatgtagtgttaacattaatattaaaagcactttcaatgaaa

SEQ ID NO: 198455 - DNA, 930 bp, Homo sapiens
atacgtatataataaacatgtatacatatgtatatacatatataatatacattatgtctatatacatatacatataaatatacatatattaatatgtatattaaatatgtatatacatattaatatacgtatataacatataatatacattatgtacattatataacatatgtaatatacattatgtccattatataacatatgtaatatacattatgtacattatatacattatgtaatatatatatgtgtatataaaaaacatacctggaaaaagcaatataaatgtctgggtcttactcagtagcccagattatggttgcatagcactccatggtgtatatataccacattccctttatccagtctgttgttgatgggcgtccaggttgattctatgtctttgctatcgtgaatagtgccacaatgaacatacgtgtacacgtatctttttatttttacacgtgcacgtatctttgtaaaagaataatttctattcctctgggtatatacccaataataggattgctgaatcaaatggtatttctgcctttaagtctttgaggaatcaccacactgtcttccacagtggttgaactaatttacactccaactaacagtgtaaaagccttcctatttctccatatcctctccagcatctgttgttttttgactttttaataatagccattctgactggtgtgagatggtgtctcattgtggttttaatttgcatttctctaataatcagttctttcttatgtttgttggccacatgtatgtcttctgagaagtgtctgttcatgtcctttgcacactttttaatgtgattgttcatttttttcttgtaaattgtttaaattccttgtagactctggatattagaccttgtcagatgaatagattgcaaaatttttctcccattccgta

SEQ ID NO: 198456 - DNA, 261 bp, Homo sapiens
atactcaccaaaccaaacactatataatggagctaaagctatggacactccatgactgggctacacacagagaccctgtgatatgcctatagttatatctccccaggactatttccttattgcaattaaatccatgcacattggctcagcagtgccccaccagtagagagagtaccagagttagcccctcatccaacagaactaagcagccacttgggctggtctttggatctgttgtgggagggggctactgaaccatgg

SEQ ID NO: 198457 - DNA, 485 bp, Homo sapiens
ctggtcaacaataggctattagtagttaaatttttggggagtcaaaagttatacatgaatttcagctgcacaggaggttggcactcaaattgttcaagggtcaactacacgctataaaatataaaatattatataaatagaaccaaagttagctttcaccctgaatatttctttaatgtcctggagaccatgatatttccaatttaacttagaagctgttaaaggcacaatgttaaaacctacagcttgtccaaagtaggaagccaaagtcaatgtaaaggtaaaaaggaaacaaacctcagagagacagagacagagaccaaccaagaccttgtctgtaccttagtattggtggcatatggaaaaaacaatttcccctgagaatccataaccactaatagccctcaattagattagcagtcagaatgtatgctattgtataatctgaagaatttcaagctcagaacttaatttacggcagtccc

SEQ ID NO: 198458 - DNA, 528 bp, Homo sapiens
gcaaacagacaggatcttctggaccgctctaagaatttggactttacttttactctagagcaaaagtaggcggggaggtgccattagcatccagtgggtagaggccatggatgctgctaaacatcctacaacacacagagtcctcacagaaagaattatctggccccaatgtcaacagtgctgagatgaagaaactctgcaccaggggtttggagcagagaagtgatatgatcagacttctgttttaaaagaaccactccagcccctatgctgagaatacactagaagcaagaagattagttagggggctactgcagtgattcaggaaagaaataacagtggtggtggcttggagtagacagagtgggaactgggaaggtggtgagaagaggctgaattctggatacattacaaaggtagagtcaaaactgttttctaatgaattgaaaggaggtgtgagaaaaaagagaagcagtaaggtttttgatctgagcaccggaaaacagccttgcctttattgagatgagg

SEQ ID NO: 198459 - DNA, 290 bp, Homo sapiens
aaagagttgagataccactataaagttcttttaggcaacaaggatgaaatttaatgttttaattagaaatttatttaaggctcccacagtgctgggattacaggcgtcagccaccgtgcctggcctctacaaacattttttaaaaaattagccagtcatgatagtgcacacctgtagtcccagctactcaggaggccaaggtgggaggatcacttgagcccaggaggtccaggctgcagtgatcatgcaactgcactccagcttgagcattagagtgagaccctatctcc

SEQ ID NO: 198460 - DNA, 392 bp, Homo sapiens
tgcacagacttcctgtactacctcactcctgaggggagatgcttctgcagggcctgcgacctggggcacaactttagacaccatcatcctggagcggcactgcaccctcactagccagggtgttgatgacttcctcaatgccaaggccacgttcaagattttcgacttcagtgatgcgtttgtgctgagcaaggtgggcttctccgggatcttaattcaaaaggtagaatgcagcttgagatctagtgtctgatcgaagaacttgaacttgacctggagggctctggggagccatggaaggtgctggataaaggagggacagtcatatatgttttagagatgactgtggaaggctgcctggaaggagtgaacaagagccaggagaccaggga

SEQ ID NO: 198461 - DNA, 411 bp, Homo sapiens
acaaggtctagggtattgactgtgggagtgagtggaatgtagggtaaaggacgagattgtcgtatgagaggtggtcaaggaactgagaggtgcgagcatcagaacagtcatctatatgaacattgaaatcgcctggaatgatagcccagtgaaccaggaactaaagtcttcaaggcttaaggcttgagaagtgacctaggcatatcagatgaatgtaaagaagaagggggtagtggtggtatggtttgacaggaggcttttttcaggaaggaagggggaattatctggaaacaaactaggtacaagataaataactttacctcttctaacctctaggccctctggtataagagtgtgagagctgagtgaagtggatgcccccttataaaaacttcagatctcgtgagaact

SEQ ID NO: 198462 - DNA, 524 bp, Homo sapiens
acaaggtctagggtattgactgtgggagtgagtggaatgtagggtaaaggacgagattgtcgtatgagaggtggtcaaggaactgagaggtgcgagcatcagaacagtcatctatatgaacattgaaatcgcctggaatgatagcccagtgaaccaggaactaaagtcttcaaggcttaaggcttgagaagtgacctaggcatatcagatgaatgtaaagaagaagggggtagtggtggtatggtttgacaggaggcttttttcaggaaggaagggggaattatctggaaacaaactaggtacaagataaataactttacctcttctaacctctaggccctctggtataagagtgtgagagagaaaacactacggataggactatagagagaacagtggcttcagagcaattagatttcgtttggagcaaaagagtgaagggaccattcagacaagaggtttaagatataggggatttagctgatgtgttccaggggatatgatgcaaagatttcaggaattga

SEQ ID NO: 198463 - DNA, 301 bp, Homo sapiens
tgcacatctgcctttggactgcacggagaaatcaggacaggagtgaactctaggccatgaactcactggatttccattttataggcacccatagggtatgtttttaggatgtaagtttctgaggagaaagctagctctagcatgaagcttttttggattggcttctccatcgtgttggggtaacattttttttaattttttttgagacacagtcttactctgtctcagctcactgcaacctccacctcccaggttcaagcaattctcctgcctcagcctccggagtagctgggattacagg

SEQ ID NO: 198464 - DNA, 302 bp, Homo sapiens
gttagtcccaactacttgggtgtgttgaggcgggaggattgcttaagctcaggagttagggaccactctgggcaatacagtgagaccccatttccaaaaataattttttaataaaaaaggaaaaaaatgtttaaaatgaaggtgtcagaaatactcttttgagactacgtaataacctgggtgctgcctctaggtatctttgcggaattgttacagtaagtaaaactctctcaagccaacattcatggctctccatgaagtaatctctatttatttttttcacgtggcctccagcacatcat

SEQ ID NO: 198465 - DNA, 102 bp, Homo sapiens
tcacgtgcaggcacgcgcaaccagggctcccagggagaatgtgcattttaaacaatagacccagcctaattcctggtgttcacgtggaggccattcagccag

SEQ ID NO: 198466 - DNA, 213 bp, Homo sapiens
tcttagggagcctttcctgggctgcacgaataacctccattgttcgagaccccaaactctgctcacatcttcctttccctatctctgcttgggctatgatcacggtgactctagcagcccttcatggacattatagtactctctgccattcatcttttgctctaatcggacttcaagcccccacttacttgtccctcctaaacccggggagcc

SEQ ID NO: 198467 - DNA, 363 bp, Homo sapiens
ccatcctggggagcagagctagactctgtctcacaaaaaaaaaatttgtgggtgccaagactcaagaccatgggagctggtcgggcacagtggctgacgtctataatctcagcactttgggaggccaaggcaggtggatcgcctgaggtcaggtgttcaggaccaacctggccaacatggcaaaaccccgtttctactaaaaacacaaaaattagccaggcgtggtggttcatgtctgtaatcccagctgcttggaggctgaggcagaagaatcgcttgaacccgggaggcatcggctgcagtgagtcaagattgagacactgccctccagcatgggcaacagagcaagattctgtctcacaa

SEQ ID NO: 198468 - DNA, 485 bp, Homo sapiens
ttggttctccctgttttctttctttccttttctgaactgtactgtacctcctgcatgtgcacatcagcgtgtgccgcttctactggttgttttgccttttctctccctttggcatggacttaggcacttgcatgctgaacaattgctgctcaatagtgcaaatagtgatgttgctggaaatagcttgcgccttttatgttaacaaggtgcacgttgtgattagttaataacagacaactaaaccttactaatatgtacaccagcaaaactaacctaggaagcattttactaacaccatttttgtgtctgctcaataacttttgagttgcagtagggatgatgctgacactagttcaataatcagttaactctctaactagtttagatctcttagggctagttgaatagaatctaagaataaacctcaaacagacatgaaaatgggttccgtcataggtctaaaaacaaaaaccaaacaaacagaa

SEQ ID NO: 198469 - DNA, 410 bp, Homo sapiens
ctgttgtcatcaatacaactgtgctaggtgggtgggaaaggaaaatatcttgggctcccaaaatcactaagctaaaaggaaaactcaggatcatggtggatggaagtcaggactagattgcagctccgactcggatggacagagaagcatgtggaggctcatatcatgaatttttgctccagaacgactggaggaataaattacaaaacctgagaggacccacaggccccctgaaggaagcagatggctcctgcaggacccaggagacacaccaaatactgtgttagtatttacttatagaaatgcaaaatggtctggaaagtctcagccatagaatcaaacaagtagaagaaagaaattcagagctcgaacacaaagtcttcaatttgacccaatccaaccaagacaaa

SEQ ID NO: 198470 - DNA, 518 bp, Homo sapiens
cagaagatttgacatttgtgtcatcggattcccagaggagaggagaaagaggcagtactgacaaagtacttgaaataaaagtggaaatgttccaaaaacacagattcaagaagctgaggaaacctcagacaggataaagtgaaagaaattcacacaaagacatatcatagtcaaacttctgaaaacaaaagacaaagaaaatatttggaaaagcagtgagatagaaacaacttacctgtaagagggagacagttctaatgacagaggatttttcataacctaaggaggccagaaggaagtacaacatttttcgggggaatcaaaggctgaatgaggagtctagacttccaccctcctgtaacaaggcacccagacacttgtagaacctggagagaaaataactgtcaacatagaattttatatccagcaaaaataacctttaggaatgaaggagaaactaagagcacttgttaccagcaaacttccctcaaagaatgactacagatagctctctaaac

SEQ ID NO: 198471 - DNA, 355 bp, Homo sapiens
ctctgtgactcaggagcagggatctcaggcagctgatatcaaaaccacccagccccatccccaggaggcgacattccaatgctaggaccaatcccagatatctggtcccgatggtgaaatggaacaaagacctgcttgggaataaaccaaatgatttctcatgacgttgaacataagttctcccaagccatcatcttggtagaaaatgggacttattccttgacaggccccacccccttcagaaagaggcccttgaccctgataggttctctctaaaacccgtatattaacgcatctggccaacttgggttataaaattcagccttgtgttggcaactcgaaacatcaccagaga

SEQ ID NO: 198472 - DNA, 260 bp, Homo sapiens
tgctgggattacgggtgtgagtcactgcgcctggccctaaagttcctcttataaggataccagtcatattggattactgtcctaatgacctcattttaacttgattacttctttaaagatcctgtctccaaacacaggcatattctgaggcactggaggtgaggacttcaacatatacacttggaggtggggggacaaaattctgcccataacgccatatgttatttatccattcatcaattcacacttacatttccttt

SEQ ID NO: 198473 - DNA, 124 bp, Homo sapiens
ggtgcagttacggataagatggagtgatgagggaaaaggaagagacaggaatgagtactggccttggggcttggttgactgtgtgggtggggcacagagggccgcagcaaggattacaggaaaa

SEQ ID NO: 198474 - DNA, 3234 bp, Homo sapiens
cgggcgcgctgagtgagtgcgcgcgtgaaaaccgccgcaccgccgggggtgcgagtgtctgggccgaagcggccactccagcgacccagccccacggccacgctctcgggggcctttggctccaggcaacttggggcaagcgtctcagttctcgctctcccttcctcccagcggggtcgccgcagaccccagccctgggagcaccgctctgcagcgcggccggcgggtggagacggttggcccctaaactcgctcgtccagcccaaccgccccggcggcttctcccagccctcgaggctctcctgagcggcctggagaggcgtcgagcgcagcccagcgcccgcctgctcacccgccccggcccgggaagggaattttcggatcctgcgagcccggggcgcccccgcggcctagggcgggcagctcccggggcctggccgagccggtggcgcccgggaggccgcggggacagcacgcagcgcgcgcccttggatgccgtcccgcagcgacgccccggcccgccccgctcctcctcctgcctggctagcctgcctctcatttgggaagttttgtgggttttctttctcctcctccaaccttggcggaggccacgactcaggcgccacagctgggggctagaggccgcggaccatggtgcggggcagccaccgctgaagtcagcaaaaccgagcctggcctgaggcaggctgcgcgggaggccaaagccatggccattgccacgtcggacccagctggcccgggcactgtatgacaacaccgctgagtccccccaggagctgtccttccgccgaggggatgtcctacgggtcctgcagagagagggcgctggtggactggacggctggtgcctctgctccctacacggccagcagggcattgtgcccgccaacagggtgaagctcttgcctgctggcccagcacccaagcccagcctctctcctgcgtccccagcccagcctggctcaccatatccagccccagatcacagcaatgaggaccaggaggtgtatgtggtgccgcccccagctcggccctgtccaacctcaggacctccagctggaccttgcccaccctctcctgacctcatctacaaaatccccagagctagtgggacccagctggctgctcccagagatgccttggaggtctacgatgtgccccccaccgccctccgggtgccctccagtggcccctatgactgccctgcctccttttcccaccctctgacccgggttgccccgcagccccctggagaggatgatgctccctatgatgtgcctctgaccccaaagccacctgcagagctggaaccagatctggagtgggaaggaggccgggagccggggccccccatctatgctgccccctccaacctgaaacgagcgtcagccttactcaatttgtatgaagcacccgaggaactgctggcagacggggagggcgggggcactgatgaggggatctacgatgtgcctctgctggggccagaggctcccccttctccagagccccctggagccttggcctcccatgaccaggacaccctggcccagcttctggccagaagccccccacccccacacaggccccggctcccctcagctgagagcctgtcccgccgccctctgcctgccctgcctgtccctgaggcccccagcccctccccagtgccctctcctgccccaggccggaagggcagcatccaggaccggcctctgcccccacccccaccccgcctgcctggttatggaggccccaaggtcgagggggatccagagggcagggagatggaggatgacccagcaggacaccacaatgagtacgagggcattccgatggccgaggagtatgactatgtccacctgaagggcatggacaaagctcagggatctaggcccccggatcaggcctgcacaggggatcctgaactgcccgagagggggatgccggcgccgcaggaggccctgtccccaggggagccactggttgtgtccaccggagatctgcagctcctgtacttctatgctgggcaatgccagagccactactcagccctgcaggcagccgtggcagccctgatgtccagtacccaggctaatcagcccccgcgccttttcgtgccccacagcaagagggtggtggtggctgctcatcgcctggtgtttgttggggacaccctgggccggctggcagcctctgcccctctgagagcacaggtcagggctgcaggtacagcactgggccaggcattgcgggccactgtgctggctgtcaagggagctgccctgggctacccatccagccctgccatccaagagatggtgcagtgtgtaacagaactggcagggcaggccctgcaattcactaccctgctcactagcctggctccatgaaggtcctttggcacagctctgctcctcccctgcctgccaaagcccccctttaggccttgggtggctggaaggctttgttaagggactaggagaaatgggggtatctttcccctttcctgccctttctgctcatctcaacctctcacagaggtgtcttctccccctaacctacagctttttgtacaagccattttgtgtaaattatttatatttaatattattccctgctttgtcaggagcaggtactaggctctggggcagtgaggaactagatccttctctcctcagcctagggtggaggtcactgcactaccacccacctctggaagactggctgtgaaaagtcaggtggcagaaacctggggccacatagagcctctctcttttcctgtttcttggctctagaagatcagcactgcactgttagctgagagtgcgggcaagacataaactgtccagagtttgaaggttctcggaaagaccggagggcttctccccacagaaggcggagagagctggggctcagacatgggtgtgcaccttaataaaccctgctgtctgcctccctgactctgcttcttgggagcatggtgagcagccctggtgctcagcagccatacctatgggacacacactacgaaaaggatgcctttagggtttgggggagattttactcctttcttcaacaactattcactggacaagttctctgctcccatgatgcgccaggcacagttctgcaagtatattgtgaatgtattgttctagtgggatacacaaataagtcagttaaaatacataaataaaaacataaacctgc

SEQ ID NO: 198475 - DNA, 2954 bp, Homo sapiens
cgggcgcgctgagtgagtgcgcgcgtgaaaaccgccgcaccgccgggggtgcgagtgtctgggccgaagcggccactccagcgacccagccccacggccacgctctcgggggcctttggctccaggcaacttggggcaagcgtctcagttctcgctctcccttcctcccagcggggtcgccgcagaccccagccctgggagcaccgctctgcagcgcggccggcgggtggagacggttggcccctaaactcgctcgtccagcccaaccgccccggcggcttctcccagccctcgaggctctcctgagcggcctggagaggcgtcgagcgcagcccagcgcccgcctgctcacccgccccggcccgggaagggaattttcggatcctgcgagcccggggcgcccccgcggcctagggcgggcagctcccggggcctggccgagccggtggcgcccgggaggccgcggggacagcacgcagcgcgcgcccttggatgccgtcccgcagcgacgccccggcccgccccgctcctcctcctgcctggctagcctgcctctcatttgggaagttttgtgggttttctttctcctcctccaaccttggcggaggccacgactcaggcgccacagctgggggctagaggccgcggaccatggtgcggggcagccaccgctgaagtcagcaaaaccgagcctggcctgaggcaggctgcgcgggaggccaaagccatggccattgccacgtcggtgtatgtggtgccgcccccagctcggccctgtccaacctcaggacctccagctggaccttgcccaccctctcctgacctcatctacaaaatccccagagctagtgggacccagctggctgctcccagagatgccttggaggtctacgatgtgccccccaccgccctccgggtgccctccagtggcccctatgactgccctgcctccttttcccaccctctgacccgggttgccccgcagccccctggagaggatgatgctccctatgatgtgcctctgaccccaaagccacctgcagagctggaaccagatctggagtgggaaggaggccgggagccggggccccccatctatgctgccccctccaacctgaaacgagcgtcagccttactcaatttgtatgaagcacccgaggaactgctggcagacggggagggcgggggcactgatgaggggatctacgatgtgcctctgctggggccagaggctcccccttctccagagccccctggagccttggcctcccatgaccaggacaccctggcccagcttctggccagaagccccccacccccacacaggccccggctcccctcagctgagagcctgtcccgccgccctctgcctgccctgcctgtccctgaggcccccagcccctccccagtgccctctcctgccccaggccggaagggcagcatccaggaccggcctctgcccccacccccaccccgcctgcctggttatggaggccccaaggtcgagggggatccagagggcagggagatggaggatgacccagcaggacaccacaatgagtacgagggcattccgatggccgaggagtatgactatgtccacctgaagggcatggacaaagctcagggatctaggcccccggatcaggcctgcacaggggatcctgaactgcccgagagggggatgccggcgccgcaggaggccctgtccccaggggagccactggttgtgtccaccggagatctgcagctcctgtacttctatgctgggcaatgccagagccactactcagccctgcaggcagccgtggcagccctgatgtccagtacccaggctaatcagcccccgcgccttttcgtgccccacagcaagagggtggtggtggctgctcatcgcctggtgtttgttggggacaccctgggccggctggcagcctctgcccctctgagagcacaggtcagggctgcaggtacagcactgggccaggcattgcgggccactgtgctggctgtcaagggagctgccctgggctacccatccagccctgccatccaagagatggtgcagtgtgtaacagaactggcagggcaggccctgcaattcactaccctgctcactagcctggctccatgaaggtcctttggcacagctctgctcctcccctgcctgccaaagcccccctttaggccttgggtggctggaaggctttgttaagggactaggagaaatgggggtatctttcccctttcctgccctttctgctcatctcaacctctcacagaggtgtcttctccccctaacctacagctttttgtacaagccattttgtgtaaattatttatatttaatattattccctgctttgtcaggagcaggtactaggctctggggcagtgaggaactagatccttctctcctcagcctagggtggaggtcactgcactaccacccacctctggaagactggctgtgaaaagtcaggtggcagaaacctggggccacatagagcctctctcttttcctgtttcttggctctagaagatcagcactgcactgttagctgagagtgcgggcaagacataaactgtccagagtttgaaggttctcggaaagaccggagggcttctccccacagaaggcggagagagctggggctcagacatgggtgtgcaccttaataaaccctgctgtctgcctccctgactctgcttcttgggagcatggtgagcagccctggtgctcagcagccatacctatgggacacacactacgaaaaggatgcctttagggtttgggggagattttactcctttcttcaacaactattcactggacaagttctctgctcccatgatgcgccaggcacagttctgcaagtatattgtgaatgtattgttctagtgggatacacaaataagtcagttaaaatacataaataaaaacataaacctgc

SEQ ID NO: 198476 - DNA, 2697 bp, Homo sapiens
cgggcgcgctgagtgagtgcgcgcgtgaaaaccgccgcaccgccgggggtgcgagtgtctgggccgaagcggccactccagcgacccagccccacggccacgctctcgggggcctttggctccaggcaacttggggcaagcgtctcagttctcgctctcccttcctcccagcggggtcgccgcagaccccagccctgggagcaccgctctgcagcgcggccggcgggtggagacggttggcccctaaactcgctcgtccagcccaaccgccccggcggcttctcccagccctcgaggctctcctgagcggcctggagaggcgtcgagcgcagcccagcgcccgcctgctcacccgccccggcccgggaagggaattttcggatcctgcgagcccggggcgcccccgcggcctagggcgggcagctcccggggcctggccgagccggtggcgcccgggaggccgcggggacagcacgcagcgcgcgcccttggatgccgtcccgcagcgacgccccggcccgccccgctcctcctcctgcctggctagcctgcctctcatttgggaagttttgtgggttttctttctcctcctccaaccttggcggaggccacgactcaggcgccacagctgggggctagaggccgcggaccatggtgcggggcagccaccgctgaagtcagcaaaaccgagcctggcctgaggcaggctgcgcgggaggccaaagccatggccattgccacgtcggtgtatgtggtgccgcccccagctcggccctgtccaacctcaggacctccagctggaccttgcccaccctctcctgacctcatctacaaaatccccagagctagtgggacccagctggctgctcccagagatgccttggaggtctacgatgtgccccccaccgccctccgggtgccctccagtggcccctatgactgccctgcctccttttcccaccctctgacccgggttgccccgcagccccctggagaggatgatgctccctatgatgtgcctctgaccccaaagccacctgcagagctggaaccagatctggagtgggaaggaggccgggagccggggccccccatctatgctgccccctccaacctgaaacgagcgtcagccttactcaatttgtatgaagcacccgaggaactgctggcagacggggagggcgggggcactgatgaggggatctacgatgtgcctctgctggggccagaggctcccccttctccagagccccctggagccttggcctcccatgaccaggacaccctggcccagcttctggccagaagccccccacccccacacaggccccggctcccctcagctgagagcctgtcccgccgccctctgcctgccctgcctgtccctgaggcccccagcccctccccagtgccctctcctgccccaggccggaagggcagcatccaggaccggcctctgcccccacccccaccccgcctgcctggttatggaggccccaaggtcgagggggatccagagggcagggagatggaggatgacccagcaggacaccacaatgagtacgagggcattccgatggccgaggagtatgactatgtccacctgaagggcatggacaaagctcagggatctaggcccccggatcaggcctgcacaggggatcctgaactgcccgagagggggatgccggcgccgcaggaggccctgtccccaggggagccactggttgtgtccaccggagatctgcagctcctgtacttctatgctgggcaatgccagagccactactcagccctgcaggcagccgtggcagccctgatgtccagtacccaggctaatcagcccccgcgccttttcgtgccccacagcaagagggtggtggtggctgctcatcgcctggtgtttgttggggacaccctgggccggctggcagcctctgcccctctgagagcacaggtcagggctgcaggtacagcactgggccaggcattgcgggccactgtgctggctgtcaagggagctgccctgggctacccatccagccctgccatccaagagatggtgcagtgtgtaacagaactggcagggcaggccctgcaattcactaccctgctcactagcctggctccatgaaggtcctttggcacagctctgctcctcccctgcctgccaaagcccccctttaggccttgggtggctggaaggctttgttaagggactaggagaaatgggggtatctttcccctttcctgccctttctgctcatctcaacctctcacagaggtgtcttctccccctaacctacagctttttgtacaagccattttgtgtaaattatttatatttaatattattccctgctttgtcaggagcaggtactaggctctggggcagtgaggaactagatccttctctcctcagcctagggtggaggtcactgcactaccacccacctctggaagactggctgtgaaaagtcaggtggcagaaacctggggccacatagagcctctctcttttcctgtttcttggctctagaagatcagcactgcactgttagctgagagtgcgggcaagacataaactgtccagagtttgaaggttctcggaaagaccggagggcttctccccacagaaggcggagagagctggggctcagacatgggtgtgcaccttaataaaccctgctgtctgcc

SEQ ID NO: 198477 - DNA, 3117 bp, Homo sapiens
cgggcgcgctgagtgagtgcgcgcgtgaaaaccgccgcaccgccgggggtgcgagtgtctgggccgaagcggccactccagcgacccagccccacggccacgctctcgggggcctttggctccaggcaacttggggcaagcgtctcagttctcgctctcccttcctcccagcggggtcgccgcagaccccagccctgggagcaccgctctgcagcgcggccggcgggtggagacggttggcccctaaactcgctcgtccagcccaaccgccccggcggcttctcccagccctcgaggctctcctgagcggcctggagaggcgtcgagcgcagcccagcgcccgcctgctcacccgccccggcccgggaagggaattttcggatcctgcgagcccggggcgcccccgcggcctagggcgggcagctcccggggcctggccgagccggtggcgcccgggaggccgcggggacagcacgcagcgcgcgcccttggatgccgtcccgcagcgacgccccggcccgccccgctcctcctcctgcctggctagcctgcctctcatttgggaagttttgtgggttttctttctcctcctccaaccttggcggaggccacgactcaggcgccacaggacccagctggcccgggcactgtatgacaacaccgctgagtccccccaggagctgtccttccgccgaggggatgtcctacgggtcctgcagagagagggcgctggtggactggacggctggtgcctctgctccctacacggccagcagggcattgtgcccgccaacagggtgaagctcttgcctgctggcccagcacccaagcccagcctctctcctgcgtccccagcccagcctggctcaccatatccagccccagatcacagcaatgaggaccaggaggtgtatgtggtgccgcccccagctcggccctgtccaacctcaggacctccagctggaccttgcccaccctctcctgacctcatctacaaaatccccagagctagtgggacccagctggctgctcccagagatgccttggaggtctacgatgtgccccccaccgccctccgggtgccctccagtggcccctatgactgccctgcctccttttcccaccctctgacccgggttgccccgcagccccctggagaggatgatgctccctatgatgtgcctctgaccccaaagccacctgcagagctggaaccagatctggagtgggaaggaggccgggagccggggccccccatctatgctgccccctccaacctgaaacgagcgtcagccttactcaatttgtatgaagcacccgaggaactgctggcagacggggagggcgggggcactgatgaggggatctacgatgtgcctctgctggggccagaggctcccccttctccagagccccctggagccttggcctcccatgaccaggacaccctggcccagcttctggccagaagccccccacccccacacaggccccggctcccctcagctgagagcctgtcccgccgccctctgcctgccctgcctgtccctgaggcccccagcccctccccagtgccctctcctgccccaggccggaagggcagcatccaggaccggcctctgcccccacccccaccccgcctgcctggttatggaggccccaaggtcgagggggatccagagggcagggagatggaggatgacccagcaggacaccacaatgagtacgagggcattccgatggccgaggagtatgactatgtccacctgaagggcatggacaaagctcagggatctaggcccccggatcaggcctgcacaggggatcctgaactgcccgagagggggatgccggcgccgcaggaggccctgtccccaggggagccactggttgtgtccaccggagatctgcagctcctgtacttctatgctgggcaatgccagagccactactcagccctgcaggcagccgtggcagccctgatgtccagtacccaggctaatcagcccccgcgccttttcgtgccccacagcaagagggtggtggtggctgctcatcgcctggtgtttgttggggacaccctgggccggctggcagcctctgcccctctgagagcacaggtcagggctgcaggtacagcactgggccaggcattgcgggccactgtgctggctgtcaagggagctgccctgggctacccatccagccctgccatccaagagatggtgcagtgtgtaacagaactggcagggcaggccctgcaattcactaccctgctcactagcctggctccatgaaggtcctttggcacagctctgctcctcccctgcctgccaaagcccccctttaggccttgggtggctggaaggctttgttaagggactaggagaaatgggggtatctttcccctttcctgccctttctgctcatctcaacctctcacagaggtgtcttctccccctaacctacagctttttgtacaagccattttgtgtaaattatttatatttaatattattccctgctttgtcaggagcaggtactaggctctggggcagtgaggaactagatccttctctcctcagcctagggtggaggtcactgcactaccacccacctctggaagactggctgtgaaaagtcaggtggcagaaacctggggccacatagagcctctctcttttcctgtttcttggctctagaagatcagcactgcactgttagctgagagtgcgggcaagacataaactgtccagagtttgaaggttctcggaaagaccggagggcttctccccacagaaggcggagagagctggggctcagacatgggtgtgcaccttaataaaccctgctgtctgcctccctgactctgcttcttgggagcatggtgagcagccctggtgctcagcagccatacctatgggacacacactacgaaaaggatgcctttagggtttgggggagattttactcctttcttcaacaactattcactggacaagttctctgctcccatgatgcgccaggcacagttctgcaagtatattgtgaatgtattgttctagtgggatacacaaataagtcagttaaaatacataaataaaaacataaacctgc

SEQ ID NO: 198478 - DNA, 2873 bp, Homo sapiens
cgggcgcgctgagtgagtgcgcgcgtgaaaaccgccgcaccgccgggggtgcgagtgtctgggccgaagcggccactccagcgacccagccccacggccacgctctcgggggcctttggctccaggcaacttggggcaagcgtctcagttctcgctctcccttcctcccagcggggtcgccgcagaccccagccctgggagcaccgctctgcagcgcggccggcgggtggagacggttggcccctaaactcgctcgtccagcccaaccgccccggcggcttctcccagccctcgaggctctcctgagcggcctggagaggcgtcgagcgcagcccagcgcccgcctgctcacccgccccggcccgggaagggaattttcggatcctgcgagcccggggcgcccccgcggcctagggcgggcagctcccggggcctggccgagccggtggcgcccgggaggccgcggggacagcacgcagcgcgcgcccttggatgccgtcccgcagcgacgccccggcccgccccgctcctcctcctgcctggctagcctgcctctcatttgggaagttttgtgggttttctttctcctcctccaaccttggcggaggccacgactcaggcgccacagctgggggctagaggccgcggaccatggtgcggggcagccaccgctgaagtcagcaaaaccgagccctgtccaacctcaggacctccagctggaccttgcccaccctctcctgacctcatctacaaaatccccagagctagtgggacccagctggctgctcccagagatgccttggaggtctacgatgtgccccccaccgccctccgggtgccctccagtggcccctatgactgccctgcctccttttcccaccctctgacccgggttgccccgcagccccctggagaggatgatgctccctatgatgtgcctctgaccccaaagccacctgcagagctggaaccagatctggagtgggaaggaggccgggagccggggccccccatctatgctgccccctccaacctgaaacgagcgtcagccttactcaatttgtatgaagcacccgaggaactgctggcagacggggagggcgggggcactgatgaggggatctacgatgtgcctctgctggggccagaggctcccccttctccagagccccctggagccttggcctcccatgaccaggacaccctggcccagcttctggccagaagccccccacccccacacaggccccggctcccctcagctgagagcctgtcccgccgccctctgcctgccctgcctgtccctgaggcccccagcccctccccagtgccctctcctgccccaggccggaagggcagcatccaggaccggcctctgcccccacccccaccccgcctgcctggttatggaggccccaaggtcgagggggatccagagggcagggagatggaggatgacccagcaggacaccacaatgagtacgagggcattccgatggccgaggagtatgactatgtccacctgaagggcatggacaaagctcagggatctaggcccccggatcaggcctgcacaggggatcctgaactgcccgagagggggatgccggcgccgcaggaggccctgtccccaggggagccactggttgtgtccaccggagatctgcagctcctgtacttctatgctgggcaatgccagagccactactcagccctgcaggcagccgtggcagccctgatgtccagtacccaggctaatcagcccccgcgccttttcgtgccccacagcaagagggtggtggtggctgctcatcgcctggtgtttgttggggacaccctgggccggctggcagcctctgcccctctgagagcacaggtcagggctgcaggtacagcactgggccaggcattgcgggccactgtgctggctgtcaagggagctgccctgggctacccatccagccctgccatccaagagatggtgcagtgtgtaacagaactggcagggcaggccctgcaattcactaccctgctcactagcctggctccatgaaggtcctttggcacagctctgctcctcccctgcctgccaaagcccccctttaggccttgggtggctggaaggctttgttaagggactaggagaaatgggggtatctttcccctttcctgccctttctgctcatctcaacctctcacagaggtgtcttctccccctaacctacagctttttgtacaagccattttgtgtaaattatttatatttaatattattccctgctttgtcaggagcaggtactaggctctggggcagtgaggaactagatccttctctcctcagcctagggtggaggtcactgcactaccacccacctctggaagactggctgtgaaaagtcaggtggcagaaacctggggccacatagagcctctctcttttcctgtttcttggctctagaagatcagcactgcactgttagctgagagtgcgggcaagacataaactgtccagagtttgaaggttctcggaaagaccggagggcttctccccacagaaggcggagagagctggggctcagacatgggtgtgcaccttaataaaccctgctgtctgcctccctgactctgcttcttgggagcatggtgagcagccctggtgctcagcagccatacctatgggacacacactacgaaaaggatgcctttagggtttgggggagattttactcctttcttcaacaactattcactggacaagttctctgctcccatgatgcgccaggcacagttctgcaagtatattgtgaatgtattgttctagtgggatacacaaataagtcagttaaaatacataaataaaaacataaacctgc

SEQ ID NO: 198479 - DNA, 2641 bp, Homo sapiens
cgggcgcgctgagtgagtgcgcgcgtgaaaaccgccgcaccgccgggggtgcgagtgtctgggccgaagcggccactccagcgacccagccccacggccacgctctcgggggcctttggctccaggcaacttggggcaagcgtctcagttctcgctctcccttcctcccagcggggtcgccgcagaccccagccctgggagcaccgctctgcagcgcggccggcgggtggagacggttggcccctaaactcgctcgtccagcccaaccgccccggcggcttctcccagccctcgaggctctcctgagcggcctggagaggcgtcgagcgcagcccagcgcccgcctgctcacccgccccggcccgggaagggaattttcggatcctgcgagcccggggcgcccccgcggcctagggcgggcagctcccggggcctggccgagccggtggcgcccgggaggccgcggggacagcacgcagcgcgcgcccttggatgccgtcccgcagcgacgccccggcccgccccgctcctcctcctgcctggctagcctgcctctcatttgggaagttttgtgggttttctttctcctcctccaaccttggcggaggccacgactcaggcgccacagctgggggctagaggccgcggaccatggtgcggggcagccaccgctgaagtcagcaaaaccgagcctggcctgaggcaggctgcgcgggaggccaaagccatggccattgccacgtcggtgtatgtggtgccgcccccagctcggccctgtccaacctcaggacctccagctggaccttgcccaccctctcctgacctcatctacaaaatccccagagctagtgggacccagctggctgctcccagagatgccttggaggtctacgatgtgccccccaccgccctccgggtgccctccagtggcccctatgactgccctgcctccttttcccaccctctgacccgggttgccccgcagccccctggagaggatgatgctccctatgatgtgcctctgaccccaaagccacctgcagagctggaaccagatctggagtgggaaggaggccgggagccggggccccccatctatgctgccccctccaacctgaaacgagcgtcagccttactcaatttgtatgaagcacccgaggaactgctggcagacggggagggcgggggcactgatgaggggatctacgatgtgcctctgctggggccagaggctcccccttctccagagccccctggagccttggcctcccatgaccaggacaccctggcccagcttctggccagaagccccccacccccacacaggccccggctcccctcagctgagagcctgtcccgccgccctctgcctgccctgcctgtccctgaggcccccagcccctccccagtgccctctcctgccccaggccggaagggcagcatccaggaccggcctctgcccccacccccaccccgcctgcctggttatggaggccccaaggtcgagggggatccagagggcagggagatggaggatgacccagcaggacaccacaatgagtacgagggcattccgatggccgaggagtatgactatgtccacctgaagggcatggacaaagctcagggatctaggcccccggatcaggcctgcacaggggatcctgaactgcccgagagggggatgccggcgccgcaggaggccctgtccccaggggagccactggttgtgtccaccggagatctgcagctcctgtacttctatgctgggcaatgccagagccactactcagccctgcaggcagccgtggcagccctgatgtccagtacccaggctaatcagcccccgcgccttttcgtgccccacagcaagagggtggtggtggctgctcatcgcctggtgtttgttggggacaccctgggccggctggcagcctctgcccctctgagagcacaggtcagggctgcaggtacagcactgggccaggcattgcgggccactgtgctggctgtcaagggagctgccctgggctacccatccagccctgccatccaagagatggtgcagtgtgtaacagaactggcagggcaggccctgcaattcactaccctgctcactagcctggctccatgaaggtcctttggcacagctctgctcctcccctgcctgccaaagcccccctttaggccttgggtggctggaaggctttgttaagggactaggagaaatgggggtatctttcccctttcctgccctttctgctcatctcaacctctcacagaggtgtcttctccccctaacctacagctttttgtacaagccattttgtgtaaattatttatatttaatattattccctgctttgtcaggagcaggtactaggctctggggcagtgaggaactagatccttctctcctcagcctagggtggaggtcactgcactaccacccaccttacgaaaaggatgcctttagggtttgggggagattttactcctttcttcaacaactattcactggacaagttctctgctcccatgatgcgccaggcacagttctgcaagtatattgtgaatgtattgttctagtgggatacacaaataagtcagttaaaatacataaataaaaacataaacctgc

SEQ ID NO: 198480 - DNA, 2718 bp, Homo sapiens
cgggcgcgctgagtgagtgcgcgcgtgaaaaccgccgcaccgccgggggtgcgagtgtctgggccgaagcggccactccagcgacccagccccacggccacgctctcgggggcctttggctccaggcaacttggggcaagcgtctcagttctcgctctcccttcctcccagcggggtcgccgcagaccccagccctgggagcaccgctctgcagcgcggccggcgggtggagacggttggcccctaaactcgctcgtccagcccaaccgccccggcggcttctcccagccctcgaggctctcctgagcggcctggagaggcgtcgagcgcagcccagcgcccgcctgctcacccgccccggcccgggaagggaattttcggatcctgcgagcccggggcgcccccgcggcctagggcgggcagctcccggggcctggccgagccggtggcgcccgggaggccgcggggacagcacgcagcgcgcgcccttggatgccgtcccgcagcgacgccccggcccgccccgctcctcctcctgcctggctagcctgcctctcatttgggaagttttgtgggttttctttctcctcctccaaccttggcggaggccacgactcaggcgccacagctgggggctagaggccgcggaccatggtgcggggcagccaccgctgaagtcagcaaaaccgagcctggcctgaggcaggctgcgcgggaggccaaagccatggccattgccacgtcggtgtatgtggtgccgcccccagctcggccctgtccaacctcaggacctccagctggaccttgcccaccctctcctgacctcatctacaaaatccccagagctagtgggacccagctggctgctcccagagatgccttggaggtctacgatgtgccccccaccgccctccgggtgccctccagtggcccctatgactgccctgcctccttttcccaccctctgacccgggttgccccgcagccccctggagaggatgatgctccctatgatgtgcctctgaccccaaagccacctgcagagctggaaccagatctggagtgggaaggaggccgggagccggggccccccatctatgctgccccctccaacctgaaacgagcgtcagccttactcaatttgtatgaagcacccgaggaactgctggcagacggggagggcgggggcactgatgaggggatctacgatgtgcctctgctggggccagaggctcccccttctccagagccccctggagccttggcctcccatgaccaggacaccctggcccagcttctggccagaagccccccacccccacacaggccccggctcccctcagctgagagcctgtcccgccgccctctgcctgccctgcctgtccctgaggcccccagcccctccccagtgccctctcctgccccaggccggaagggcagcatccaggaccggcctctgcccccacccccaccccgcctgcctggttatggaggccccaaggtcgagggggatccagagggcagggagatggaggatgacccagcaggacaccacaatgagtacgagggcattccgatggccgaggagtatgactatgtccacctgaagggcatggacaaagctcagggatctaggcccccggatcaggcctgcacaggggatcctgaactgcccgagagggggatgccggcgccgcaggaggccctgtccccaggggagccactggttgtgtccaccggagatctgcagctcctgtacttctatgctgggcaatgccagagccactactcagccctgcaggcagccgtggcagccctgatgtccagtacccaggctaatcagcccccgcgccttttcgtgccccacagcaagagggtggtggtggctgctcatcgcctggtgtttgttggggacaccctgggccggctggcagcctctgcccctctgagagcacaggtcagggctgcaggtacagcactgggccaggcattgcgggccactgtgctggctgtcaagggagctgccctgggctacccatccagccctgccatccaagagatggtgcagtgtgtaacagaactggcagggcaggccctgcaattcactaccctgctcactagcctggctccatgaaggtcctttggcacagctctgctcctcccctgcctgccaaagcccccctttaggccttgggtggctggaaggctttgttaagggactaggagaaatgggggtatctttcccctttcctgccctttctgctcatctcaacctctcacagaggtgtcttctcccccttttccagagccccctggagccttggcctcccatgaccaggacaccctggcccagcttctggccagaagccgccacgctagacatggcccacggggtcccctcaggcatgaaagccgtgtccacggcacggcaccgtcgtgcctgcactgcgctgctgccatgcaggcagccacaggcaaccacaaccgcctacagacctgctaccaaacaacgcacgccacaaccaaccggcgactagcagctcacacagggccacacacagagctgtccgggcccagcgccacggacccgcggtacagcaggaaaagcgcacagcaccgcgcgccccagccgacgcccagccacggcatgcgccccagccacgaccgacaaggaggagagagcgacacagccgccgactaacgcccgggtatgaacgg

SEQ ID NO: 198481 - DNA, 745 bp, Homo sapiens
gaatccagatctatctgatatcaagtgtgggcacttcactgctgctctctctagaatctaaactttccgatgggcagaggtaagagctaaaaggatcgcccttgggaagaaagagaggaaggagaaaagaagtgagggaggaaatggcactcatgagaatgttctctctgaccactcctcttgcccttcaggaggccctgtccccaggggagccactggttgtgtccaccggagatctgcagctcctgtacttctatgctgggcaatgccagagccactactcagccctgcaggcagccgtggcagccctgatgtccagtacccaggctaatcagcccccgcgccttttcgtgccccacagcaagagggtggtggtggctgctcatcgcctggtgtttgttggggacaccctgggccggctggcagcctctgcccctctgagagcacaggtcagggctgcaggtacagcactgggccaggcattgcgggccactgtgctggctgtcaagggagctgccctgggctacccatccagccctgccatccaagagatggtgcagtgtgtaacagaactggcagggcaggccctgcaattcactaccctgctcactagcctggctccatgaaggtcctttggcacagctctgctcctcccctgcctgccaaagcccccctttaggccttgggtggctggaaggctttgttaagggactaggagaaatgggggtatctttcccctttcctg

SEQ ID NO: 198482 - DNA, 2785 bp, Homo sapiens
cgggcgcgctgagtgagtgcgcgcgtgaaaaccgccgcaccgccgggggtgcgagtgtctgggccgaagcggccactccagcgacccagccccacggccacgctctcgggggcctttggctccaggcaacttggggcaagcgtctcagttctcgctctcccttcctcccagcggggtcgccgcagaccccagccctgggagcaccgctctgcagcgcggccggcgggtggagacggttggcccctaaactcgctcgtccagcccaaccgccccggcggcttctcccagccctcgaggctctcctgagcggcctggagaggcgtcgagcgcagcccagcgcccgcctgctcacccgccccggcccgggaagggaattttcggatcctgcgagcccggggcgcccccgcggcctagggcgggcagctcccggggcctggccgagccggtggcgcccgggaggccgcggggacagcacgcagcgcgcgcccttggatgccgtcccgcagcgacgccccggcccgccccgctcctcctcctgcctggctagcctgcctctcatttgggaagttttgtgggttttctttctcctcctccaaccttggcggaggccacgactcaggcgccacagctgggggctagaggccgcggaccatggtgcggggcagccaccgctgaagtcagcaaaaccgagcctggcctgaggcaggctgcgcgggaggccaaagccatggccattgccacgtcggtgtatgtggtgccgcccccagctcggccctgtccaacctcaggacctccagctggaccttgcccaccctctcctgacctcatctacaaaatccccagagctagtgggacccagctggctgctcccagagatgccttggaggtctacgatgtgccccccaccgccctccgggtgccctccagtggcccctatgactgccctgcctccttttcccaccctctgacccgggttgccccgcagccccctggagaggatgatgctccctatgatgtgcctctgaccccaaagccacctgcagagctggaaccagatctggagtgggaaggaggccgggagccggggccccccatctatgctgccccctccaacctgaaacgagcgtcagccttactcaatttgtatgaagcacccgaggaactgctggcagacggggagggcgggggcactgatgaggggatctacgatgtgcctctgctggggccagaggctcccccttctccagagccccctggagccttggcctcccatgaccaggacaccctggcccagcttctggccagaagccccccacccccacacaggccccggctcccctcagctgagagcctgtcccgccgccctctgcctgccctgcctgtccctgaggcccccagcccctccccagtgccctctcctgccccaggccggaagggcagcatccaggaccggcctctgcccccacccccaccccgcctgcctggttatggaggccccaaggtcgagggggatccagagggcagggagatggaggatgacccagcaggacaccacaatgagtacgagggcattccgatggccgaggagtatgactatgtccacctgaagggcatggacaaagctcagggatctaggcccccggatcaggcctgcacaggggatcctgaactgcccgagagggggatgccggcgccgcaggaggccctgtccccaggggagccactggttgtgtccaccggagatctgcagctcctgtacttctatgctgggcaatgccagagccactactcagccctgcaggtacagcactgggccaggcattgcgggccactgtgctggctgtcaagggagctgccctgggctacccatccagccctgccatccaagagatggtgcagtgtgtaacagaactggcagggcaggccctgcaattcactaccctgctcactagcctggctccatgaaggtcctttggcacagctctgctcctcccctgcctgccaaagcccccctttaggccttgggtggctggaaggctttgttaagggactaggagaaatgggggtatctttcccctttcctgccctttctgctcatctcaacctctcacagaggtgtcttctccccctaacctacagctttttgtacaagccattttgtgtaaattatttatatttaatattattccctgctttgtcaggagcaggtactaggctctggggcagtgaggaactagatccttctctcctcagcctagggtggaggtcactgcactaccacccacctctggaagactggctgtgaaaagtcaggtggcagaaacctggggccacatagagcctctctcttttcctgtttcttggctctagaagatcagcactgcactgttagctgagagtgcgggcaagacataaactgtccagagtttgaaggttctcggaaagaccggagggcttctccccacagaaggcggagagagctggggctcagacatgggtgtgcaccttaataaaccctgctgtctgcctccctgactctgcttcttgggagcatggtgagcagccctggtgctcagcagccatacctatgggacacacactacgaaaaggatgcctttagggtttgggggagattttactcctttcttcaacaactattcactggacaagttctctgctcccatgatgcgccaggcacagttctgcaagtatattgtgaatgtattgttctagtgggatacacaaataagtcagttaaaatacataaataaaaacataaacctgc

SEQ ID NO: 198483 - DNA, 3385 bp, Homo sapiens
cgggcgcgctgagtgagtgcgcgcgtgaaaaccgccgcaccgccgggggtgcgagtgtctgggccgaagcggccactccagcgacccagccccacggccacgctctcgggggcctttggctccaggcaacttggggcaagcgtctcagttctcgctctcccttcctcccagcggggtcgccgcagaccccagccctgggagcaccgctctgcagcgcggccggcgggtggagacggttggcccctaaactcgctcgtccagcccaaccgccccggcggcttctcccagccctcgaggctctcctgagcggcctggagaggcgtcgagcgcagcccagcgcccgcctgctcacccgccccggcccgggaagggaattttcggatcctgcgagcccggggcgcccccgcggcctagggcgggcagctcccggggcctggccgagccggtggcgcccgggaggccgcggggacagcacgcagcgcgcgcccttggatgccgtcccgcagcgacgccccggcccgccccgctcctcctcctgcctggctagcctgcctctcatttgggaagttttgtgggttttctttctcctcctccaaccttggcggaggccacgactcaggcgccacagctgggggctagaggccgcggaccatggtgcggggcagccaccgctgaagtcagcaaaaccgagcctggcctgaggcaggctgcgcgggaggccaaagccatggccattgccacgtcggtgtatgtggtgccgcccccagctcggccctgtccaacctcaggacctccagctggaccttgcccaccctctcctgacctcatctacaaaatccccagagctagtgggacccagctggctgctcccagagatgccttggaggtctacgatgtgccccccaccgccctccgggtgccctccagtggcccctatgactgccctgcctccttttcccaccctctgacccgggttgccccgcagccccctggagaggatgatgctccctatgatgtgcctctgaccccaaagccacctgcagagctggaaccagatctggagtgggaaggaggccgggagccggggccccccatctatgctgccccctccaacctgaaacgagcgtcagccttactcaatttgtatgaagcacccgaggaactgctggcagacggggagggcgggggcactgatgaggggatctacgatgtgcctctgctggggccagaggctcccccttctccagagccccctggagccttggcctcccatgaccaggacaccctggcccagcttctggccagaagccccccacccccacacaggccccggctcccctcagctgagagcctgtcccgccgccctctgcctgccctgcctgtccctgaggcccccagcccctccccagtgccctctcctgccccaggccggaagggcagcatccaggaccggcctctgcccccacccccaccccgcctgcctggttatggaggccccaaggtcgagggggatccagagggcagggagatggaggatgacccagcaggacaccacaatgagtacgagggcattccgatggccgaggagtatgactatgtccacctgaagggcatggacaaagctcagggatctaggcccccggatcaggcctgcacaggggatcctgaactgcccgagagggggatgccggcgccgcaggaggccctgtccccaggggagccactggttgtgtccaccggagatctgcagctcctgtacttctatgctgggcaatgccagagccactactcagccctgcaggcagccgtggcagccctgatgtccagtacccaggctaatcagcccccgcgccttttcgtgccccacagcaagagggtggtggtggctgctcatcgcctggtgtttgttggggacaccctgggccggctggcagcctctgcccctctgagagcacaggtcagggctgcaggtacagcactgggccaggcattgcgggccactgtgctggctgtcaagggagctgccctgggctacccatccagccctgccatccaagagatggtgcagtgtgtaacagaactggcagggcaggccctgcaattcactaccctgctcactagcctggctccatgaaggtcctttggcacagctctgctcctcccctgcctgccaaagcccccctttaggccttgggtggctggaaggctttgttaagggactaggagaaatgggggtatctttcccctttcctgccctttctgctcatctcaacctctcacagaggtgtcttctccccctaacctacagctttttgtacaagccattttgtgtaaattatttatatttaatattattccctgctttgtcaggagcaggtactaggctctggggcagtgaggaactagatccttctctcctcagcctagggtggaggtcactgcactaccacccacctctggaagactggctgtgaaaagtcaggtggcagaaacctggggccacatagagcctctctcttttcctgtttcttggctctagaagatcagcactgcactgttagctgagagtgcgggcaagacataaactgtccagagtttgaaggttctcggaaagaccggagggcttctccccacagaaggcggagagagctggggctcagacatgggtgtgcaccttaataaaccctgctgtctgcctccctgactctgcttcttgggagcatggtgagcagccctggtgctcagcagccatacctatgggacacacactacgaaaaggatgcctttagggtttgggggagattttactcctttcttcaacaactattcactggacaagttctctgctcccatgatgcgccaggcacagttctgcaagtatattgtgaatgtattgttctagtgggatacacaaataagtcagttaaaatacataaataaaaacataaacctgcaaaagaaaaaaaaagatgaaaaacaataataggaagagagaaccgaacgaagtgactgaagaggcgacaaccgaagaaaaaaaaaagggggggggaggagaacagaaatatgaacacacgggggggggccagcgacgggaccagacccccgaatggtgtgccggagaaggtggggccaatgagataggtccaagttgtaaaagagtagccgaccagaaggaggacaaccaagggtgcgggaggggggaaaagacttggcaagggacgaatccttggaaaaagaagccaatgtagggggggggggcgataagtagtccgcaaacagcccaggaataagagtacccagggggatgaaacaaagacgtatgagagtcgacaaacacgcgaagatctggggagaaacaaagtgagcggggacaattgaagaagac

SEQ ID NO: 198484 - DNA, 616 bp, Homo sapiens
caagtatataaaaggcacattgttttataaatctcctcaaggaaattcaagggcagtggaaattcttttggttcatgaggtggtgtttggtaatagaaagaaagggtcaaagttggcaaagtgatgcaggtttagtgtcctttatctgaaatgcttgtgaccagagtgtttcatattttgtatttttccagattttggaatatttgcatatacaaaatgagataacttggggatggaacccaagtctaaacatgaaattaatttatgtttcatatatatctcttatacacatagcccgaaggtaattttatatgatatttttagtaattctgtacattgaagataggaagggaaaaaaataataattctctgcacgaaacaaagctttgactgaccagcacatgaggtcaggtgtggaattttccaccatggcactcaaagggtttatgaatttttaaatgagggatgctaaatctatatgttggattgaacttccatcgtagaaaaaacttcttgttaggagcagactcctaattcgcctattgacttgattgattaattgagacagagtctcctctggcccaggctagagtgcagtggtacaatctcggctcac

SEQ ID NO: 198485 - DNA, 245 bp, Homo sapiens
ccgggaccatcgagtactgcggaaagggtggcccgaatctgacccctatttagcacttgctgtgggtggtgccaggacaatcacttgcatgctgggcatgacgagttatggattatcttcagggttcctagggcgctggcttgggaaagatttccatccagtggttttgttttgttatgtctgagctgggaaagaaaggggtttacaagagcgtcaggaaaaggaagattgaagaggagatgggg

SEQ ID NO: 198486 - DNA, 720 bp, Homo sapiens
acaacacacctttattatctgacatttctgggggtcagaaatccaaaatgactctccctgggctggatccgggtgttggcagagctgcgttccttctggggtcctgggggaagcctgtttccttgccttttccagtgtctagaggctgaccccattctttggctcatggcctcttcctccgtcttcaaagccagcagtgttgggccgagtctttctcaggctgctacctctgttctctctctcgtgcctccctatgtcatttgtcaagacccagaggattccacaggcctacccagataacccggggtaatcttcccactttaaagccagctgattgacaaccttaatcccatccacaacctctgtgaccctctgccatgcaaggtaacatactcacaggcatagggatgaggatgcggatgtctttagagggccactgttttgcctaccacagcttccatttggattcttgtcccaacccctacaaaagtgaggcatataatttgttgaattctgaataaaatgctaccagtgtctacaaattatattttttctttttttaaaaaaaaaaaaaaaccttcttccccaagtctggtttcctttagacctcaggactaagtacctgagaagatctgcgggcaaggatagttatgtgattatctggacagaatggcatttctgattgacattgttgcattactttggctccagatgcagtgg

SEQ ID NO: 198487 - DNA, 371 bp, Homo sapiens
atttcagccttagaagttcttggcttgtagtttttgttgtactcatgaaaatgctcccccatatatatgatcattctcgcttactataacatccttgcttactaaatgagttaacagggctttatggtgtgtatcgtgaaacacacgtgcattaaagaccctctggaaggtattagcttttcacactttcacaacaaaagcttcacacttgtggttattaagctattttctctaaccagttccctttcaagcaaaatgcatacattggtctctgtaggtgatgggttaatgcatggaaatagtttctccttccctggaactgggaatagtgggtgagatagtgtattttttaatgtaaagacaggcacaaa

SEQ ID NO: 198488 - DNA, 372 bp, Homo sapiens
tacttaacagcaaatggtaaagcaggaagatcttcagtagcataaccagacactataaactgagtccatgtgaatggcaaagactggataacagaacaccatgtaattctactatgaacatatgtgtaaacagatatcataaaaatactttaatgaagtatttcattatgaagccaagactctgttaaacctaaacataagtggatggttgtaaaatgattgcagccattggcaaagccttattagaggtatgaagaatggaggcttaacttttccttatcccagggtttatgcctgcagtgagtctaagaatggtactgcaaatggtgaaaaggaacagcaggtagtaaatactgttcacttattgaaagc

SEQ ID NO: 198489 - DNA, 392 bp, Homo sapiens
ggtactccaggcagaaggcacaacgtaaacaaaggtgaggaaacaggaaacataggatgtacacaaagaacaagttttaactttgacagaaagaattgaggatgacaaaagggcaataatgatttttttaaaatttgctttgaaagaatgaatagagtcagatcattaggggcctagaggctaagataggcagtttgactaattttttctaagcgccagagaatgatgaaatgttttcagcaaaagcagtatgcctggaactctgctataggaaaattaacacagtgggtatgtgtggcattaatcaaagaaggaagaaaaagttgaggaaatcacctagaactctaatggaaaatgtgacataacagttagaaaagcaggaagcagcaaag

SEQ ID NO: 198490 - DNA, 449 bp, Homo sapiens
ggcatcactaatgtcactagtggcattttgaatgggtcccatagtgttagacaaggtttacaatattccattaaatacaatgaaaaatacataagaactatgagatcatttctttactttgatatgcaatttactggagagacaagctgctctcacagtttagcatcacagcatgcagtgttttcagtggatactcacaacacttgagtttactgcaatagcagcaggaggtagctatgaaattattacaatactgcaatatgtactacagttaattttatacagttatgatttaatactgcatatttacgtttgtttacgtttgtctcgactatgaatggcaccatgtgtagtctgtgtttatgtgcctaaattttgataaattttaactttttataatagattttatgtatgtgtagattttatgtagtaaatgataaaacaggcca

SEQ ID NO: 198491 - DNA, 465 bp, Homo sapiens
tgcaaaggtggacttggaagccattttcatttttggcctatttagaaaattaaatgatactactttttcctatacaacttatatttggtgggatatttttatttacttaatttgaaattttagactgaatagtcttaaatttccagcataaatattctatattttaatcaatgtttccttgtatgtagcatttgtacagttagttttttgaagtttttaattttttttttgtttgagacagtgtttcactcttgttgcccagactggagtgcaatgggcgacctcggctcactgcaacttccatctcccaggttcaagcgattctactgcctcagcctcccaagtagctgggattacaggcatgtgccaccacgcccagctaattttgtatttatagtagagatgggatttcaccctgttggtcaggctggtctcaaactcctgacctcaggtgatccgctcacc

SEQ ID NO: 198492 - DNA, 328 bp, Homo sapiens
ggagtgaagggtgacacagcgatacacaataacctttacagggttcatctgcaagtcagaatcattcaaggactaggcctaattcacctgaggtcacatgtgaaataatttggatgagattcttaactccagttgaactgtgttatgcaatcatgcttggttcactgaggctggaataacctttatgctggaaccattcaccaagcaaaaacatggctttacttttcaggatgatggggcagggcttagtcccagaaaagaaacactcttacacttgttactagtaagaggaacacttgtagcctcttagggaacaagaaaacatggc

SEQ ID NO: 198493 - DNA, 434 bp, Homo sapiens
aggctcatttgaggaaatggtggaacttaagaggagggttctctatcattgtcaaaaacagcatgaaattcttatgaattaagttgtaaagagaatttctgaattgaggaagacattgaaatagattgtctgcaagattccgattaatgctatttttatggttccaaatttaagatagacaatagctgatcataatagggaacacttacagacattactatgcaaagacttgcaacaactgtatgaggcaggtgtttttatctccatcttcaggatgaaagaactgaggcatagagtagtaaaagaaacttaattagcaggtggtggggctatgatctaaacacaggcattctgggtccaggtccatgctctgaacctctgctgtacttgctgagaactctcaatgttacttattctatcagtggcttaagctg

SEQ ID NO: 198494 - DNA, 478 bp, Homo sapiens
atgaacttactatagccagatttatctttcctgtagcccccacttacccagtttcatttctgtgattgcagtttcccatagtacagtacactaagatagttatgagaaatagagaccacattcacttgctctattttattattgggtatcattgttaatctcttactgtgcctaatttagaaattaaactttatcatcggtacatatgtataggaaaaaacatagtataggtagatagggcttggttctatccatgatttcaggcatccactggggatcctggaatgcatcccccatggacaaaggggagctactgtactttccttctaatatccgaggattgtggactcccctcttcttcgaggtcagtcccttcatctgtactcctgaccctttggcccacctcttttgagatctcaggccatctttacctcttcccccttagactttcagcctctccccctgaactgagtccttc

SEQ ID NO: 198495 - DNA, 364 bp, Homo sapiens
attagaggtggccgacagtggattctgagggaaaaggaaaaggtgactaggaagactttggagatttccagttttctggaggatggtacctggtaatgacaatctaaatagtagaaagtgagaaagactgagagcctgggaacaaacttgatgaattccaactttaaatgagggactagcgaacgtatctgaaaaggaggagccagtgagatagaagaaactcagctgtgtggtgttgaggccaagaaaggagtggcctatgccatactgctgaaaggcctagtaatgccagcaacaattgtagctaccattatcacaggcttattatgtgccaggtactttataagttttatctcatttaatc

SEQ ID NO: 198496 - DNA, 241 bp, Homo sapiens
cagcagtaaatgagggttctcttaggcaggctttcgagctctaacatcactgagtttctttgatatgttgggatttcttaactctgttgcttgcttagacagtggaagtgcagctcacagcgttactcatagtagggcatgatacatttttattggttagctgaggaatcaaaatatgagtagtccgttgagtggccctgaggtaccactttcattttgatttgtttctacttcacagagg

SEQ ID NO: 198497 - DNA, 444 bp, Homo sapiens
  misc_feature (36)..(36): n is a, c, g, or t
  misc_feature (64)..(64): n is a, c, g, or t
tcgggatgcgaggcgggtggatcatgatggtcaggngatcgagacatcctggctaacaaggtgnaaccccgtctctacaaataaaagatgtgagcatctgagatcaccccctagagattctgattttactggggcggtgcccaggcaatgataatttaataggtacagagaagagggaggtggaactttgagacctgcccacgggtggaagcagaacaaaccagagatggggctaggagaggctaggaaactaggagaggctggcagaaaggagggaggagattaggtcaggagcaaggccgtctcaggaaagacggaacagcagctgcgtcagagggaggaaagccaggcttttcatgaggactggactgtccccttgaccttcgtctctgggctgtggacattggtgggggtggagaatgactcggtgtggggaggtgtggt

SEQ ID NO: 198498 - DNA, 497 bp, Homo sapiens
ccttacaaccaccctacgtaatacacacgcttattattccccattttattgataagtaaagtaaggctctcagtgcttaagtaactggcccatgattacagaattaattgtgttgaagtctggatataaaccctgattcaggtgagccacagttcacattcttaaccacatagaggccattgttctaagcaaagatgcattttgtatgctataatttttttcttataacttttctttcagtcatctagatttctcagcaaagcttacccagataggtaaacattttggaagatgtagaatagagaagattttttagaaggggagaagtgggagagagctttccatattgcaaatttttgagatggtatgggaaacagcatatatgccactattgaatgtaacttcggatatattctttcattattctacatgagtttttaaattacatttactttggatccttcagttttgtcaagctcatcaaaatcatcttttta

SEQ ID NO: 198499 - DNA, 306 bp, Homo sapiens
ccttttaatgaaaatttattgataaactctaatagcagtctggatttttttttttatttccccaagactatcataaaacggtatgatagcagtctgttgtctcacttcaggaaaaggctttacttttataaatcagtccacctccccttcagtctaccattgatgggcatttaggttgattccatgtttttgctattaggctgtcagaaattccagggcagaggccaagtttatttcttctttgtatgtcttaagcacagtgcccaaactgtgctaagtactcaataaatattagttgaattgaac

SEQ ID NO: 198500 - DNA, 627 bp, Homo sapiens
ctttttttctattcctagtttctctcacttccttttgcttactgtttaaagtttcaaaacttgctgcacatcacatccttctttttatcagctttggtgcaccttagaacagaaatttctcccgggaggacaggatacaggagcctgtatttagaaagtacttattatgggttggatgaaggcctaactatgcctagagtcaagctgcttgaagccattctaatattcatttagttagaacggtaaccacactgagttattgctggtctcatatggatcatatattcacagtcagctcttggcttagacaagaagatatatattgtctctgctgttcacatcgtgtatttttatttcattatgactattgtgcttagaagcatgattttcaatctatattcccaattaaattatttctacacagtctgtacatgtaagcacatggttttctttgaagcagactttgttaaaattgatacctattctctactatctctgccttccaggactaccacattctgccctaacgagacaggaagaaacaattttttacatgaatggacttcataaccaggcatataggaactggcgcgaagttttaaaagttctagaaagcagtagaagttc

SEQ ID NO: 198501 - DNA, 548 bp, Homo sapiens
aaaagaaatataaagctcttaatcagtgccttgcactaatgggcaatcaataaagtgatgctgtatcatcatcatcaattctacgatcaattctcaggctttggaggctttagaatctttctatgtctttggatgttgtggcctttattcaacatacaagtttgtttggagctggtggtcagggatatggtattttcactaagttagggatggagctttgtaagaaatcagtataaaggaggaaaaaagaaacaagcgtcctaaagacagaacatttacagctgagcaagtgctgatggctgccttcaccacgttctgctgcagcggttctcagcatttatgtgcatttctgaaagattcccactcttttctccccagagtctgaatggagaaggtctggaacaacctgagattcagcatttttaggagtgtctctggagattttgaaacacgtggttcaaggactctctgtctcttctccctcccccaaacgagaaactgctgcttgtgtctgagagtcaatacgagatttaaaaacagcaacaaaa

SEQ ID NO: 198502 - DNA, 411 bp, Homo sapiens
ctggcactcccacagccaagttactggatttctttccattctttttttcatgcattttggcatggaagataccatattacaacataattttttcacttagtatattattattatagccatttctcttactaaatttgcttccgaaacatcatttttaatgtctgcgctaatattccactgtaggcatgcattaccacaattttgccagttctctatttgacacttaggtcatttgcaaattttcacttttataaacaaataaaataagcatctttgtgcatacagctttatctgcattttaattatttctttaggaagggtctcagaagcaggattaaaactaggaaaaggagtacatgagtacagctgaaaaacccactgtctacagcaggggaaatgatttaaaaaaat

SEQ ID NO: 198503 - DNA, 1042 bp, Homo sapiens
ataaacatgtaaacaatgaaacaatgaatatggtactggtactgtcagaaggccgtgtggtaagcagccttgaggagggttgccgagggagtctgagaagatgcctgtggagttgagactgctcagtgaggagaggcaagggagtctagggtggctggggtgtcttagatgaggtcagagagaagagcaggaccagaaatggccagaacctgtcagctgcctttggactttggatttaattctggttgcagtgagaggctgtgggaggattctgagcaggggcgagctgtggtttgatttgcacttagaagataattgggatgtcgtgaagactggactgtaacgggctagagtggaggtgaggaaagcagttcgagttggtcatgaagcagttggtgaggaaaacctaagtggatatttgcctcttaggggcaagcagtgttctaggcttcggcagtgaacaaaaatcctttcctgatggagctcgaatcctggcaatctgctgttgctgtagtcccaggaggagacagcgtggtaccttaatttaggctatggctgtaggagtgagtacagtgggacatcattggctttgggtatatttcagaggtagaactggatttgagcaaggattagaagtgggatgtgggaatgagacaggctcggtttctggcctgagccactgggtagatgatgatcgcattactgaggtgaagtaggaaattgttaggaagaggacatttggtgaggaaaacccaagtttcttggcttcgttacattagagatgcctattataaatttaatggaaatggcaagtcaccaattaggtatttaggtcgggagaagtttgaggtcggagagagacattttggtgactttctttaactgcggaccatcctgaacaatatgtaacccataaaagagcctgggctttggactcaggcctgggtttcaatttggaaatctggacaatgaggactggtgtgactggatgagttacttaccctctatgacctcattttacctcaactattgaatgggtact

SEQ ID NO: 198504 - DNA, 798 bp, Homo sapiens
ctggctaatttttgtatttttagtttgagaccagcctggccaacatagtgaaaccccatctctacaaaaattagctaggtgtggtggcaggcccctgtaattccagctactcgggaggctgaggcaggagaattgctcgaacccaggagatggaggttgcaatgagctgagatcgcaccactatactccagcctgggtgacagagcaagactccatctctaaggaaaaaataaagaagttgaaaacatcatccaacatgtaatcaatataaacattattagtcagatattttatagtttttttgtgctaagttttcaaaatctgatgcatattttatacctagagcacatctcagtttagatgctacattttcagcaattgaagtgaaatatagccctaccaaaatgataaagttgtgtttaatgggaaaatacttcatttactttagttttaaaatatgttaattaaaattaaattaatttaaaatctaggtctaaccacatttcaagtgctcagtagccacctgtgtctagtgagtgctgtattagagagcatggaaatagagttgtggggtagggtgggcagcagcatggagctgcgtcaggaacctattgcagtaattgaagccaagatgttggccgggaccagagtgttagcagaggagtaggtgagaagtggttgtattcaagctgtattttaaagatccagcttgcgggacttatgaatggattgaatgtgggatatcagagaaagtgaggtctcaacagtaatcttttcagtctgagcagttgaagaata

SEQ ID NO: 198505 - DNA, 480 bp, Homo sapiens
ctcatatccagtcatcttacagggttggctccataaaggaaacagtttaattttccttagaattagcatattctgctgggattacaggcatcagccaccacacccaatctgattatctttttaaccagacaaaacaatagtactctataagaatcgtaaaattttattattaaaaatagcagccgggcatggtggatcacgcctgtaattccagcactttgggaggccgaggcaggcagatcacttgaggtcaggagtttgagaccagcctggccaacatggtaaaaccccgtctctactataaatacaaaaattagctgggcgtggtggcaggcgcctgtaaacccagctacttgggaggctgaggcaggagaattgcttgaccctgggaggcagaggttgcagtgagccaagattgcaccactgcactccagcctgggtgacagagtgagactccatctctaaaaaaacaaaaaaaga

SEQ ID NO: 198506 - DNA, 433 bp, Homo sapiens
ctagattattttgaggtcttattttcccctttacaactgggaacatcacagtttttttataactagcctggtctgagctgtcaatgaaaatcttcaattttttttcattctctcatccttctggcttagctttctgacaacagggcctcaggaaaaccaagagaatcaagctggaatgtttgtagcatcccatttgacttgacaacagcatatggaacaagtcagaacctatttcaggacttgtgcctggctctttagtctccatatggaaccataggcatttgaggaaccaacccttttgatggggttaccaagttctggagacactttatcatcttgattgtcctatctattgttcaattttgcctgaattaatgtaggataaaaccttgcagaggaaagaaggaagaggttgttatagaaatctattatc

SEQ ID NO: 198507 - DNA, 573 bp, Homo sapiens
tggaagtatgaaagtaggtcattttgaaataacaaaaggcacgctcataaaaagcaaaaatacctccatggttttggttatccaatttctcaatctggtttgggtcagtgggaaagtttaagaattaaaaaatgaaagtttttgacagttcaagttcaaaagtaaatttatagatgaagaaacagaggcataagagtgtttaaataacgtgcccaagtcacacaactagtaaggggcagagcttggattcaaacccagaccaggtgctccagagcctccctgagccaccaggctgtgctgcctcctgcatgagacacaggcaacaaaagacaccaaggaaaggcagaggtgagtcacgtgtgcgtgactctgaagagtgacaggctggatgctaagggaggcagcatgccaacccgagtccaacaagagtagaatgttgacaggaattctttcattcactcattcattcgctcagtgttcactgcatgcctattccagacgcctgcctgctcaaacagctcaaggtgttgagggaggcagacacctaactcacacctgccttgttcacagttg

SEQ ID NO: 198508 - DNA, 408 bp, Homo sapiens
gggagtgcactgcggtgtcttaatgagggtgacatacctaattcatgaggttaggagagtgtccacatgtgcagggtggaattcaagaagcacaggcgtagtaaggggttatgctaacacatacatcacatgagcggaaaatggcagataagcccctccttgggcggtctggtcttgtgcacatgtgggtgatagggttaactcctttgagtaagatttatgttgggatattgcttattttagtttttcaaggtcctgcgatcagccagtatggtgccttgagtaagatttagaggcttcaacctagctgaagaatttcaaatctacaaatgagcgcttcctgaaccagataaaagttcaagagatgtatgtctggaataagagagaaagcactgagaaagggagtcc

SEQ ID NO: 198509 - DNA, 350 bp, Homo sapiens
taagaccaatgtcatggagcttttctcctatgttttcttctaggcattttatggtttcaggtgttacacttaactctttaatccattgagttgacttttgtatatggtgtcagataagagtctaatttcattcttctgcatgtggatatccaatttttacaacacagtttattgaagaaactgttgttccctcactgtgtattctgtaatcaaagattagtagacaacataggcatgggtttatttctggactatcttctgttttattgatcaattagtcattaagtcagtaccacactgttttgattactatagctttgtaatataataaaatcacagagtgtgatgcc

SEQ ID NO: 198510 - DNA, 475 bp, Homo sapiens
cttaatgtgttataatctgaaagaggggaaaaaatccgaaaataaacagatggccttgttttgagtgcaccttataggccccatttcttggcttacacaagcaataaggatactaatttatgcagttcaagatgcaaattttccggccacttgtattagctgttctctagttgttactgtgctcagtttattctgacccccagccataaactgcctttcacttcatcaaatctataataccttgtttacagaggagattgaaaaaaaaaaatctatcacttctgctagaaatgcttaaaactcatgtctatgattatgatattatttctgcaaacaaaagacagcattaagtacatatgcacatacagggaggtagaaggaaaccaagtgcttattatacgctaacctgtttaattctctcaatagttacagagtaggtagtgttatgtttacgtttcaggtaaatgaaccgagg

SEQ ID NO: 198511 - DNA, 468 bp, Homo sapiens
tctcaattgacattgcaccacattgaactgcacacttattcctgctgtactatatattgtatatctttaagcaggaaaaaatgacttgttatttcaagcgaacaatatgcattatttgactccctgaaagacccattaatctctaagttagagttataccaatcatcggagtttctaatttgtgaatctgtgttctaattaatataaattacaaattactattctattctgcaaagccatacaaactttatatttttgaattacccttcagtattccctaaaacctaaccaggtaacaatcagagttgaagttctttcttcccataaacctgatttttatcctttgccatcaaagcctttttattgtaaaggcttatattaattttctaagtttgaatacatgtataattctacaataatacattgcgcttgaatagtttattttctactcacaaagggtacaaaaag

SEQ ID NO: 198512 - DNA, 104 bp, Homo sapiens
ctagaggcctaatcagatccagttttgttttgtgtgtgtgcaagaacactttataatattatggtgttgcaagtggtgttatgtatggtaccctttaaaagttt

SEQ ID NO: 198513 - DNA, 457 bp, Homo sapiens
gccaaccataaatgggagttcttgttgttttgtggacatttgggctcagtgtacccataaccctttgatctagcagtgttaagttgggattgtggcattactgccactttcctttttgagaatctaatgcccactttctccagagaaatccactttttgcatataacttgtaaaattttgtaatattggggttcacagcctggagtccaggttgagagtgtctgctgtagcctccaaaatatttaatatttcagtccgaaatttgaaagaacaggaaggcctcaatgaaaacaaacccttctaatcattaactatcctttccttaagtaacaagaacaacttacctttaatctttttcgttaagaaaggactgggtttctttaagaaaggactgtcagaaagtctgggttagtgttacctttgctttgaagtcgacgcggccgcgaatttagtagta

SEQ ID NO: 198514 - DNA, 483 bp, Homo sapiens
gagttcccgccggagcaacaagtcctggtgctcggagaacccagagggcagtaggggtccaacgcccctctccctgccctaggacccagtcaggaatgtctgttttgagaaggaggagaatctgggtgtcctcagaacgatttggcacagttgtgcggagaatacctgctagagaagccactatagttagagcttcacagccgacacagaaatgagaaagtatttgatgtattcagacagcctgacaaaagcctttttaaattattatgatctatatcagaaaaacactggaagccgcatcatagtcttttggtatacgcattttatatcctcttcctgggtggttttaaagccaaatgacttttcattacaatttgaaattatttttaatactatagtttaaagaaatgatacattatgcagaaaacatatagactgtgttgtccaaaaacattaaagatttaagcgcttcatcttcagtgt

SEQ ID NO: 198515 - DNA, 506 bp, Homo sapiens
tgctgtgattataggagtgagctgggccccttcattgattagagaaaaattcaccaaaactcagaaataactggagttcttctatgtaaatgatatggtaacctgctttcctatataataaatttgtcttcatttaagttagttataaattaggcagcctgggcaacataatgagaccctgtctttttttgttttttttgagacagagtctcgctctgtcgcccaggctggagtgcagtggcatgatctcggctcacttcagcctccacctctcgggttcatgtgaatctcctgcctcagcctcctgagtagctgggactacaggcatgcgccagcacatccagctaattcttttatttttagcagagacagggtttcaccatgttggtcaggctggtcttgaacccctgacctcatgtgatccacccatctcagcctcccaaagtggtgggattacagatgtgaaccaccgcacctggctgagaccctgtctttaaaaaaaaaaa

SEQ ID NO: 198516 - DNA, 580 bp, Homo sapiens
tcttcccattgccatctcagggatcctcagggcagcctggtgaggacagtgagggcacgggattgcagctaacacacagagctgtgcagtgaggcaggcaggagcttgcttgggagagaggcaggggagtcgaggggcacctggcaccttatctgggccagctggcactgggttcgagtcccagctctgcccattggcagccatgtgaccttggatgcttcactcaaccctcctgtgcccgaatttctccatcgataaaaggaagatgttggtaatcgtattacccacctcatgggttcttataaagatggaaagaataagaatcaatcatgttccgagcttgagacacagctggctgattttaagtgtatgttatggttaaagtgagggagtcgagcttggactgtggaccacctgactgcattgctgtccctctaaaggtcatgattgggtggtaactgaacttcagcttctcctggattcataatcttatttcatttcataaagtacaatcatacagtcaacatgactttagaatattggaggaaactttctatgttcctcaagtaccatttaatta

SEQ ID NO: 198517 - DNA, 405 bp, Homo sapiens
cagtatctatagggtttggtactatccaatgtttcaggcatccatagggggtccaggaacatatcctctgtagataagtgggaactactttgaaaaagacatggcagccactagctcccagccacagaatcttgggaatgttactttacctataagttcctacccctgcaacaaaaatgaaagactagacaagttggcttcaaaggttcttctgttaccttctctaaatctttggtgtacacataaaccccaatctttgctatgacacctagcacagacaacgtttgttgtgtaagataactaaatagcaattttcttaaattgttttgatggttctgtcactaaagtattatcttgactaaatgttaataaactactaaaaagcatgttttctaaattctgcct

SEQ ID NO: 198518 - DNA, 382 bp, Homo sapiens
aaactaaggctcatgcttctagacaaaacagaagttacggaagcataatatataaaaaaaattcaatgactagaacttggcagtttaaaactaaacttgcaaagggtaggtaaccaagtgctgtctacctgagcagggcactgtccaggaaagatgattattttttcttaaattctagcctgcattattttaattccaatttggttatgtcagttagtataggaaagaggtacgaatttttaggaaataaaaagatatattagggctgggcacgatggctcatgcctgtagtcccagcactttgggaggccgaaacaggaggatctcttgagcccagaagttagagaccaccctgggcaacatagtgagacacgcgtctcta

SEQ ID NO: 198519 - DNA, 423 bp, Homo sapiens
aagggcattaagtgcctgccacatgttaagggccatataagcactgactcttattagtagtgctcttatcattcttttggcttgtggctgtgctccattattaacattaaaacacagcctgagagctatctcctatttcatcagtagtttaccttttatgtaagtgagatcatcagatcacttcttgataggaaattagggcagataattagggatatgtgatatcccttgatatgtgaaatggggcctaaatgaaagggagtttctgaagataacttcacccacttcacagtttcattctgatattcctgttcacatatacttaaaacagtgagacccacaaatatttcctgaactggattcattgtccataacccctccaccattcaccatcctttaccaacaaaaccaaaccccatcttc

SEQ ID NO: 198520 - DNA, 1001 bp, Homo sapiens
ggagggacggccgcgcgcgccagctgccaggcggggatcgggcggcgccgagctgaggtggtgagggactagctcccggatgtggagaagctggggagaaggcgtgggaggaagatggactcggtggagaagggggccgccacctccgtctccaacccgcgggggcgaccgtcccggggccggccgccgaagctgcagcgcaactctcgcggcggcagggccgaggtgtggagaagcccccgcacctggcagccctaattctggcccggggaggcagcaaaggcatccccctgaagaacattaagcacctggcgggggtcccgctcattggctgggtcctgcgtgcggccctggattcaggggccttccagagtgtatgggtttcgacagaccatgatgaaattgagaatgtggccaaacaatttggtgcacaagttcatcgaagaagttctgaagtttcaaaagacagctctacctcactagatgccatcatagaatttcttaattatcataatgaggttgacattgtaggaaatattcaagctacttctccatgtttacatcctactgatcttcaaaaagttgcagaaatgattcgagaagaaggatatgattctgttttctctgttgtgagacgccatcagtttcgatggagtgaaattcagaaaggagttcgtgaagtgaccgaacctctgaatttaaatccagctaaacggcctcgtcgacaagactgggatggagaattatatgaaaatggtcattttatttggctaaaagacatttgatagagatgggttacttgcagggtggaaaaatggcatactacgaaatgcgagctgaacatagtgtggatatagatggtggatattgatgggctattgcagaagcaaagagtattaagatatggctatttggcaagagaagttacgaaattaactttgggtttgcaaattgatggattgttcaccaagggccctttatgtttcaggagaccaagaatt

SEQ ID NO: 198521 - DNA, 1042 bp, Homo sapiens
  misc_feature (47)..(47): n is a, c, g, or t
gcgattggaacatttaaccccgtggattttaaaaaagccaggctggntaccgagccctccgatcggatttgtgacagcgtcgatggcgggcggctgaggtggtgagggactagctcccggatgtggagaagctggggagaaggcgtgggaggaagatggactcggtggagaagggggccgccacctccgtctccaacccgcgggggcgaccgtcccggggccggccgccgaagctgcagcgcaactctcgcggcggcagggccgaggtgtggagaagcccccgcacctggcagccctaattctggcccggggaggcagcaaaggcatccccctgaagaacattaagcacctggcgggggtcccgctcattggctgggtcctgcgtgcggccctggattcaggggccttccagagtgtatgggtttcgacagaccatgatgaaattgagaatgtggccaaacaatttggtgcacaagttcatcgaagaagttctgaagtttcaaaagacagctctacctcactagatgccatcatagaatttcttaattatcataatgaggttgacattgtaggaaatattcaagctacttctccatgtttacatcctactgatcttcaaaaagttgcagaaatgattcgagaagaaggatatgattctgttttctctgttgtgagacgccatcagtttcgatggagtgaaattcagaaaggagttcgtgaagtgaccgaacctctgaatttaaatccagctaaacggcctcgtcgacaagactgggatggagaattatatgaaaatggtcattttatttggctaaaagacatttgatagagatgggttacttgcagggtggaaaaatggcatactacgaaatgcgagctgaacatagtgtggatatagatggtggatattgatgggctattgcagaagcaaagagtattaagatatggctatttggcaagagaagttacgaaattaactttgggtttgcaaattgatggattgttcaccaagggccctttatgtttcaggagaccaagaatt

SEQ ID NO: 198522 - DNA, 195 bp, Homo sapiens
ctgtaggacagcgctggtctagttggtcaaaattctggtttattgctcacctggaatctgtcaatggcttttttggtctcccaacttccccttatgcctgtctggctgatccatggaaaagcattactgctgggatcctgacactcctgttgaaaatgcagtggccctggtaataaagtccaagcttttcatagc

SEQ ID NO: 198523 - DNA, 413 bp, Homo sapiens
aaaccactgtaacatacagccaaagaagatactttgttgactgaatatgggctttttaaactctcaactgtatttttataatatcacaatcccaaagttagactaaataatgaataacacggtcaggcatggtggcttgcacctgtaatcccagcactttgggaggccgaggcgggcggatcacctgaagtcaggagttccagaccagcctggccaacatggcgaaactccatctatactaaaaagtacaagaattagctgggcgtggtggtgggcgcctgtaatcccagctactcaggaggctgaggcagtagaatcgcttgaacccgggaggtcgaagttgtagtgagccgagatcgtgccactgcacttcagcctgggcaacaagagcgagactccgtctcaaaaaaaaa

SEQ ID NO: 198524 - DNA, 435 bp, Homo sapiens
tctttgatccatcagtctcagaatgaggtgtaagcaagccattaggttgctgcatgagtctggttgggcacctccttccctcattttgaacagtgagattaagccacaaactctctgaggaggttcaaatgctgatgtaagtctcagagtgaacacaacctataaacactactataagtttcaatcatgtaaatgggaagttaattatgattgtcataaactgctaggttcaacaaccttcaatttatttttttaaatgttaatggagtgcttcccctgtgccaggattgtgtagcctgaaaatacagagttgaatgaggtacaggttacaacttagaagagcttatgatctaatacaggagttggcaaactacagcctgtgggccaaatctggcctacaatctgtttgcataaataaagttttattggaattca

SEQ ID NO: 198525 - DNA, 187 bp, Homo sapiens
tctctctgtgtcacctccatacagtggcactcttggagaaaaaagatgatgttacaatgaaaagacttatctgtgaccccttccaccaaggtacccacaactttcttcaccattgcacatggtagggctcctgtgaaaatctttttaggtggtcatagtaaattatttgtaggtggtggttggtctg

SEQ ID NO: 198526 - DNA, 413 bp, Homo sapiens
cacgggcaccaactgtgtgctgggcacgaagccccttcctcaggccttcaggcctcactggctccagggtcttagagcttaaggttggaatctggtctgggttcgaaactgtatagtgaagggtgggcttggaggaacgggctgccctatgaacacgtcagactcaggacagtgggtgcaaagtgaggccaccctggggaggaaaaggctgtggttccctactcagtgtctgttctaggtgctgagaaggatgggtccttgggctcaggggtgggatgggagactgggaggagtgggacccgaggaacccaggggtgtgtccttgagttcaagagtcacggcaaacatacagaggccttacagccccctgggacccagctcactgctggctcaaaacgagtccgttaccacgc

SEQ ID NO: 198527 - DNA, 626 bp, Homo sapiens
catatatattataccaaagtacaaaaaatatataagcttctttacttgaaaaatctccctaaggcttttgctcaacctatcaccacatctgtccatttaatattctcttttttttgccattaatatagaggcccctaaatttgacttcatttttttatttatttgtttattttaaattcataaaattctatgtattcattatgtacatggtgttttgaagaataaatacattgtggaatggttaaatatagttaattaaaatacacattacctcatatagttattttgcaacaaaagcattcaacatctactctgcatttttcaggaatataatattttgttattaactgtggtcaccatgctgcacaataaatctcttgaactcattccttctatctaactgtaattttctatcctttgaccaacatctccttaacaccttcccctcccaactgcccagcctctggtaaccatggttctactctctgcttctatgagatcaacttttttagattccacatgtgagtgaaatcctacagtctttgtctttgtgtgcctggcttattatacttaacataatgtccttcaggttcattcatgctgttgccaatgatgggatttccttc

SEQ ID NO: 198528 - DNA, 609 bp, Homo sapiens
gcagaatatttgctcttgaaacctcaatttctccatctgtagaggggaatattaatacctcatggaactggcataagatggaagtaaggaaagaaaatggatgtgagtcatatttctgaagttagaacagcagagtgagtattgagttgtttttcttcattctgctcagactctcaatcatgtcctcatgtgttcttttttttttttgagacagagtctcactctgtcacccaggctggagtgtggtggcgctatctcagctcactgcaacctccacctcctgggttcaagcgattctcatgcctcagcctcctgagtagctggaattacaggcgcctgccaccacacctggctaattttgtatttttagtagagataggttttcaccatgttggccaggctgctctcaaactcctgacctcaggtgatccgcccggctcgccttggcctcccaaagtgctggggttacaggtgtgagccaacgtgcccggccctcatgtgttctttcacatttctctctcctaggtaaaaatgcagaagagctcctaaatcagtcacgacttgagctttaaaaagcacattcttttcagagatgatccacctgcttta

SEQ ID NO: 198529 - DNA, 646 bp, Homo sapiens
gcagaagccagtagaagcaatccacttgccaggttgccctcctggaaccagggtccacccatgagagccaacgacaaccacatcagcctttgtgctccttggggcatctggtcaatctcctgcatgggatagaagctccgggaataccccaaaggggagaagcagagaagagggcctatgcccttccttgtccaggcttggagtgcctcgcttggatgatactgctagccccaactggtcccagacatcagagaggaagtgaggtcctcctgaggtttggggcccaggacaggggctctgcttgctctgatctaaaagcagtactgtttctaggtttactactcactactaactaccttattgattttgtgcttcttgatttaaaaattccagagaaaatggttgtcttagctaatcagttttgctctgagccaacggtattcaaagcatggcctgtggacccctagtgggtctccaagaccctctcaggggtctatacagttaaaactatttttttcatgataatattaagatgtcatttgcctttttcactatgttgacacttgcaatgatggtacaaaagctatggtgaataaaactgctggcaccttggcacaaatcaaagcaaggccaccaaccattctaa

SEQ ID NO: 198530 - DNA, 366 bp, Homo sapiens
cagcttctagatctctaaaatggattatttttaaggttaaaaattatgtattatcatgtacaaaatgcttagaacagtgcccactcttagtgaacattcaatagctgccattgttgatgttatttatccaggaattgggtgcaattaggaactgtttctataaacctgggatcctaggatgcaggattttttttttttttttaggtaaaggaagcagaagtaagattctccgttgagaacagctctaagaaaaagccactgcatttcagaattgcctcaaatgtatctttcaccccactctaaccttgtgttctgagcatggcacctctgtcaacttttctttccatatccttttagcttcgtcta

SEQ ID NO: 198531 - DNA, 1369 bp, Homo sapiens
aaaaatacaaaaaaattagctgggcatggtggcaggtgcctgtaatcccagctacttgggaggctgagacaggggaatcacttgaacccaggaggcggagattgcagtgagccaagattgcgccattgcactccagcctggtgacagagcgagactccgtctgaaaaaaaaaaaaaaaaatctaaacacaagattttacttttaatcctatcatttcctcttgcttggcttcagtaatccttcaagttttctaggtcttttcaaaatcttgattctgttgatttatattttaattatcttttcctttcagcttttcctgttcaggtgtgacatctgggtctttatctgagttttattagattataaaacattcagcaagatagggcaggtactgagtccagttgtacaccatggaaggcctctttctgtgattgttcattcatgaggctttatgaaaatgtctacattacaccaggcacttggaggttacagagatgaataaaacatagtccattaggaggcagacaatgggagagacaaacatgggaaaaagttactctgattatgaggagtaatgagaattacatatgaaggaaagtattgttagtactgttaggatttagtgtcaggaaagttttcagagtagcaaggaaacatcagaaattttactctttctgccaggcatggtgcatgtattattctgttctcacactgccacaaggaactgaccaaaactgggtgatttattaaaaaaaaggtttaattgactcatagttctgcatggctgaggaggcctcaggaaacttactgtggcagaaagggaagcaggcacgtcttacatggcaggaggcgagagagtgtgaaggaagtgaagggggaagagccccttatgagaccatcagatcttgtgagaattcattcactatcactcgaatgggggaaaccgtcgtcataatccaatcacttctccataatccaatcacttccctcagtgattacaacttgagatgagatttgggtggggacacagagccaaaccatatcagtgcctgtagtcccagttacttggaggctgaggcaggaggaacacttgagcccaggagttcaagatctgcctgggcaacatagcaatacctccattttggataaaaaggaaattttactttttgggtgccattgcttactttaatcagctgtaacttcttgttgacttttagtcaaaaaacaatttttccttctatctttgtgaaagaggttggtgagcaaggaagaaaaggaaacttgctttattgagcagcttctatagtcaggcacattttacaaacattagttcatttaaacccctttagctgttgtacaaggtgaatgc

SEQ ID NO: 198532 - DNA, 832 bp, Homo sapiens
cagatttctggctccggttcccagctgccatagcccctttggtcccttcactttggtgaccctttaggcttccctttttagaccacagctgtcacatgtttctgactcaacttgcttctgccatgccagcgtcacccctggtctcaggaagccaggcaccccgaatggagagaccagctgaagccgcggcagaagaacaaaaatgtgaagatttaatggacatttatcagttcccaaaattaatatttttataatttcttacgcctgtctttactgcaatctctgaacataaattgtgaagatttcatggatatttatcacttccccaatcaatactcttataatttcttatgttgtctttaatctcttaatcccgtcatctttgtaagctgaggatgtatgtcacctcaggaccctgtgatgattgcattaactgtacagattgtaaaacgtgtgtttgaacaatatgaaaccagtgcaccctgaaaaaggacagaataacagtgattttcagggaacaaaagagataatcataaggcctgactgcctgcggggttgggcagaacacagccatatttttcttctcgcagaaagcctatagatggatgtgtgagtaggagaaatattgctgaattcttttcccagcaaggaatattaataattgatagcctggggaaggaatgcattcctggggggaggtctatgaacgccggtctgggatgtctgtcttatgtggttgagataaggactgaaatacaccctggtctcccgcagtgccctcaggcttgctaggattgggaaattccagcctggtgaattctagtcagaccgg

SEQ ID NO: 198533 - DNA, 770 bp, Homo sapiens
cagatttctggctccggttcccagctgccatagcccctttggtcccttcactttggtgaccctttaggcttccctttttagaccacagctgtcacatgtttctgactcaacttgcttctgccatgccagcgtcacccctggtctcaggtgatttcttaggctaattctcagagatggggttattgggccaaaaaagcaaactatggctttccgaagctctcattgttcccattatgtcatgcatccctgagatgcagtcagcagaggattctatttgagggactaaacactcccggggaaagcaggaagaaggagacgggaactaacatttgctattgagcgccaggcatcgtcctacaggcttcgaagtgaaccttggatgtgctgctgatctgacctgcccagatttgtcatcattgttattgtcttggccgcttatgaagacgttcacccagcaggacttcagaagctttgttcactcgatctcatttaatcctcacaatagtgccctaaggaagatattagtatccccattttacaaaggaggaaacaggaacctggggagattaagcgaaggcctcacagatcatgaatagaagaggctggaaacctagtctggttcaagggtgtgctctttctgctctgccatgctgtgcttcagcccttccccactctcagccccatgtgcacgcagatagggattttcactctttgccctgtatgaaaggagggaaggtaagacacatgagcctagggggaaggtccatctg

SEQ ID NO: 198534 - DNA, 230 bp, Homo sapiens
tgccaccatgtgagacatgcctttcactttctgccatgattgtgagtcctccccagccatgtggaactgtgcatgcattaaacctcttacttttgtaaattgcccagtcttgggtatgcctttatcagcagcatgaaaatggactaatagaagtgggatttttacaaattcagttagatgacccagaaatcctcttttgcataaattagttttatctggttttctgccat

SEQ ID NO: 198535 - DNA, 551 bp, Homo sapiens
catttattgccatagaaaacaagtaaaggaaagtgttcttaggttgttcctgttttgggcaggtgtgctaagttccagtagacagtttatcatttggtgaatgcagtagcattgtgaatttaaaaaagcaatttctctcaaattcagtaggataaaatttaaattctgggactcccatataaagtaattcaggaaggacttgctacccacacaacaagcaggttcagtcacttggtgggtgtcaactcaatgaccacaaccaaagaagatttagcaaggggattttattacttataaggagtaaggagaacaccagggatagtccccaaagcagtgtctgcctgagctgggggctgggtcaggttttataaacatagggtaatgaggcatgatctgactgggtcttgcaatgaggggatgtcaggaggcatgatctaactggatcctgccatggggtgatgccaaagctcaatccagttggattctggatcctgccatgcagtgtccacttcttaattcagttcccactcctgagtcagagcaatcaggtt

SEQ ID NO: 198536 - DNA, 591 bp, Homo sapiens
caacctaataacttcattttaatttaatcgtctcttttaaagaccgtatttccaaatacagtcacactcagaggaattaggggttaggacttcaacatatgaatttgcgagggacataattcagcctatatcagaggctcttcattttattgttttattttactttttgagacagggtctcacttgtcacccaggctggggtgcagtggtacaatcacagctcactgcagccccaatctcctgggctcaagcgatcctccctcctcagcctcctgggtagctgggactacaggcgtgtgccaccacacccagctaattttttattttttggagagacagggtcttactaagttgcccaggctggtctcaaactcctggcctcaagcgatcttcctgccttggccttcaaaagtgctgtgatgacaggcgtgtccctcactttattctatcactctctcccccatgcctggcccatcagacctcagtgaatgtccattcaatgaatgaatgaagtgatgtcatctcggtagggttttcaaggatgaataggagtttgctaggcagagaaggcacagagggcattccaggctt

SEQ ID NO: 198537 - DNA, 486 bp, Homo sapiens
tttcaaagtgtatcatcattccccttttaaatagcacattcgaagtgtgctgacttttagttctagggtctgccttccccttacctgctgagtgtcacaggatctcttccctccttgattatctcaaggagatacatcaacttttggttcataaaagaaagtcagtcgcttttatttgttaaagacttgaagtatgggctgggcgtggtggctcacgcctgtaatcccagcactttgggaggccgaggcaggcggatcacctgaggtttggagtttgagaccagcctgaccaacatggagaaaccctgtctctactaaaaatacaaaattagctggatgtggtggcacatgcctgtaatcccagctacttgggaggctgagacaggagaatcgcttgaacccgggaggcggagcttgcggtgagccgagatcgccccattgtactccagcctgggcaacaagagcaaaactctgtctcaaaaaaaa

SEQ ID NO: 198538 - DNA, 443 bp, Homo sapiens
cgagatacctccttttgcctcctgtgcccctcccagccaaaattaaaacttaggaacagaaatctaactgctccacctccttctccttcaaacccttcagtggctccctgttgttcttagcacaatgacccaaatcctcagcacggcctctaaggccctgtactggtgccagctgccttgccagcccacgcctggtaactccgacccttgctgtgcactcatcccccagcatctccagttcccagcactcagactcctgccagctctaggcctctgcacacagtgaccttcagctcagagcacaccccctctcccagttcactcctgtgtgtccctcaggtcggtgtctactcggccttccttggagacttcctgcccccgctccaccaggtcggagttcccactgctccttcccataacaccctgtccttctctactgcaga

SEQ ID NO: 198539 - DNA, 572 bp, Homo sapiens
ctccataatgtgtgcccaggaggtggctgctgtgtctagctgggcacagattatggagaggctgcaaggcaaggaggatgcccaggactttgaggggctgctgaaggcactgcaggggctcggcttgtgcccagaggagttgaatgccgtctgggctgtgctggccgccatcctgcagctgggcaacatctgcttctcctcctcagaggtgggcttccccgtgggcaggggccatctggggtgctgggtctgtagaatcagggcagtggtaatgacgccaaatgctggtgtgtaggagactacagagtgctgggctgccctgaaaagtgggtagatccccactgtgtagatgagaaagctgagacatagagcttctccactctcccaatgtctgtgcctctaagctgccacccctaagaacatctggcattagatgagcagctatggtcaggcatggtgggtcacacctgtgatcccagcactttgggaggccgaggcaggaggatcgtgtgaagccaggagtttgagaccagcctaggcaacatagagaaaccccgtctctattaaaaaaa

SEQ ID NO: 198540 - DNA, 476 bp, Homo sapiens
taggatttcatgagtaaaataaactaaaacctccattgggcttttgttaatgcctaaatatctaaatttaactggaaaaaaatggtatctgtacttttaatatttgtatttaataccaattggagtacaagttcttacatatttttgttttagcgtttttacagcttaatttacaaaaatgtttgtaaactaaatcaagtacaattcatgcatttcagttgtcccagactttctgaaaagcacatgagcaaaaaagacaactaaagatgtcataaaaaaaaatacatcattgagacacatctccttatttcacttaatttaactggtatatgtgatgtgcacacatgaatatgtagatgcatacacccatggttttataaaagacataccatcatttaaataaattgtatgtgttttatcatttgaaatcatattttaaatattttctgtggccttaaatttgttctccactgtct

SEQ ID NO: 198541 - DNA, 587 bp, Homo sapiens
aggcatgagccaccgcacctagcctctttaatctattttgaaatgagttttgtgtatagtaagataagggtctaatttcattcttttgcatgtggctatccaggtttcccagcaccatttattagattatcctttctccaatgtgtgctcttggcacctgttttttgaaaatcagttggctgtaaaagcatggatttatttctgggctattttgttccattgttttatttgcttttattgccagtaccatggtgttttggttaatacagctttgtagtatattttgaagtcaggtagtgtaattccactaactttgttatttttgttcaagattgctttggctatttgaggtcctctgtggttcagtatgaattttaggcttgtgttttccactgctgtgaggcatatcattggtattttggtagggattacattggatctgtagatcactttgggtcatatggacaatttaacagtattaatttttccaatctataaacatgggatatctttccatgtatttgtgttttcttcattttattactgtttcatagttttcattgtagtgatcttttacttcttcaatt

SEQ ID NO: 198542 - DNA, 448 bp, Homo sapiens
aaaaaatagttcatcatttagatcaatattggataataatgttcattctattccatatcaggagacctaggttcaagtcctgctttggtgtttattgagtaacctgaagctattccgtttcttcatttgctaagtgggagtaggggcagctctgaggactgagatagctaactcttcttccctcccggagcaaattatatgtaccactgtgtatactacttgtcactttacattgtaatcagtatttgcccatttctcccagtatactttgagtgcttgaggaccagaatctttcttcatccttttgtgttcagcatttcctgcagtgcgtgacacacatttggtgttcagtaaaggctttctgcatggataagtgcttgagaagtgtcattagtgagctgaaatccttcaaaagagagttgtgagaaaacagagaaatacttccatt

SEQ ID NO: 198543 - DNA, 434 bp, Homo sapiens
ggcggcgctcagaggatcccctctggatgcaagtgtcaaatcatgatcctctcatatttttaaaggtaaacaaatgcatttctttgggagtcatggaataggtaaatgcaagtagaagagaaaaagcagatgtgacagtcaagggcagagagatgacagatactcagatttcatagattagcacagaacttctttcggcctttattaataagattgccctaataataagtgttgtgcaaccaattgaaagctgttcagtttatttctgacacaaacgtaaatgttacccacaggcagcctcttactcaccttttctactatggcctaaaaagcactcctgaacacccaggcagttttgaagcctctgaagcatatttttttcttcttcttcttttttttttttttttttttttgagatggagcctcactctgtc

SEQ ID NO: 198544 - DNA, 536 bp, Homo sapiens
tattattgactaggctgtatgacattttgagctcttaactgtgaatggcattcattaagctcctttatcctatagattctatctttatgttcatctgaaatgaactattcatcagtactttctcctcccatcctaagcttctcattttaggaactgacatgataaggtggttctttcataactctaatgccatccaacatagccctgggagaggcatgttaggtttcagagattttctccatggagcaaggtgcagtgctagaatatggtggttgattcccaaacagagcagttaactttactcttggttctgagtctccaaataataatagccgacgtttattgagcacttactatgtgcccaaccctgttatgcctttctcaggctcatgataaatgtattagtctgttctcatgctgctattaaagacatacctgacactgggtaatttataaaggaaagaggtttaatggactcagttccacatggctggggacgcctcacaatcatggtggaaggcaaggaggagcaaatc

SEQ ID NO: 198545 - DNA, 258 bp, Homo sapiens
gcttggggcaaccagaggttgctgttgtcaccacgctgtcctctcacctcagagcagtgggggccttcccagccctttgggaggtgggcagggcagtgtcacaagcctctagggtgcacgtggagaatgagaggcagagagaagggagatggaggaagggagacggacaggccactcaacagggaggcggcagattcaaagctgctgactcctacacatggtcccctgggggactgagcccatggtcctacctcaaat

SEQ ID NO: 198546 - DNA, 595 bp, Homo sapiens
tcctatagcatcactcatggtctcttgtgaactatgaaattttattttcctggtccttcagtccaaagtttctatctcaatctttgctctgactttgcactcctgcgtgaccttgggagagccccttaggatccctgaggccttgatttctcttaggcaattttaaccataaagatgcataactaatatatgcatgggctttacaagtcttcaaatgctttcacatgctgtatctcttctgctatacagaacaaccagtaaatgtgggaaactctgctgtatttgctttaaaaatgaggaaactgaggctcagagagtttaaattacctgctgcatcccccagctggatgctggagcctggacagctcaggggttcccactcccatccttttttgtgtatcatgcaggtatccaggggctagtgagtgggcttggaggaagaaaggcaggagggaaattcgtagggcaacaggccaaattattataatagttttttttttttaacatggttcatggagaacagaatcttattgtattggctgaatatatacactcccatttgtttttcattacatcaatgtctgatagggagttc

SEQ ID NO: 198547 - DNA, 422 bp, Homo sapiens
tttgccttgtgttagatctgtgactttgggggtgctactcaacctctctgagctcctatttcctcatctggaatatgaggaaaatgcaagtgcctactttgcaggacagttgtgaaattcaaaagtactaactgggtaatgcacgatacactgtgcctggcatataggaaatacttcaatgcatgccagctagcagggctattgaaccaattttccaacaaagcacaagctggcgtaggaggcactgccccatgtttaaaaggctagacataaaaaagtgagagaatatccaatgaggccctgcatgtgcccatcctctgttccccactgatatgaaacaaaggggtttattcaaaaggggaaagtgtgcaacagatagtgcaagcccctggctgctgttgtatcttctataaccttccaaa

SEQ ID NO: 198548 - DNA, 281 bp, Homo sapiens
ttacccttgccctgtagatagtgaggtctttattgaatatgtacatctgctcaatgtttattcagttgcatgtacgtctttcaagtgtgtcctatgagaattttatttcttgcaccttaaatgacagagaacatgtttacttaatgcactttgcattatgcctaacacatcaccaattgttgacaatattcaataagtacatttgatcgtggcatattcaactatgattttagacaagatgtgtgtgtgtgtgtgcatatatacatatgtatatacaagag

SEQ ID NO: 198549 - DNA, 498 bp, Homo sapiens
caggatcattttcagttctctaaactgtttgcaataacataatttctgctttttctttgttttatttctttaagctcccatataaatttcatctgagcaaataactttaggctgaaatgttgaagccacttcactgcagtaggccaaaagagagattagaatagggcagcgccaaaactcattttaaacacatttttgtataatcactcagctctcataatagatttggatactatgattcatatgaattagatcacaggtaccaacgttcagtgttcaggcaacagaaatatgtaagtccctactgtgtaccaggctttctgctagatccagggatagagtgatatgttgctttacttgagtgttagaggcaggcattgaatacatttttttttttttgcatttttgactaacatggtgtatcttcagtgccatgtaaaatcaatcagcttaagggcttacttaattaaaaaaaaatctccgtctagggcttagatt

SEQ ID NO: 198550 - DNA, 301 bp, Homo sapiens
ataggttaaaaaaaaatgaggcatggagaggctaagtgacttgcccagggtcatgcaatacaaattatatatgtatacagtgtagacatggaagcctaacaagactagaacctgtgtggcctgggtccagagcagagtcccatttagataggcacagtatgatgaggtaaaacaaatcattcaaagaatcccatccttcatcctaagtctctctaagaatatgaaaagggaccagagacagctccccctgctgttctcaaacatcctctcctgcctcccacatctgtcccaccccactccc

SEQ ID NO: 198551 - DNA, 447 bp, Homo sapiens
cgggagggccggtccgctcctcccggacgccgaggacctaccaccgcgacttcgccccgcccggcgcgggcccaggaccctgatgtcgcttttgaacagcccctgcacctggcagccagcgagctactgtagtaggcattgccgactgtttgcataccggatgggagtgacagtgtaatagaaaaacaagcaagaaaccttttaggtaggactcctaaggctcagaggaagttacctccagccgctgccatgcccaactcagtgctgtgggcggtggacctcttcgggagagtgtacacgctgtccacagcaggccagtactgggaaatgtgcaaggactcccagctggagttcaagcgcgtcagcgccaccacgcagtgctgctggggcattgcctgtgacaaccaggtctacgtgtatgtgtgtgccagcgatgtccccatccgc

SEQ ID NO: 198552 - DNA, 422 bp, Homo sapiens
cgggagggccggtccgctcctcccggacgccgaggacctaccaccgcgacttcgccccgcccggcgcgggcccaggaccctgatgtcgcttttgaacagcccctgcacctggcagccagcgagctactgtagtaggcattgccgactgtttgcataccggatgggagtgacagtgtaatagaaaaacaagcaagaaaccttttaggttacctccagccgctgccatgcccaactcagtgctgtgggcggtggacctcttcgggagagtgtacacgctgtccacagcaggccagtactgggaaatgtgcaaggactcccagctggagttcaagcgcgtcagcgccaccacgcagtgctgctggggcattgcctgtgacaaccaggtctacgtgtatgtgtgtgccagcgatgtccccatccgc

SEQ ID NO: 198553 - DNA, 1255 bp, Homo sapiens
gcaactggtccccaggaacatgggcactgggggtgggaagcaggagctgcacagggggcatcactggtctgcccgccagcacctaaagatatgaggcactgaagtgtcaggtggaggagaggaccagtatggttggttgcaagttggttataatgagcaaatatgtaaatgtgttgaagataatgttagccaagattccccttgttgaaggttacttatttactttattattttaaaatttattttaatgtttttaaataaaaaatttttggtttttttttaaatagaaatgaagaaggttatttaaaagcaaggtgggctcaagacattatctgataggaaggaaggctagaaagaaccctcaggtgttgggccaacattagaagtactgttataaactcatggcatttaagtttatatacacagcagacataaaaatagtttttaaaagtgttacatatgtgtgtatatatacacagacacattcatgtatgccgtgtaaaacacacatatataacactgctcaactctctctactaagagggcacaggagcaataagcacaatgagcagccagcttttggtttctaaatactattttccacgaaaggaaccaagttgcccggagaaatgacaattccaggttggagcatgaactgtaaaagataaacctgggtcatcttatgccagaagattaggaagcactcaacactagaaataccaaaaggacacaggagccacttcaaagagttccccactgggaactctggccaaatcagagacaatatcagcaccaaattaatgttagcaatggaatataacctgttagtaaactaagaatctagattccatgttaacataaatgaataaatacatggggagagaagggaaagcgctccttacagaatactaactaataaatgcagtaggagcgaagaagacaagaactactccttggcatccttcacagaggtagctgattcagggggaagttatcaatgaaggccaaggcttgtgggtttactggaaaacaggatactgatataacactggaatatgcccccacaaaatactgattaatacaaagggaactattgtgactttacagtagaaaacctggcattcagcaacatcacccatgatggtatactgtctacaaaaagtgcctcctgaggccacacagagctgggcatagcatcatttctgtggcactcctgctaagggttacaccgacccccaggaagcttaatttcgct

SEQ ID NO: 198554 - DNA, 451 bp, Homo sapiens
gttgctcatgtcagctgatctaaatgttcatgatattatttaatggctatagtagcattttcttgtaggattttataatttaggctttacgggctgactttagcgcctgcctgtgtaaggtttgactctaataacagcactagaacttttaaagctgtttttctttatgttattaggccatcccatgtagacaaaaagtgtgtaccctaattaaaaaaattattcttttataattcagtcaaggtgagtaattttcctcaagtttaggatctgatattttgggttagtgctagtttcaggtgctttcaagttttgttttattttatttattgatggattcattgttgatgttgccaatacaaatgggattttcctttctctgtctaaacctctgcttattttgtgttgattaactgctcttattttacttggagtatttgtagttttctct

SEQ ID NO: 198555 - DNA, 388 bp, Homo sapiens
ataaagccttccatggctccccactgccctcatgagaaaggcctcaacacaaagccagccttctccagtgcggtagccatcccctccccacttttcacctcacctcctactaccccccacttatcaaacgggaatgtgtgtatgaatcctccctggaatctggttacagtttatgctcccaatcagtaaggtcagagtggggcctgagcctctgcatttccaacaagctccctggtgatgctgatactcccagtccattgaccacactttggataggaagagtctacacttgctctactcaacttctctccattctgtcctcaaacacaccacgcttccttccccaccagctggagggggctctgctcccaggccccagaggtcaagg

SEQ ID NO: 198556 - DNA, 327 bp, Homo sapiens
taagagagggtaagaacattatccagtgcaaatataacacacaatatggtaaaagctaccacttactgcctactgtgtcccagatgctgaattaggtactttatgtatattaacttaatttgtagggtagttacccatgcagtgagtggtactattcccattttacagaagtgaaaattgaggagcagagagattgaatagcttactagaggaaatgataagagtcagtatttgatctgctttctttgaaagaatagtgttagaaaacctgaaaagttccctgtaccaagggaacagagatgtctaaaaaaaaccaacctcactact

SEQ ID NO: 198557 - DNA, 239 bp, Homo sapiens
ttataaaatcatactgaggagaaaactgaggccctgaaagtgatctggatgacatggatagtagaagatttagattatggaaaagtcacttcttcctgctttaccatattgccttttccctattaaattaaaagtcaacaaactactgtgtgcctacgtagaagtactcaaaatggagaagtgaaaatcaagatctttgcacttacataactcatattcttgtgtgagtaaacagccaa

SEQ ID NO: 198558 - DNA, 438 bp, Homo sapiens
gtggcctctgcagggctactttgggcttcatcacagcatggtggcggcagctgccccagagcaaatgtcccagcagaagtgggtggatgtcgtgttcctggaagtcccgtggcatcacttctgctgtctcctaggtcgaagcagtcacaagtcccactcaggctgcagggctggggaccgaggccccagccacgtgtgaatggggaagcatgcacagcctggtttatgtctgcttcctgaaggtctgcaggaccctgggaggtgtctaagaaagtgggctagaaactctgcccttcctgtccctttaaagagcaagtgactgagcatactggttaggacgtagttcattaaagtgggagcacaattaagctggccacaaatgcagatgcctcccctgaagcttccacccaccctgccatggtgtcctagccttcccgc

SEQ ID NO: 198559 - DNA, 408 bp, Homo sapiens
ggctaattttttttgtatttttttagtagagatggggtttcaccgtgttagccaggatggtctcgatctcctgacctcatgatccgcccgcctcggcctcccaaagtgctgagattacaggcgtgagccaccgcacctggccatttcattgtagttttaatgaattatttccttaaggttggtgattttttgtgtcctaagaagtctgattatcccaagattgcaaagatcttcccctatgttttcttctaattttacaagtttaacttttatgtgaaggctctgactcattttgacttagttttcagcatggtgtacagtatttttgcataaaatatctagttgtttcagcgtctccccccattggtcgacgcggccgcgaatttagtagtagtagtaggcggccgc

SEQ ID NO: 198560 - DNA, 289 bp, Homo sapiens
aaagctttcaccgctcatggaatgtgtttcagtatgtggtgtgggatagtggatacaatatctctttcctccagaaacacggccaattattgtagtaccacatattgataaactgtccttgatttactgatttcaaattccatgtttattaaactataaattcctatgtatacctgtatctgattctagactctatgccagtaatacatttacttatgccaatatcaagatcataatcttttcattccagtggttttgtatcaactaataatattccgtggtaataata

SEQ ID NO: 198561 - DNA, 854 bp, Homo sapiens
aggagaccaggctgagatggagaccaggctgagcagtataaagtctgcacgtagaacacttggtgtctagtctctattcactagctaggaaacactgagcaactgggtccttagttcctcatctctaaaactaccaaataacaataacaatacctagcctgtctacctcacaagaccgttatgataccctacagcagtggggagcaatggaagcttcccaggcaagggaaggacagagctggagctctgcttagtaaggcaagtgaatgtaagctgggctgctggagaggaagatgaccaggcagaagtgtctgggaatgttagtggctcaaaccatggcactggcaatatgaaggaacaggcaaacacagaagatgtgcagacaattcaacagacgaccaagtgatgggaaggaggatgggggagagtcagagatgatcccaaggccctgatctggatcgggaaagcaggaggaaggaatggtaagggggccaggagggatctctttgggacacgctgtagagagagacatggggagtgggagggggagctggatctgcaggcctgatgctcgtgagaggggtcagagttagtgttatgggctaaactgcatccccctcaagttcatgttagagacctaaaccccagtacctcagaatgggactctatttggacacagggcctttaaagaggtaattatggtaaagtgaggtcatatgggtggaccctaatcctacatgactattgtccttctaagacaaaagcaggacacagacacgcacagagggaagaccatgtgaaaacaccaggagacggccatcgacaagcagacgagagaggccctcagaagaaac

SEQ ID NO: 198562 - DNA, 597 bp, Homo sapiens
agagtatccagacatagaagggtaactggaaacctggacctgtcttcctctacaggactgtgaagtatttccgagtggtgctgaccgtgggtggagtcagcatcgcggaagaactacagtggagggaatgacgccccccaactcaggagttcaccagcaaacaggaggcacggaacacaaagcagctaaatcgtggggcagcaagtgtcacaggagacaggggttacaacgggagtgtgtgatcacacctacggccaggcagacccttcaccctccacaggcacccatgaggctgccctgtccactggaataactcatgtgtgaggggaaatccctggaaatggttaatttatgaagtgccttaaggagtctgacaaagcagaaaaaggaggagggtcaagggtacagattgaaaaagaggcagaaaagtgtgggtgcctggggagctgttaggaaagagacagttgggaccgcagtctggggactatgccattgccattttgtgtgccacccttcctgcacttatgcctctacccagataatgagtctacccactgatgactcctctctctagtacagtccgctcctaatgagcat

SEQ ID NO: 198563 - DNA, 188 bp, Homo sapiens
attccaatgatctcctgagataattgtttatatttatgtaattcgtgatagagtaatatctttatgctgttacaaaattttgttcacgttcctcacctacatgtgctgatgttcttgattaataactaaatacatgtatttttctaataaaggatatttaaattcttaaaatatataatatcgttgac

SEQ ID NO: 198564 - DNA, 1014 bp, Homo sapiens
ttggggagagggttaatgggagataatccattttgtgaaatgtatttgtttagaaatttagatcatttgtgattcctccccaaactcggtctcaaaaaaaataaaaaagagtttcactcttgctgcccaggctgtagcgcagtggcacgatctcggctcattgcaaccttgacctcctaagttcaggtgattctcctgcctcagcttcctgagtagctgggattacaggcgtgcactaccatggctggctacttttgtacttttagtagagacggggtttcaccatgttggtcaggctggtctccaagtcctgatctcaggtgatccgcctgcctcggcctcccgaagtgctggaattacaggcgtgagctgccatgcccggcccccaaactcttttgaggtaattctggacaaacctttgtgaaggtcttggaggtagaaacgcttgggtggtggctggagatgagtgaaagtagggaagaagcctgctcccgctggacacattctctctagggtgcaccttctcccagggtcacgaaggctgggatgaaaaagaaagtagagagcagtgtgagcttccccatcagagtatcagcagtcagtggaggaggagccagaatttgtggggcctgaaactctctaattctgagggccctctttcagaaaaagaatacaaatttaggtatcaaaatgaaaatttagaatgaaaaagaagtcactagttgtacattttgaaaagctaaaactacaaacaactcaaaacctagaaccatataacacagttctttctttggcacacaaccttacactttccccctgcatttttggttacctattctaatctcttcacgtagcaattttgtaacattttatgtaaaaagactagaaggccgggcgcggtggctcatgcctgtaatcccagcactttggaaggccggggcgggtggatcatgaggtcaggagattgagaccatcctgcctgacacgggaaaccatgtctctactaaaaataca

SEQ ID NO: 198565 - DNA, 570 bp, Homo sapiens
acttgagctagggtggtcagagaatgttgctgtggaggaagtgacattaactctgagaacagaatgaaggagaaggaaccaaacatgtcaagaactctctagacagagggagaggcctgaagtggaaataatttaaaatattgctctggctgctgtttggtgaaatgattgaaacgaggtcaagcatggaaatcctggaaccagtttggaggctactacaacaggctttctagtgcagataagaactttgaatcagatggcagcagtacaaatggagagaattggatgtaggaaggccttccaacatctcattactatttataactttcttaagaagcagaaagttataaatggaaatgagtgtatcctatttcaaaagcggaatatcaggagcagaggggacactaaggtatgtaacccaactgagtaagtgagtgctgtatatgaaagttcatttctaaggtaccagtagcacataccaggaagtagtagcaggaaaggtaagttggaggatatgacatctgctgagacctgaagcacgaaagccagtgtgtaaagcaagaaaatgag

SEQ ID NO: 198566 - DNA, 113 bp, Homo sapiens
aaactttctatctgcaagtcaaaatatagaagtgataggaaaaagactaataaatatggctacatagtgataagaaagactttttccttccagaaaatgtggcaagcaaagtt

SEQ ID NO: 198567 - DNA, 111 bp, Homo sapiens
agactgctgtgccgtgcactttacatacttattccatgtacttccacagcaaccctatcggtagtactgtcatgatgcctcctttacagataagaaaactagggcggggat

SEQ ID NO: 198568 - DNA, 478 bp, Homo sapiens
ggcggtaccagaatgtgtaacaacgacccagcatagaaaacaggaagcatcagttaaaatgggaaattgctgtgggctggattactgtaattcctcgtcttacttagaagttggcatagagcagggtcctttatccacagcgtgatgtctcttgcttttctatgccttgataattttgccctttctttagggtggtgcattgctaagctgacaggcttttaggctggaattgctaccttttactatgcttagaaattgtgtttttaaagagctgtttgttttttctctgtctctgggttaaaagcagtctagctccactgctggttctggttccctcctcctgccccctctttaggtctaagtaggcgagattgagcacacagagggactcacagctcagcttaataataaccccgcagtaagtgacatagtcgttgtacactagacagatacacagaggtaagttctccaaagcaga

SEQ ID NO: 198569 - DNA, 494 bp, Homo sapiens
tgaagagtccatctgcgtgctggggagcagaagggacttctgcgtgtaccacactttgaagaatgagctcaagctatgagttagtttccttccagggtagagaactgatgtttgtgtctctgcagtgatggctaatataggactcctgagttatgaatttgaaggaaggaaaattatggcaccttttatgctaaggaaggaataataaaatggtttctgcatacttctcactgtggccatgtttacaagcaagaagacgctgtgctttcagatcccacagatacctctccatctcattttaacagggttataaattaatgcaaaacagacacgttcatgtatccagatcatgtcatccaagaattacattacaacatgggtggagagttggcagtgctcacccaattttgacattcttgagccctgagggtgagagtgagtgtttataggagcttatagaaacttctatgacatccttagtttaaaaaaaaaaa

SEQ ID NO: 198570 - DNA, 452 bp, Homo sapiens
ctgagcactctcagttatctaatactatcttccccccattccgagcactcttagttatctaatactgtcttcccccaattctgagcagtcttagttatctaatactgtcttccccctattctgagcactcttagttatctaatgctatcttccccccattccgagcactcttagttatctaatactatcttccccccattctgagcagtcttagttacctaatactatcttcccccatgtctcctcctggcgaggacacccagtatgctaaatgcgtatgaagctttccagttagtgggcagggggaaaactctgatcgtgcagccagtccaaaccagaggctggggcactgtacacctaccttagagtcgagagaagagagaaggttggtgggctataaggttaatatgtcaagagatttcaacttttgaacacaacaaaagcataacaac

SEQ ID NO: 198571 - DNA, 226 bp, Homo sapiens
tcaatcacagaggcacatgatcttgttcagcagcctagaaaaccaaggcccagcggagccacccgtaggcacccactccccatagcctggcacacacacacggcagagccacccacaggcacccactcctcatagtccagcacacacacggcagagccacccgcaggcacccactccccatagcccggcacacacgtggaccatgccaccctccacgtgcgcctgg

SEQ ID NO: 198572 - DNA, 300 bp, Homo sapiens
agcagtgtgcaacacgctaataaatattcaagccaatgtctttcaaatgttattgtgaatcatctttccctccttccttcccatggttcagtcatcttgctggctccaaattttcaccttttgtctcaggcctcagctgcctccagtttactgcatatgactgcaattgtctttgtctcctttatccgcttcactgtgtctcattttcctaaagtatctggcacccacttttccacaacattgttcctttgttccaggaaaaaaaaaaaattggaggcagcagaaacacagttccaaagg

SEQ ID NO: 198573 - DNA, 609 bp, Homo sapiens
tgtaaaaaatgtcattggaattttggtaggaattgtaccgaatctatagatgactttgggtagtatggacattttaacggtactcttccattgtcttccttaccttcctcctcctcactctctggccaaactccccttgtcagccccattcatgtccccacctcctctgtcaagtcttcctgggataatctggcttctcactctcccactcctctgaattcgtcaagacagccagagctcggtgtagacctgtatcccagctttcgtattctgtatgttttccctagttagcctcagcccctgcactaaaaaggaagcctcttgagctcggcacttggactgttttacactgaagtacatcattcacatcccccagtgtgagccaaacccacacaccactggccagatactgggactgagaggtccatgagggccctgctgcatccacgcaggagtagggaaccaaatagaacaagagcctgacgcttgcggctttgccatcagagggtgaatggcataaagagacccaagtgtgcaatgattaaatcagggtaatcagcatatccatcacatcaaatgtatcatttctttgtggtaggaacatctgcc

SEQ ID NO: 198574 - DNA, 331 bp, Homo sapiens
tgatccaacaagtctgatatattctagctacctcacagaggaacaatattgaaatgtcatagaagatcacaccaatcacttaccaatcacaactctggttaaaccaccgaaaatatcattactaaattatgagaactgaaaaaagaaaacttccttttaaggacaacaaatatacatgagacaccattccttccattatccagcaatgccacacagttcttcactggccggccctgactttctgctgtggtgcttagggctgtgaaaactccaccctgggcagagcaaccattcagacactggacctgaatcaaaatttaaaaaataaacc

SEQ ID NO: 198575 - DNA, 470 bp, Homo sapiens
ttttttgagatggagtctcgctctgtcacccaggctggagtgcaatggcgcgatctcggctcactggaagctctgcctcctgggttcacaccattctcctgcctcagcctccagagtagctgggactacaggcacccaccaccacgcccagctaattttgtttttgtatttttagtagagacggggtttcactgtgttagccgggatggtctcgatcttgatctcctgacctcgtgatctgcccacctcggcctcccaaagtgctgggattacaggagtgagccaccgtgcctggcctggaatgcatcttaaaaacaacactgtgccataatttaatggtcagtattgtttctttctcagcaaaacataaaataatgatagctcttacaatagatggcattttaagatttaacaaaatttggtacgtgcctttgtctcctgggcataatgcctggcacacagtagcaatc

SEQ ID NO: 198576 - DNA, 297 bp, Homo sapiens
catgactacctaaaagttgtctgagggaggctgtgcactgggtgatcttgtgaggcaggtggacgtctattctgccaagatcttgtgggcccagtttgagaatgggttttaagttttagtccttttacacttcctttgcaggaatgtagcttttgaaatagaagcaaagtgttgtgaaacctttgacattctgttctttaacacttcctcctcagcctgaagatctcagcttttgcttgggcgttacaacaccccacggaatgccacacggaatgccgcacaggatgcccccccgga

SEQ ID NO: 198577 - DNA, 286 bp, Homo sapiens
gaagatgggggaggggtgagtaaaattcacagtctacctgatctactataaagttaatttgaagcttctttggtgtggcactaaaagattctcttaaagctatcttgttgtttcacttttagcaactgccaccacaacactgataaatacaactatttatagagtcctcaggtgctaaattggcagagtgatatgtacttttttaattattattttttattatacttttaagttctagggtacacgtgcacaacgtgcaggtttgttacatatgtatacatgtgcc

SEQ ID NO: 198578 - DNA, 339 bp, Homo sapiens
ttatgcctttgaagtattgagtggttaaacaagtgtgactaaagaaatcaacaaaatgcaattgtgcttatgtatctcaagaacaagtgtttctttaagtaccctttagctaccacccaactcttattcccattagtcagtgaactgctatgggaaactgcaatgagagtcatcctaagtcagggtttctcaacctcagcacactggtattttatgccagagaagtcattattttgtggggctgttctgtacatcgtatgatgtttagcagtatccatcaggcctaactactagaagctagtagcacatcctccgtgttgtgaaattaaaaaaaaaaaa

SEQ ID NO: 198579 - DNA, 262 bp, Homo sapiens
gaaaggtgaggtgacaggaggtggcataatggtcattgttaacatttatgcaaggttggttgtaggttaggtgttctaatcgtgtattaagtcacaaaatcctcacaacaatcctctcaagtagtttattatctttactttgtaaacaaggaaacatatccaaataagttaaataattttccccataagcacaaagttagcaagttagggattccaatccaagtactctcgcttcagatcccttgatcttaaccttacctgc

SEQ ID NO: 198580 - DNA, 434 bp, Homo sapiens
gagctttaaaactagacaccaaatagtaagtttattattatccatatgacagctttagaaactctcatataagaaaagttctattgggtgtggcggctcatgtctgtaatcttagcactttgggaggccaagacgggaggatcacttgagcccagaggtttgaacccagcctaggcaacataatgagacccttgtctcacatacacacacacacacacacacacacacacacacacaaaaacacacacacacacacacacacacaaatagccaggtggggtggagcacacctgtggttccagtgactacggtggctgagatgggaggactacttaagcccaggagatccaggccgcagtgagtcctgattatgccactccagcctaggcgacacagcaagattctatctcaaataaataaataaataagaaaga

SEQ ID NO: 198581 - DNA, 543 bp, Homo sapiens
ccataccacatagcctaggtgtgtagtagactgtcccagcccatctaggtttgtgtctgtcccagcccatccaggtttgtgtaagtgcactctatgacattctctgtgatgcctcatgacatgtttctcagaatgtatctctatcattaagtgatacatgacggtatttcctttagaatcaggaaaaaattaacttactaaacacaaccaaacaaaacaagaaacataattatagacttagtaagctatacatcatccctgcttctctcaataaagcaaagggcagagcatcctaagtcccatcagacctcccctacgaagtgctacagaaagcacagaaactgtccagctttgcccacaacctcaactccttggtagggacagaaatgtctgaggggcaggtcacgtggcaggtatctgggtagggaatcggccttttgaaagatgtgatgtggcagcaacgtggatctgactaaatttctggttaacctccaggctgtctgcctggccccatcctccacattctctctagagtatggcaaa

SEQ ID NO: 198582 - DNA, 414 bp, Homo sapiens
caggatttacatattttctatgtacatgaactgaattattataatcagcaatatcagtgaaaggtgggtggtttggccttgaagacttttctatgctgtctagggttctataacttgagattttcaggacaactgcagagtccagggtgagaagagcgtgaagtcatagccatgttccttttctatattatcagaaagcttttgctaaaaggccatagaatggaggatggtaactggctattctccgtctattttgagaacaggctgagagggaaggagctttcctgttttactggagagggcaaaactgatgagaaaagaaaaggtaatggggaaaattacaaaaggccacagaatgtgaaatgaatagtaaatgaaattcagaaaaggaacactgaaatagaattgagaagg

SEQ ID NO: 198583 - DNA, 598 bp, Homo sapiens
atgatgctttagaagttgaaagtctgtgagaatattttcttttttctaacaaaacacaatttcaagttattttacagacagaagatattattttcaattcccaaagtaggtgttgttcagtagcacttctgacctgcaaagttctcagaaatgataatgaataaaaaacaaccttatcttggaattataaaacaacttggatttaaaaaccaacttgatatatggtaggtaggaacaagggctgggtataattaaatataataaaaatgactaaggtacctagaatgttgctgttacataaagtttttattttttagtgatctatattttagtgctttttaaataattgtttgcagagtgacttattctctgtttacataaagtattttttgtcgtttcacaaaaaacaaccataatgtggtattttcctaaaatgtcttagtgtacttaggactttggtgtttactctgccagcatcagaagcactacagctgggcttaatccaaatcacaagcaataatgtctacgttggttggataggattcaataagatgactaaattctttcctttcctctcattccaacaatttcttaccat

SEQ ID NO: 198584 - DNA, 363 bp, Homo sapiens
gagagaaactgagagaaacagagaaataaacacaggaataaagagaagcaaaggaagagagaaacagaaacagacatggggaggcagaaacacacacacatagaaatgcagttgaccttccaacagcatggggcctgagggcggtgacctccacccaatagaaaatcctcttataacttttgactccccaaaaacctgactagaaatagcctactgttgacggggagccttaccaataacataaatagtcgatttatgcatacgttttatgcattcatgatatacctttgttggaattttttgatatttctaagctacacagttcgtctgtgaatttttttaaattgttgcaactctcctaaa

SEQ ID NO: 198585 - DNA, 723 bp, Homo sapiens
cttacatcagtccccaaaaatgcccagctcagctcaacacctgagcttccaggcttccatggcagcctgggattttgaacaggaaaagcagaggaacaggaaaagcactgtggcatctgcctagatatgcttttctgagctcacccaccctcaactgctgggagcttctagaagcttagagctgtgccctcacaggaaagtgctattgtttccagaaaacttcctttctcatatttaggctcagttttgagagttttggtttgatgactgcctgagccaagaacccaaggccccgccttaatacaggatgacactgaaaggccttccagctccagacctcccattgtggatgcctgaggcctcagttgcaatcttatgatgggtcagggtctccttctggtgggtgatgcttctctcactcctttcagattctctgtgcatgaaaatgtttatctcaaagtctactttcagggaacccaaactaagacggccagctgtcaccaaaatgagccaccatagacctgaggtggccactataccctggaatgcatcagcgaatttcctaaatttccactgtgagcatccaaatgcccaacgatttctgagagatccttgtattcttataaaatgaaaagggatcctgaaatgccaggtgctctgagtcctgaaggagaggtggaggcagatcttcctgcaaggattccacggaaaagggagcagcct

SEQ ID NO: 198586 - DNA, 233 bp, Homo sapiens
cttcaagatgctgaattccaaagagccctaccacccttgtcctccctccctttcatctcagaatgcagatcagaggcctgagtgagcagcagacaacacttgtagatggcctgtggatgctggaaccacaggccgctgaaggctccttgggcttcaggagaaccctcagagtctaaacagcctgggaggaagaggcagtgacaggcattgagtcagccactccagacatgcca

SEQ ID NO: 198587 - DNA, 641 bp, Homo sapiens
ttcagccatctgttaaaggttgctcacgttcacaaccagacagtaacaaccaaataaatcatgccacatcatttcatataataaaaaagcacagaaagcaacaggaaatcttttgttctatggtatcttcaccaccatttgctcaattaagtccaattttgaaatttaagagataactaggtaattatacgtcatggtgcttccccaaactcatgaattattttatgcccctttccaaaattagattctaatttctccccaatcaaaaggattccccattttattttattatttttagaagacggtgtcccactatgttgcccaggctggtctcaaactcctagacgcaaagaatcctcccgtttcaacctcccaaagtgggaagactccttaagcccagaagtttgagatcagcctaggcaacaaagcaagaccctatctctatgaaaaaattagttggacgctgtggctgagacaagaggaatgcttgagcccaagagttccaagttacagtgaacgatgattgtgccactgcagtccagcctgggcaacacagcaagatccatctctaaaaataaataatattttttttacaatgttctagacaatgtcaccacaattatatgtcatacacatttggg

SEQ ID NO: 198588 - DNA, 475 bp, Homo sapiens
tgtaatacaaggcccttgggggagtctttgcattccattaaattatccattgagatgaatgtgtgtcatgtgacttgttagaccacataacctgtccagggaaatgggaatgtcttggccatcctagagtcctaggtctccacgtgaagtcaccacttaatcagtgtctgtcctgtggttatcaactgcgtgtgtggcgtggccttgctgcctgcatggggaggtccagaatgtggttcctgaggctgggaggcgagggcaggaagtctttggggcacagaggtccttgtgtggttttcgtgggaaggggtcagccattgaggcagtagtggaggaagctgagagggcagaggaagggatgggacgcggtatttggggtcttttaaatctgatgtaaagcaaatctgcgccgggaaaattctcaccaccattttaaacaactcattgatggagctcagtctcagattttatgtgt

SEQ ID NO: 198589 - DNA, 610 bp, Homo sapiens
tgtccttgcgatagtttgctgagaatgatggtttccagcttcatccatgtccctacaaaggacatgaactcatcatttttatggctgcatagtattccatggtgtatatatgtgccctttcttatttcacatcgttgactttccgaggcagtaagagggccacctctccaacttgtcctcagttttagagcacttccccatctatgaaggcacagttttcttctccatctcttctactaggctgtgctctccctggtgcccagcacagtgtgggcaccaagtaggtgctccataaacacgtgaatatacatatatgtatatactgtatatgcatgttttatacatacaaacatgtttatttgtagcatatagttggcattcaataaacgcttgttttatgtagtcttaacacacacatgcatatgcatgctttatatatctagataaagtatgtttcatctataatacataataggtgttcagtaaatgactggtatatacgtaatatgtataatatttcatgctgctgagcaaatgaataggtaaagaacaatacggtgtgtgtgtgtgtgcatgcatgtgtgtgtgtatgcgtgtgtgtgtgtgtgtg

SEQ ID NO: 198590 - DNA, 236 bp, Homo sapiens
ttatgagcctaaaactgaagacaaattagttgtctatttttaggaagaaaggtaagtaaaatgtggcaaatagtttccacaaacccatggacctatttttgttttttttttttttttttagacggagtctcgctctgtcacacagactggagtgcagtggtgccatcttggctcactgcaagctctgtctcccaggttcacaccattctcctgcctcagcctcctgagtagctggg

SEQ ID NO: 198591 - DNA, 466 bp, Homo sapiens
tgtgggtgcaacattcagggaatggttactgaagtgttccaggcaccagagctcaggcaagaagtggaaaactgcgcaagatcctgcaccattcaacggctaaaatgacttttaaaactacctggtgaatggcaataccacatcaagccactaggtggcaaagcagactcggagaacgacctctctgccagcaggcgctgaagcagctacccgttccccatgctggtgaccaggaacttcagcttagctcagtcatgcagttcgcggaggatatcaaacagagtcaacaaagctttgcaatcaaacgtgtctttaaagggaatccaacttgtgaacctggctcttgatattcatttgaagctgcaagggggaaaagatgttacctaatatggagcaatggctcttattgtgaacaaaacatctctgaacaccaaaaccggaataaaattctatttaaaaagggaaa

SEQ ID NO: 198592 - DNA, 227 bp, Homo sapiens
gatttgtcagaaatgcagaatttcaggccccaccctagacacctcagacctactgaatcactatctgcattgtatcaagatccccaggtgatccacgtgccaataaaggtgaatactcactttctagaatattttggtggttcactgactcttccattcccgaatcatccactatctgttaacacactttccttgttatagactaattatcatattcaattgtttaa

SEQ ID NO: 198593 - DNA, 518 bp, Homo sapiens
ccgggtgagcgcacactggggcactatgatgatgccgggtgagcgcacagtgggacactatgatgaggctaggtgagtgcacactgggacactatgatgaggccaggtgagtgcacactgtggcactatgatgaggctagttgagttcacactggggcattatgatgaagctaggtgagcgcacactgtgacagtaagatgaggccaggtgagcgcacactgggacggtaagatgaggccaggtgagcgcacactgggacactatgatgaggctaggtgagtgcaccctggggcactatgatgaggccgggtgagtgcacactgcgacactatggtgaggctaggtgagtgcacactgcggcactatgatgaggccgggtgagcgtacactggggcactatgatgaggctaggtgattgcacactggggcactataatgaggtcagatcaacgcacactggggcactatgttgaggctaggtgagtgcacactgggaaactatgataaggctagatga

SEQ ID NO: 198594 - DNA, 456 bp, Homo sapiens
aagaattaattagatcttttacgctctgtcgttggttctaagtcttggaaatccagtgtgtgttttagagttaacagcccatctcaatttggactagacccgtgccaggtgcccagttggctgtgtaccctcatgtatataggacagcaaagttctgtagaaaagaacttcaggccaggcgcggtggctcacgcccgtaatcccagcactttgcgaggccgaggcgggcggatcatctgaggtcaggggttcaagaccagcctggccaacatggcgaaacccagtctctgctaaaaaatacaaaaattagtcccggcgcagtggcgcagacctgtaatcccagctacttgggaggttgaggcaggagaatcgcttgaacccgggaggcggaggttgtggtgagccgagatcgcgccactgcactccagcctgggcaacagagcaagattccatctc

SEQ ID NO: 198595 - DNA, 1301 bp, Homo sapiens
agcctcccaaagtgctgcgattacaattcaaccatttaaagcttacaattaagtggctcttagtatactcagagttgtgcaaccatcaccacaatcacttttataatattttcatcacctccccacaaaaaactctgcaccacttagcagtcatcccccaatcttcacttccccccagccctagacaaccactaatatactttctgcctctataattttgcctatcctggacatttcatataaacagagtcatacaatatgtgaccttttgtgtctggcttctttcagtgagcatgatgttttcagctttcatccatgttgaggcatgtagcagtacttcattgcttttcattgccaaataatattccattgtatggatatgccacattttgtttatccattcatcagtttgtggatatttgggttattctcacttttggctattatgaatgaatgctgctatgaacattcacgtacaaacttttgcatgtacatacatttttctttcttttggatatctggtagggagtatttttctccttgttttacaaataaggacattgaggcacagaaagtttaagttatttgcctgggtcacacagcaaataagtaacagagtcataattagaactcaggtagtctgcctccaaagtctgtgctgttcatcagtacctctcctgaacgcttccttatagcagctactgtgccaggagccagagagactggggagagcaaagcagacatgtccctgtccttgtgaaacttacagggagaccatggcgcaataatcgaagacacgggaaataactaccatgacagctgcgttaaggattacagtcgagagttgcaaggttctggcaggtagaccaatgggctatgggacttgtcatcatcagagtggccagggaaggaaagcttccctggagaggaggtgcttgctctaagatctgtaggacatgtaagtgctaaccaggcagagatggaggaaagcagcagctttaaaggatgcaagactcgagggtgcggccagtatagtatgcaggcttctgaagtcaagcatttactcatctattactcagcaccccataggcacaaggctccatggataatgggtcctagggacactgctaactgagaaaaatctctccagccccaggcaggaacacatcttgctgtcagagatcactgatgtcccagtctgagagacccaaattcccatccctgcctctcattttcaacatcaaaaggctgctatgctttagatctaaaacccaggatggcatttttcatctcctctcctc

SEQ ID NO: 198596 - DNA, 494 bp, Homo sapiens
tgcctgatttcaacaatatcagtcattatgatacatttaaattgactaaagcatcccgattaaaaggcagagattgtcagactggattaagaagcaagacccaactgcatactgtccattttaaatacattttgcactatgtagtgcattttggctacagtgcatattggcttctatgtagcagctttttttttttttttttttgagacagagtctcgcactccagcatgggcaacagagagagaccttgtctcaaaaaaataaaatggtgaatgtaaaataaaatggtagctcacgcctataatcctggtactttgggaggccgagatgggtggatcacttgaggccaggagttacagaccagcctggtcaatatggcaaaactcccatctctactaaaagtacaaaaactagctgggctggtggtgatgcctataatcccagttactcaggaggctgaggcagaggtcacagtgagctgagatcacaccact

SEQ ID NO: 198597 - DNA, 201 bp, Homo sapiens
gcacacagtgggcgctcacaattggtgatggatgcaggcatcctacacccatgttatcgctgtccttcccagggctcctatagcacttgttaactctgctaacgaagcatttaccaatcttattttataattatctcttcccggccgggcgcggtggctcacacctgtaatcccagcactttgggaggcctagggggtgga

SEQ ID NO: 198598 - DNA, 323 bp, Homo sapiens
ttacatctatttctggcccaagactgtggcttagacagaatggatggtggtggtaccatgactgagatcgcgccactgcactccagcctgggcaacaaagtgagactccacctcaaaaaaaaaagaaagagctctcaggatgcagagaatggcatggagtaaagactgggtgacgcattaggaggctgtggcagagatacaggcaggagatggtaagggtttggaaccacagtagcagcaacagggggcagagaacagtggttgatccaggagtcatttaggaggtgaaactgacaagacatgacgatgcaatggatgttggg

SEQ ID NO: 198599 - DNA, 368 bp, Homo sapiens
aataaaagaattagccacacatggtggtgcgtgcctgtaatcccagctacttgggaagctgaggcaggagaattacttgaacctcggagatgggggttgcagtgagctgagatcgcgccactgcactccagcctgggcaacaaagtgagactccacctcaaaaaaaaaagaaagagctctcaggatgcagagaatggcatggagtaaagactgggtgacgcattaggaggctgtggcagagatacaggcaggagatggtaagggtttggaaccacagtagcagcaacagggggcagagaacagtggttgatccaggagtcatttaggaggtgaaactgacaagacatgacgatgcaatggatgttggg

SEQ ID NO: 198600 - DNA, 132 bp, Homo sapiens
ttatgatataaaccaaatggcctaaccatacttgtaacaaaattacagtcatccatcttaacttatgtgcatgatttaactcattggagccctgatgaattgattacttgggaaaaaaacaacaacattatt

SEQ ID NO: 198601 - DNA, 636 bp, Homo sapiens
gaaatttacctctgaggcaggtatggctgaagctttacgaaaagagatggggcccgtgccaggccttagacgtgcgagaaggagggcgtgtcaggaagcagaaacagtatcagcaaaggcgctgctgggaggcatgtgggcagtgtttggggaacggccaggggctttctgtgtcaggtttacagcatctgtgggaggctgcgttggtaaataagcccagagaagtaggctggggctacttacattaaaagtatgcatggctttgaaggccagctgagtggtataaatagaaactacaaatagtatcacatttattgaggacagcttgtgctgccaaaagagtttttaaaatttttttggattgtgtaattggtggataaagaattattgacctaaatgtatctgatcttagagtgttttagtatgctagattattggaggtgaaatggctaagtcaaaggtgatgagtgtttttgagactcttaatgttaattgcaaaattaacctctaaaaaggtaggccgggcgcactggctcacgcctgtaatcccagcactttgggaggccgaggcgggcggatcacgaggtcaggagattgagaccatcctggctaacacggtgaaaccccgtctctact

SEQ ID NO: 198602 - DNA, 1072 bp, Homo sapiens
agtgctgccagtaatatatctaattgtacctggttttccagttttgtgatcattgtattttataactccatttacttttgccagcttaatagttgttttgaaactatagtccttacttggctagggaggcaatgaattttttttacatggtagtttactatttacatatatttgagtataaaacatctattcatcttctctgataattagctgatggacttactttgtatatgctgtccactgtccacattattagtggaactaattatgtagtgtcttatcgttacgagttcatctgtattaggtacttaaagctgtacctgcatataataaacactcaataaaagtcaattagctatttttatttcaggctatgaaatttgctatgagtatagcagtggctgcacattttttgactggtttatcaggactcttgtttgcagttgatttattaaaagtgaatcttaggaaaacctggcagcaaagagtgtaatagggttctgtctcaatttattgagaggcttctgaatattcactctgatgttcagtgtgctttttttctacaaaaaaaaccacacgtgaccatagacaggtctcaaattttagtttcatccatgaggcagataccaatccaacatttccttctggctgcaactcttttgagtctggctgctttttctcagctttccagattgatctagcttgtagtatcagtaatttatatttattgctgagtaatgtttccttgcatagatatgccataatatgtttatccattaacctgtcagtggactttcaggtcttttctattttgtggctattatgactgaagctgctgtaacatttatgtacagatctttgtctggacatttctcatttctcttggttaaatatataggagtgaaattactgggttgtacgataagcgaatgtttaaagggactaccaaaatgtttctcaaagtgattgtatcattctaatttcctagctgagtcttccagtttctccacatcctctccagcacttggtattgctagtcttttaaattttgccattttagtggatatgaagt

SEQ ID NO: 198603 - DNA, 654 bp, Homo sapiens
cagtctccccacctccaatatccaaagttctgtcaaggatcacatactacatttggttctttattatagactttttaaatatcgttgtataccattgtgattctatcgtctcctttaataaagaggagaaccagaaaaatgaaaggtcataagaggaatgaggtttggagaataggtgaaaaaaggcatcataatgtttataataatgtttgcctgttcagagaaacaagaatcacagataaagtcacttatatgtagataagagaatgctgtattactttttgctattctattcactgatcatttttctaagaactctgtatgcttcttgtttaactcttatgtcagcatgtatgagaaaactgagttaaagagatgttaagtaactcattcatgctttactagaaattggttgatgagggacataaacctaggccggtgtgattttagattgcttcttttaaccattgtgttgtattgccttatatttctaagtaatttatgttcactgagagcaaataatagtctagctatgacttagaaaagtaaaataaagatgttgggcagaaaaccattttattaggggtttttttggaggagcagattaattgtttctgtattctttggactagtgtgaggtcctctgttcttttt

SEQ ID NO: 198604 - DNA, 189 bp, Homo sapiens
gcacctggccaacccaccccttctttacatattgcattagtccattctcacactgctataaagaaatatccaagactgggtagtttataaagaaagagggttaattggcccatggttctgcaggctgtacaggaagcatggcagaacctgcttcttggcagaaggcaaagggggagccagcactttaca

SEQ ID NO: 198605 - DNA, 515 bp, Homo sapiens
atctgatcctcatggctaatgcatgctgaacagaacacagggcagcaaaaattgaccccagagaaggaaggaagagggaacgggaaaggagagtttggttatcattgctcttggagaaacaagatgcatgatgttttattaataggcacaattcctttatgtaagtaacctgataaaaggtagtaggttgatttcatgctctgctgaagagaagtgggatggctttctaccctgaagccactagggctcttttaggcactgcatggagcatatttgcttttttcctttatataaattgcaaatagcatcttagtcacataaaagagttggtccagctccctgcaaaaatgctctgttatgtccagtgtgcatttcatatatttcacatgctccaggggctgtcagctcatgcagtcatatccaacattgacattgactatggcagtcacagtgacagcagttttgttctttcatgccatttggtactccacaatgcactacttaacccaagacaa

SEQ ID NO: 198606 - DNA, 450 bp, Homo sapiens
ctcccaaactattggtccaataaatgaggaggggccactacttaggaaaattgttctatatttagttttaacacctttatagagatgcaactgaaataccacacaatctgcctgtttaaaatgtacaattcagtgacattagtgcattcacagagttgtgcctccattaacacaatttagaatattttcagtacaccccccaaaccctttgaccctcaatcttcaatcccccataccccctccaaccctaggcaatcattaatccactatagacttgtctatagtggacatttcacttaaatggaatcatgaaattatgtcattccggcttctttcatttagcataatgttttcaaggtttatacatgtaatagcatgcattgatactgaattctttattgttgaataatattccattgtatgaatataccacatttgtttatccatcag

SEQ ID NO: 198607 - DNA, 265 bp, Homo sapiens
aacctcacaacaagaaaaaactgaacaaactgaaaatcaacaacacttcttagaataaccagagaaatgaggtcacagggcaaatcaccacctcaaaagctggggacagacatgaatacagagagccacagtttacaaggtacaaaagttactgctgcagccagcagctggcaggcacaaattgctagaggctgagtgtggacttgcctaagagttagagaccactgggggcccactcctttttttttttttttttttttttttt

SEQ ID NO: 198608 - DNA, 164 bp, Homo sapiens
ctgactatttcaaccttttgagtttctgattcatccaaagaatcagaacattgactaccaatgagaaagcttgctccctattcattttggaacatattctactgaaagtgtcttcttttcttttctcttttttttttttttttttgaatcagagtctctctctg

SEQ ID NO: 198609 - DNA, 385 bp, Homo sapiens
tcaaccacagaaccatgccaatgccagtggactctggccccagacttgctcctgtgtacccaagctccagttaaaccccatggacctaagttctaagcccattccagaggcatacctgccccacggtccaaggcttcaggccttgagacaaggcctagggacaaggcctgtttctgtggagcctggcgcctggttgagccctgtgggcccaggtgccagcaatgtttacccactgacccaggcaccaagccagcctgttggagtattctaacatccagcctgcccctgaacctcatccagaatctctggataggctgacttgtgaagagttttcccttcctgagtagtctatgaggactgaaagagctgccatttctttaaataa

SEQ ID NO: 198610 - DNA, 336 bp, Homo sapiens
agatgccggtatggaggatacaagaccagttttgtgtttcaattgcttttggatgtatacagaggaatgtagcaaatatttgctgagtttctattatgaaataggcaccatacaaggcactttatagagacactctcctttaattcttactgataatccttactatgtgttattacttcccattttatggatgaagaaattaaggttcaaagaggttaaataacatgtcagaagctacggagtttgtaagtaaaaactcagggttttgaacgcatcttttaagcttcaaagcagatcttacccagtgcatcagtggtcgacgcggccgcgaattta

SEQ ID NO: 198611 - DNA, 172 bp, Homo sapiens
taaaggtaacaggagcgaattctgatataataaaaatgataaattataaacatattgctttccctagggggaaaaaaagtaagagaaaaaacagctaagtgagaccgagccttgggtacaaatcccgagggaccacccatccttttgtagctggatgtctaataggttcatg

SEQ ID NO: 198612 - DNA, 460 bp, Homo sapiens
tttggagatggaaactttgggaagtaattaggtcataaccctaatgagtggtattagtccccttagaggaagacacatgaaaacatcctctttctctgctctccaccatgtgagtatacaataagatagccatctgtgggtaggtgctggctcacacctgtaatctcagcattttgggaggctaaagtgggaggatcacttgaggtcaggagcttgagaccagcctgagcaacaggatggtctcagtctcctgacctcttgatccgtcagccttggctgggattttatgctaggattacaggcgtgaggcaccgtgcctggccaaaaaaaaaaaaaaccactttttaagaaaaattagccaggtgtggtggcatgtgcctatggtctcagctactcaggaggttgaggcaggaggttgaggctgcaatgagccatgattgcaccactgcacttaaccccg

SEQ ID NO: 198613 - DNA, 583 bp, Homo sapiens
gcaaaggcaatcaactgtacctaagaggtggggagaggcttgaaagaggagatgctcttcaactgattctttaaggatgagaacaagtatacgaggtagaagaggtggtggtagaagagatggtggcagtgcttgctggtaaagacacagttataattaatgtagatgatcggcaggaacctaggaaggaaagataaagccaacttgtaaagggcctcctcagccttgtaaatgagcttaacaatgggagccatctaaagtttttaaaaagagaactgtcagattttaaaaggagaactgatgagttttacttttgagaaactgctctgggtggggaaagatttgaaggactaattctctgttactggagagggaccctgagaagctgagccaagatcaaatgccataggaatgtaaagtggcacatagaaggtgaggggagaggtatgatgacttcagagaggattgagtggtgcctttgagacaagagaaagggattagggtgggtgcgtgattcttttcaacaggaagaatctttctttgaggtacctgctggaagccaggtggtatttagcaatctgat

SEQ ID NO: 198614 - DNA, 669 bp, Homo sapiens
aggttgcagtgagtggagatcgcaccactgcactccagcctgggagacagtgtgagactctgtctcaaaaaaataaaagtaaaataaaataaaataatcactctgaatgtagtgcagagaatcttccagggcagggccagcagaccacagcccatggcaggttctggcccactgcctgtttctatatagctagcaagctaagaatgctttgtatgtttttaagtggttgaaaaaaaatcagtattttatttcacatgaaaattatatgaaattcaaatttcagtgtccagttccagttctattgaaacagagccacactcttgtgtgtattatctgaggccgcttttgagctgcaacagccaagctaagtagttgtaacagggagcatatggcctgtagaggctgaaagatctatactgtttggccctttacagaaaagagttgttgatccctggtttgggatagaagtagggagaccagtgaggagactgttgcaagaactgatggtgccttggacagagcaggaagaaatggtcatatatgggttatgtttgaaaggaagagctggtagactgtattaatataggaagagtcagggatgatgactgtgtttttgcactgagtaactggaagaatgctattcttctttactgagatcaggaagactga

SEQ ID NO: 198615 - DNA, 1349 bp, Homo sapiens
ctatcagctggaccagcatgggttcaaattactgcaataccgcaagcctttccctgaaagttgcaagtcatcaatggattccagagtttcaaaggagttacatcaaatagattctgccagtgtaattattgtctaagtgggcagacagatttctggtacttcttactctgccatcttcacagaatcctattttaaaactgatactctaactgtattccctataattgggaaagctgaaaaatattgagtgaattaagcagagatatagaagatattttaagaaaacaaaacacccaagtcagacttttagaaaactataacgtctgagatgaaaatataatggaagcaattaaaagcagattagaaatagaagaataaagggttatgaacttgaagacagcaataggaactacccaaataaaacagacgaaacaaaaacttgttaaaaaattaacagagcctcaatgaccttggaaagacttcaaatggcctaatacacatatatcggaatctctcaaaaagagaaagtaggagggacagaaaaaacattaaagcaataatggctaaaagttttacaaatttaataaaagctataattccacagttccaagaagctcaacacgaagaacaagaaacaagaaaaccacacaaaggcacacaaaaaccaattggctgtaagccagcaaaatagatctttactctggcatcaccagttgagtccagtagcagcaggtgattctgttttagtttttggccctaacatttttgggaccaacatcactgcactctctcagaggtgccggcatcaaatggccagaatctcctcctcagaggtctctgtcccagctctacagggcgctctcctctgtgctactgaagcaccaggaccaacactagaccgtgcctcctcttcatgggtcccagtccaagctttctaggactctccttccaagcttctaaatgctgataaacctaatcccttccctttgctctgtagccctagataggagctgcttcctattataaccacctctgtgatgtcttaagtgttctctttttgcctgtttaacaattctttacattaagtactctacattaaatactactaaaataacagagaaagatgattgcaccttgttaggtaaaatcataagctttttctatcttttaaatttttttaatcaatttttttagagataggatctcactccatcacccaggctggtgttcagtggtgcactcatgcctcactgcaacctgaactcctggctcaagcgacacttcaccttggactccaaagtaacacagactgtgtgtgaatgccacccacacctggctacttttttttg

SEQ ID NO: 198616 - DNA, 414 bp, Homo sapiens
tacttctctatttgtaatggttacataatagtttatgatatggacagtctgtagtatggacaatcacagtttattaaaggacaaatcttaataatagttttaatgttgagtctaacattgagaaatcctttttcgacaactctcctgggatcgaacaagcataccacctaccttattatcacataccttctgttcagtgtttttcttatctttatgctttgcctaggtagggagcatgatttacttgatggattagtcaagctcatgaaataacaagccatgctagagtccattcctgtccctgtggcataactccactgcatgactttactagatttttaaagtcttttcccaacgtaccgctttaaaattagatctgctacctgtttagcgttttttttcctcctgtgatgg

SEQ ID NO: 198617 - DNA, 552 bp, Homo sapiens
gctatatcactatggtctgataggtttgtctgggttgggtcagagaacaaatccatcttcatgggcagggttggatttatccctaaatgaagtggacaatctgactgtcaatcatcctgtgaagaaatagatcccagatggccttgcacaaggataaggagaaatctttattctccttctgagctttatgaatattgggggggcctgaattttgataaaggaaaacattattgggacattcctagtgacttgtgtaaacttgccaaagctacacagagatgaaccagaagctaggcaggggagatttatgaggatgagcccgggggcactaagagaggtcacagctagttgcagctgtaaatcaacatttgtgatataattcccttccgttttccttaagtctccagtaagagcttgttaaaagttgcagtctgttttcagctgtgttgaagggacttataggtctggtccatgcttgggaaaggagagatcagcatttctttttgtctaggacagaatgatgatagcagtcaaaacagccagatgagaatg

SEQ ID NO: 198618 - DNA, 674 bp, Homo sapiens
taataagtaatcatcaaaacccaggcaaggaaaattgttaactgattaaaagtttgaattatattccctcaaaacccccaaaggccactagatagtttgaaagtatgaatgacatacagacttattttgcaaaagttttagttataatatacacctgatatcaaatcaggctttttaattaattgcacagaattatttctcctattttaccaaaggattcccattggaaagaataaggggtagaaattagtaaccttaaaaatttttttgagcaatttttcacttaaaaatcactgctgagattgttttaaatatagaatatgaaaaacatgagttaaatattaacctcataaagtcgtagttgaattggccaggcgcggtggctcacgcctgtaatcctagcactttgggaggccaaggcaggtggatcacctgaggtcaggagtttgacatcagcctggccaacatggcaaaacctcatctctactaaaaatacaaaaagaattagccaggtgtggtggtgggcgcctataatcccagctactagggaggttgaggcaggagaatcgcttgaacctggggggcagaggttgcactgaaccaagactgtgacacttcactccagcctgggcaaaagagcgaaactccgtctcaaaaataaaataaaatatagt

SEQ ID NO: 198619 - DNA, 276 bp, Homo sapiens
tccagcctggtgacagacggggactccatctcaaaaacaaaacaaaacataacaaaaacagatgttcaaacactgaatatgcatatatacatttatcaaaactcatctaactatctggacatggtggctcatgcctgtaattccagtacttcgggggttaaggtgcggggatcgcatgaggccaggaatctgagaccagcctgagcaacacggtatgacattgtatttacaaaaaaattttttttaattagctgggtgtggtggcacacacctata

SEQ ID NO: 198620 - DNA, 405 bp, Homo sapiens
accggcgaaaggagagcactcggattgcagaagccatcaggtgagctgtgctccttttcacacaccctggggtcctgcgtaggattaccaagtaaaaatacaggctgctcagttaaattcgaatttcaaacaaccaggaattttatttttagcataagtatatcctgtgcaatactcgaggtctgcttacatttttaaaatgttggttatttatctgaaattcaaattttaattgggcatcctatattttcatctctaaccatggtcctgccaaaattagggatgctttgccctctaggttagatcccactttcattcttttgatcggaaagattttttatttgctatcaaggcctgagtctggtagtggccatgtgttgtccacactactcccgccccttgcct

SEQ ID NO: 198621 - DNA, 826 bp, Homo sapiens
ccatggaaacaaacagagaagaactctatgatctcttggaaaccctgaggagactttctgtcacctccaaggtgaagttcatcgtcttcaatccgtcctttgtatacatggatcgatatgcctcctctctgggagcccccctgcacaactcctgcatcagtgctttgttcctgctcttcttctcggcattcctggtggcagattcactgattaacgtctggatcactctcacagttgtgtccgtggagttggagtgataggtttcatgacattatggaaagtagaactggactgcatttctgtgctatgcttaatttatggaattaattacacaattgacaattgtgctccaatgttatccacatttgttctgggcaaggatttcacaagaactaaatgggtaaaaaatgccctggaagtgcatggggtagctattttacagagttacctctgctatattgttggtctgattcctcttgcagctgtgccttcaaatctgacctgtacactgttcaggtgcttgtttttaatagcatttgtcaccttctttcactgctttgccattttacctgtgatactgactttcctgccaccctctaagaaaaaaaggaaagagaagaaaaatcctgagaaccgggaggaaattgagtgtgtagaaatggtagatatcgatagtacccgtgtggttgaccaaattacaacagtgtgataatgtctgcttggcatattttcaccttaggtcttatcaagaccaaagagattatgttaatgaaacaattaaattcaaagttcttcccttttttaaagataggaaacaggcattgcc

SEQ ID NO: 198622 - DNA, 600 bp, Homo sapiens
aagtgctgaggttacaagcatgaggagaaataaatactaaagtttgagagcccactagagcgactgtacttagcaacaatataatgtataagtcaaagtcactagaaaagaggactttaaaggatatggtgttagtctgttcttgagttgctattaaaaaaatacctgtggctgggtaatttataaggaaaagaggcttaattggctgatggttctgcaggctgtataggaagcatggtgcggtcatctgctcctggtgaggccctcaaagagcttccaatcattgcagaaggcagagggggagcaggcatcacatggcaagagcaggagcaagagagggagacatctcatgaactaacagagcaagaggtcactcatcacaaaggatatggcactaagccattcatgagggatctgctccgtgatccagtccctcctaccaggccccacctccaacactggggattaaatttcaactggagattcgaaggggatagacatccaaaccatgtcagatgccgacacataaaaatgataaacactcggtcaggtgctgtggctcacacctgtaatcccagtactttgggaggccgggtcagg

SEQ ID NO: 198623 - DNA, 411 bp, Homo sapiens
tctccactactgatgctttctacgtctcaaaaccacagctcaacagatgtgagtttcaactgtctttgtgcaggaaacatcctttcagtattgttgttttttttttctgatatttaaaaaaaaatttttcttttggtctacttgtggtattactgagaacagcatgttaaaatctccagctattattgtagattttctattttcccctttggttttactagttttggtccatatatttgggcattctgtcatcaaatgtgtatatcttggtaattgtagtctctccctattgtattgcgcaggacctatccttttggccctataatactcattctattgaagcaatatttggtgtgctattaatccagctactacaggccatgtgcagtgtggctcgtgcctgtaatcccg

SEQ ID NO: 198624 - DNA, 434 bp, Homo sapiens
tcagagaagtatataatttgtaacattttgtatataagaaacagatctgtgcattcatctctcagtgggctgctatacatgattcttttcttagcgtaatgcatagaagtagatttgcttgatgaacatatacagtcacacaccatataaagatgtttcagtcaatgacagaccacacataccactgtggtcccataagattataatggagctaaaaaattcctatctcttagtgctgttgtagccgtcatattactgcaacacatcattcatgtgtttgtggtgatgctggtgtaaacaaacctaccatgctctcagtcatacaaaagtagagcacatgcaatacttgataataaatgactgtgttactagtttatgtatttactacagtctgctttttattgttattttaaagtgtaccccttctacttatt

SEQ ID NO: 198625 - DNA, 486 bp, Homo sapiens
tgcatttcttcagaaggtacgctgtcctcacgggaaaccgcccgccactgcctgggtttggggctgatgaggccaggaagaaacttaatgcgtgcactctaacaaaaagatttcccagtaagttaagaaaataagacggtgggcaccaaagaatatgcgcatgccctgacatctccttgacgttcacgtacgtgccactcccagcagcatgtctgtcttgagaacctgcacagacacccttgatttaggctgattgatttgcaagagggcaggggaacatcagaggaaatgaggccaggagaaagcaaggatatcaagagaactcgcttttttctcccagagtgattgtttttgaattcttcactctgccttatttcagagtggaatagcaagctgtaggtctaaggcacatggcgaagaaactgtaactgatccccttgtcctaaagcgccttccttcatgctgcttctcccttcccatgtagtg

SEQ ID NO: 198626 - DNA, 425 bp, Homo sapiens
acgcatccagaacgctactactggcaagtcgtgttcttacacccaagagacattactgtgcgggacgcatgtgtgcgtgtgtgtgtggtgtatgcgtgtgctgtgtctgtgtgggtgcgtggtacacgtggtgcatgtatggtgtgtgtatggtgtgtacatgtggcgtatgtggtgtgtgtgtgcgcatgtggtgtgtgtgcgtggtgtgcaagtggtgtgtgtgtggtgtggggtgtgtatatacatgtgtgtacatgtggcatgtgtgtggtgcatgtgtgtgtggcatgctccccaacctggatgtcgagatgcacccgcagtttgccaccagcgaagagagccatcctggtagaattggagtgcagacagatttgatggtcaccgggcgtgtgggaggtgaacgtgaagcggccctccga

SEQ ID NO: 198627 - DNA, 338 bp, Homo sapiens
gcccttgggaatataattggtttcctaggttaaaaagaagctattttttttaaaaaaaagaaagatgtattgcgttagtagaatttttagatattttacttgtaatgagaaagaagaaaagactttgggatgttacaatttattagagtattaaatatcatacagtgacatgttacagttaacatttatcaataattcagagtggtcaacatggtatgatattaggcattatggacacacaaagatatcttactaatagagagatacaaaatgagggcagagacagcaagagagaaatgagggtggagtgcagttaatcagagaagtaggaggacagg

SEQ ID NO: 198628 - DNA, 241 bp, Homo sapiens
cagtttcttaaactcagttccagattcttcagctgcagtaaggtggagctacaattaaatgtgggttactgaggacttggtaggcagttgattacatatagtaaacatttattgtatgttaggttcattctttttgttttgttttgttttgtttttttgaggcagagtctcactctgtcacccaggagggagtgaagtagtgcaatcatggctcattgaagcctcaacctcccagactcaa

SEQ ID NO: 198629 - DNA, 978 bp, Homo sapiens
agtctaaactcaagggtgtagcagggttggttccctgctgagaggccttttctggcttgcagacggcactgtgccctcccatggcctttgctccgagcaagtgcagagaaggcgagtgtgagccttctaccatccctccttacaaagacactaatcctggagggccaaggccccacttatgacttcattcacccttcattattttctctgaggacccatctccaaatccagccacaccagggtttaggtctttaacatgaatgtgaggaagggaggccacaagcattgagtccatgacagacactgaaaagaggacattgtgttcagagcaagccatctgagtcaccttgcaggccctcagctcagcatcaaggattcagtgagtgtgcaggtgtttgagacggggcctagctgctgggctgactgtcactgtgcgggagagcttcaactggaaaccctaatcactagctttcctgctagtagaaaccaccagtttacttaggaatctcagctgactgggtgcctcagtcagggctgtgcagagaaacagcaggagagacagagattgagatctcaaggacttgccttctgcagtgggtgagtccagcgggcaggtctggactccgtggacaggcagcgggcacgagacttggccgtggtggacactgcaggccgcaggtggactctcctcagagaagctgcagtttgggtctcacaggcctctcagctgactggttgaagcccccacattctcaagagtgatcgctacttgaagtccattgattataggtgttaaccacatctataaaatgccttcacaggaacacccacagcagtgtttggacagctgggcactgtggcctagccgggttgacacatacggccagctggcacagtcggggacattttactttttttcagttatcgcctttaaccacgatgggtgaaatcacactttcctgtgcctaaataacatct

SEQ ID NO: 198630 - DNA, 595 bp, Homo sapiens
ctgtacatgagagttatctgagggctttaaaaaatataaggtcagggctttgccatccccccaactctgatttaatttaagtggtctgatatgtgccccaccgccaggtgattccaatgtccagcttagctgagtagcaccctgctaaagaaacctgaatattctgaatcatagagttactatgaataccatataaggaaaaatagctttaaaaattaagcaaaaaacaccctgctttacccttgtactctactttgtttcagtagaaacttccagtttttttatgtctaaattatcattattaatatcataatcactgtataatatatgtagagaatataaagaattgtctgcatctgttttacgacaattctgaagttggtctttaagaaataaatttttcaattgtctttctaataaaatacataatacgaaaaaaagtttaattctttgagcattccagtttgtattctgttaaaaccagaatcagttataaatagtaatattttaaaatgagtgatagtaacaaaagatggataggcccttttatctataaatccagggctttagagtacttttgttaacagcaaattaa

SEQ ID NO: 198631 - DNA, 284 bp, Homo sapiens
cattaagttattcagctagaacagggagagacaaaaagattaggaagggcctgttcctaactttaaggatttgatacattccttgagatggaatgataaacttgatgttttcataattgtttttgaattttaaagcaccatttatatgggtacgttgaaaataaaatgataaaactgtatattaccttcattactttccataaatgctaaagtttgggagttcataaactgcaggcaggtagaacagggcattgaagatgagatgggaagacaagactttcaga

SEQ ID NO: 198632 - DNA, 555 bp, Homo sapiens
tcgcgctttgccctttccagctaggtggaagttcacgagggacaaaaatcagatgaaataggctacctgcccgtctcttgagtcgaggcagggctttcagatgttcagatgccattttctcgtgtgttcgttttcgtagaaggaatgatgtcctgtgggaaggacactagattgagtgtcaggcaactttcatttctggatcttagtctttgaagctagagggttaggttaggtaatctcaaaacaatatgttatggggctagagtcttggttacccttgtgacccccagctgttagattcttagaaatgtgggagacttgaggggtcttctgagtccagctgtctctctttggagttaatgagattgaggctccgagagagggagggatttgctcaagttcacctagccagtttgtagcagagcccggacccccatcaaggtaccccctcacgcgacgatctttctctcaggctgcccgccgtgagggcagtggttatacagaaaataatttttttaaatgatgagaggaggctgtacctcagtcaccatcatt

SEQ ID NO: 198633 - DNA, 261 bp, Homo sapiens
aagtttgtggctattctgtggtaattatttctattgttggaaaatgttccagtgataattactgatgttattaatatccatgaaaaatattttaaaatactttctgttgctacatgtaaaatgtgaattactatcctagttcttctttctttctgaagattttagtctcatgtattttataatgaaattatctccatgttgtatagggggaaaattctgttgctatgattaagtgtaccaatttttaatataatgcttacc

SEQ ID NO: 198634 - DNA, 557 bp, Homo sapiens
cgaggagtccgcagaggcgtagcattgcaattttctgaagggaaggctatccacaactgttaattctgatctaaggaactatttcccttcttaacttctttgctaggttatctaaagggagatatgctttctcacatttgtttccttgaacttacttttaatgttgccttgtagggtcaaaactttagaaatacagctttctcaggaaacttggtcctcagatctttcagacattatcttcctttaagcttattgtcctcttgggaattggcaaaggattcccaccctttaaaaagataggaaattgtaaaatccacacttaaaaattaatctaaaattatttttcaggaagaatttatacaatggcaactaaatgccctgcagccaattatgtttatgattcctgcctcatctccaaatggtactagagtttgagtcatatgagaaaattaattgggttgggcttgattgtacatgtatatgtatataataatgttctggttataatgcagtttgcagtttttctagttacagctcaaggcaaagatgagaagcaa

SEQ ID NO: 198635 - DNA, 509 bp, Homo sapiens
ccaggcacctcctctactgtggtcagagagggacccagacagagcatgagagagcatatggtccgtatccctcagttcacaaacaggggccggggatttgatgtgattcatcccaagagcaagggtgcttctgtcatcacacctggattctcactgtgatatgagcaaaacatagcgtagtacagtcatgctttgcatagcgacatttcagtcaacaatggaccacatatatgtcatggtcctgtaagattataatgaggctgaaaaattcctgtcacctagtgatgtcatggtcattgcaatgttgtagcacaaaatataactcatgtgtttgtgtgtttgtgctggtgtaagcaaacttactctgctgccagtcatataaaagtatagcacatacgattatgtgcagtgtgtattatttgataatgataataaatatgttatttggcttatgtattttctatactctagccttattttagagtatgttctttctacttataaaaaaa

SEQ ID NO: 198636 - DNA, 357 bp, Homo sapiens
taacataggtaaatctcttaaattctcagaacttcaattcatttatatgtaaagtgaggagttgtaccatattggtagttattaacatgtactgtacttatgaatcagtctgaaaatcttgctaaactgcatattctgagcttttcttaatttttttttgttttctcggaaacgctgattctctaggtcttggttggagtccaggtatctgcaaattaaataagcacttgaagtgatagtatctgagtgtccgtaggcaaatgttaggagaactgaatcagatgttctttgaaagattttcatggttctaaaatgttctgatttaaaatccacaaagaaaaaaagcattgaaaatga

SEQ ID NO: 198637 - DNA, 377 bp, Homo sapiens
caagaaatgcagcagctgtcagatgccgttagtgattcaactgtgaaataaaaggttccaaccataatgcttaaaaaaaaaaaaaaaaaaaaaaaaaaaaggccaggcatggtggctcatgcctgtaattccagcactttgggaggccaaggcagaaggaccacttgaggccaggagttaagagaccagcctgggcaaccaagtcagatcacatctctacaaagaatgtaaaaaaaaaaaagaattagccaggcatggtggtgttcatctgcagccctagctatctgggaggatgaggcagaaggaccgcttgagcctaggagtttgaggttacagtgagctatgatgctgctactgcaactccagtctgggagact

SEQ ID NO: 198638 - DNA, 347 bp, Homo sapiens
gtatgaagttcaagcatactcagatacttgctctcttacatccttcctaaccctctgctaccctccctcctgggcttctccttacataaaaaagaagaaacaggataaggaggatatgtgttctcttttcttataagcaagaacacttctttatttcccgagaccacaaactcactattaaagcacatcccaacttaaaacatacagcaagctagtaaagaagtaagagaggcaggggatgagtgggaaaaacagctgccagtgataaagggggctgtctcatgcctgggagagctacagcggtccacattccatctcacagtcatggtgtacgaactagaagaaca

SEQ ID NO: 198639 - DNA, 286 bp, Homo sapiens
aaagtgctgggattacaggcgtgagccaccatgcccggcttaagtaactaaatattttaattgtaactaagtgaaaatatttgccagccctgagatgcagtttaagggattaagtaaatgtgggggaagactggggctaaagaagaggaaagaggggcacgcccagctacctaggaggctgaggcgggaggatcacttgagtccaggaagtggaggcttcagtgagctgagattccaccactgtactccagccggggcgacagtggaaagggtgctagaggtcatt

SEQ ID NO: 198640 - DNA, 192 bp, Homo sapiens
tagtaaagctggatttaagtgtggaactcaggaacactgatagaactgacgggtcttgctgatgatgaactgaagcaggaggatcctttaagcccaggagttcaaatccagcctgggcaacatagtgagatcactgtctcttaatacatatatatattttacccttaatacatatatatataaatacccaca

SEQ ID NO: 198641 - DNA, 343 bp, Homo sapiens
cagcccattatatttaaatagataaattgtctcagttatttcacactagctgtatgactttatttctgttatccccagcaactacatttttagctttaaagaatatttttattgcttttgcatcaatttcaagtttcaatatacaaaagagagtagtaactagttcctatgctcttcagtctgcttccccaagtaatcattctactgtgaggtgttttgtttttggtattggcattttggtattaggattcattattactagttatcaaggagactcattattacactgtgtcccctaatcatgtataaccagtggcctggcaaagcagaagacgacttcctc

SEQ ID NO: 198642 - DNA, 399 bp, Homo sapiens
ccccagaggggcgggccagctccatccctccatcacctcccgtggggcgctgggattgaggggctgccaggcccctggagctagggtgggggctgaggaggggcggcagccagccccaggcctgatgtaattactgctaacaaagtctccctgggggtctggctaaggagggggcctgtgggacagggaaggacaggcccggagtcattgtggggccccaggggtccgttttctcagccttgacaaacagctctgacaacggagcgcttgagcctgggcactggcctcggagggctgggagaggaggtagaggctggggctccgttgccggctccaccccaggggtacccttgagactgtcagctctggtggtgagccctgtcctggctgcacttgagg

SEQ ID NO: 198643 - DNA, 334 bp, Homo sapiens
aaccattcttaaatttgcagggtttttttctttcttttcttttcacatgacagtttttattatttttatgctggaacttgtataatcaagagttgtgctcttgaagatagtcaatcatcttggttgaatttacatgactttctttttttgagaagttgtttcagaacatgcctttattgtattatttcacacaccttcagcagaacctcatcttgcttcttttagggcagctttgatttctcgaaatagccaaaattcatctgaaatgaaatctaccaggtagaactggtaaaccaaagagatacctagattttttatgctgatggagatgtgg

SEQ ID NO: 198644 - DNA, 345 bp, Homo sapiens
agccaaacttccttcccagctttgcctctcctgagccaaacctccacctcagccagggttccatttcctcgtcctcctccctcctcttcctctgaaggtgcccatcctctcatctccttgactctttcctctcagcccaaaaacctgctccattgcatccagcctgaaaatccctccttaagccagcacctgcctctgctttccttctccacagaactattgagcaaatgagctacatttgccatcaccacctccttctctcctactcaactgtacaatctggtttttgctggcaaatgctctgtgctccttaaagtccccaacaatcaccccattgccaaattc

SEQ ID NO: 198645 - DNA, 319 bp, Homo sapiens
aaactgagcacagagcttaagtgccacacatatagtaagtagcagacccaggactacaaaccaagtcttctcattaaaatccatgtgcttggccaggcgtggtggctcacgcctataatcccagcactttgggaggccgaggcaggtagatcacagaggtcaggagatcgagaccatcctggctaacacagcgaaaccccatctttactaaaaatacaaaaaattagccgggtgtggtggcaggcacctgtagttccagctcctcaggagtttgaggcaggagaatggcgtgaaccggggaggtggagcttgcagtgag

SEQ ID NO: 198646 - DNA, 444 bp, Homo sapiens
aaaaaatgaaacagggctggctgggagtggtgactcatgcctatattcccagtgctttaggaggcagaggtgggaggctagcttgaggccaggaatccgagacaagcctgggcaacatagcaagactatctctacaaaaataacaaaaattagccagttgtggtggtgcacgcctgtagtccagctactctggaggctaaggtgggaagatcctttgagcccaggagtttgaggctgcagtgaggcatgaagacaccactgcgttctagagcctgggtgatagagcaaaaccctgtcttgaaagaaagaagaaatgtaggaatggagggagggaaaggagggagaaagggagggagggatggagagacagagagaaagagagagggagggtggaagcgaaaggagagagagagagaaaagaaaaaagaagaaattaaggaaggc

SEQ ID NO: 198647 - DNA, 308 bp, Homo sapiens
ctcagattggggggcagagttgaaggggctaaattgctcctgacgggcacaggtatgggattaagacaaaaaaggctgcgcaggcagggctgaggccaagctcaggaatgtggcaggtagggctgctggtgctctggcagggcccacgtgggcaggcagttcagcctgtgcccacaccaaggctggcacccagtcctgctcacaccctttcccgtgggctggggaacacaggttcagaaatgcccacgattcccagcagcctgagtagcccagtccatctccacagtgagaggcacctccacagcaag

SEQ ID NO: 198648 - DNA, 509 bp, Homo sapiens
ctgctgtactcaaagaacatccacacacacacacacacacacacacacacacacacgcatgcaacataaaaagacattgcaacacatttatttagaccacaaacaagttcttcgtttctgagaatatttttcttgaacaattgtaccgttactttttttaaaattgctttataatttcacaagagattcagtttttcaagtttctacaaaagcatttgtaacagccctcagttatctttgtttaataatcatgatgtttaatcaattgcgcctgattctacacaattatgaccacagtatgaagactggtttgttcacccagcttgactttaggcatttctaagagatgctcccttaggaaaataattggtttgctgctgagatgacaattaagaaaaagactaattatcttgattttgagaaattacaagttacctatgttgggcacacgcttagtagaaatttccatgtaaagtatgcatttcttctagggctttggttgatgggaa

SEQ ID NO: 198649 - DNA, 400 bp, Homo sapiens
ggccttaagggttcctcatgcctcggcttcccaaagtgctgggattacaggtgtgagtcaccatgcttggcaaatagctcctttttataaagaaacattagtaccctggtagcatggaaatgctaataatctttatagttatgaggagagcttagaaaccttgtgaatctcacttctcacaatactatcattattaaatggtatttatttatctctcatgtagccaacataagataaaatgttaatacatgtaaacaaaacctgctttgagtaataagtaattagattctgattcatccaataaatctgtgctcatccatgtcatgacgcatggtatccgataattttatttttgcatataatcataatcacagaaataacatgagaagtcaatagcaga

SEQ ID NO: 198650 - DNA, 428 bp, Homo sapiens
cggatcgacacccatctgatgctacggaggtctgtggttcagtataaactttaggattatttattctatttctgtaaagagtattattggtatttcatagagattgcattgaatctgtagaccgctttgggaagtctggacattttaacaatattgattctcccaatccatgaacatggaatatctttccattttgttgtattttcagtttcttgcatcagtgttttatagtttttattgtagagatctttcacttctttggttaagtttattcctaggtatctttttatatttgtagctattataaatgggattactttcttgatttctttttcagattatgtgctgttggcatatagaaatgttgattttgtatcctgtaactttactgaatttgcttatctgttctaatagttttttagtggcat

SEQ ID NO: 198651 - DNA, 833 bp, Homo sapiens
ggacaggacaagagccagtccagagagagagcagggctgatgccaagaaagagccaggctagtgccgaggctgaggcagtgtcagagcatgtccagggcagggccggggccagggacagaaccgagccagggcacagccaagacagggtagggcagggaaatagcatggctgggtcagtactgggacagggcagagcagggcaaggcgatggtagcggcagggcagggacaggccaatgcagagccatgtcatgccggggccaggacacctccaagtccacttcaggcccagggctatggcaggacaaagaccagggccaggatcagggccaggtctgtgctagggccagctccagatgagggtctagcgaagactagggtgagggccaaggtaaggccagggcagggtcaaaggcagagtagggccaggtcagggtgatgacacatccagagcacaacagggcagggtgatggcaagaccaggggcagaccactgccagctcagggccaaggaaaggccagtgcagagccaggaaagggtctgggtctgaacaaggcagagcagggccagggccatggcagagtcagggcaggtccttgacaggaccaggttccaggccagggctagggcagcagcaggggcagggcctggataagggcagggcagtacagggccagatccatggcaggcgcagggcaaagccaggcccattgccaatgcaccagccctccctacaaggctcctaccacctggccactgctgcagcccgtccatcgctgtaagcctgaaccccaaccctggctgcagccacctgccctcctagtgcggccgc

SEQ ID NO: 198652 - DNA, 398 bp, Homo sapiens
atgagacttagctctgttaaatccaactaacatacttgagactcagaattctggtgagggcttcctgccacaaatctgggaaaggataatatgggacattccacgatctaagaaaagggtcctcagcatacagatctggtagcaatgaaaaaaggaaactcgtctctttctgcaacattatttgaactgaaccccgagggcctaaaggataatttatcatgaaggtcttagctaagtctaggctgagacaaaagcgtaacaggcggggtttcaccatgttggtcaggctggtctcgaacttctggcctcgtgatctgccctcctcggcctcccaaagtgctgggattacaggcatgagccaccgagcccggccaacatgaagttcttaaggatggaag

SEQ ID NO: 198653 - DNA, 466 bp, Homo sapiens
ggagatatgccaggtttgatatagaaattggttttatttctaatatattaagtgcttgctgcaaatgtcataatccagaaagattgttctgtggtccctggatctaggagagaagacgccactgacttgctctccttggttgtccaggaaggccaccctaagaaaacaacaaaaccttgatttctttagccacgtgtgtgtgtctgtgtctgtgtgtaagtgtgtgtgcatttgggtcctcacctgatgaagaaaagtgagaaatctgtttatttgtgggtacaaggtgtttcacagtttatgaaatgcatctgtgcttttccatgatcatatttaatgttcaaaacggtatgagaatactttgtctagtttacaattatgtaaactaagcttcagaacagttaagtgatttgcctaagttctcctagttagtaaagattggaaccaagactggggtaaacttgaa

SEQ ID NO: 198654 - DNA, 731 bp, Homo sapiens
ttttttgagatggagtctcactttgttgcccagactggagtggagtggtgcgatctcggctctctgcaacctccgcctcccaggttcaagtgattctcttgcttcagcctcctgagtaactggggctacaggcaccatgaccagctgatttttatatttttagtagagatggggtttcatcatgttggccaggctggtctcgaactcctgacctcaaatgatctgcctgcctcagtctcccaaagtgctgggattacaggtgtgagccactgcacccagccactttttctttgttctaagtacaattatctgtcacatgatagtgatgtgttttgagaaatgcgtcattaggcagttttgtcactgtgtgaacatcatagagcgtacttacacaagcctagatcgtagagcctactacacacctaggctataggtatagcctgttgctcctaggctacaaacttgtacagcaagtttctgtgctgaatactgttggcaattgtaacacagtactatttgtgtatctaaacatagaaaagctacagtaaaaatacggtataaaagtttaaaaatagtatacctgtatagggcactttacatgaatggagcctgtaggacttgaagttgctctgggtgagtcagtgagtgagtggtgagtgaatgtgaacacccaggacactactgcacattattgtagactttataaacattgtatactttggcttcattaa

SEQ ID NO: 198655 - DNA, 439 bp, Homo sapiens
gtaatattaccaggtgatgatacaagtaaacattagctgacaagtgtgctgacatcttccctaggtagatggctcttgctcattctttttaacctcttcaaatctaaatcagactccaaggcttagttcaaaactgatctccaaaaggccactttttggaggtaggggtatgtgtgtatatgtgtgtgtacaaacatgcacagttcttgtgcaaccaaagttggtaactgcatggaaggagtacagatcttagggtctaaggcatctgggttcaaatcttaaccctgccacttagtggctctttagtaaagcagtatcctcatttaacttctctcaaatgttactaagaagacaacctcctacacttggagaattatagcaaagatgaaagaaaacgatggtgtcagaccctaagatctgtactccatccgaagcagtg

SEQ ID NO: 198656 - DNA, 502 bp, Homo sapiens
gtaatattaccaggtgatgatacaagtaaacattagctgacaagtgtgctgacatcttccctaggtagatggctcttgctcattctttttaacctcttcaaatctaaatcagactccaaggcttagttcaaaactgatctccaaaaggccactttttggaggtaggggtatgtgtgtatatgtgtgtgtacaaacatgcacagttcttgtgcaaccaaagttggtaactgcatggaaggagtacagatcttagggtctaaggcatctgggttcaaatcttaaccctgccacttagtggctctttagtaaagcagtatcctcatttaacttctctcaaatgttactaagaagacaacctcctacacttggagaattatagcaaagatgaaagaaaacgatggtgtcagaccccttatcacaaaggcattcaataaattaccattagccccacaaagcattccctgtcgacgcggccgcgaatttagtagtagtaggcggccgc

SEQ ID NO: 198657 - DNA, 967 bp, Homo sapiens
gcaccgttgcccggggatgggtccctgagacttggcgaagtaggagccctgtgtgatcgtgcgtcagagtcggggctgagaccatgccctggccaggacagttaccaggacggtctccggaggccgggattcgcggagggtccaccagcaggaagaaaccccaggaggaagaaacctcagacagatcgccggggaggcagcgcgggatcccagcctcaggcgtgcgcggacggtgtgcggtgaaaatacaatgagaaggcagctgtctgcaagccaggaagaactcttaccaagaattgaatctgctggcacctttaacttggacttgccagcctgcagaactgtgaaaaacaaatgtcttttgtgatcaagtgccaagatgacttactagaagcagctagtatgctccactctcgtgaaaaggaaatagactggccagtaaacactagcacttcaactggatcttccaagaggacatgttgggattcagcaaggaagcaacagaagccatggagaacaaaaacagcaagacacaacagccacccacccaggattgggtggagtcaggggaggatccttaccacaaagaaatagtgactgagagagagccccatggccccatacttctgtcacggacctttgtaatcataggcacaggtgatccaccctgagtccctccccctggggccttcagactaacaaggagagctgcatagaatctgggcagagctccagatcaggcacatgagaagtcccaggggtcttagacccctaagcaccccagtgctagttgccatagcttcaccaacaagaacgccaagttctctgcatgccaaaagttagtggctacattcatggttctgaggagcagagggacttcatgccttgcctctggttaacctctccaggcaaggcacactgacctggaactccagaacagccatgaaacacccatttgacctcttca

SEQ ID NO: 198658 - DNA, 749 bp, Homo sapiens
caggccggactgcggactgcagtggcgcaatctcagctcactgcaagctccgcttcccgggttcacgccattctcctgcctcagcctcccgagtagtgggattacaggcgtgagccaccgcgcccggccctgttatgattgttaatactaccttacatctaaacttgttaattaattataaaataacacacagcaattcaacatattctttctcattaacattcattatgaaaatatattccatatcttagcctacatatcaagtgtcttgttcatttcaaaaatgggaaaaataatgggaaccatggcagaatatccaggttatggcaaaccactagatttgaacaaagcacaaaaccactgatgtggacaaagtagggcctacactcctaatagtttgctatgcacactgctggatggagaacagtcagttaccaaggctgacctcttgccaaagcctaaacataaatgggtctgacgctcggttatacaagtgcactaggtaggagccaacgttaagtagaaatctggtttgggatttgtcttcaatttgaaggcagatttttttcttaaacataaaggactaattgactaaatatataatacataaacacaattatctaaaattaactgtttagttcagttattgtattgtttctatctttgcttctatcttctctatttgtgttgtttctatctgtattgtttctaatctttcttcagcacctccaaaagggatgtaatctctc

SEQ ID NO: 198659 - DNA, 252 bp, Homo sapiens
  misc_feature (66)..(66): n is a, c, g, or t
  misc_feature (82)..(82): n is a, c, g, or t
atgtcgcttccattcttctaactttcattgtttaatttttcatgcgtttccagctggtacattatntttctctctccctttncacagtctttacaatttcaaaagcattaagctttgtatctttcacgacccagcaaatctctgtgagtatgaaatctgaactttctctcaaacttgcttctctattacaaaattttaatctatatcatttcccggagcgttggtttaaaaagcaaaacaaaacaaaacaaa

SEQ ID NO: 198660 - DNA, 609 bp, Homo sapiens
gttatcctgcataaatccccagtggtgtggcagctccaaattaaggtcagtgttcccttcacttaccggacacctcaaaattagtaccttgtagaattaaagaatccaccttggaggctgccttccagaagggataatctgactcttgtccaagttgaacaggtttactgggaacaaaacaactgcctctgggtttatgctcgtctgctcttttaagcagtgaaatgcttgtgtccaggagccaagtggcagtaacctttgtgacttcaattcttccaagaataggtgtttcttagtagccctgattgaattagaactcaagtcccagctggttgccttccactggccagaaactggctcctggaactggctcgatggcctggcccgactatctcaagaaagctgcccctcctgcccagcaactgggtctcatccaagggcaccttgtcccattgctgtgttcctttttgtgagaaccccatcctgaaactgcataattgcaagcttagaaaaaaaatagaattgccataagatggggcaaaattagaatagcttttgggtttgaaagttaaaactcattttaagtatgcacagacaattgtctgagct

SEQ ID NO: 198661 - DNA, 466 bp, Homo sapiens
ttcagaatgtgaccgcatttggagatagggcctttaaagagacaattaagttaaaatgaggcttttagggtgggccctaatacaatctgattggccctaatacagtctgattgttgtcccataaaggaaattgggagacagagacaggagggctgtgagaacagaggaaagaccctgtgaggttgtagtgagaaggcagctgtcttattctggttgggctgctataacaaaaattccataaacttgagtggcttaatcctggccattttaataggcatatctaataatgttggtatctcatcacggcttcaatttgcaattccccaatggctagtgctgttgaacatcttttcatttgcttattttccaacccctatattctcactagttgagtaattgtttcttattttagttcagatgtagaacattgccagcctagagtcaaggtaaggaagttgaaattggg

SEQ ID NO: 198662 - DNA, 320 bp, Homo sapiens
tgagaaagtatacatgaaaggaaattcagttttgaacaataccacattgaggcttacatgtacagaaacttaaccttggaattgttgaaacagaagtcctgaaagcccagagttcatctatcccactcttcactgtcagtctgccctctgaggccttctcaccaagggtctcatccagcttctctgcttgattacctctagtgatgaggagctcactctcttacagggcacttccttccatatttgtgcaggtttaactgtttaaaagctccttcgtctgttgaagagaaatgtgtttctttcatcttctacccattgaa

SEQ ID NO: 198663 - DNA, 93 bp, Homo sapiens
gccagcatcaggacctgacagggcacctgggcacctggctcctgagatcagtacccactggcctcccttggttttctggtattgggttttttg

SEQ ID NO: 198664 - DNA, 665 bp, Homo sapiens
ttgggattttcatcagagagtccttttcagctttggaaggagctaataactgatttgtatactggttacaaaaatagagttaactttctaaaatacccctgaagatttcttacagacatttcaccgtcacatatggcagcattcactctgtgctggtggaggaaagaaataccaaatagggattgtggttttctttgttatgagtttgaaggtgctaggcaggaggatgcttgaccctaatacatctttcatgaatgcaagtggtctctggagtctcttatttaaaaaaacaaatctaaggccaggcacagtggcccacgcctgtaatcccagcattttgggaggccgaggggtggatcgtttgagctcaggagttggagaccagcctgggtagtatggtgaaaccccatgtctacaaaaaataaaaaaattggcctggcacggcagctcctgcctgtaatcccagactttaggaggctggtctcaaactcctgacctcaagtgatctgcctgcctcggcctcccaaagtgctgggattacaggtgtgagccaccatgcccagccaagtctgcatgtttaatactgtagctgctccattatatttcatcaaattgcctttttggttgaagctagttccagttgggtttttcacttggtactagaa

SEQ ID NO: 198665 - DNA, 674 bp, Homo sapiens
aaagtgctgggattacaggcgtgagccaccgcacccagccatgcctggaatatttttgtaatggaaaaatgaaatgggagaagtcactgttcctggctttgaggcttactctgaagccacaaatcaacattgcggcgatggcagacagacgcgtctgtggagagaagagaggactcaggccacacaagagagaccagcggagctttgacagaggcagaaaacccgttcatcagatggtctggagcacctgggcagcggtaggcaaagccctaagccctcgttctacagaacagctcatcagaatgcagggcctttaggtgaaaacctttgtggcctggggctgggcagagttcgtagactcgccacccaaaccacacccataagaggacaggtggacccaacttcagagctctgagcatctgagctgcggactgggagaagatatttccaaaccacctatttgacaaaggactcatctacagaatataaaaatacagtcaaaaacaaactgaaagcaatccagttagaaaatgggcgagagcgcagggtcctctgcctacgaaaaccagagacctttgttcacttgtttatctgctgaccttccctccactattgtcctgtgaccctgccaaatccccctctgcgagaaacacccaagaatgatcaattaaaaa

SEQ ID NO: 198666 - DNA, 133 bp, Homo sapiens
tggctctatccttcactgttgataaatactaatgtatttattagcttcctagatactgtgtaggtcacaaaataattatgctatattttaatgttttgtattcattttttagtgtatggagatttagataagg

SEQ ID NO: 198667 - DNA, 526 bp, Homo sapiens
caaacatggagtttgtcaataaaaaagttcaaaggagaaaattacctggaggagacttaatgtcaagcagggataccattggaagccccaaggaatgtgctactgagtctctgatcctggtgctgtttttatcagccgatatgaacaaaaggaaaataagtgcagatgggcaggcaacttcctccaagcactgcctggtggaatacatggagccacttggctgatcttcacggaggagatcgcggatgtcttagttccctgactaagccagagtgcttctgaagatccaatgagcatctggattcattcagtctgcatactgctggaacaaccatgcatttgaaagccatacagacccagattcgaattctggtctgctactcagttgtgtgatatgggcatgcattgccattcctacaaactctggcctgtctcctcatctgtaataatctggtacaataagctgggaggaggtattggagtaagtaatccatattctttcctcttgtataggaaaaaaaacaca

SEQ ID NO: 198668 - DNA, 436 bp, Homo sapiens
agcttggctgggggccaggggttcttccccagccatgcgtttggagccccaggcaggcaagatcctgccatattccacacatagatataggtatctctagtcagcagaagggaaaaggaaatgagtagatcaggtatgtggggcagagggcgcagttatgaagaccctggaagcaatgtacatcacttctccccacattccttggccagagctcatttgtgtggctccccgttggacgcacagggcagggagtgggggtgctggaaatgtatgcctaggctgggaacccactttctagaagcagcattctgttccatcataggggagcaggaatcgtgcagggacagctggccatccctggcacacaacggaagacggtggaggacgctgctcttggtggcgaggaagtgaaatttgtctaagctctgaggtcaac

SEQ ID NO: 198669 - DNA, 869 bp, Homo sapiens
gacacagcccctcccctcctgaccagcagcccatctacttcagagagttccgcttcacgtctgaggtccccatctggctggattaccatggcaagcacgtcacgatggaccaggtgggcacttttgctggcctcctcatcggcctggcccaactcaactgctccgagctgaagctaaagcggctctgttgcaggcacgggctcctgggtgtggacaaggtgctgggctatgccctcaacgagtggctgcaggacatccgcaagaaccagctgcccggcctgctgggaggcgtgggccccatgcactcggttgtccagctcttccaagggttccgggacctgctgtggctgcccattgagcagtacaggaaggatggccgcctcatgcgggggctgcagcgaggggctgcctcctttggctcatccacagcctctgccgccctggaactcagcaaccggttggtacaggctatccaggccacagctgagaccgtgtatgacatcctgtccccggcagcccccgtctcccgctccctgcaggataagcgctctgcgcggaggctgcgcaggggccagcagcctgccgacctgcgggagggtgtggccaaggcctacgacacagtgcgagagggcatcttggatacagctcagaccatctgtgacgtggcatcgcggggccatgagcagaaggggctgacgggcgccgtggggggcgtgatccgccagctgcccccgactgtggtgaagccgctcatcctggccacggaggccacgtccagcctgctcgggggcatgcgcaaccagattgtccccgacgcccacaaggaccacgccctcaagtggcgctcggacagtgcccaagactgagcc

SEQ ID NO: 198670 - DNA, 858 bp, Homo sapiens
ggtaacatagtgagaccctgtctctacaaaaaattaaaaattagccaggcatggtggcatgtgcctatagtcccagctacctgggaggcagaggcaggaggatcatcgcttgagcccgggaggtagaaactgcagtgaaccatgatcacgccactgcactctagcctaggtgacagagcaagaccttgtctcaataaataaataaataagtaaaataaaataaataaataaataaataaaataaactaggcctgtcccaaggaaaccaggatttatgatcaggtgactcctggcttcattttaaatttcttggacctgcctgtcttctcctcccacaaaacaccctcaacttacaaatcagttctcactctcagtatctactgcatttagtgaaagggatgcaagagagagtgttgcatggtgagaatactcttccttaggatcattcctggaagagactcagcacactgggctggaattacaggccaggatacagattagttctgacagattaaatggaggctgggataaaacgatgggatgaaagagtaattcctccttctgtcttcttttttccatacttcagtgactttctaggaggaaactatggagcttaaactgaagaatgaaaaatcttttgactacacttttagttaatcctttcaaaaataatgttgagccctgtgtcctttctctaataaaattaatgtttgcaggagtgttttttgtatcatcatgaattgtggaaaaaatttgtaaaccacattattatataaatagaagtcctggccaggcatggtggctcattcctataatcccaacactttgagaggtcgaggcaggcagatcacttgaagc
